United States Patent 7,745,391 (HUMAN THROMBOSPONDIN POLYPEPTIDE) - sequence listing, part 245

SEQ ID NO: 682915 - DNA, 471 bp, Homo sapiens
  misc_feature (10)..(11): n is a, c, g, or t
  misc_feature (52)..(52): n is a, c, g, or t
  misc_feature (54)..(54): n is a, c, g, or t
  misc_feature (57)..(58): n is a, c, g, or t
  misc_feature (108)..(108): n is a, c, g, or t
caggccggcnnaaacaaccaacgcacacttgattattccccgcgcaaaggancnccnncaaccccccgcactttttttaaaaaggaaacacacgcccacccccctggngcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaacaaaaaaaaaaaaaacacaaaaaaaaaaaaacctaacattaactccaagaaaacacagtatttcttcctttacccccgcctcgcccaaacacatttaacattcagaatcaaataaa

SEQ ID NO: 682916 - DNA, 387 bp, Homo sapiens
aattcgcggccgcgtcgacacggtgcgagaagacgacagaagggaatgcccaggatgctataaaatcaccacggtctttagcatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaaaaaaaaaaaaaaaaaaaaagcggccgcgtgaattcgcggcccgttcgactacggctgcgagaagacgacagaaggggccacctggatccctgcccctccccactgggacggaataaatgctctgcagat

SEQ ID NO: 682917 - DNA, 463 bp, Homo sapiens
caacgcatgtgccgctcccaacgcatgtgccgctcccaacgcatgtgccgctcccaacgcatgtgccgctcccaacgcatgtgccgctcccaacgcatgtgccggggcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaa

SEQ ID NO: 682918 - DNA, 291 bp, Homo sapiens
cagagatgatgccactgcactccagcctgggcgacagagcaagactccatctcaaaaaaaaaaaaaaaaagctgctgaattcaggcagggcttttcaattcccgggcccgggtgatttcgtaactcgtgggcacccgggctaggtgcccttcctaggccgggccataaccctcttcctcaattaagcactgggccgatgtctctaacattctctttaccaagttttttacggggcggggtgtagagcctttcacccagggaagagtacaaccgggggggggggggatcgtc

SEQ ID NO: 682919 - DNA, 556 bp, Homo sapiens
  misc_feature (313)..(313): n is a, c, g, or t
ttccaggaggtgatctcgctctgttggcccgcctggcatgcagaggcaccatctcagctcactgcaagctccgcctcctgggttcacgccattctcctgcctcagcctcctgagtagctgggactacaggcgcccgccaccatgcccggctaatttttgtatttttagtagagatggggtttcagaatgtttgccaggatggtcttggtctcttgaccttgtgatccgcgtgcctcccaaagtgctgggattacaggcatgagccactgcacctggcctatctcccctttctagtaccttaaatgcttttttnacttttctcaaccaagggagtcactttgggtctacctgcctttggaaggcgtaaaaaatgagaatttcatacctttgggattaaagtgggggggcttaaatttaaagagggatctttttttaaaatacctttttccctagttagaataaaaattattaactgtgggcatttttaaagaaaaataaaaataatttccctataacttttttggcacaaaaaagaaaaatggcctccttggcctca

SEQ ID NO: 682920 - DNA, 323 bp, Homo sapiens
gacttcgctgttgcacacacgtgaagttatatcgcagctcctgcggcagtacgccatcacaggagcgtcgccttgtcgtcacattcgatcttagctcatggtcccacgagaagccactgccacgtcgtccgatacctccacacaaagtctgctgattccaacgacgccgcctccagccagggcccagcgtaccttctgattgccacactcggtgcccaccttcacttcgaagggactgcgcccgatgttctgaccaccccacgtgatggtgacgatattaggttccaagggaccatgggggtaatactcgaaagccatacacg

SEQ ID NO: 682921 - DNA, 635 bp, Homo sapiens
  misc_feature (65)..(65): n is a, c, g, or t
  misc_feature (635)..(635): n is a, c, g, or t
tattactaggcaccatggagctgggtggatcaaatttttttattttttctactaaatttactgantccaagaccttggattgaaaggaaattgggaaaggttcctttttgattttttccccagggcccggaaaaaaaaggttaaggggcccgggctcccattttttttgcccggggtgggtaaaagaccctttttcgggaggggggaaaatgggggaaagggcttttttttggtttttgaaaaccccctgggggaaaaaacccttttggggggtttaaaaaacccccctccccgtttttttggggaaaatttttctaggaaaaaaaaaatttggggagggaggggggtttttttttgtggggggaacacccggggggggggggggagtcttattttttttttttattaaaaaaaaaaaagcccccccccggggggcccccttttttttttttttaaaaacacaccccccccggggggggggggagggttaaaaaaaaaaaaagggggggggggcttctccccaccaatttttttttttaagaagaggggggaagggttttttttttttgtgaaaaaacaaaatattttttgggggggggggggggagaaaaaaaaaaatatatttttttttgtgn

SEQ ID NO: 682922 - DNA, 155 bp, Homo sapiens
  misc_feature (52)..(52): n is a, c, g, or t
tccttggatgaggaacgtactgggataggaatgtactgggatgaggaacgtnacttctgccacctagcctcaccctagctcagcttggaggtggagcaacagtctcagtcttcggaactaaattcccttcttagcaagccccaacttccctacag

SEQ ID NO: 682923 - DNA, 440 bp, Homo sapiens
ctgagatagtagactccccattccccttcctcccaggcccatggtaattccgttctagaatcttatgaatttgtctctatgtaagtacctcatgttatgggaatcaagcaatatttatctctctgtgtctggcttatatcactatagcataatgtaaacaatgttcatccatattgtagcatgtatcaaaattacattgtataaaaggcagtattctatatagtattccattgtatggatataccacaatttatcatttcacctgatgatggacattagggttgtttccaccttttgactgttgcgaatagtgctgctgtgaaccatgggtatgcaaatatctgttcaagtctctgctttcagttctttttaatatatccctggtggtggaattgttgggtcagtatcgataggtagtatagataggtcagtatagatag

SEQ ID NO: 682924 - DNA, 606 bp, Homo sapiens
  misc_feature (3)..(3): n is a, c, g, or t
  misc_feature (397)..(397): n is a, c, g, or t
gcnatttacagtctcttgggcatatctgaatggccagcataactatgctcgtgcttgggggccattataaagtcaaataagggtggctggaacacaagcacggcaataccagggcaatagatcgcatcaccaagagggctgctaagtgaaccacaggcaggagtgtagacagcagggacacattagacgaagggaagattcacgtggccaggggaacacagcaggacagcaagagagttcatgatgctactcagaagggcatgaaatttaaagcttataaatggtttcgggaattttccgcttaatattttcagaccacggtggagttcaggtaactgaaaccataggaagcaaaacacggatgacgagggaccacttcgtatggcctaatttagtnggtttggatcttctgggacctttttttctggttgtaaaaatttatggggcggttaatagtggtggctcatggatttttcattgctacataatacttccattgtgtaaatataacagaatattcatctacctgtcagtggccagtggggtctttttgccattataaatgctgctggtgtgaccatgtggggggcaagttcctggggcaca

SEQ ID NO: 682925 - DNA, 768 bp, Homo sapiens
  misc_feature (550)..(550): n is a, c, g, or t
  misc_feature (737)..(737): n is a, c, g, or t
gcgggaccgggagtgtatgggaaaggctctgtaccttatgcgcgactttctcctgtggagtcataatagtctactaagtaatgtgtagggatcttgttaaagacacgtagagtttggatgaatcatggatcgggggaatacatgatttgctaatctttgacgagagggaatacagcaaagagtgagatgatagtgtgtctatatgatgttcgtctgtcgaatatgtctgaatgttacttcatgattagtgtgttggagagtttagtcgagcacaactattagtgagttgttgctattggcattataaacaacgttatgagtggagtcataccccttgagcgtatcagtctgatagtggttgtcttggcattttgctatgcttcctggatgaatcactatacaactagtatgatctaatgctaagtatgatgtacactgtatttagttcgacgctgtgagtattcgtgtgtatagacgttcgtctgtagttagtagagggaatgactgagatgtttccatgaaggaatgttcggatcgtattcagagcctnggtgcgtatacatggtgttcagctcttgtggattgccttagtgatagactgtgcttgcactttggccgtttattgccgtcttgactgaacgtcatacttactatgaggcttgccgtcacgaattatctagtcgtcagaagctaggaagtttgacgtgattagtgcagatgggattgtgcggcctatntcccgtaccccgtattgtcctgggacgtatc

SEQ ID NO: 682926 - DNA, 262 bp, Homo sapiens
atagtggaactgctcggaatattccgatctgttccatgaagacctgggtgtgtatggtgagggagaattctccatgcaggcacgactgagaggttctcagaaagctcattgcttcatcctgaaggtcatgaagaaccaccaaggcacctcatcttgaagagccaggttctgccccggctagccacgtggacaggggcagcagaaggagcaaggtggtggcctccgacaaggcatagtgaagcggagcagctatccaattagg

SEQ ID NO: 682927 - DNA, 103 bp, Homo sapiens
  misc_feature (3)..(3): n is a, c, g, or t
  misc_feature (24)..(25): n is a, c, g, or t
aangcaatggagggaaagaggatnnttttaataaagagaaagtgttctcgcacctttgaaacggtgctcctcctaagaagaatgaagccatttcctgggttct

SEQ ID NO: 682928 - DNA, 983 bp, Homo sapiens
  misc_feature (1)..(1): n is a, c, g, or t
ncctcaggggttgttccaaattctggcgcatactcttttgtggataagacccaagtgtttctccgtgagctcaatgtctgtttcgcatttatcctttggagcacgagttgttttctaaaccaagaagtcgctcctcgcggctgactccacgtgtccactatcgtagtggttggtcaccaacgacttctttggcggggtccttcgtctgcctcttccgcgcggggcagcgcaccaaaagaactactacggggtcgcaccaccaagcggcgggtttgtacaacaatagtactaataggagggggcaatcctcttttgtctcggccccgtcccaaggtattgtcttttctcgcgaccctgtcgactgtgggtgtgttgactttcttttcggcgaaatgattttccctgtgaaggagatagagatatgtatagatagatagattagctttacacatcggtttctttgtaacggggggggtcaccaaagcaagaggatatttgctgaggttttatataagggggtattatcttagagtgtgagtgactcgattttcggacgccacttcatctctatcactcgatcctggtgtggtcacgcgccacggctatttctctaccagagcgtcatgtatggtaagcagctcaggaatggggtgggctgatcagggatgcactctgcggcatcctctctcgcaacagcattgcacaagagagtttatctatccatgagacaaacatgcttgtgtgtagacacttccccgccgttcgaggtagcagccagaattggaggctggtacatagggtagggtctgagaagggtgggggctgggacccctggcccgggaggagttccatcctgggttttccatttaggactcgtttacaatgaagattagatactccctgttcatgaatacccgttgatggttcaagtattatagacctacgccatattttttacgttttataataaacatggtttggta

SEQ ID NO: 682929 - DNA, 860 bp, Homo sapiens
  misc_feature (17)..(17): n is a, c, g, or t
  misc_feature (116)..(116): n is a, c, g, or t
  misc_feature (118)..(119): n is a, c, g, or t
  misc_feature (126)..(126): n is a, c, g, or t
  misc_feature (135)..(135): n is a, c, g, or t
  misc_feature (150)..(150): n is a, c, g, or t
  misc_feature (183)..(183): n is a, c, g, or t
  misc_feature (185)..(185): n is a, c, g, or t
  misc_feature (194)..(195): n is a, c, g, or t
  misc_feature (197)..(197): n is a, c, g, or t
  misc_feature (200)..(200): n is a, c, g, or t
  misc_feature (210)..(210): n is a, c, g, or t
  misc_feature (238)..(238): n is a, c, g, or t
  misc_feature (243)..(243): n is a, c, g, or t
  misc_feature (303)..(303): n is a, c, g, or t
  misc_feature (329)..(329): n is a, c, g, or t
  misc_feature (333)..(333): n is a, c, g, or t
  misc_feature (335)..(335): n is a, c, g, or t
  misc_feature (348)..(348): n is a, c, g, or t
  misc_feature (350)..(350): n is a, c, g, or t
  misc_feature (356)..(356): n is a, c, g, or t
  misc_feature (501)..(501): n is a, c, g, or t
  misc_feature (586)..(586): n is a, c, g, or t
  misc_feature (843)..(843): n is a, c, g, or t
aaacccacaggctttancactgcctaatttacttcacacaatgaataaaaaccataaaccaaagcttgctgcctaaccactccccaggtccagacgggacaaggaaatgacatgananncgagganacccatggngcacactcatgagangcaggagcaccagaattcacggaaaataaaaangnaaaaaaaanngnggntcggaaagtnagtcccagatgtagtgggacagataggngtganttcatcacaccctatagccctggtctttcccctcctctgctccaggtatcgaaccaaganttccttttccaagatgccctgctggntcangngtgcatgatctcntnggtctngcctctggcacagtctacatgcttccacaacaacgacagcagtttgataacagatgttaccccacgatgtgggggcgggctcacactgtgcgcctcccccacactcttcccactgggtgtggtgctcaggacacctgcatttgtnggacgtacgcatgaggcaggagtagaagctgcctgctgcaggcaggcgactgctcacttcctcctgatcgtcccccaccccaagnagtccagtcaacaccagaagagatcatacctacagttaaaatttgcagtgtttctaaggggaagagaaatgtcacatagaaagtatttacaaagaagggattaaatttatcagctgtccaaacactataagaccacatgctttatacagcggcaatgcagtcaagcccgcttttccatggagcgggcagaattgggacaggctcctccagtcagtcgggcacagggcgcaggaggcagctgaggaaggcaaggagcnctaggaagtctgctgct

SEQ ID NO: 682930 - DNA, 433 bp, Homo sapiens
actggaaatacatggggatgagcagcggcggcccaatcaggaagaagtattcgtgctggtgattgtagggcaggtatttcagcttcttcttgccgtctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaa

SEQ ID NO: 682931 - DNA, 731 bp, Homo sapiens
caacgcatgtgccgctcccaacgcatgtgccgctcccaacgcatgtgccgctcccaacgcatgtgccgctcccaacgcatgtgccgctcccaacgcatgtgccggggcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaaaaaaaaaaaaaaaaaaaaaaattttggggccccctgggcccccgaaaaagttttttaaaccctctcgttggggccgcgcggggccccaagaaggggtacggcagaccatgtggccaaagcggggttcccaaggagaaaaccggggccaacagaacaaagcgggtgggagttcctccaccaacataaaaaaacgcgccggggggaaaacacgcgaagggttgcggcacaaaactccagagaggggaattcggagagggcacacaaggga

SEQ ID NO: 682932 - DNA, 195 bp, Homo sapiens
ctatcacattatcctgaacaaataatgagttcttttatttgaggtatgccattttgaagactgagacgttggagtttaatcctagaggataaaggaaatctttgggaaagtcagtatgttatatagccacaatatgaacctcaaactgaatcctctaaagggcccctacaatgaagtagacattggtggaaacat

SEQ ID NO: 682933 - DNA, 851 bp, Homo sapiens
  misc_feature (552)..(552): n is a, c, g, or t
  misc_feature (559)..(559): n is a, c, g, or t
  misc_feature (577)..(577): n is a, c, g, or t
  misc_feature (626)..(627): n is a, c, g, or t
  misc_feature (668)..(668): n is a, c, g, or t
  misc_feature (711)..(711): n is a, c, g, or t
  misc_feature (785)..(785): n is a, c, g, or t
  misc_feature (787)..(787): n is a, c, g, or t
caacgcatgtgccgctcccaacgcatgtgccgctcccaacgcatgtgccgctcccaacgcatgtgccgctcccaacgcatgtgccgctcccaacgcatgtgccggggcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanaaaaaanaaaaaaaaaaaaaaaacnttgtgggcccgcttggcccaagcgcttttaaacttgggcaaggtttagnntggggcccgaattcggggctcacttggcaaattcccccaantgggggggtattaaaattaacgggccggggtttaaaaacgttnggactgggaaaacctggggttacccaacttaaatccctttggagaaaaaacccctttttgcaaagtgggaatancnaaaaaggcccccaccgaaacgcttttcacgttggcaaacccaaatggcaattggtttgagcctt

SEQ ID NO: 682934 - DNA, 858 bp, Homo sapiens
  misc_feature (644)..(644): n is a, c, g, or t
  misc_feature (651)..(651): n is a, c, g, or t
  misc_feature (675)..(675): n is a, c, g, or t
  misc_feature (687)..(688): n is a, c, g, or t
  misc_feature (705)..(705): n is a, c, g, or t
  misc_feature (807)..(807): n is a, c, g, or t
caacgcatgtgccgctcccaacgcatgtgccgctcccaacgcatgtgccgctcccaacgcatgtgccgctcccaacgcatgtgccgctcccaacgcatgtgccggggcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaaaaaaaaaaaaaaaaaaaaaaacaaaaaaaaaaaaaacacaaaaaaaaaaaaacaaaaaaaacaaaaaaaaaaaaaaaaaaacaaaaaacaaaaaaaaaaaaaacagaaaaaagaaaaaaaaaaaaaaaaaaaaaaaaaaaaaaaaaaaaaaaaaaaaaaaaaaaaaaaaaaaaaaaaaaanaaaaaanaaaaaaaaaaaaaaataaaaaaangaaaaaaaatannataacaaaaaaaaatanaattttttaaaataaatttatttaagtttaattaaaaaatttttaagttagtggttaaaaaattatgggaaatggaaaaatattgatatcaaaatgggaaantgaaggggaaattttttgtataagtgggcttatttttggaggccgctctct

SEQ ID NO: 682935 - DNA, 688 bp, Homo sapiens
  misc_feature (688)..(688): n is a, c, g, or t
caacgcatgtgccgctcccaacgcatgtgccgctcccaacgcatgtgccgctcccaacgcatgtgccgctcccaacgcatgtgccgctcccaacgcatgtgccggggcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaaaaaaaaaaaaaaaaaaaaaaaaaaaaaaaaaaaaaaaaaaaaaaaaaaaaaaaaaaaaaaaaaaaaaaaaaaaaaacatgcggccgaaattcgggctaacttgcccaattcgccctatagtgggccgtatcaccaataaatggcccgcggtttaacaacgtggtaactggccctgggggttccccaaattaaacgccttgggtatcccttttcggccggtgggcn

SEQ ID NO: 682936 - DNA, 309 bp, Homo sapiens
cattcagctcggtacccactttccagagtggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaa

SEQ ID NO: 682937 - DNA, 382 bp, Homo sapiens
gtatgtggaggaggaggagggagtgagtgcaggggaggaagaggaggaggaagaggaggatgaagaggcctgaggaggagtgcctggctctggaatgggccctgtggcgcggatgaggacttcctgctggagcacatccgcatcctcaaggtgctgtggtgcttcctgatccactgtgcagtgcagtatccgccatgttcgccgtctgccttgttgttcaccgacttcggcatcgcagtcttcgagatcccgcaccaggagtctcgggggcagcaagccagcacatcctctcctccctgcgcattgtcttttggcttcccgcattggcagacctcaccgagtttggcttcctcattgcgggagcttgtgtcttggttgctca

SEQ ID NO: 682938 - DNA, 210 bp, Homo sapiens
aaatatcgctgcgtgcagctgagttactagctgttgaaacttatcgttacttgtgtaggttgtctgaaacggtcgcagtcaccggttagcttgataagtcaggttttcagcaactgtcatcaagccatcacgacctatataagccactgcaatcgcactttacatcattaagacccttactagaagtaactggccatcctgccaccgctt

SEQ ID NO: 682939 - DNA, 1012 bp, Homo sapiens
caacgcatgtgccgctcccaacgcatgtgccgctcccaacgcatgtgccgctcccaacgcatgtgccgctcccaacgcatgtgccgctcccaacgcatgtgccggggcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaaaaaaaaaaaaaaaaaaaaaaaaaaaaaaaaaaaaaaaaaaaaaaaaaaaaaacagggggggggcgcccaaaaaactcatcccccaggggggcccaaaccaaagagcgacaccccgagtttgttgggaaaaagggggccccaaaaggggggcgcggtatataaacacacgagcgcaggggcgcgcagcataaacacaggcggaaaggaggaaaacacaggaaaacggggacacactgggagaaggacaccctccacacgggggaggggaaacaaaatggggcacaaccaccaccccagcgcgaaatataaaccgcatccgagcggacacacacatataacaccttttgacacaagtggtattaaacagggggggtgtaaaacacaaaatagcgaggacaaatataatgcacgacatggtgctgtgttagaaagaatgttgtgtgtgacatcacgggaggaatcttattatctgctgataaaacgaatattttttaaacgcgcggagcgagagtgttagtatacatataaaatcgaaaaaaaaaaacaagt

SEQ ID NO: 682940 - DNA, 225 bp, Homo sapiens
tatttgaaacagtctgcccctttgatacggtattgcatttccaaagccaccaatccattttgtggattttatgtgtctgtggcttaataatcatagtaacaacaataatacctttttctccattttgcttgcaggaaacataccttaagttttttttgtcctccccttggccctcccctccctgttttccttgattaagaaaaaatacaatagtcacattttaat

SEQ ID NO: 682941 - DNA, 294 bp, Homo sapiens
agttaacagaatgctctttgttgtcgtactagtaatggacatctgttattatatatccattacatgtaggttgctgttaaagttggcaaatgaaaagatagtgttaagaggttacttttttatcttattataggctatttaactttactctgtttctcaaatcttatcttggaaatgctttctcttgatcactgaagggtatcaggaaagagaatagtgaaaatttcattatgtaaaataattacatcctaccagtggtgggattttaaaaatttaatgtgcgtggggtaggag

SEQ ID NO: 682942 - DNA, 770 bp, Homo sapiens
caacgcatgtgccgctcccaacgcatgtgccgctcccaacgcatgtgccgctcccaacgcatgtgccgctcccaacgcatgtgccgctcccaacgcatgtgccggggcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaaaaaaaaaaaaaaaaaaaaaaaaaaaaaaaaaaaaaaaaaaaaaaaaaaaaaaggaaaaccgaaaattaacaacgaaaaaccttgtcgcccgcctgggcccagccgattttagactcgggcaagtttatgcatgcggccgaaattggggctcattgggccaattcgccctatggggggccgaataacaattaatgggccgtggttttacaacgttgggactgtggttgggcgaaatacgaaggggcccgaaccggacgcctttccagttgcccaacctgaatggccaattgcacttggaccgcgtttt

SEQ ID NO: 682943 - DNA, 1018 bp, Homo sapiens
caacgcatgtgccgctcccaacgcatgtgccgctcccaacgcatgtgccgctcccaacgcatgtgccgctcccaacgcatgtgccgctcccaacgcatgtgccggggcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaaaaaaaaaaaaaaaaaaaaaaaaaaaaaaaaaaaaaaaaaaaaaaaaaaaaaagagggggcgcgccgcccccaaaaatatatctcccccagggggcgccccaatttacgcgcgcgccccccagtttttctcggccaaaagggggccccccaaaatatgaggagagaggcacgataataaaatagacgccgtgacgaccgcggggcgccccgaccgcgtaacaaagacaggcgcatagccagcgtggggaacacaagcgagcgcacaccgggggagacacctcgtggagagagaagaacccctaaaactccggggggggagggggagaaaaatatgtggggaacaaaaatatcaataatcttaaaagaaaaaaatattaaagagagctccagcagaagaggagaaattataaaaaaatttttgaagaggggttataatagggggtgttctacacaacgtagggctggcaaattattatgaagagagaagatgaaaagatttggagcattacgcggatagttattgagtatagcagcagaagcaatttatatcacggg

SEQ ID NO: 682944 - DNA, 198 bp, Homo sapiens
cgaagtctcggcgccatccgatgccgcgggagaaagaaagaaatggaatttgaattgccagtggaaacacttatttaaaagacaaggcgctgctgatgttcatgaagcaaagactctaacaagttgtgctctgtgttacaagttatcaaagccagactggttcaggaaccagaagacttggttctgcccgagtcatcg

SEQ ID NO: 682945 - DNA, 116 bp, Homo sapiens
cgctttattgctgatgactttagagccagtatgttacagagctggcatgcgcagtctgtggagaacgacatcatgggctccgaagtcttgatgaacaatataacgaagagcaggag

SEQ ID NO: 682946 - DNA, 750 bp, Homo sapiens
caacgcatgtgccgctcccaacgcatgtgccgctcccaacgcatgtgccgctcccaacgcatgtgccgctcccaacgcatgtgccgctcccaacgcatgtgccggggcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaaaaaaaaaaaaaaaaaaaaaaaaaaaaaaaaaaaaaaaaaaaaaaaaaaaaaacccgcgcgcgggcgcccctgtgggggggggggaaaaagagggggagagagagagaacgagcggcgaccagagggagaccaacaacaaggagagcccgcaagccccccaatctttctgggcccccaagaggggggaacaaacaggcgcggcggcccccccaaaaaaggaaggcacccgcaataaaacctcaaaaaccccggggtacccccgcgataaaaagccgccacaaaagagt

SEQ ID NO: 682947 - DNA, 448 bp, Homo sapiens
  misc_feature (277)..(277): n is a, c, g, or t
  misc_feature (282)..(282): n is a, c, g, or t
atcttaagtaagagaatgtggagccaccagtggaaagaacaattgcagggaaagaggcctgattatattccagaccctggtcccagccattccttatctgcttacctaaattaattcaaattgagtttcaccatcatactgggacccccacctgatgtggtttcgttgcccatttttcaaatatgtattatttgtggcttacattaacatcttagatttcactctgacttcctcaccagtcagtcttaatctgctataatatggccatcactccatntggtngaaactgttggtatccaaattacaagtgacttaatgtctaaatccactggatgcattctacttgttaatatatttgacacacataaacactcacactgacacacataagtacttcttaaaactctctcctccatgggttggaactatagtctcttggacttttctt

SEQ ID NO: 682948 - DNA, 157 bp, Homo sapiens
acccaagaggcaggaaaaacgcgagtgtcttaagacctcaccctggcaggtgggcttctatccacccatgaggcacctcgggcttctcagccaccccgtggtgtaacaagtggaggaggaggaggggtagacacctttctccagcctgtgccaatcc

SEQ ID NO: 682949 - DNA, 252 bp, Homo sapiens
atccccacttggtgatgccccatctctactaatataaatatcaaaaattagtctgggttgtggtggcatgcacctgtatcctagctactcgggaggctgaggcaggagaattactataacccgggaggcggagttctcggcagtgagctgagattgtgccattatactccagcgcgggcgacagtagtcacagctctgtcttctaaatataccttactctcttattatctttagtaaactaactaggcttag

SEQ ID NO: 682950 - DNA, 296 bp, Homo sapiens
gttcccatttagaactaaccccttttttttccaaaaaaatattaatccctctcccccccggttccctttatatgttaaaaaataatggctttgaggggggaaaaaattaacctaggggagaggggggtttcctgtagtgctgtttccttaaagggtttccgtaaatttaattcccccgctaattcaataaaaaatgggccctttaagtgttttgattttaataaaatttttcccctttttcccccccgtaacaatgtaatatgttaatgtaaaaaaaattggtttttattctccga

SEQ ID NO: 682951 - DNA, 389 bp, Homo sapiens
  misc_feature (337)..(337): n is a, c, g, or t
  misc_feature (352)..(352): n is a, c, g, or t
  misc_feature (369)..(369): n is a, c, g, or t
tggcctcaaccccccaagggggtgggcataacagacatgtaccacggtaccgggccggatctcattctggatctctggcttcagaatatcggcacggagggtaaagcacacgtatgtacacacaaacacacacacaaagtttaatataccttttaaaaaattgtatggtatggtttcctggaaatagggtccggctatgtggcctaggcgggtctggaactccggggataaagcaatcctcccaattaagccttccaaaaggcgggcattacgggggtgagccaccacaatcagtctcttagatttggtttttaaagaacaattcgaagtttacggnaaaatggtgaagaangaacggacggttcccanatacccggtctccacggggt

SEQ ID NO: 682952 - DNA, 379 bp, Homo sapiens
  misc_feature (105)..(105): n is a, c, g, or t
cccccgggggggggattgtttttcccccccaattttatttttttggggggggggtcccccccaaaaacccggggggggtgggccgaaaaaattgtgtgggaaagngccggggtttcgggggggggggggcccccccctttaaaaggccccccgggggggtttttgggtttcccccttttttaaaagggggggggggggttttgggggggggggggcccaaaaaaaaaccccctttttggaccccaagggggggggggggtagttttttccccccccagggggttttcccccgtttttaaacccccctttttttggggggggggccaaatttttggggggttccccccccaaaaaaaaaaggccgggttttttcccttta

SEQ ID NO: 682953 - DNA, 249 bp, Homo sapiens
agagacgacctatagtcgagctgtcatatggcactggacttcaatcttgacaacgctcagtaaatcatagatgaacaatatcctttgcagagtaggacggaatataacttatccataaagtggcagggttataaattataggatagtgacacagtatactgcatagctgaactacacctgcaaacccgtgttaacctgactgggaccgaagacctgggagggactccatctagacatcgaccctggcag

SEQ ID NO: 682954 - DNA, 1397 bp, Homo sapiens
cctgaagagtgcagagcccaagcagggtcgcatatgtggtctttcagtattcggatggaaaactacagactgtgtgctgcacaaaggaagtgaaatgtggtgccgtgtactctatgtgtgtgaatttaactggcgaagctgttagccagcatcaatagcactggtgcggctctatgagtggacaacagagaatcgagctgctgcactgcagtgcaaccactacaacaacatcatggccctctacctgaatgaccaagggcgacttcatcctggtgggctgaccttatgcgctcagtgctgctgcaatgcctacaagcccatggaatgaaactttgaagagattgctcgagaactttcaatacccaactggatgagtgctgtggaaatcttggcatgcatgacaattctctggtgcggctgacacaacttgccttataactagtaaagtgtgtcaaaaggcatagcgcttgccaccactgacgaggagcggcagcacctccaggacgttggtctaattccaacagggacgagtattgtccaatgtctttttgccacggctcttctggtaatgcaccactctgagtgagacttaccaccccacacacacatgctcggtgcctcttcgcgcacggtcaacgggctatgatagggctggtgacctcactgtccagagaacctggtacaaacctacctgctggacattgccgcacatccgactccatccaaggtcatccacagtcgtcggtgacaagcactgtgatgacatccattcatggtacgaaatccttttcacaccccgacacgtaacgcacggtaatcatacacacgtggatcttaattccaactgtgcacctgctacgtcggacgtatccctggaaaactagagcgtgcccagagaaggtatgacgtgtgtttgtcgacccacatcttctgtaccgtggacactagtcataagcatgcaggtacctgataaaacaccacaaatagaatcagctcccacaaaaacaaacatacatccaaactatattctatataacgtaccacccaccacaagtcaaatagtcacccacgccaccacaactcatatacaaaaaagaatcaactagtaactaacgagacatccacatttaaccacctatcagcacctccactctaacctcaccactactactacaacacacaccaccatcctataaccaacaaacaaccaagtcttatatacatacaagctaaactatcataattctactacctactcatctcagctacatccaaactaaccaacacaccactcacatccaactcacaacacacaatccaccaataactacatctaatctaacaacatacccctaaaccacaacactacaccacccaccccaatcaccatcctacca

SEQ ID NO: 682955 - DNA, 489 bp, Homo sapiens
  misc_feature (377)..(377): n is a, c, g, or t
gaaattcggccataatggccgggaaattcaatcggattagccggtgggttggaagctaagttattccaattggatggtaaggtccagttttggaaatgggccgtttccgattaccaaaggtaaaatggcagttaatagcggtggcaacttttaaaggggtaataatggcccttgcatggggggaattaaaggtttaaccactggggtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaataaaaatataatttaacttataaaattattcctttttaattattatatttttttcaattncctctccattattacacctattgccctaatcgcccatttttccgcgcgatcccaacattttgcgctgccttcaaaccctcataatcgggaatactcctctttaccccttctt

SEQ ID NO: 682956 - DNA, 328 bp, Homo sapiens
  misc_feature (121)..(121): n is a, c, g, or t
  misc_feature (148)..(148): n is a, c, g, or t
  misc_feature (227)..(227): n is a, c, g, or t
  misc_feature (245)..(245): n is a, c, g, or t
  misc_feature (304)..(304): n is a, c, g, or t
  misc_feature (314)..(314): n is a, c, g, or t
aagctagaatagataatttgactctatttcaagtcacgacattttgtagccatttgactttggcctaagctttctgaacttgaaattccttgtctatgtaatgggaatcataatatctgcnctctttctttgtatgattgtcctaagnttaagaaaagtaaggtatacatacacagccttacaatggagaaaagtaatgtttaagagtatgatgttctagaaaagancatttccatttatttgcnttgtattgatttcatttatgtactaaagtagcagaactttaaggtagtcaaatatgganttctattttntcagttacccatga

SEQ ID NO: 682957 - DNA, 105 bp, Homo sapiens
tgtactaccgacggttgctacagacaccttacccactactttacaactctcactacactggctcgtgaccgtacgcgtgtggacttacttacgcttatccactac

SEQ ID NO: 682958 - DNA, 296 bp, Homo sapiens
aggtgatgctgaggtactctaagatcccgtggcatgtatcagttacttgggaggctgaggaaggagactgttgagctagcggttgtaggcatgctaagcaacacagtgaaatctgtctctaaaaccattaattcgatggacacagagacagacaccaagtgagatgatgtcaccatcggatggggcgatcgtctgcaaatgtagggagaagaacagctggggaagggcctggagcaagacgggacacacctcagcctcagaagcaaccaggccttgaatacctgtgtctcacattg

SEQ ID NO: 682959 - DNA, 189 bp, Homo sapiens
  misc_feature (56)..(56): n is a, c, g, or t
gaccccgggccatgctgactggttccagtttttgatgagcctggttgcatcctcanctcacaggcacagtgacttagatttgtaactgggtgataaattactcctttttgcttgagctagtttaagagggcttctgttaccaccaccaaaagagccttggccaaggcaagaaccagtcagcattaacca

SEQ ID NO: 682960 - DNA, 176 bp, Homo sapiens
ggttgcagaagatggtcgcctgacatccaggagactgatgggcacctatgtcgccaatatgctctgcaggagtgtgctagaggcaggcatcctctatggccagtgcgcctgtacggctggaccatggagcccgtgtatatgtgccagcgagcacctgcccctacctcgtggactgc

SEQ ID NO: 682961 - DNA, 437 bp, Homo sapiens
tcgatcgttagtttccttaatctctacagagggaggtgggggctaatatggcagggatgtctggggatggatttctttaaaacaacaacaaaaataaaaaacaaacaactctcaaaacacaaagtagtagaagtagaaatattgataggggcggggggagtgctgttggatatatcagtctaattggtggaaacctagaaatcatgtatgtcctagtgggtttattctactggggattagaaaccaagtgcttagggtaaaggaggagagattctgcatttgttttattttcatggcagatgcacattacctctttcagaaattcctgagtcatacatgattacattatgtttgtatgcgagacatttaattccttggcacggggaaataagtttttcagtggcagttttttaaaaggtgaaatgggctgctttata

SEQ ID NO: 682962 - DNA, 123 bp, Homo sapiens
atatcttcgctcatatactctccataataagagtctggtaaggtgcacacttttccttagtcatttatacaatgaaccaatgtcgtggttacctgggaaagaaacttcacgtgcttttaaatc

SEQ ID NO: 682963 - DNA, 892 bp, Homo sapiens
  misc_feature (54)..(54): n is a, c, g, or t
  misc_feature (140)..(140): n is a, c, g, or t
  misc_feature (165)..(165): n is a, c, g, or t
  misc_feature (168)..(168): n is a, c, g, or t
  misc_feature (172)..(172): n is a, c, g, or t
  misc_feature (242)..(242): n is a, c, g, or t
  misc_feature (250)..(250): n is a, c, g, or t
  misc_feature (255)..(255): n is a, c, g, or t
  misc_feature (263)..(263): n is a, c, g, or t
  misc_feature (274)..(275): n is a, c, g, or t
  misc_feature (279)..(280): n is a, c, g, or t
  misc_feature (285)..(285): n is a, c, g, or t
  misc_feature (290)..(290): n is a, c, g, or t
  misc_feature (299)..(299): n is a, c, g, or t
  misc_feature (326)..(326): n is a, c, g, or t
  misc_feature (348)..(348): n is a, c, g, or t
  misc_feature (376)..(376): n is a, c, g, or t
  misc_feature (380)..(380): n is a, c, g, or t
  misc_feature (402)..(402): n is a, c, g, or t
  misc_feature (474)..(474): n is a, c, g, or t
  misc_feature (482)..(482): n is a, c, g, or t
  misc_feature (490)..(490): n is a, c, g, or t
  misc_feature (498)..(498): n is a, c, g, or t
  misc_feature (528)..(528): n is a, c, g, or t
  misc_feature (564)..(564): n is a, c, g, or t
  misc_feature (585)..(585): n is a, c, g, or t
  misc_feature (589)..(589): n is a, c, g, or t
  misc_feature (736)..(736): n is a, c, g, or t
  misc_feature (785)..(785): n is a, c, g, or t
  misc_feature (862)..(862): n is a, c, g, or t
tacaaaaatattacagcagtgtgagcggggattgggaaggaagagatggggaanacaagtagatgctaaaatgggataggtgaacttcaggtcatcatggtcattgaaggaactgtaaattcttaagcttctagattttnccgctcttcagaaaacatttaaggnggntgcntttccccatgaatgagaaatgaaacgttccctaagcatttgagtctaaagacaagaaagcattgcttttnctactggnaaatntctctttncttcccattgnnctgnnctctnccgtncccctcgtngctttatggggtctaagggggagaggngccatgggtttccaccagcggnagagtgggtgctgggcgcaacacagggntgtnagtgacattcagactcactggnaatgggtccaactcatcttgaataaaatacacaaagaaagaaagagagagagagagagagagagagagaganagagaganagagaganagagaganagagagagagagagagagaacccgagaaancgaaaattgtttttttatggagggttttacaaagtnctctagatttctttatgtgcnaganagttcatttctggacttaatctctaggggggcaaaaaagaataaatagaaacaaatttaatgatcattctggaatcctgttctttactttgttcacacgctattaattctcataccttcacctctctaccacaaagcctagaaaatnaaatggtctcctattccatatttgcatagtattaataatactgtcaggnggtgaacttctagccccttgcttgcagccacattcctgaagagcactggtccaatctgacgtattcgaaaacaatanataagtgtctataggccaaaaattgggtcc

SEQ ID NO: 682964 - DNA, 634 bp, Homo sapiens
caacgcatgtgccgctcccaacgcatgtgccgctcccaacgcatgtgccgctcccaacgcatgtgccgctcccaacgcatgtgccgctcccaacgcatgtgccggggcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaagtcgacgcggccgcgaatttagtagtagtagtcgacccgggaattcgggacgggtactggaggggtgtccagttttcccaaaagggagccgtttaagctctggttaacacagggcaaacggtttcccggtggaaatttttatccctcccaaatttccacaaatatgggggt

SEQ ID NO: 682965 - DNA, 1528 bp, Homo sapiens
caacgcatgtgccgctcccaacgcatgtgccgctcccaacgcatgtgccgctcccaacgcatgtgccgctcccaacgcatgtgccgctcccaacgcatgtgccggggcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaaaaaaaaaaaaaaaaaaaaaaccccgggggccctctttggcgcgggggcgcgggaaaaagggggtatagagaagggcgcccggggccaagagagtgtgtttccgcgtgacacccaatattttcttgtgtgtcaccagcggggcgaaacatcgcgcgcgcgagtccccccatatgaggagagaggcgcgattataataattcccgaataaagcccggtgtttaaccgcgggctttatgactgtctcggcggcacccacaagtcaatcctcgacacgacaagatcataaccaacgaccgcgacggaggacagcaccaccggagagcgacacagctcaacgacagaacagccggccgcgaatcaccacaccacgacaagcactctgcaggagacaccgaccacaaacaagagaccgcggcgcccgcgaacgacacacacagccacacccacttgtccacacccaggttcgcgacccacgcaccacattgcacacctcaactctcatccaccaccccaccaaccaaaagcaaaaacaaacacaacagcaccgaccaatctactaactacttactcatttataaacaactacttttatacaatatataaaatatactaccaaacagcaaagaggtactatcagtctaaactaaacaaagaaaacaacagtaaactaaacaaacacacaagaactaaacacaccactaaaaatgaagtaaagaacaaacaaaaaaaacaaacagaccatcaacacccaacccaacctcacatactacacaataagaagtacaacaactcaaacaacacaccatgaaagtccgaagatagacacacaagcttaacacctgcacgaaacatacagacaactactcgacaaacactacgacaagacgcgacacacaaatcaaacatggatacataaaacaacatacaaaccataatagcaatcacgacacgccaacacgcacgtcgctatccataaagttctgtaatactaataccaaagtcactgactcatgtctgatatatcagtacagtaacaactaatctacttctcagccaagtcacacc

SEQ ID NO: 682966 - DNA, 394 bp, Homo sapiens
  misc_feature (4)..(4): n is a, c, g, or t
tgantcggcaccgtttgcccacaaggactctggctcagtggttgaagacgattttaagactgaactcctatattctctttcccagcatgccagttaaaaacttcaatcaaggccaggtgcagttactcacacctgtaatcccagcactttgggaggtcgaggtgggcagatcacctgaggtcaggagttcaagtccagcctggccaacatagtgaaacccagtctctactaaaaataccaaaaattagctgggtgtggtggcgggcgcctgtaatcgtagctactcaggaggctgagacaggagaatcgctcgaacccaggaggcagaggttgcagtgagccaagatcacgccattgcactccagcctgagcaacaagagcgaagctccatctc

SEQ ID NO: 682967 - DNA, 747 bp, Homo sapiens
caacgcatgtgccgctcccaacgcatgtgccgctcccaacgcatgtgccgctcccaacgcatgtgccgctcccaacgcatgtgccgctcccaacgcatgtgccggggcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaacagcagacacaacacaagagaaacacaacgcgacggaggagacaacacagaaaaaacagcaagaagaaagcgggtggggcgcacaggacccccgagaacgacgtcagaaaaccacggtagggcacgaacaccacaagaagaacaaacaaccggacaaaaagaacaaaaaaaaaatgagaggaaaaaaaagagggagagacaccacaaaaaaaaaaacgggggaaaaacaagataagaaacaccaaggaaacaagacaaaggaaacaaggagaaaagacgaaaac

SEQ ID NO: 682968 - DNA, 877 bp, Homo sapiens
ccacattttcttatccagtctatcattgttgaacatttgggttggttccaagtctttgctattgtgagtagtgccgcaataaacatacatgcgcatgtgtctttatagcagcatgatttatattcctttgggtatatacctagtaatgggattgctgggtcaaatggtatttctagttctagatccctaaggaatcgccacactgtcttccacaatagttgaactagtttgcagtcccaccaacaatgtaaaagtgttcctatttcttcacattctctccagcacctgttgtttcctgactttttaatgatcaccattctaactggtgtgagatggtatctcattgtggttttgatttgcatttctctgatggccagtgatgatgagcattttttcatgtgtctgttaaagagcttctgcgcagcaacaagaaactaccatcagagtgcaagaggcaacctacagaatgggagaacatttttgcaatctactcatctgacaaagggctaatatccagcatctacaaaggactcaaacaaatttacaagaaaaaaacaacccatcaaacacgtgggcaaggatatgaacagacacttctcaaaagaagacatatgtcttttaaagtttccactgaaaggagtctacctctgtgttgtcactgtcttacgctttctagacctatttgaatttaaccttctgcatatatataactttgggaaacttacatttaacttttaaaccagattatttactcatcgaagacatctcagtaaatcattcccagcactggtgggtcagcagtttaaactgtgcctcctataactaattcgcttcatgcctcttcacggctgtcactcggtcagccttttcgtggaca

SEQ ID NO: 682969 - DNA, 112 bp, Homo sapiens
ctggcttggtcacgtgatttgcgaggcagcttctctgtgtcattttactcaggcatcaagccttgcatggtccctgcagggcaggtggattcagaactttttttgcattttc

SEQ ID NO: 682970 - DNA, 134 bp, Homo sapiens
tgctccacccagtagcgacccgccatcgcggcgtgggcgctggtcccgcacgcgacgaagtagacgcgcgtgatcttcttcgcgagctccggcgtgacgccgatctcctgcgcggtgatgtcaccgtgctcgag

SEQ ID NO: 682971 - DNA, 116 bp, Homo sapiens
atgtctagctccataactccgcccttcgcgattcttccccgtcccctcggcgtcttgacagatagacagacgagctgccccgccccctgcgcttaccgactgactctagtgacctc

SEQ ID NO: 682972 - DNA, 652 bp, Homo sapiens
  misc_feature (481)..(482): n is a, c, g, or t
  misc_feature (488)..(488): n is a, c, g, or t
  misc_feature (490)..(490): n is a, c, g, or t
  misc_feature (538)..(538): n is a, c, g, or t
  misc_feature (585)..(585): n is a, c, g, or t
caacgcatgtgccgctcccaacgcatgtgccgctcccaacgcatgtgccgctcccaacgcatgtgccgctcccaacgcatgtgccgctcccaacgcatgtgccggggcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaaaaaaaaaaaaaaaaaaanngggggntnttaggggggggggggaaaaaggggtaaggaaggggcccggggccaaancgggtcccggacccagttttttgggacaaggggggaaatcggggggntcccctattggggggcggattaaattcgagaaaagccggggttacggggtttgaaggggaaaaggct

SEQ ID NO: 682973 - DNA, 125 bp, Homo sapiens
gtacaatcctcctacctcagacctcccaaatagcttggaccacaggcgtccaccaccataccaggccaattcttgagttcttagtagagacacagtttcgccatgccggccattcaacgcctccg

SEQ ID NO: 682974 - DNA, 891 bp, Homo sapiens
  misc_feature (592)..(592): n is a, c, g, or t
  misc_feature (599)..(599): n is a, c, g, or t
  misc_feature (617)..(617): n is a, c, g, or t
  misc_feature (666)..(667): n is a, c, g, or t
  misc_feature (708)..(708): n is a, c, g, or t
  misc_feature (751)..(751): n is a, c, g, or t
  misc_feature (825)..(825): n is a, c, g, or t
  misc_feature (827)..(827): n is a, c, g, or t
caacgcatgtgccgctcccaacgcatgtgccgctcccaacgcatgtgccgctcccaacgcatgtgccgctcccaacgcatgtgccgctcccaacgcatgtgccggggcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaacaaaaaaaacaaaaaaaaaaaaaaaaaaacaaaaaacaaaaaaaaaaaaaacagaaaaaagaaaaaaaaaaaaaaaaaaaaaaaaaaaaaaaaaaaaaaaaaaaaaaaaaaaaaaaaaaaaaaaaaaanaaaaaanaaaaaaaaaaaaaaaacnttgtgggcccgcttggcccaagcgcttttaaacttgggcaaggtttagnntggggcccgaattcggggctcacttggcaaattcccccaantgggggggtattaaaattaacgggccggggtttaaaaacgttnggactgggaaaacctggggttacccaacttaaatccctttggagaaaaaacccctttttgcaaagtgggaatancnaaaaaggcccccaccgaaacgcttttcacgttggcaaacccaaatggcaattggtttgagcctt

SEQ ID NO: 682975 - DNA, 519 bp, Homo sapiens
  misc_feature (509)..(509): n is a, c, g, or t
caacgcatgtgccgctcccaacgcatgtgccgctcccaacgcatgtgccgctcccaacgcatgtgccgctcccaacgcatgtgccgctcccaacgcatgtgccggggcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaacatacaaatatatgaatgtgggaaacacaacaataaaaaatgcttnttaatcatgt

SEQ ID NO: 682976 - DNA, 805 bp, Homo sapiens
  misc_feature (547)..(547): n is a, c, g, or t
  misc_feature (596)..(597): n is a, c, g, or t
  misc_feature (638)..(638): n is a, c, g, or t
  misc_feature (681)..(681): n is a, c, g, or t
caacgcatgtgccgctcccaacgcatgtgccgctcccaacgcatgtgccgctcccaacgcatgtgccgctcccaacgcatgtgccgctcccaacgcatgtgccggggcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaagaaggaaaaatgaaaatgataaaggaaaaataatccgagaaaataaaaataaaaaattaagaaagaagaattcattaaaaaacnttgtgggcccgcttggcccaagcgcttttaaacttgggcaaggtttagnntggggcccgaattcggggctcacttggcaaattcccccaantgggggggtattaaaattaacgggccggggtttaaaaacgttnggactgggaaaacctggggttacccaacttaaatccctttggagaaaaaacccctttttgcaattgggtaaaaagcaatagagcctcccgacggctttcccatttgggcctcctcgaggggcgg

SEQ ID NO: 682977 - DNA, 840 bp, Homo sapiens
  misc_feature (566)..(566): n is a, c, g, or t
  misc_feature (615)..(616): n is a, c, g, or t
  misc_feature (657)..(657): n is a, c, g, or t
  misc_feature (700)..(700): n is a, c, g, or t
  misc_feature (774)..(774): n is a, c, g, or t
  misc_feature (776)..(776): n is a, c, g, or t
caacgcatgtgccgctcccaacgcatgtgccgctcccaacgcatgtgccgctcccaacgcatgtgccgctcccaacgcatgtgccgctcccaacgcatgtgccggggcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaatatttaatttatttaattaatatttatatactttataatattttattcacttccttatcatcttacaattttaatattaaaaacaactataaaaaaaaaaacnttgtgggcccgcttggcccaagcgcttttaaacttgggcaaggtttagnntggggcccgaattcggggctcacttggcaaattcccccaantgggggggtattaaaattaacgggccggggtttaaaaacgttnggactgggaaaacctggggttacccaacttaaatccctttggagaaaaaacccctttttgcaaagtgggaatancnaaaaaggcccccaccgaaacgcttttcacgttggcaaacccaaatggcaattggtttgagcctt

SEQ ID NO: 682978 - DNA, 762 bp, Homo sapiens
gcggcgcgagcgtcacgccagacagcggcccgcgcgccttctcctcggcgtcggcctgccgccgcctcccagaacctcctcgtgccctcgcgtgccaggcccgcggcgtgccgaaatccgcggttcacacgcatgtcctgcctcggacccctgctgcggagggggagggaacccccacccagcccgcgtccgagaaagaacccgaaatgcccggtcccagagaggagagcgaggaggacgaggacgaggacgacgaggaggaggaggcaggaggaacaaacgaaaagagtctcatcgtggaaggcacacgagggaacacagaaaaaagtacgagacggttgacaatgcaagtctcttccttacagagagagccattttacaatttgcccaacggaaaacggggcagaaacttcgtgacaattgcgaggatacatttttttctacactacagaacgaaaaccgatgaacttcgaaatctacacaaactgctttacaacaggccaggcactgtgtccttcattaccggaagaatgtgggtcagttcagtggctttccatttgcacaccggaagtgtccaatattaccacgacggccgaccatgctcgcacccacctctaccaaatgcccatgctccaagaagcatctgtgaaggtcttgaattcggcagagactcaggtgtacctagtgaacttactgacgaggatcctgaccttcctcaactgctccaaagcttcatggcaaaccattgccgaaatctaacac

SEQ ID NO: 682979 - DNA, 1842 bp, Homo sapiens
  misc_feature (524)..(524): n is a, c, g, or t
  misc_feature (1464)..(1464): n is a, c, g, or t
tcccctcttttatattttttttttttatatatatatatttaaaaaaacgcgtctctctcctctcttcttctctctctccccccccgagagacacaattaaaacccacatcaaagagggggtcttaggggcgcggggggtgcaaagagaggctcaaagaggagcgcgcgctatatatctctttttcggttcctctctcttcacaagcgagcggcggcgggaggggcccgcgtggtgccgcgtgtggtggcacataggcgcagataatagagagtcgaaagagagtgtagagagagagagagtgtgtgtctgcgaggggagtctctctctagaagagagtgtgcgcacagagagagagtgtgcgtgtagtgcgtcccgcagggagtgtagtgggagtgtgatgtgtgagaaagtgtgtctctctctctctctctcacaacactatagagagatcattgtgtgtggtgtctccccacgcagagatgatatctctctcctctctctgcagcgatgagcacagcagagngagatgtgttgtgatcctcgccgcagagaaaagaaggaggagtactatgtggtgtgggcaccactgctgatgagtaaaaacagcagcaggtcgcacccacataatctacgccgccgcgagcggtgctctcttctgcggcagcggagcgcgccccgcagcggtgagcagcacgcgggaggagaatcatcgtcgcgcggcgcccccgtacgtgtggagaggagtgccgggcacttatagtgtgtggcgccccacaatccaaaacagatgcgtagggaggagagaacatcacacacccgcacggaagagttccccccccatagtgtgaaatattttatagtagggggagaaacaaaaaatgttttgttgcaccacacaaagaggtagcttccctattaaaaaaagaggagatctccaaccaccgacgggggggggagagacagacaaccaagcacgcgatgagaaaacacacacagcagtggaaccataccgagaggaggagaagtgaaacaacgtgttgctgcgacacacagcgagaggggtctcatactctgagcagtaatactcccacagggcagaaaagaggtggggggagtacacacaccaccaggtgtgggaagaggaggagcgccaccatcttctataccaacaaaaggaggaggaggacaccacctcttcttttgggcggaagaaagaagcgtccgatgacgagaaggagcacccccggcgagggagaaaaaagactatttaatactgatcaccccgagtaaggacagcacgaggcggggcagcaggcggacaacaacttaattcgcgcaccacaaaaagtaacattctcttgaggcacgcggcggacgggacgaggatcaaaaaaaacatcaactgtggtagtggaaggacacccggggagcagccaacggacgggagtggaaacaaaacccangcgcgcgagagaaggatgaggaaagacactactcctacaccggggagagaggggaaaattccgccgcggagtgttgtttgcccccccccccgcaaaaaacaacaggaggtgtagtagagagcgaatgagaaaccaccacccaatcatcgatggaaacactgcctcatcacaacaacccacggaggggaagacaaaatagattcaccctccagcagaaagagtcaattctgatgacgagagaacaaagaagaggtgtggagggcagccaccaaaacaaacagacaaagtaaatcccccaccacagggagtgagaaacagattggggagtcaaggtaggccgacgaaacaatagtgagtagatcgttgtaggagatgccc

SEQ ID NO: 682980 - DNA, 786 bp, Homo sapiens
  misc_feature (542)..(542): n is a, c, g, or t
caacgcatgtgccgctcccaacgcatgtgccgctcccaacgcatgtgccgctcccaacgcatgtgccgctcccaacgcatgtgccgctcccaacgcatgtgccggggcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaacaaaaaaaaaaaaaacacaaaaaaaaaaaaaaagggggggcccccccaaaaatcccccccggggggcccgccgagcttntgtcgccgatcctccccgcgcttttttgttgtgtgctaccaaagtgggggccccctctattatggaggcggcgccatttttaaatctccgacggggccgcggcgcccgcgctcgtttctaccacaccgctgcgtcacacgtgggaacaaaccgcgtcatcccgcggggcacctctgttggtgacaggaaccccctccactcctcggggggggtggaaccctatggtggcacccactccccttcg

SEQ ID NO: 682981 - DNA, 526 bp, Homo sapiens
caacgcatgtgccgctcccaacgcatgtgccgctcccaacgcatgtgccgctcccaacgcatgtgccgctcccaacgcatgtgccgctcccaacgcatgtgccggggcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaacagaaaccaaaataaaaagctttgacatcctgatatcggctgggcgtaattaggaatcggccc

SEQ ID NO: 682982 - DNA, 94 bp, Homo sapiens
gcccccggggtttggggggcctttttttttggccccaggttggggcccccgggggggggtttttttttttaaaaccaagcccatccccttttta

SEQ ID NO: 682983 - DNA, 126 bp, Homo sapiens
atatataatacagccacactctggctgcacagctgccttcaggattacctgccgcagggtctgctgctcagaagcaagccacgaacagactctgccagagcctgaccacacttaccctgcacaatg

SEQ ID NO: 682984 - DNA, 1080 bp, Homo sapiens
gatacagactgttcctggatctgaggcagccaggtgctaagaatcaacatcctttcactgcgtcctaagcattacagttaaattaagatcaaactagcaacttaaaccaaaaacatagaaaaacaccgttaagcgttctatcgcatgcttcccagagagtccccatgaatcggagagaaggcaagcctaaaacaagacaaatctgccactacattctgacataactcttctccagaactcacctgtactcctaacttattctaactgttactgctgtgaggtactgactgtactacaaacactctgatctacttaactttcactccagctaatgactagaacttacatattattaaaaaccagagagcacacaagtagacaggtgatgagaaaggaacacaggcgtaacgcaaacaccaagacacgcaatcgtgaccgacaactacagcacaactagcacgcgaaacacatctcacacaaccgtgccgcgctcccaaggccacacaggatacctacacacacacgacacgcaacaaccacgaaacgacagaacatgcatacaaaccacatcagagatcatactggacaccacagcgaaaaagtacagcatgacacaccacccgcaacaagacactcacaaaccaacactactagcagacaacaaaaaacacgacacaaccactgcaacgcaaaggacgcagaacaagccacataccatcggcccacagaacccaaaggaaacaaaatgaccaaaaggcaaacacaggaagcaaggcgcaaaaacggtaacgaaccgacgacaacagcaccaacaacaacagaggacacaaacaccagatacaaacacatacccaaaaacaacacacgagagcgtacacgacacggcacaccaaacacacacaaagaagtcgaaaacgggcaacacatgcacaccacccaagaagacaacggggaacacagcgtcaccaaaaccacaaagaaaagaaacaaacggaagacagacacagacataaggcgcacgaacagagaccaataagaatcaagagcagcagcagcccccggcccgcagcccgaagcaga

SEQ ID NO: 682985 - DNA, 524 bp, Homo sapiens
tcagtgtaaaatgactggcagctgtatctgtaagtcgctacattctagctctacctaatgtgccaggagctgccggagaactgggacaagcagcctcgtcaggtccttgtgtgcgaagaactttaaagacgtggttatgatgagaaaaaaaaacgtctttgtggagttctatgccccatggtgtggtcactgcaaacagttggctcccattttgagctaaactgttgagagacgtacaaggaccatgagaacatcgtcatcgccaagatggactcgactgccaaagagatgaaggccgtcaaagtgcacagttaccccacactcaagtactatcctgccagtgccgacaggacggtcattgattacaacgggaaacgcacgctgaatggtaaacaagaaattcctgaagagcggtggccaggatggggcaggggcatagatgacgatctcgaggacctgaaagaagcagacggagcccagaacattgaggaagacgatactcaagacgggttctgggtaccgag

SEQ ID NO: 682986 - DNA, 471 bp, Homo sapiens
  misc_feature (34)..(34): n is a, c, g, or t
cggacactgacctagaggcccgagaagggtgggnaccccggaggccagagcttgcagtgagccgagattgtgccactgcacactcccatctgggtgaaagaccgagactccgcctcaaaaaaaaaaaaaaaagaaagaaagaaagaaagaaagaaatctacctgtcaaggaactaaggtattttgctaacaagcaccaacttgccagccatgtaagggagccatcttggaagcagatcctccagcctccagtcaagtcttcagataattgcaacttcagttgatcttttgaccaagacctcaagagagccagaactacccagctaagccttttactaaatttctgaacttctaacactattagataataagtgcttattgtttaacaccattaattttgagtataatttgttacatagcgacagataactatacagctcaacaactagaaaaataaactgtttacctgcct

SEQ ID NO: 682987 - DNA, 455 bp, Homo sapiens
ccagaggccggagaatctcggaccccagaggtggagttttctgtgggcccggatccaacccctgcactcccatctgggtgaaagaccgagactccgcctcaaaaaaaaaaaaaaaagaaagaaagaaagaaagaaagaaatctacctgtcaaggaactaaggtattttgctaacaagcaccaacttgccagccatgtaagggagccatcttggaagcagatcctccagcctccagtcaagtcttcagataattgcaacttcagttgatcttttgaccaagacctcaagagagccagaactacccagctaagccttttactaaatttctgaacttctaacactattagataataagtgcttattgtttaacaccattaattttgagtataatttgttacatagcgacagataactatacagctcaacaactagaaaaataaactgtttacctgcct

SEQ ID NO: 682988 - DNA, 373 bp, Homo sapiens
  misc_feature (259)..(259): n is a, c, g, or t
  misc_feature (355)..(355): n is a, c, g, or t
actgttaacattgggcattaagtttcaacacatgaactttggggaacacattcccaccataggacttgtttttttttttctttccttttaagccctgtcactctcgtattattagtcagagttcatgtctctgttttctgttggatccctgaggtataaaaaaaataagttagttttggagttatacaaaaacctaggttcagattccatctctaccatttactagctttgtgaacttgaacaaatgacatgactattntaagcctctctaaaataggataatggtttctaatttataagattattgtaatgattagaaattaccttttaaaactacctatgctagttctgggcncatgataggtccttgcca

SEQ ID NO: 682989 - DNA, 620 bp, Homo sapiens
  misc_feature (34)..(34): n is a, c, g, or t
  misc_feature (587)..(588): n is a, c, g, or t
  misc_feature (592)..(593): n is a, c, g, or t
  misc_feature (600)..(600): n is a, c, g, or t
  misc_feature (603)..(603): n is a, c, g, or t
  misc_feature (606)..(606): n is a, c, g, or t
cggacactgacctagaggcccgagaagggtgggnaccccggaggccagagcttgcagtgagccgagattgtgccactgcacactcccatctgggtgaaagaccgagactccgcctcaaaaaaaaaaaaaaaagaaagaaagaaagaaagaaagaaatctacctgtcaaggaactaaggtattttgctaacaagcaccaacttgccagccatgtaagggagccatcttggaagcagatcctccagcctccagtcaagtcttcagataattgcaacttcagttgatcttttgaccaagacctcaagagagccagaactacccagctaagccttttactaaatttctgaacttctaacactattagataataagtgcttattgtttaacaccattaattttgagtataatttgttacatagcgacagataactatacagctcaacaactagaaaaataaactgtttacctgccttaattatttatctttagttccttattagttctcaagaaacaaatgctagcttcatatgtatggctgttgctttgcttcatgtgtatggctatttgtatttaacaaggacttaatcnntcanntaatttngtnttnccgcaccgctacta

SEQ ID NO: 682990 - DNA, 262 bp, Homo sapiens
cttcgaatagtcaacaatccataatacttgaagatgcaataagggcaagagcacgaaaacaagatatgcctgtatatcaagaaaactgaaaacatgtccacacaaaaacctgtacatcaatgttcataccagcattattcataatggccacaacgggaaaccaactcaaatgtccatcacactgtcaagggcgtaaacaacacatatcagtatatatcccatacaagggcaatcattcattcaagccccataaaaaggtact

SEQ ID NO: 682991 - DNA, 319 bp, Homo sapiens
caggtacaggaaagcattttccaggtctcctttaaactctgttcgtgatgctttcccaacatgtcatcagggctgtaactcttgtgcctatcaaatcctttctggaggtggggccacgctccgctcggtcatgatgctgatccacttgtggcacacatccagttcctttcctcttccactccagcgtcatagcgcatcgcgagcctcttggtcaatccagttccataatcaaagacagagaccatcctctgctctatctcacctttggccagggccacactcatcagcttgcgaaagtcaacgatgtgggtcccgagct

SEQ ID NO: 682992 - DNA, 1074 bp, Homo sapiens
  misc_feature (585)..(585): n is a, c, g, or t
  misc_feature (697)..(697): n is a, c, g, or t
  misc_feature (758)..(759): n is a, c, g, or t
  misc_feature (805)..(805): n is a, c, g, or t
  misc_feature (822)..(822): n is a, c, g, or t
  misc_feature (827)..(827): n is a, c, g, or t
  misc_feature (843)..(843): n is a, c, g, or t
  misc_feature (856)..(856): n is a, c, g, or t
  misc_feature (880)..(880): n is a, c, g, or t
  misc_feature (882)..(882): n is a, c, g, or t
attgctgtcctacaaaacatcagataataatggatgttgatcgcatctcatgttaactctttactgatatgttgtaaatacagaagtgaaatgtggacaaaatagttacgctattggttaatggtactagacaacatgtactcaatgacattcaaaaattaatggctagtgatatatataaagtaaaatttctttgcagtaaaatatgccctttattatagaagggaggatataaggaaccaacagttgtatgaaaatagctcaaataatatcttttatttgatcttaactatttcttattctggtttattagtgtcttagaacaaaatgggcttatataatgaaggcctagttaatgctggacggtaagatctctttaactggtccggaccagatagtgggggatgagagccgaataaggttgcctgaaataactgacactatataatttctgcttggcaaatactaagttctaacttgtcattcctggtagaacaagctttatttttcgagcctagcaatgatctagaagcagatgttatctcagtgcctttgcaattgttgtgtgggtttttttttttttanaaggccacacaataatttgggaaaaccaaggtattgggtagaacatgtgtctgttaatggcacacaaaaccacttttaaggggtacacgagttaaattggaaggaataagtnctagctgaagtattatgaactccaaataatggcttggaggacctccaagggtaaaagtacnnatcccttgggccatttatggagagagagagagagagagagtagggngactatagtaaggtatngatgntcttgctacaaataanggatattggagcngaggggggtgctaataacacggtntnggatcaatacccattggtttgtgaacacagtacataccccatattttccaattgtgttttcaacctttaaaactttctaatataagtatctctcaaacgtgtgggattcaaactccttcgaatttatatccaacatcttgaacatcttcaaggaaaacacgggtgaaaataaaccattctagatacaagggg

SEQ ID NO: 682993 - DNA, 1330 bp, Homo sapiens
  misc_feature (1330)..(1330): n is a, c, g, or t
tctgctaccgtgactaaaatggaacctttttgggggtcgcggcccgaattttgggcgggggtgtccggccccaggacagttttaccgaatttccgtccacttcccgaattcctttcagtggactccggcgttcgtgcatttttacagaggtctccaattcacgcggacccagaacccctgtggtgaccgggacctcagtcctcggcgtaaagtttcgagggcggaggtggtgattgccgcagacttgcgtgggactccatacggcctccttggcctcgttcccgaaacattctctcgcatttagtgcgagttcaacaacagttcccagtgcgtggggtgcccttgtggcgacttacgctgatttcccaggtatttgtgaagcaagtttctcggccagagtggctgatttgattgaggacgctctctgtgggagatgtgtgacacgagcttatatatgctccataaagcttatttcatctcattgcgcttgacccagggcctatgtgttacaggccgggcgcctcagaaaattgaacccctttttggtggacacaccatgtggctcaactcgagaggcaatatgcctagatgagaacagaagtcttcccctcctggtttattattgtggcgacctttgtcttggtgtggtaacgccttatggaaagcccccttcgtttggggcccactggcgtttatgggtggcataaaccttggtctacagccttcgtgtggcgcaaaagttctggggaaaaaagccaggcccagttgttaaagcccagaccggaagggcccggcggaattttaagttaagacacaggctgctattgccaaaagtggccgtgtaattaaacaccgaaagatggcccactgtttttaaaacaacccgggtttttacaaacacccgccattgtgtctcacccggaaaaaagcggtgtggctggaaacatcacggacgcggactccttttgttctcacgagagagaccccagtgtggggatatttgggcccccacattgtaaatcaccaggagggcctatggaaactgtgaataataacgcgagagtggcttttattccccggaaaaacgtggaaaggtttcccccatactattataaaccttgtgaagaacttgtgtgggctatgttccaaaagaattaaaaccttctttctttttgggaacacgcaacaatataaactcttctcttcacaacgtgccacacaccaccaaaaaaaaccctggcgggactctatttgtcgggcgggtgcgccacacagacggtctaccataaatagtggcccatttgtcattcaatcatgttttcgtgcaccn

SEQ ID NO: 682994 - DNA, 1020 bp, Homo sapiens
  misc_feature (585)..(585): n is a, c, g, or t
  misc_feature (697)..(697): n is a, c, g, or t
  misc_feature (721)..(721): n is a, c, g, or t
  misc_feature (768)..(768): n is a, c, g, or t
  misc_feature (771)..(771): n is a, c, g, or t
  misc_feature (810)..(810): n is a, c, g, or t
  misc_feature (872)..(873): n is a, c, g, or t
  misc_feature (888)..(888): n is a, c, g, or t
  misc_feature (890)..(890): n is a, c, g, or t
  misc_feature (898)..(898): n is a, c, g, or t
  misc_feature (912)..(912): n is a, c, g, or t
  misc_feature (914)..(914): n is a, c, g, or t
  misc_feature (934)..(934): n is a, c, g, or t
  misc_feature (938)..(938): n is a, c, g, or t
  misc_feature (947)..(947): n is a, c, g, or t
  misc_feature (949)..(949): n is a, c, g, or t
  misc_feature (951)..(951): n is a, c, g, or t
  misc_feature (956)..(956): n is a, c, g, or t
  misc_feature (961)..(961): n is a, c, g, or t
  misc_feature (963)..(963): n is a, c, g, or t
  misc_feature (966)..(966): n is a, c, g, or t
  misc_feature (970)..(970): n is a, c, g, or t
  misc_feature (976)..(976): n is a, c, g, or t
  misc_feature (996)..(997): n is a, c, g, or t
  misc_feature (1001)..(1002): n is a, c, g, or t
  misc_feature (1016)..(1016): n is a, c, g, or t
attgctgtcctacaaaacatcagataataatggatgttgatcgcatctcatgttaactctttactgatatgttgtaaatacagaagtgaaatgtggacaaaatagttacgctattggttaatggtactagacaacatgtactcaatgacattcaaaaattaatggctagtgatatatataaagtaaaatttctttgcagtaaaatatgccctttattatagaagggaggatataaggaaccaacagttgtatgaaaatagctcaaataatatcttttatttgatcttaactatttcttattctggtttattagtgtcttagaacaaaatgggcttatataatgaaggcctagttaatgctggacggtaagatctctttaactggtccggaccagatagtgggggatgagagccgaataaggttgcctgaaataactgacactatataatttctgcttggcaaatactaagttctaacttgtcattcctggtagaacaagctttatttttcgagcctagcaatgatctagaagcagatgttatctcagtgcctttgcaattgttgtgtgggtttttttttttttanaaggccacacaataatttgggaaaaccaaggtattgggtagaacatgtgtctgttaatggcacacaaaaccacttttaaggggtacacgagttaaattggaaggaataagtnctagctgaagtatctccaagcatnattgggagtggataatacttcagctacaaccaagcagaatctctttnttngggaggtcctcgaagcataattgggagtggataatactncagctccaattgggagtggataatattccagctagaacctagtagaatctggttttccctgnngaggtcctcaaagcntnatggggtncataatactgaagntnagaaccaagcagaatcggtntccntgagggagnancnggacncatanantgntgantataanccttagtaccctggatattnntggnnggcagtgaccagcntatt

SEQ ID NO: 682995 - DNA, 1084 bp, Homo sapiens
  misc_feature (585)..(585): n is a, c, g, or t
  misc_feature (697)..(697): n is a, c, g, or t
  misc_feature (785)..(785): n is a, c, g, or t
  misc_feature (832)..(832): n is a, c, g, or t
  misc_feature (835)..(835): n is a, c, g, or t
  misc_feature (874)..(874): n is a, c, g, or t
  misc_feature (936)..(937): n is a, c, g, or t
  misc_feature (952)..(952): n is a, c, g, or t
  misc_feature (954)..(954): n is a, c, g, or t
  misc_feature (962)..(962): n is a, c, g, or t
  misc_feature (976)..(976): n is a, c, g, or t
  misc_feature (978)..(978): n is a, c, g, or t
  misc_feature (998)..(998): n is a, c, g, or t
  misc_feature (1002)..(1002): n is a, c, g, or t
  misc_feature (1011)..(1011): n is a, c, g, or t
  misc_feature (1013)..(1013): n is a, c, g, or t
  misc_feature (1015)..(1015): n is a, c, g, or t
  misc_feature (1020)..(1020): n is a, c, g, or t
  misc_feature (1025)..(1025): n is a, c, g, or t
  misc_feature (1027)..(1027): n is a, c, g, or t
  misc_feature (1030)..(1030): n is a, c, g, or t
  misc_feature (1034)..(1034): n is a, c, g, or t
  misc_feature (1040)..(1040): n is a, c, g, or t
  misc_feature (1060)..(1061): n is a, c, g, or t
  misc_feature (1065)..(1066): n is a, c, g, or t
  misc_feature (1080)..(1080): n is a, c, g, or t
attgctgtcctacaaaacatcagataataatggatgttgatcgcatctcatgttaactctttactgatatgttgtaaatacagaagtgaaatgtggacaaaatagttacgctattggttaatggtactagacaacatgtactcaatgacattcaaaaattaatggctagtgatatatataaagtaaaatttctttgcagtaaaatatgccctttattatagaagggaggatataaggaaccaacagttgtatgaaaatagctcaaataatatcttttatttgatcttaactatttcttattctggtttattagtgtcttagaacaaaatgggcttatataatgaaggcctagttaatgctggacggtaagatctctttaactggtccggaccagatagtgggggatgagagccgaataaggttgcctgaaataactgacactatataatttctgcttggcaaatactaagttctaacttgtcattcctggtagaacaagctttatttttcgagcctagcaatgatctagaagcagatgttatctcagtgcctttgcaattgttgtgtgggtttttttttttttanaaggccacacaataatttgggaaaaccaaggtattgggtagaacatgtgtctgttaatggcacacaaaaccacttttaaggggtacacgagttaaattggaaggaataagtnctagctgaagtattatgaactccaaataatggcttggaggacctccaaaggggattagtagttggccggtggaggtcctccaagcatnattgggagtggataatacttcagctacaaccaagcagaatctctttnttngggaggtcctcgaagcataattgggagtggataatactncagctccaattgggagtggataatattccagctagaacctagtagaatctggttttccctgnngaggtcctcaaagcntnatggggtncataatactgaagntnagaaccaagcagaatcggtntccntgagggagnancnggacncatanantgntgantataanccttagtaccctggatattnntggnnggcagtgaccagcntatt

SEQ ID NO: 682996 - DNA, 492 bp, Homo sapiens
acttgagcccctgaaatttaacagatcgctactgaacacgctacttaatatacaccatgtgtacccctataactaggaatctaaaatctggaactctaagcaggattacagcatctagtatagaacaaccttcgtgacaagtatatttacaaaattgtaacttgaaagtactttcacacttacagaatggtagcaacgacagtacatgtaatactctgcaatatgtatacactttatgcagaatcatttgttaacatttagtgccatttgctttgtcataaggacttctatatacatgttttactcctgaaccatatgaaagtatgttgcttacttcaggcccccttgtacctcaattatttagtgtgccacggtacagttgtcaacttaaggtagtaaacatggctgcagttttttaaatcaaatgtttatcgttcatcttctagtttgtccagttgattcggtaatgtactttatttatatctttatttc

SEQ ID NO: 682997 - DNA, 97 bp, Homo sapiens
cagatttttttcaattctccacccgccaaaaggggaagggcttttccccagagaaaaggaaaggggggaaaaggggaaaaaacccaacccaaaacca

SEQ ID NO: 682998 - DNA, 111 bp, Homo sapiens
gcccccttcaccttcttacaacctcttcccctttacccaggggtcccgttctgcaatccagaaaattcccttaggtaagggctgggcagttaagtgtgaaattaatctaag

SEQ ID NO: 682999 - DNA, 1005 bp, Homo sapiens
  misc_feature (259)..(259): n is a, c, g, or t
  misc_feature (295)..(295): n is a, c, g, or t
  misc_feature (301)..(301): n is a, c, g, or t
  misc_feature (857)..(857): n is a, c, g, or t
  misc_feature (894)..(894): n is a, c, g, or t
  misc_feature (988)..(988): n is a, c, g, or t
cttcaggtatcaccagatgctgatcctatggaattaacatagaggtctcctcaaaaaagaagaagaatcacactggcctgagatgatccacacaaaatggagggagaagacaacagagcaagaccttctaagttatgaaaggtactactatatatcagtcagaacttgtcactctattatcgaaacacatcaaataaccctataatttgagacattgttgaaatactgtttcaggttttacactcttgcatgctagctncatttatcccttaatattaattttttgatggatctnacctcnccatgaataattaaattatggaaagatggttagtattgttacaaataccattagatcttcccactaacttcataaaaagatgccctagtgatcaccccatatctcaggtccaattctagacccttgcctttgattaggaacacccttggtacataattcttacttatggctcttataaaaataatatatataatttgcctgtaatggtcactttacaaatgtattcttcttaacgtcgctttatcttttggccctcacgcctttacaagggaactctccattactacgtgactatgcctgtatcaaggaatttctgtctagcggtatggtatttcactcaaacagagcgattaactttataccaccgaatagcgtatatcacttcttttaactacgtgtttaaccaaagtcccataggtggccacttatcaccataaaatgaccactgctttttgaagttttttcatatggcctcgccccccctaactatagtctccaaacttgacccctgattccctatttaatcggacgccatgttcttgtaacaaacctcggntctttcccaataggctcctctgtgctcttccttgtanaccccttcccttaccctttcccaacacccttatcctcttggaaatccagacctctctctatcacgacttaatgctctcctcgcgtgaggtgtgnaccccgctctccttgtt

SEQ ID NO: 683000 - DNA, 109 bp, Homo sapiens
accgcgtacatggcatgctgagcagctcagatctgaggacacggcgtgtattactgtgcgagaggagtggagggtggttattactacgcctacaggggccaggaactct

SEQ ID NO: 683001 - DNA, 151 bp, Homo sapiens
gctgttctagaggaccctgcggcgctacctgagtgcgggttccatcactcttctcgtgactccttctcactgtcgccttctttcccttttcctcatccttcttgggagcctcgctgggttatctctatttgcttcctcctcgtatagcacc

SEQ ID NO: 683002 - DNA, 188 bp, Homo sapiens
tcctcctgccattgcagcatcgacattccctcaggtgctgggatcagaagaatgggacgtggagaagggaaatgctggagggatcagccagacttgctcatatccctcacagcccccaaaaagtctgcaacccagtttaccggtcgctaccgttacctggggggtcgttttgtgccacctgctctgga

SEQ ID NO: 683003 - DNA, 901 bp, Homo sapiens
ggcgttgtagaccactgttggaatgtgcgcagctagttaggtacgcccgcctgtttatgggaggtgttgctctcatcaaacaataggcgtggacggtaccgtctatattaggactcacgatagtttgaagtgacctggttaaaaggtgcttggggtgcccgttctaccattagataatataagaatgttagcctcggggactcacataagccgtataaaagtggacctcttattggattggggttgacccttttcagtttgtgaccaaggccacgttcgtgtataatggggtaaaagacttggcctagacccagcacgttgtaatgtaaggagtgtaacacaaagttggaatgggtagttggtatagttgtttctgggcatactataggagggaagtcacctttggaggaaagttcagtgtgtcattgaccaacacatagtgtggactgacccaatgttgttggattgactcaggacacctgtgacttttgttataaatgttcaggtcgccccctgcctggtgttagttgtaacaggttagttagaacagttagtttgggaggtacatgggtaacagaggaaaaatagccagtatggtgtctagttggtgtgcggtgaaagttcgttactttgttcgaagtctaattgtgcgtgtacttggcctgaatgtggtgttctcaccttgcttgattttgcctgctgtttaaaaaaatatcaagacagtttcttcattttataatagcgttttattcatcatgtttgtattctgaatttgaaacctgctgtgttactgatcaaaaatgctttcagaggctgggtgcagtggctcacacctgtaatcccagcactttggaccagggcatcacgagtcagagtctgtctaccacaacccacataacaa

SEQ ID NO: 683004 - DNA, 422 bp, Homo sapiens
atgtccgagaacctcattgggtttttcccatttttcctatccagttggtctttttttttggagaccgagtctcactgtgttgtccaggctagagtgcgggggtgtgcatcttggctcactgcaacttcgtgcctcccaggttcaagtgattctcctgcctcagcctcccgagtagctgggattacaggtgcctgccaccacctccagctaattttttcagtatttttagtagagacagggttacactgtagtaggccacgctggtctcgaactccagaccttgtgatctgcccacctaggcctcccaaagtgctgggattacaagtatgagccactgccccgggcaatttttttttacaacaaagatcatatttatattaccaggtgatatgtcaaataagtcgggtgctgagggtctcttg

SEQ ID NO: 683005 - DNA, 728 bp, Homo sapiens
ggtaataaccgcgcgcggcgctcggcgtcccgcaaggtcgctttgcagagcgggagcgcgcttaagtaactagtccgtagttcgagggtgcgccgtgtccttttgcgtggtaccagcggcgacatgacggggtacactccggatgagaaactgcggctgcagcagctgcgagagctgaagaaggcgatggctgaaggaccaggagctgagccctcgggaagccgggtgctgccccccacaaggaagatggggcctatggagaaaattcgtgggaataaaattttggagaataaaatccccttgggagggaaaaagtgggcccagtgggggtatacaaaaaggagtatcttggttttcactcattgtactgtgtaccctgtctgggattatccattattacatgaaagtatcagtgtcttcttgaaaaaccatatggcatagttgaaaaagaaggccagattatcccctggtgatacaattcctggagactggagaagtaattccaccagtgaaaagaatttccctgatcaacatcatttaagaggatcatggtaaacaacggttaaagggcttatgagcctaagtgggtccctattataccatatttactgaatttcgggcaaaagtacttcaataaaggttatctctaaaaaaaataacgacacacacaaaatgggcgggcggcgagcccgaaaggttttagaccatgggggggggcccgggtggac

SEQ ID NO: 683006 - DNA, 698 bp, Homo sapiens
  misc_feature (271)..(271): n is a, c, g, or t
  misc_feature (334)..(334): n is a, c, g, or t
gagggcatgaatatcaaacgctagggggacagccactgtggtgtctgctaacctcatcctggtcactgcttctgtataacagccctaggccaggaatatgaacgaagtcgctgcttgtggatctctgctcctcacgcagaccatcgctggaaggcctttgtcgtctaacacaggaccgtctagtggggagagctgtttggtgatttcctatgagagatctgttacttgatcagtgtagaatcgttgcatcacaccagctggagtaagcctnctacatgagactgtactcttgtgtttctcgatgcctatagtgtatctctctcgtgacctacangcctctgtctacctagcaatagcccaagcgcagggatacatgagctagcatgagtttatacataaggaaaggagttggacgagtataagtctatacacttggcaagacacctaggagagttactactccaagggttatcgacacaagttcccggctccgagtgtcagcatctgtggtgagctgggagtcctcatcatggtattgctgaactttgggatcacctgggacacctttggtgaaacagggtctgcgacagggttacttggtggaagctcagtccaagattgtcctggggcaggaacaggatcctgatgggggcaagtttgataggagccagtgccttgtgagagagatggggatcgtc

SEQ ID NO: 683007 - DNA, 581 bp, Homo sapiens
  misc_feature (402)..(402): n is a, c, g, or t
ttagaagaacagttggatagactcatgcaacaattacaagatctggaggaatgcagagaggaacttgatacagcatgcaatcatgcaagcaaacccaaaaaggcaacactctgggagccaactaagtgcaatttcaattgcattcactcaacagcaaaattcatgtctggcacaatcatgcactttgtgtagcatgcaactcacagtggcacatgcagcttggcctattccaggccaagctcattcagcgctagtgtccgttttcacaacagccccgcaggcaggggttcatccaagcaatcttgcttttggccacaacatgtacaagccaacccgagtgctaacagacgtctaccggcaacaaaggcttcagccagcaggcattgtggatcagcaagaatncttgaattggctagtgaaaaaagcttgggaaatagaaaggaccttgttacaacttcaaagcaagtacagatgttgggcagcaatcaacttacgacaagacgttccttataaggggcaaaaaaaaaccgttatggggggaaaggcaaggcaaaaagggggctttgggaaaagtcgtgggg

SEQ ID NO: 683008 - DNA, 119 bp, Homo sapiens
ggcacgaggcttcgtggaggtatgccgggatgctactgtctcctttggacctcatgccggataattgagtcgcgattgtagatgttattgatcagaacagggcattggtcgatggacct

SEQ ID NO: 683009 - DNA, 366 bp, Homo sapiens
  misc_feature (8)..(8): n is a, c, g, or t
  misc_feature (47)..(47): n is a, c, g, or t
  misc_feature (71)..(71): n is a, c, g, or t
  misc_feature (95)..(95): n is a, c, g, or t
  misc_feature (137)..(137): n is a, c, g, or t
  misc_feature (140)..(140): n is a, c, g, or t
  misc_feature (166)..(166): n is a, c, g, or t
  misc_feature (175)..(175): n is a, c, g, or t
  misc_feature (192)..(192): n is a, c, g, or t
agttgganacggcctcctagggaaaagttcatagggtctcttcaggngcttagtgtcacttacctagattnacagcctcacttgaatgtgtcacnactcacagtctctttaatcttcagttttatcttgaatctccnctnttatcttggactgacatttagcgtantaaggtganaaggtcatagctgaganctgtgggtcgggtgttacgcacacgtacttaaatgaaagcatgtgggcatgttcatcgtataacacaatatggaatacagggcatgcattttgcaggcagtgagtctcttcaggaaaacccttttctacagttaggggttggagttacttccctatccaagcccagttacgtgg

SEQ ID NO: 683010 - DNA, 146 bp, Homo sapiens
gctcttggactctctgtaaaaagcttctgaatatgacttgtagccggctgagtaggctgtggctgtggacttcagcacaagcatcaacattgctgttcacacgacattacagtttacgtcacttccccaggaggtctggttacttt

SEQ ID NO: 683011 - DNA, 287 bp, Homo sapiens
agacgaccttgaaaaattatgctaagtgaaaaaatcagtcacaaaagaacacattgtatgttttcatttatatgagatgtccagaataggtgactgtataaagacaaattagtggctgtcagaggctgggagtgtggtgtacgagaggaaggaaatgggaatgactgctaatggtccaagatttctttgagggtgatgaaaattttctagtattagattgtgatgatggttgtacaactatgtatgctaaaagccattgatatgcacatttaaaaaggatgacattt

SEQ ID NO: 683012 - DNA, 275 bp, Homo sapiens
  misc_feature (29)..(30): n is a, c, g, or t
  misc_feature (61)..(61): n is a, c, g, or t
agtgggagttgaacaaattgagaacaccnncgggacccagggagaggaacatcccacatancggggccgttgcagggtgggggagtaaggggagggatagcattatgagaaataccctaatgtagatgatgggtgggtgggtgcagccaaaccacccctgcacatgtatacctatagtaacaaaccttcacattctgcacatgtatcccagaactgaaagtataatttttaaaaaatttaaaaaacaatatatgcttaatatagaaaagttgaga

SEQ ID NO: 683013 - DNA, 545 bp, Homo sapiens
caacgcatgtgccgctcccaacgcatgtgccgctcccaacgcatgtgccgctcccaacgcatgtgccgctcccaacgcatgtgccgctcccaacgcatgtgccggggcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaatttaaaatatctcaacaccatcaaaatccaaactaatctataacaataaatctacttaacaccccctcttctccaacttctt

SEQ ID NO: 683014 - DNA, 368 bp, Homo sapiens
gtaatgctttcaaggtttatacacattgaagcatgtatcgatactttatttctttttattgccaaataacattccattgtgtagagtatactgcgttttatttctccattcatcagttgatggatgtttggttgattccacttttcagctactctgaataatgctgctatcaacatttgtggaagggttttcgtaaggatatgtgttttcatttctctcgggctatatgccgtaggattgtcaaatgggtatactttttttttttttttttttggagacggggccctcactttgtttcccccgggcgtgtagagcaggggcacaaccacggcctcattgaggccttcgacccccaggagtttgctgga

SEQ ID NO: 683015 - DNA, 119 bp, Homo sapiens
cagcgtgcctgttgtagggagaacatctgatccgtattgaactggtttcaccaagcgaagaatttgactttgtgactctagtactacagagagccagataacatggcgcacatcgactt

SEQ ID NO: 683016 - DNA, 258 bp, Homo sapiens
ccgtaggacccagtttccttttttagctgatgtttttggccagaaccccgtgggctgttacttgctttgagttggaaacggtttgcatttacccctgtaaatgtattcctttttaatttatgtaaggttttttttgtacccaattttcgattttttgaaaagatgccccccaattttggttttttactgttttgtgagacccttaggccccccccccccgtctttgtgtaaggaaaaattaaagtgctcccgtaccca

SEQ ID NO: 683017 - DNA, 522 bp, Homo sapiens
caacgcatgtgccgctcccaacgcatgtgccgctcccaacgcatgtgccgctcccaacgcatgtgccgctcccaacgcatgtgccgctcccaacgcatgtgccggggcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaatgaaataaatataatattgatccttattatattgtatttaaatattttatgaaaatatt

SEQ ID NO: 683018 - DNA, 355 bp, Homo sapiens
  misc_feature (53)..(53): n is a, c, g, or t
  misc_feature (116)..(116): n is a, c, g, or t
  misc_feature (204)..(204): n is a, c, g, or t
tttggcgggggacttctggttcagacaagggactatcaggaaaacgcacccanaactgagaactcaggtggggcattagctaaagtggaggactccaacccctcagaagacttcanccactaaaaactggtttgaaagaatctaagcagccactggctgatgaagtcagagccagagagccgcctagagaaaggtgtagatgtnaagttcagcattgaggatctcaaagcacagcccaaacagacaacatgctgggatggtgttcgtaactacctggcagccctctctgggacctccctttcttcctaacccaagattcatcctgtgttgataatctaaattactctcttatgaa

SEQ ID NO: 683019 - DNA, 161 bp, Homo sapiens
ctctggctctgacacctgcctctccttttctccgtgctcgcgtctttcatgcttagttgcctctgatgtactttggcggtcttcctctttccattgtattttgtcatgacggttgactgtggtgtcaccttcatcttacggattttagctcgaactttggt

SEQ ID NO: 683020 - DNA, 457 bp, Homo sapiens
caacgcatgtgccgctcccaacgcatgtgccgctcccaacgcatgtgccgctcccaacgcatgtgccgctcccaacgcatgtgccgctcccaacgcatgtgccggggcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcggtcttggcatactgtgttcgtgagcgagagaggtaccgagccgcc

SEQ ID NO: 683021 - DNA, 164 bp, Homo sapiens
  misc_feature (85)..(85): n is a, c, g, or t
  misc_feature (137)..(137): n is a, c, g, or t
ggaaaaaagcagacctaagaagcttaaaacttacatggaaaataaaagaacacaaaatttaataaattgaagatggagcagtttntatccacaagggatatatacctaaaacaaaactcatgattgaaatattaggntggaaagagacataccagggtaatacc

SEQ ID NO: 683022 - DNA, 835 bp, Homo sapiens
gcacctttgaaaaggggccgcggcttaattccggaccgcctaactcccgcggcctcaaacaaatgcaaaatgggggagttcaacatggcgcgccgccccccctccccgatgttaagaccccggcgcccccccaagataggtcctgccccaacataatgggcggccgcccgcgacatacacaactgcgcgggatggtgagaaaaaaagcgctaatctcttcgcggacagctgtgtagaaggaagaagaagagagaggatatgcaaaccacgcgctgctatacagagtggtccacgcaggtcgcaccaccacagcgagatcttctccaacagcgaagacatttggaagaaaaaacaccctggtgtaaatactccccagagggggcgctctgtgtgaaagacatctgggcgagtacatcccccgcccccctctggagagagagtgaacgcctcggtgactccaccccccgcgcccgacgagaagaagacgccccatgagaaggggcaccccaacagcaagaacagaataataaaagagaaacaagcacaaggagcgaaacaaggaagcgaatatacaaaagccatacaagtgacaagtaaatacagggcccgcccaaaccccctctgtcgaacaggtagtctgcgcaccaaatcgttctggctgccgtagaccctcaaaagagagggcataagaacagatacatcacacaacaagaagagacaagagaggggagacagaagcgctatactaaccgggcgtgccagacgacaagctacgatagacgccccccgctgtaacagagaagagagggctccggctcgggagccacacaaaaca

SEQ ID NO: 683023 - DNA, 780 bp, Homo sapiens
  misc_feature (412)..(412): n is a, c, g, or t
  misc_feature (417)..(418): n is a, c, g, or t
  misc_feature (421)..(421): n is a, c, g, or t
  misc_feature (430)..(430): n is a, c, g, or t
caacgcatgtgccgctcccaacgcatgtgccgctcccaacgcatgtgccgctcccaacgcatgtgccgctcccaacgcatgtgccgctcccaacgcatgtgccggggcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcncatcnnaanaaacacatntgggtgagaagagaaatcacacacacaaatgaaaaaaaaacacattgtgggccgcaccgggacccatgaaaaagtatttcagaaacccattgcgttggggcggcgccgcgggcccacataatggtcaaggtggccacagtggggtcacagagacgtgtgtccccgaggaaaatcgcgggcgcaaggaacaacggtgcgtggggattctcccacccaatttaaaacccgcccgggggggcaacaaccgcgacggtttcttggaacaaaattcccagagagggagcttgggagcgccccatgcagggtttctaaccaagggggcttccaaaagacgactcgaatatcaatag

SEQ ID NO: 683024 - DNA, 191 bp, Homo sapiens
agacatgtctaattgcttcagtagagccacaatatgtatctttgctgtacaggtgcaaggaaatctaaaattctgggccactgagttagatggtaaatactgacttacgaaagtagaattgggtgaggcgggcaaatcacctaaggtcagcagtttgagcactagcctggccaacatgatgaaaccctgtc

SEQ ID NO: 683025 - DNA, 444 bp, Homo sapiens
caacgcatgtgccgctcccaacgcatgtgccgctcccaacgcatgtgccgctcccaacgcatgtgccgctcccaacgcatgtgccgctcccaacgcatgtgccggggcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcgaaagtgctactctggaagtggggtccgagcag

SEQ ID NO: 683026 - DNA, 510 bp, Homo sapiens
caaacgaaattcatactcataagcagtcactctggtatgtatccctcctccaggcccggcgaaacacaagtctacttggtgtctctggatttacctattctggacacaccatgataaacagagtaagacaatatgtggctctttgtatacggcttctttcacttagcctgttctcaagttttatccatgttgtatatgtattaatggttcattcctttttattgccaaataatattccattatatgggtttaccatattttgtttatccattcatcaattgatgaatatttttgttgtttccatttttcaactattatgaataatgttgctatgaacatttgtgagcaagtttttaatatggacatatgttttcaattctctcgggtatatacctaagaatggaatcgcttggtaatagggcaattctatctttaagattttaaggaactaccaaattactataatttccacgatggctgcaccatttcacattcccactagccatgtat

SEQ ID NO: 683027 - DNA, 766 bp, Homo sapiens
  misc_feature (99)..(99): n is a, c, g, or t
tgggacacaagaggtttcaaacaaccccacaggggtcttggtgaatacctcgagacgttgtgtaaattttagtttcgaatagtgttccgagttagcctnggacacttgggtgcttcacacaccccggttgatcgcccgcccattgtggggagggcgcccagtgccaggccggcatcaccctgtaggtccaaggagttctcgaacaccacccctggcgacaaacatggggggaaaccccccatctgtttgtcccgggatatcaccaaaaatctaggcgttgggttgtgtgttggttgggtccctgtaatccccagcttactccaggaggcttgaaggttagggataacatctcactttggaagcccttgggagtttaaagcgttcccacagtgaggccccaagatgcgccacccactgccactcccacacctgggccacaaagagtgaatcccccccgcgccccccccccccctaaaaaaatggccacggcatggtggctcacacctgtaatccccgcactttgggaggcaagaggcacggtggatcacgaggtcacggggttcgagacccgcctgacccacaatggtgaaacccgtctctactaaaataccaaaattaccgggtttggtggtgggcgcctgtaatcccagactactcaggaggctgaagcaggagaattgcttgaacgcgggaggcggaggttgcagtgaaccaagatcgcgcccctgcactccagcctgggcgacagagcgagactccgtttcca

SEQ ID NO: 683028 - DNA, 468 bp, Homo sapiens
caacgcatgtgccgctcccaacgcatgtgccgctcccaacgcatgtgccgctcccaacgcatgtgccgctcccaacgcatgtgccgctcccaacgcatgtgccggggcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtctgtttattgagatggtttcccactcatcttgactcagaggtcgacgcggccgcgaat

SEQ ID NO: 683029 - DNA, 358 bp, Homo sapiens
cgtctcggtaccccagtttgtgtcaatttgcgcttctccctccgggtccatgcacgactgtctggaaggccctgaagtcggtgagcgtgacttcagcgttctccggacacacgtctatcttgtctaccaccttgtctgcatcaaagtcgtcctggttcacgtcgccctacgctcgtcctgttcgcgtcctcctggccggggttaggcaccatgcggtagttgtcccgactgacagggactccgtcattgtctgcgtcgtcgtcgcatgcatcaccctgtgcttcgtggattgagtcctcctgggcactgttaggcaccgtgtgacagttgtatcgagagttctgacgtacgtattcat

SEQ ID NO: 683030 - DNA, 363 bp, Homo sapiens
aattcgcggccgcgtcgacacggtgcgagaagacgacagaaggggcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttcttgggatgaaagccctcgacatgaagggatcctctagaaacgacgcagca

SEQ ID NO: 683031 - DNA, 396 bp, Homo sapiens
  misc_feature (346)..(346): n is a, c, g, or t
  misc_feature (351)..(351): n is a, c, g, or t
  misc_feature (355)..(355): n is a, c, g, or t
  misc_feature (360)..(360): n is a, c, g, or t
aattcgcggccgcgtcgacacggtgcgagaagacgacagaaggggcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggagggagcggcacatggaattttatcntaagngtcnggacntactaaggtaatagtgggagaaggcaattttgcgct

SEQ ID NO: 683032 - DNA, 1420 bp, Homo sapiens
  misc_feature (1420)..(1420): n is a, c, g, or t
gggcatgtatcagagagagtcccgacgaggttctgtctcattgcattcaacaagtgtatagagacaggaacagaatccgagtggacatcatcttcacagcctccgaccagcccatccgatataccatacatccgcattgaaaccctctcgaggacccatacttactcgagccactcttccatgcattactggaggacactgcacaagacaccgtattataaagatagagttaggctaccattcctatgccaaaacccaagcacagtgacgactaccacagaatttcagtccaggaaaattaataacgcagccgaaacgttgacaagcgaagacacgatccaagcaagacctaggatacacacttcttggtcacccttagccagagacactaccttaaacaagccgtaccccttcctactacatggagaacttcatgataatatagagcggcagcattgattgtgaggacatcgtggggaagatggacgattgcacccccaaccttatacttacaacggcggaaacttgtgtgaccaggaaggggcagacaggcagcgcgacggggccataccgagcaagcggatctatccattggaacaggattgccaaacaaacccatggatgtggacaggacaccgagcggcactcatcgattatccaagtgaaacaacataaaaacgaaaaggcacagacgtcggacacaatgaacctagagcgttacaaaacacccccagaaacggcaccaaagacaacagcacagccaaaatgggacccatgcgcaagcaacaaacagccatgacaccccagggacacctgaaaagagcgacactacaacaacaagcccccaaggaggatcagaggccccggaccaacggcgaacaccacaccaaacatagatgagcaaccatgaccgatgaaagcaactaccaatacccattcagcaatgaagagaacgcagaaaaggcatacatcaaagagaagaaagcaggagacaaaacgaggaacagagagcctccagaaagagaagagaatgccccgacagacactgcaaccggaaagcataccaatcgcgacaggcactagctataaacgacggaaaatagacgccatgacggacgccagaacccgtacttgaaggcaaccatgcagaggtaacgaggaagaggagcaaagaactacctcaagcaaagtacgcacgtacacaccctcaacgatggcacgaaaggacaaacgagtgaccgaccaacagagactagaaaccacacgtcgctctaccgcagaagcatcaacctctgcgagcgcgaaagaaaagacagacagccgcagagacgagagagacaagaaagagagggaaaccaagagctgacaccgacaccgctgtacgtcgagagagcagaaagacagcagatagtgccatatn

SEQ ID NO: 683033 - DNA, 248 bp, Homo sapiens
gtgtactccctgtggtactcctcccatggatgttaatgcccaggatgctataaaatcaccacggtctttagcatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaa

SEQ ID NO: 683034 - DNA, 524 bp, Homo sapiens
gagcggcggcgggcgcagctagcggagtcggccgcggagcggaggtgcatgctcggcttccgccggtacaccgttcaacctcgtggcgacaaagttgtccaacagagtgaaaaggcagggagtatgagctatgatagagaccgtatgagggaaggaaagaagtgggtaccgcggtacagcaggcagccccttcgacggcactaagtcatagaagcgaggaccgaccgaataaagagcaaagacgagaagccaacacccacaaaaagaagtagaaaaaggcacaaagagacaatagacacaaagaaaacaaaagcgcaaatgatgaagctaacaccacacaaaagagtcaacaacaaggcaacaaaaacgcccaaggacaaaccgggaacaagaacaagaaacaaaacagaaaaaccaaaaaaacgacaccacgaaaagaaggcgatgcaaccaccaaaaaaaaggtcaacaaaacaaagcagagggcacaaaagaccgaacaacaaaaagaccacaacaacaaa

SEQ ID NO: 683035 - DNA, 704 bp, Homo sapiens
  misc_feature (405)..(405): n is a, c, g, or t
  misc_feature (412)..(412): n is a, c, g, or t
  misc_feature (430)..(430): n is a, c, g, or t
  misc_feature (479)..(480): n is a, c, g, or t
  misc_feature (521)..(521): n is a, c, g, or t
  misc_feature (564)..(564): n is a, c, g, or t
  misc_feature (638)..(638): n is a, c, g, or t
  misc_feature (640)..(640): n is a, c, g, or t
aattcgcggccgcgtcgacacggtgcgagaagacgacagaaggggcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagcaagatgagtgggaaaccatctcaataaacacattttggataaaaaaaaaaaacaaaaaaaacaaaaaaaaaaaaaaaaaaacaaaaaacaaaaaaaaaaaaaacagaaaaaagaaaaaaaaaaaaaaaaaaaaaaaaaaaaaaaaaaaaaaaaaaaaaaaaaaaaaaaaaaaaaaaaaaanaaaaaanaaaaaaaaaaaaaaaacnttgtgggcccgcttggcccaagcgcttttaaacttgggcaaggtttagnntggggcccgaattcggggctcacttggcaaattcccccaantgggggggtattaaaattaacgggccggggtttaaaaacgttnggactgggaaaacctggggttacccaacttaaatccctttggagaaaaaacccctttttgcaaagtgggaatancnaaaaaggcccccaccgaaacgcttttcacgttggcaaacccaaatggcaattggtttgagcctt

SEQ ID NO: 683036 - DNA, 268 bp, Homo sapiens
gggataaataattgaaagtagtgttcctatggccttagtgtttttgtgaaaagggtaaatgtagtgaaaaaggttttttcatggccttaataaaaaagcccttctgtaatatatatatttttttgtaaacctttccctgaagggccaaaagttaaattataactaaatccctgtgttttcagaatgatatttaaccccaaacccgtggtcaaacccaaatagtgggttgaagtgtattattcatcttttagtgccttggcaattgcca

SEQ ID NO: 683037 - DNA, 310 bp, Homo sapiens
gcagatccctcataggctgttggagttgcaatggtgtgatctcagctcactgcaccctccgcctcccaggttcaagcgattctcctgcctcagcctcccaagtagctgggattacgggcctgcaccaccacgccgggctaatttttgtatttttagtagagaccgggtttcaccatgttgaccaggctggtcttgaactgacctcaaatgatccacccacctcggcctcccagagtgctggggttacaggcatgagccactgcgaaaacagaagagaacttccaccaggtttgcaactccaacagcctct

SEQ ID NO: 683038 - DNA, 1145 bp, Homo sapiens
gcgtacgaggagggtaggatcacttgaggtaaggagtttgagactagcctggccactatggtaaaaccccatctctactaacaaataccaacattcgccgggcatggtggcatgtgtctgtagtcccagctactcgggaggctgaggcaggagactcgcttgaacccaggaaacggaggtcacagtgagccacgatcatgccactgcactccagcttgggcatcacagcgagactctgtcaaacacacaacaaacacaaaaaccaacttacagaggtaataatagcacatacatatcttatgccagcagatataaataaacttggacccatactggtactacagactaaagctagagacatctaaacagtagcatggacaagccatggcacagacaggcccatcctctaacaggggatgccaggaatggagcaaagcaaatcagtaaccaagctcagccaccagacgaccaggcagtcactcatataaacttgcagtctcgacagtcatcgcaggccacgccacgccagaccttccctgacacctcacactcatctggctggtcacactccatattcccacccagaccagaataccctgagttgctcgagcaagactcctagaccaacacacatcacgaagactccccttgtaaacttcacgccaacagaatcccacactgtccaaaacctattccagtatcagaaccagcgcacgccaaaaccagggtggcatacccattcatgaccaaggaaggcaaggagtgtgcccatgatactgcgaacacatggctgcacgccatctcacaataagtcgtgctgacataaggatgccacacatgagatggcacacaccatctagaaactacacctaacgacgctcaaccagaaacacgtccccatatgctctctacgaccaccagacaccagaattggtagccactagacaagcacaaccagagtcaacgcgacagagctgaatatggcggagaaagggaaaccctccatccaggacgagattcgaatcaaaaccgaaagcaggcacgccaacgggaagaagaccacatgagaaacgcatgtctgaagagagaccaaaaaaccggcagcgtagatggagaagaaaaggtgagcggagcccaaatgcaac

SEQ ID NO: 683039 - DNA, 245 bp, Homo sapiens
  misc_feature (50)..(50): n is a, c, g, or t
gggaaggggtctttggaaaggggagggaagagtgggaagggctgcatctnatggcttgagtgccagctcagccacagtacactagaacaccaagtagacttctaaggtttttaactgcagtccctggctcccagacagcacctctagacctgcccacggcctgggggaacttgctacagaggttacactgagccgagatcatgccactgcactccagcctgggcgatacagcgagactgcatctc

SEQ ID NO: 683040 - DNA, 290 bp, Homo sapiens
tagatatgtggtgtaggtcacagacatggctcggatcccgagttgctgtggtgtggtgtaggctggcggctgcagttccgatcagacccctagcctgggaacctccacatgccatagatgaggccctaaaaagcaaaatagacaaaaacaaacaaacaaacaaaaaaaaccaaggacattggatgcccatcatctaattctgctgcctcaggtacagatgtagaaaatgaggttcagagattctaaaactactgtgttcaaggccatacaagtagtttatccattatatc

SEQ ID NO: 683041 - DNA, 633 bp, Homo sapiens
  misc_feature (2)..(2): n is a, c, g, or t
  misc_feature (5)..(5): n is a, c, g, or t
cnacntacagcagctatccaagcaggcactggccatggctcaagtgcaagtccagttcacatcatccaggttcgagagatcgcgcacattgagcgggacggctatgcacagatcttgagggatctgggtggcattggtctgggccaatgcttgtggcccctgcattggccagtgggacaggaaggacatcaagaagggggagaagaacacaatcgtcacctcctacaacaggaacttcacgggccgcaacgacgcaaatcccgagatccatgcctttgtcacgtccccagagattgtcacagccctggccattgcgggaaccctcaagttcaacccagagagcgactacctgacgggcacggatggcaagaagttcaggctggaggctccggatgcagatgagcttcccaaaggggagtttgacccagggcaggacacctaccagcacccacccaaggacagcagcgggcagcatgtggacgtgagccccaacaggcagcgcctgcagctcctggagccttttgacaagtgggatggcaaggacctggaggaactgcagatcctcatcaaggtcaaagggaagtgtaccactgaccacatttcagctgctggccctgggtcagttcccgggca

SEQ ID NO: 683042 - DNA, 964 bp, Homo sapiens
cggcagtgcagacatgactatactccccaaaaagaagccgacgcctcccgacgccgaccccgacaacgagccgacgacgaccgggccgatgcccccggcgccgcggcgcggcggaggtgtgggcgtggtgcggcggcggcactggtgctgtgtgtgcggctggcagatcgcagaccgtgactccgtgcgtctgtgggtgggcccgtccgcgagcttcgccaccgcctcaaggcccgctaccaggaccgccgggcgctcttcatcgcctgggcgctggccgtgccgcctgtgtgcaagtggcgtggtccccgtgccacaagcaggcttctcgcaccgtccttgcggggtgcccaggtggtccctggctggctggtccctggctggacggcgctgtggcgcagcatggctgggccggggtgttgggtagcctgctgggcgtagcgtggtaggcgtgtaggggtggtgccgtaagggcgtagcggcggcatgctagctccggggccttgggccacaggcaatgctgggcgaccgttcaagctacccgggggttgcgcgccggttggccagcggtggcagtaccacgagcgtgacggcaccggacaggcagcagggctaaccaaccagttgacggacgaagtatgagggccgggctgacaggcaccggcaatcggagcggctatgggacccctgcacacctgtacggcagcaggcagcgagcaatagcggtccaggaacacagggccctaacgagcacaacgaacggccttcatccatcaaacgcagatgcacggatggataggcgcccctggacactacccgggagctgaaagcatgaacccagggtgaactggaagaccaagggacagtgcaatgaaggatgaccgaagaggccagttgccagggagctaatctgcacttgaacaaatgcccgagtaacggcgccgagaaactgtcacaagacgga

SEQ ID NO: 683043 - DNA, 1119 bp, Homo sapiens
taggcctgacttacaagtgatcagattgactcccctctggggtccccgccacactctgctatcaggttggagtcccaggctgggccctggtggggtctccagggagtcccatcatggacattgaatggagcaaggagggactctggaagcttcctcctctttctctttccctcccaacacccacttggctaattggactatctgtgggacagaagccgggctttctgtctgggccaccactcccaatcctggagattggagagagcataggatgtcccggccccttccctaagccttcggtctggatagacctcaacatcacctctgcaataatgtctgtgtcactctcccatcggccacaggacctggagaatgcactttattctggggggtgaggcggggaagcccccatcctccttccttgctgctcctggggctcagttccacaggctcctttcctctccagaatcacatcacaggcacacaaaggccgccaggcaatctcagccctacacaggcaccatcccttgtggctcagaggaagagtggccgtggcagggagcagtcccaacgtcctcctgcagaatcccactttggaggctaagaatgagactggtgtgaccagtatgactcaggctcggcaggtgtctatctcccagtcttccctccctcttgagcccggggtggcgctggccttctggaggtcagaacccaacaagcacaagaatgggcatagctggcctcgaccactgctcccccatggccctccttttgtgccccaagctgacactcactcacctgcccctcctccagctgcctgctgctcactcaaacttctgttcacatgtattcatcttccggtcagcagctggttcctggacatcagagcggcggggcctggacatcaggtggcagacacacctgtctatcttcttggtgggtccaggatcatcctatatctggtttctcctcctccaggactctttccccagtccctgtgctcactcctctgtatctgccccaggttcttctcattacacagagaccagttgtatttgtgggatttcacccattattaattaaaacctatatttataccagtaaaaaacaaaaaaaaga

SEQ ID NO: 683044 - DNA, 1212 bp, Homo sapiens
agcggatcttgtgtctggcggctcggctgtaaggaggtggcagtgcacaaccacaacacaacggccgggggcaggagaaggcggcagcggcgattcttaagcggcccaggcggcggggcagcaggcagcaaaggcaaggagggttgggcgggccgggctttggccttccgtgctccttgcaaggaatttgggcgggcgggcgcgaacccggggggaaacccgagcaatttggattggttcccaggcattcggccgacttggttccaaaggaacaacgttcaggcaggtggttcccgtggggaccttggaattcccaaacaggccagggggttttcttaatcttgggttcacacctgggccccaggtaccggatggtttggttcccggaaagtggccccttcgggttggcccaaacaccaaacggggcacattggggccaacaggacaaaccgggcacaaggatggacaatggccaaggaaccaatttatggaaccggaagtgcgagcacctgttttaactttccacgccaggggcacagagactggttaattggttggttaggcggggcccaattgaaccatggccacactggacaaatgtctgggctttccgaaggaaaccaatttccccacacgttagtttccccttgcggtttcattccacagcgggccctttgcacgtagcgagcctcttgtgatgagccgcttcgcggaggaaattctgggatttaacacgccaaacgcggatttcaatttccgctttttggggttggggggagtagattcacaacagggacttgggtgttaaaaccccttataccaatttggacgccgaagagtgagccacaccttgtggcccccctacgggataggtgcgtggcttggaaatgtccactttttatactccgtatccccaccgaaggagattatccgtacatcgcccttgggcatggagggtcacacggggaatggggcgaagcccaactatcggacggtgtataacagacaaaacgctcgggtgtgagtcaccacgtgacacgggggttgtactctcactcacccacatgcgagacacccccacgcgtgaccgattccggaaggctgtgcaaaggcgacacttccacaacacccacggaccgcgtaaattaggtcatgagcacgcttggtgattcaccaccactgggaccccgttctaacccacccctgttagaa

SEQ ID NO: 683045 - DNA, 104 bp, Homo sapiens
ctgggttgtgatgtggaatgactgcttgagccctgagttcaagcttgcaatgagctatgatcatgccactgcactccaacctggtgagacccctgtgtgaaaag

SEQ ID NO: 683046 - DNA, 397 bp, Homo sapiens
tgtgtcttgtgatcccctcgcgacggggatatcaaacgtggttctcactacataggagcaaataacggctcatctaaggagctttataaaaatttctacacattaacttcaatccagaggccctgccttatactcttgcagtgagatcccgaagtggtagacttaacagaagtaagtcaacacaaagggcactctgatgctacatgagaacacccaagccaataaagacggctactggcctccacacatctcccttcccttcttcattccaaacatcccatagggagcagcaccctaagtaggtcgatgtcctctaaaggaacaaaaccgaaaccacagagactgaggggtgatagagtctcaatctcaagccacagagcacacaatatcctcatct

SEQ ID NO: 683047 - DNA, 558 bp, Homo sapiens
tttatgcttgcagagtgttttcattcctgggagataagtgttgaagtattaaaaagtaaagtgtcagatgtctgcaacttactttcaaatgatttagcaataaaaaaaaaaatgtgcatgcccgtgtgtgtgtgtgtgtgtgtgtgttggagagtgggtcagagacgaatgttgggacatgggagctaagggcttctgggaaagattcccgtgggggactgtccagtgttctcagttgtccctggggtgctacttctggccggatgggcacttcgaccagccggtggtccctgggaacccaaaagcaacatgagacatttggggattctgaaagcagcacattgtgctggggggcctgcctccttattccaatgttggccaataagcccctataatttgagggacgaggaaccatccagggttcagagtgcaaagcccaacttgagaagggaacggagtgagagtctctgtggagcagtgcgagtcatcgtgggctgatgtatggcgagatcccttttgcaagccttgtatacacagttgtaaacagtgtgtgtccta

SEQ ID NO: 683048 - DNA, 262 bp, Homo sapiens
  misc_feature (105)..(105): n is a, c, g, or t
caacattatgaaaatactatggtatgagagaataagtatttggaaaacaacggataattctttaaatccagaactactttttatcttctggatatcatagaaacnatgttcattgtaaacttcttgagggggcatccattgccccagataaacgtcccaggtgatttgtaaaacaggaattctccttggtgggtaaataaagattaggggaagtttttgggaaagcaaacaaggcccaaccatctagtgggggtcagtctca

SEQ ID NO: 683049 - DNA, 479 bp, Homo sapiens
gagagattctacagcacatgcatgaatgaggaggaggtggtgtcccaagggcatttatatctttgctctgtatttggaggagaatggagagttccaaatgatcagagcttgcacattactagatcccctttctagggaaaatgctgcgatcaattgaagttgtcatcctcatgaagctcatactgttttgcctgaaaaataaatgtaaatgcacattcttggtcttaaaatacatagaaacaatacttttttccctgctactagctttgtaagataaatagggttcatgtttaacatatatactcaatacttgggcaatttgtcttcatctaatgaattattatttaccatttttaaattatctgctcagattacaagattctttttaacaataaccaaattttaattagtaaaacttttggtcactttatattttctgatgtgcatattacaataaaatattattttgctgaaaaaaa

SEQ ID NO: 683050 - DNA, 113 bp, Homo sapiens
gggctaaagtgatactactaagggagactatggtctgtagtacatagcgcagggtagataggagcaccagaggctagctatcggcacctatagggatattcgctatattacac

SEQ ID NO: 683051 - DNA, 194 bp, Homo sapiens
ggggccccccggggggggggggttggggtttttgggggggggggggggggggtttttgggggctttttcttcccccccccccccccctttggggggggggccgggggggccctttttttgggggcccccccccccccccttctgtttttttccccggggggggcccccccttttttttttttttttttttttta

SEQ ID NO: 683052 - DNA, 998 bp, Homo sapiens
gctcttcctgcagtcacgtgtgcaattccagcgtctttgattcccagttagcagtatgctccaactcacgttgctggcaagggccatttgagagttggtgagctgaggttcaaacgtccccctgcattctctctacctggcagtgccactgggtgaagggaagacactttcagggagaggagtgctacttacagatctattggtgagtcatgcgcatctatcagcatccagatcaccagtggcatctagggagctgctggctataaaagggatcatccagtggagttgtaaacgagggaaccatcttgcaagatctaggaccgacggaaggggagggatgtaggactggagtctgatacattaggcctctagggagcacttgatgacatgacgtgtcgtggctctatgagagatctacttgggatgcatccaactgtcccatcccctgttaatcccatggcacggaacagtgatcggtggccgcaggatgcaacccagcaggtctgcctggaaagcttcgtctccacatcccaggctggggattgaactcactcatggcgatggtgatactgatggtcgactcttaaacccggctgacttgacgccggccacggtgcaatacatcaaaattcccacgggatgtgtgaagcaaccgtgggacagtcgacaagccgcgacgcagacacgggcactgggccgtcggagtaggaccaagggggaggccatccatgtctcatttcaggataagtgccgcgaataaagtcattccccaaagcaggcccgtggcacgagcggatagggagtctgggtggggccacagcgacccaatgcagctgggcgtgggaacgtcggcaagcgggggacgcagcccatagggacaagcaatccatcggggcgggaaccccccggaaagggaaggcacgcatcgggaggggagaaacccagaggacctcggggaccttggcctgagctccacacgggggccacgcgaagaaccg

SEQ ID NO: 683053 - DNA, 167 bp, Homo sapiens
  misc_feature (59)..(60): n is a, c, g, or t
  misc_feature (69)..(69): n is a, c, g, or t
  misc_feature (122)..(122): n is a, c, g, or t
ctgagccgcccccatgatcttgcccgagcgggtcttcggcaggccaggggcccactgcnngtgatccgncgcggcaatcgggccgatctccttgcgcaccccgccaccagttccttgtgcantcgtcgctgggggcttcgtcggcgaccagggtgacataggcatag

SEQ ID NO: 683054 - DNA, 170 bp, Homo sapiens
tatggtatgacaggggttatattgatattgtgtgatgagattgatggcccctaagatagaggagacacctgactaggtgtaagcgagaagatgcgttacggtctacgtgcatgctccacggtgtgcagtatttccctgctagcggagggtagactagttcaagctgttcc

SEQ ID NO: 683055 - DNA, 491 bp, Homo sapiens
cggggatcctgaggtcatcatggctctgaagtctctagtcgtgttgccactgctggtcctggtgctgctgctggtgcgggtccagccttccctgggcaaagaatctagagctaaaaaattccagcgtcaacatatggactctgactcgagcccgtcttcttcttctacgtactgcaaccagatgatgcgtcgtcgtaacatgacccaaggtcgttgcaaaccggtgaacactttcgttcatgaaccgcttgtagacgttcagaacgtttgcttccaagagaaggttacctgcaaaaatggccagggtaactgctacaaatctaactcttctatgcatatcactgactgccgtcttactaacggatcccgttaccccaactgcgcttaccgtacttctcctaaggaacgtcatatcatcgttgcatgcgaaggctctccgtacgttccggttcatttcgacgcgtctgttgaagactcttgaagtcgacctg

SEQ ID NO: 683056 - DNA, 330 bp, Homo sapiens
acctctgtctatggagactttagctgtaagggaggagccaaaattgacagcccagggggggatattgggctgagtctacagcgtgtcttcacagatctgaggaacatggatgccacctggctggacaacctttctgaacccagttcggttgccctccatccagggcatttcctgttcaccgtggcagggcccctggggcccttttatttctttaggcaagcgggacctggcatcatggtggatatggtgcagagaggctggatttttttggggcccttaacagccaagtgttaccccattccaaggtggggtggggcttccttccttggg

SEQ ID NO: 683057 - DNA, 153 bp, Homo sapiens
cagccaagcagcagtgcccacggagccagagtcagcccagacccttcttggccctatggggagcctagggctaggtgagaactaggccagcactgcgatcctgagccaatccgccttggggctgaggtttgtgccccgagcacagtttccctt

SEQ ID NO: 683058 - DNA, 148 bp, Homo sapiens
  misc_feature (148)..(148): n is a, c, g, or t
gggaatttgcagtgtggttttcgagcctcatgccgctctggcgaattaacccttgacttctattctttgttgtacttaatttagcctaagccaggcctttctttcatgccacctttactccatagccaccatttccttgttgtttaan

SEQ ID NO: 683059 - DNA, 1283 bp, Homo sapiens
agctgtatgtactagcgctgaacgatgcataccttacttagggacagagggagacgatatactgctactacaaactcgatagtccttcctctattagtgatgtataactgaagtaatagctatccgcttagttcgtcatacgtctatctcgtcactagagtctagtcaaagacacacaatattgccctctttatatgcatgcgtagttgatgcacgtagtacgccactaccaatgatcattatgatctgcagatgcggatatccggtactgctgatgacgatatgtccatacatacgcttgtctaggtcatgctagacagattaattggcccgtatggagctatcgaatatcagtaatcgcataatagccttagctcgtgaagaggcatagagtgcaacctaagatcgggtcacctagagtgaggacttgattcgtggagggtgagcacgattgttgaacgcaattgcatcgattgtgtcgcacacttagacgacgttctttaaaggtacggaacatgttcgcatcgaatcgagaggtcgcaatgcgtggcagaatcgattgggcgcgttgatataaagaagtgtcccacgaactgatgtgccaagtacttcgcactaacagttaacccctatactctggtttcactgctgtagagcaagcggaggaagaggttggctatcacagatgacgcaaaaaggtgactgtacaattgtgagaaaacggccagtgtggtttcaccacaccggcaagatgcacttttctttttcgccgtacaactggtaaacgcactcagcctatataagcgagtaatcgcccacgttcacatagcatcttttaataggcccagtcggtgatatcgctattaggcgccaattgagaattgtgtccccaataaattgccgcaacgtttgggtttcagattctggtgcgtacctggtgtgggaaagaggggcgcctagtgcctggcacctgtcacgtttggaaaagttttacgaaagtgaataggaaaatttgcccattcaaatccggtttcgaggggccgcacacatttggaagtcgctgaaagcagtgcaattagggtcgggttctgttcggggtgacattaccctgttgcctaggttcggataccgcagcgataaacgagaagaagatccattcactgtgtgtcgaaaggggtgttaggttagacggcgcaaattgttcagactctagggggcccatacaggacggaaggagccgtcatttcttccgcaggttcacgttcgcggaaatagcaatagat

SEQ ID NO: 683060 - DNA, 330 bp, Homo sapiens
tacgaggacgagaagatggagtaaaaccttttatgaccggtgctgctgaacaaatcaatgcacatccttgctacattcaaaaactaccagttctttattgtgtgaaaacatgaatccagatggcatggttgctctattggactaccgtgaggatggtgtgaccccatatatgattttcttcaaggatggttcagaattggccaaatgttcaccaatgtggcaatgattctggatctatcacctgtcatcataactggcttctgcttgtcatccacactacaccaggacttaagacaaatgggactgatgtcgtctcgtctctctcttgta

SEQ ID NO: 683061 - DNA, 250 bp, Homo sapiens
ccccccaaaaaaaattttgggggggggcccccaaaatttttttccccccttaaaaggggaaaacccccttttgggcccccaaattttttgttttttaagggggggggaaattgggggggggcccccctttgggggggggggaaaactttttttttttgggggttaaaaaattggggggggggcctgtttttttttttttcccccggggggcccccccttttttaaacccccccctttttttcccccttta

SEQ ID NO: 683062 - DNA, 370 bp, Homo sapiens
agcacagcatactttatctcttacagtttctggagactggcaatcccgaaatctacgatgccagtcggtctagctttctgcgtgtgtgacctcttcctgacttcctcacacggcggggagagaaagggatgacacaagctctcttcagtgttttcttatatgggcactagttgcatccggagggttctaccctcataaattacctccaaagcttctatctccaaatgccatcacattggggattaggatttcaacatatgacttttgtgtgacacaaacatttagcccatagccgagaagaaataaaacagtagttttcaggtgatgggggaccctgggtttctctgtaggagaaggaatgctgtccaag

SEQ ID NO: 683063 - DNA, 535 bp, Homo sapiens
cagtgctgggcttcacttgaactagagaaatgcaaatcaaaaccacaatgggataccatctcacaccagtcagaatggctgctattaaaaggtcaaaaaataacaggggctaatgtggttgtagagagaaaggaatgtttatacactatgggtgggagtgtaaattagttcaaccatggtggaagacagtgtggtgattcctctaggacctagagtgggaaatgccattcaacctaacaatcccattattggtcttctcttggttctctagttctttcggtggtgtgagttggttaacttgagaaccagtatggttaaaatggccatatgacccaaggcaagttatagattcaatgccatgcctgttaaactatcatggacattcttctcataactagagaaaaactattttaaaattcatatggaaccaaaaaaaaatggccaaatagccaaggcaatcctaagcaaaaagaacaaagctgacggcatcatgctacctgactttatattacaggcctacagtaaccaaaacaga

SEQ ID NO: 683064 - DNA, 836 bp, Homo sapiens
  misc_feature (143)..(143): n is a, c, g, or t
  misc_feature (481)..(481): n is a, c, g, or t
  misc_feature (559)..(559): n is a, c, g, or t
  misc_feature (627)..(627): n is a, c, g, or t
  misc_feature (666)..(666): n is a, c, g, or t
accaggtcaacagctatttctgttgaccccatctgaattaactgggcctcgaagctaaacctgacaattttgcggatcctgcacatctggtctagggaagggaaggtttaattcttgaacaaagaccaaagacttaaaagggngtttggtgcatcaagcttaatctctttctaagggaccttaataagaagggcaactttgtggtgcttcaaacttttcttactagcaagatctgaggcatgttggagcataaatatttctactaggatatgaagccctttaactatagtggtttattctttttactaggatggatttttaaccttccagtggaatgataaaggctaagtcacttttcctaagcaaagttttaagatgatttttagaacaggtttaggtttacagcaaaattgagagaaaggcacagagatatcccatatactcctgcccccatatacacacagtctccctactatgctgnagccatatttacagcaacttttccggaaatgtaggattagaagttaggctttctgaattttttcctttaatttggttntagatttttttaatatggggaagacattgcttttcttctgttagatatagtagggtttgggaatatangaaatttttagaactaaaaatcaatttcttcagaaattntgaagggcctggttaataaccttttagattccaggaccactattaagataataaatttttattatgattctaaacatggggggttgggccttatttcctcttttggaaagagggagtctctttatttttggggcgccgaactaagatgagggaactagttgggggtgttt

SEQ ID NO: 683065 - DNA, 1554 bp, Homo sapiens
  misc_feature (700)..(700): n is a, c, g, or t
  misc_feature (1553)..(1553): n is a, c, g, or t
cgcgagggagcgaggcacagacctggctcagtgagcgcggggggcgagccccgagtcccgagagcctgggggcgcgcccagagccggtgcgccgaccctcctctccgctcccgcgcccatccccttcggcagggctacaggttatttttgatcgcgtgcgcagatcaagccctcgcttccgtcctcatcgctcggcacgagcctcgctcgctcatgcgctggtgggagcctcagcatcagtaccgccagtccgtggacccctcgagtcagcggcgagctcccaagtactccactcgccttaaccactgcagacagtccaattgtgggccacacaggtaggctgacatagaacgcatccagggtctcgcgggctcagggccgggcactaagtctgctcgatcctacgatcagtgttggcccatgtatctcggtagcaagcgcaggccgaacgtgctggacctactgtctggattgctctggactacatcagaagctcagctaccttccacgcagtaggaaggcaccgcattcgtactaatagtgacgacttacggggaacaggtcggcgccaactctatagaaggtccggatccccgcaaccatataaggcgccttttattgccacataacgaatgcccaaatcttccccgcgtagcagatcgtcatggtgccaaggaggcgatttggtctagcacggtcnttccaaccgtgagccggggcgtgattcctagcttaactgggtggccactgtgggcgtactcgcaaagggttccttgatggaggcggacagggcagggcaatagagggtcctgcagggggccccgacttcgggtgcctaaggaaaggtggattttttccacacttaaggaagcagttctgatttgaacgggatagggaggcgcccggtagtgtattagacctcgctaataaggcagcggccccatactgaaagcgccccgactgagcaggcccttggaaggtcccgtgacagggtaccacaacgggccagggcttgggtaggggcacagggggaccgaaccttggtgggcccacgagggttccaggcaaggcgcgcccggggagaagcggccaaacccccgtgacgggatgagtcccggggaagacgcgggggggggccctggagggggccaccggggaagagaccgagcgccgtaaaaggtggccggaggaacggagacacagcgcctccgcaaccacgtggagaagacgacgggcaaaatgatgccgccacgcggggagtctcacgggagggagcgaggggcgaagacgggtccccccaaagaccaacatgtttccagccgggtgtggggacaccccaccgactgatgcagcgcagggcaacatgctaagaagaacaggacgccgggagatgtgcacaccatgatggtagacaaaagacggcatgtatcgtaccagcacgagcgaacacacaatacgggggtgtcgtgcgcgaccaacaggcagagagcatggctgcatcacccgaacgaacgagggcgacaaacaccctctgctgccacgtctgctgacgng

SEQ ID NO: 683066 - DNA, 1043 bp, Homo sapiens
  misc_feature (92)..(92): n is a, c, g, or t
cgtgacgcgtggtgtcagagtccgggactggtcggcggcggagccgggggacggcgacagcgggtcggcgggccgcaggagggggtcatggngtaaagactactaccagacgttgggcctggcccgcggcgcgtcggacgaggagatcaagcgggcctaccgccgccaggcgctgcgctaccacccggacaagaacaaggagcccggcgccgaggagaagttcaaggagatcgctgaggcctacgacgtgctcagcgacccgcgcaagcgcgagatcttcgaccgctacggggacggaaggcctaaaggggagtggccccagtggcggtagcggcggtggtgccaatggtacctctttcagctacacattccatggagaccctcatgccatgtgtgctgagttcttcggtggcagaaatccctttgacaccttttttgggcagcggaacggggaccggaaggcattggacattgatgaccccattactctggcttccctatgggcatgggtggcttcacacaacgtgaactttggccgctcccgctctgcccaagagcccgaccgaagagaagcaagatcccccagtcacccacgaccttcgagtctcccttgaagagatctacagcggctgtaccaagaagatgacaatctcccacaagcggtaaaccccgacggaacagagcattcgaaacgaagacaaatattgaccatcgaagtgacgaaggggtggcctgcaggaacctgaatcacttttccccagggaaggagaccagacctccaagaagattccagctgatatcgcttgtgttacaggacaagccccagaatatcttgaagagagatgggtctgattgtcagtttatcctgcccaggattcagcctcgggaggctctgtgtgtgctgaccagtgaacagtcccactctggacggagacgatacccgcggaatcaaggatgtttcaggctggatgcgggaaaagtctgggaaaggcccccttcccaaaacgccgaaacatgggaccccaatgagggagggactccga

SEQ ID NO: 683067 - DNA, 394 bp, Homo sapiens
caacctaatatggtgatgtcatcgattcggacatcaggcgtggtggctaaatttgaagcccagccagatgttgattatcgcggtgatatccacttctttaatcatgcgattcccaacactttttattcaatcggtgtgactttagcagccggggatgctaacgcttggttcaagtctgtctttggacaagatatcccatttgcggaatgggtaaatgctgcagcagagtcatcagttggggcgaacgggttgatctttacgcttatatttctggtgaacggacgcttatccagatgctgatattcgtggtagctttacgggcattgatcgacccatcaacgcgccgactttattcgcgccgtgttggaagggattattttcagctttaaaggca

SEQ ID NO: 683068 - DNA, 1565 bp, Homo sapiens
  misc_feature (92)..(92): n is a, c, g, or t
  misc_feature (1341)..(1341): n is a, c, g, or t
cgtgacgcgtggtgtcagagtccgggactggtcggcggcggagccgggggacggcgacagcgggtcggcgggccgcaggagggggtcatggngtaaagactactaccagacgttgggcctggcccgcggcgcgtcggacgaggagatcaagcgggcctaccgccgccaggcgctgcgctaccacccggacaagaacaaggagcccggcgccgaggagaagttcaaggagatcgctgaggcctacgacgtgctcagcgacccgcgcaagcgcgagatcttcgaccgctacggggacggaaggcctaaaggggagtggctcctcatgatggctggtacgctgcgcggatgagttgtccagattggtagcctactcttcgagctacagcagtttccagtgggagaccgctcgatgccaatggttttgctagacgtatcgtatcgcgtggccaagaaagtcccctttgagctagcctgtttgcgggcgcagccgagacatcgggcggaggaacgcgcgtggatcacttgcatgaccccagttctgctggcttccgctatgggcagtggagtggcttcaccaagctgtgaacctttgggccgctcaccgagtctgatccaaggagcccggcccagaaaagaagagcaaagatcacgcctcgagtctagcccacgaaacctttcggaggtctcgccttgaacgaggagtctagcagcgtgctggtaagcaacgaagcatgaacaattctcacaaaaagcgggctaaaaaaccgcggacgggagaacagtagccccgttccgaaacaggtgcagagcaagcacaccatacgtggaacccaaccggaatgtggaaccacaggggggcgggccaccggaaagggaagccacacaatcgaacatacccggacgggccacgcgagaccgtagcaccccaacaaagaattacacacagggagaacacgggcacaggtagcacaaggggcacaggccccacacaataactgttaaacgaagacgaatgggcacctgcagtgacactatacccgtggcgggaataacaccggaggaaggacccaggcggcatgaccatgacaggctccccacggaagagggagcggacaacgcgctgatcaaacacgttaagcacagaaagagcggacaaaatctgagacagagacccaccacacaaaacgccagatggacccccaagggaggagcatatcaaagaggcgaacaaaaaccaacgacgatctacaaaaaacagcctacaggacgaacaaagacagatgatacacgatcagaaggaggcgacggcatgcgatcaacagtgacgtgcttagaggtgangcgagtacataactcatacaacccaccaaccatatccaaaatctaactagaccaaaaccaccaaagatacacaacaacaacaaaacaaaaacactaaacaagaacaaaagataagaaattaaccacatagcacccgacaaccatcacacaacacaaagaacacacacataactagcctaacaaaacaaaaaccgacacataatacgcacaacctcacatccaaa

SEQ ID NO: 683069 - DNA, 1293 bp, Homo sapiens
ggtaaacaaggccaatgggaaatgtaaggtggactccggcgccctagactgatcagtgcaagaagcaggagagctaagaaagatggtgaatgcacctatttgagaaaaggccatatggaattatggtcgattggaccagtgactatctaagcacctaataagagaccatcagccgcgtttgtcaaaatggcgcgctatgtcaggttgcatgcgggctcgtagaagcctatccatcgtatcaagcgtgttgcaaagtgccgtccttgcgaattaacgcagttcagcactcaaggctccgtggtactcgcacaaaaatcagcatacctcatgcatgcgttaaaagtccgttggaccgactaagtacatgaccctaaggaagtacgacaatatgcaaattggagaatgagaggccatgaagacttagtgtaggggccacgggtccggacgcaatggaatgggcttgcatgtgcaccaagtggggactgtctccgaaacgaaacgagaccgaccgtgtccgtatctgagcgagtgaggttacacaagccgtcgagccagctttggtaggagaaacacaggataaagctcaagctgagtggtgcattagcacgcacagaaccagtgtgattcctcgatcgaagctggattgtcgttccttgccctgtcccttgattgtacgtatagaattgcggggtccccgttacctgcgatttattcaacggggaaacaagggccaacgaacttggagacctgtcttaagtacaccagggaaagcacctagccagccacttgtccgccgtatcatcagcaagggtgaaccttcgggaagacctaaagggcgcatattgcgctttaagccttggtcgggacacgctattcgatgggacccaaagtttagcaaaatgaacgcggaataactcgatagaagatccagcacggtcacttgggggtttgcccacatggtcccttgggatccctagaagtctagataggcctccgtaattcggccacacgacttccgacgagacaggcgtcaacaagctgctcttaaacgagaaaccttttgtccgcccttaaaagctcgcgggtgtcaacactggctaaccacttggtttgaagttttttcttggtagccattttagaacccacttcaattctggcacaacataaattacccaaacattttcttccctttcccaaaacaaaaacaacagaacaacacagcctctgggagcggcatcgtcataaagtcgccggggccggacggagcacacacagtgcggtcacaccgagagc

SEQ ID NO: 683070 - DNA, 182 bp, Homo sapiens
  misc_feature (147)..(147): n is a, c, g, or t
gaggagtgagctgctggacacggctcagcagatcgtgtacagaaatgtgatgctggagaactataagaaccgggtttcctgtgggttatcagcttactaagccagatgtgatcctccgtgtgggagacagggagaccgagcccgggntggggtggagagatgaaattcaccaataagaccca

SEQ ID NO: 683071 - DNA, 1013 bp, Homo sapiens
gcttgcgaagtcggctccagcattagcctgtggtaatgccatggtcttataaaccttctccctttacacctgttgactgcattgctactggctgcagaatctacagtgaggctgcgtgtacctcctgcggctcttcaagtgtggtgcacgtggaggggctgccacaggccagttatcgtgtgtcagcatcccgatgtggccaaacgtctccttcactggaatgtgtgcccactggcatgaaggatcatgtgatgcatgtcatgctaagaggaatcaaagcactgttaccattgagaagcttggcatgtgcaagatcgtccatctcatcatcgtatctacagactggtgatatgaagcaaatgcgtcgtaaagcgggagcgcttgatggcccaacttccctccacgacacagggccaagtgttgtgcgtcgtaaactgggcgacaaaggagttatttccgtcgctacgaaaacgagaagttctttgatagaatctccacgaggaggaaaagtcggtgagacacaaggaagccgagagagcgatctaatccattggggcagaatcctcctttctcatgggacaccaatgactgagaggcaatgagggtctcaacttcgattcgaaaccgaacactacgagccatggccagcctgagatcccgttaagcgcagttttgtcggaacaagagtagagtctgggccgacacagcgagaagcccaagcgttcttaggcttagcctaacggttgagtccgactccgttcagaagttcgcgcccatgaactattcacttaatgtgggtgtacaccctttgaagaaccgaaatttcgcgccaatacacgtgtcagaccacgtgtgatggcccattactttgaacacgagtctcgaactgaaccacttcgaggttgggctccgttgtgagtaccttcaagcaatctggcaccattggcagcaaaacgagaaccagttcagaccccctcggtgttcacacatggcaacatcgaggaaaatccata

SEQ ID NO: 683072 - DNA, 129 bp, Homo sapiens
gttgctcatgctgttcaagaggatccccctacagcgccttaattacaggcttggaggaggaagcagagcagagtgcgagatcctgacccaagagcaccataacatagctccgaaagggagagcagagat

SEQ ID NO: 683073 - DNA, 253 bp, Homo sapiens
agctgttgctcggggctgatctagaggatcccggtggggtgacgggatataacagacacttctcaaaagaagacatttatgcagccaccagacacttgaaaaaatgtcaacatcactaaccatcagggaagtgcagatcaaaaccacgatgaaatatcatcttaccccaattagaagggttattactaaaaacagagtaccagatgcgggcagggattgcagagaaaggggaggggtacccgagcccgaattc

SEQ ID NO: 683074 - DNA, 269 bp, Homo sapiens
tgcgctcctttctgcctcctttcctgccccatgacagcaggcagatcccaggagagccgagctccggagatgggaagaggatctgtccagggcttagccctcacgggtgccttggcgttcttaacggcacccatgctttctttgcggagttttgtgtctgtgggtgaggggtcggggctcacctcctcccccatccctgcccagaggtgggcagagtgggggcagtcccttgctccccctgctcactctctgctgccctccggctccct

SEQ ID NO: 683075 - DNA, 808 bp, Homo sapiens
cactgtttgcacttgcatgaacaatgggtttattcgctgatgtaaacggttcgagtgaagaattaatgcagtaagtatgacaacacatacacacttgcctctccccatctccagaagaggggagcagagtccgagcttatctaaatatgaatgtggccacaaagctgtggaaggtgacaaagcttaaacaccttgtgccctggctctgcatgtcacctagagagcaagaggtctatagaaacatcatgtcacatgaaacgattctctgcttttggttctgaacttgaagtccctaaactgcaaaatctaagagtgggtggttattaaaatgcttttaaagtcaactgtggcaccaattctaatgtaatccaactgtgtgactggttttttttggttggttgggttgtgtgtgtgtgtgtggcactgggaaaagtggaaacaaacatatattgaaatacatatggggaaataaaaatggttgagcgtcagtgatattctcccagaaatgtacttgatctaacctcggatgtactgtagtcactcagtatttgtatatgtggtagaattagatgttaaatagtgaatttacatgtgttcatggggttaatgtatatatgtttgggccagatatgggttaataaaaacctgagttgaggtttcaaaaaaaaaaaaaaaaaaaattttggggggacgaagttttaaaaatctgggcgggcaagattaaagggaggcagagaccgggaaggggttcacaaaaaggggaaggttaaaccgggttggttgttcgcgtcttcacgcgccgggaaag

SEQ ID NO: 683076 - DNA, 884 bp, Homo sapiens
gttatattaatcccgagcgcttcctttattgtgagaccccctccggtgttctcccctcgtgggtaagaccccctctttcacacgcccggttgtgtgagccccccccccttaatggtgagagactccccccgggggcgcgagttttctcgccctttccgggggctttttttatccctatgggccccgcgcggggcggcgagtataccacacttgttgccacccccgcgggtgaccatcgtttttggcccctcttttgggccccctatattttagaggggggaccccactatttagggcaccccgctgttgtgcacccgcaaaaagcccgcggctgtggtggtacaccgctgcccccgcgtatttctcccgggggtctcactccacagcccctctctcgggtgggagcctcaaaccacgatgtgcgctcccacttttttctcgccgttgagatattctccacacgcctttttctcccggcgttctggaaatggggccgccccccacatgcgtctctctgcgcacccacacgggggttttcctcctgcggcccttgctccccggcttctcttccacaagtgccaagagggtcgcaaactgcacccctccctgccagaagagcttctgtgtctcttgtgtagccccccttgggcgtgtgtcaccaaggtgtgccccccggcgcgtggtttcgccaaagggagccttggaggagacctgccacgtgcttggtgccctgaatttggggacagcgttttttctccccgaaggttataggacacaatggcccaaccccgggttttttttccaaaagaaatgggcccttttggcaattttttttttgtgttaaaaaaggggggggccaataaaaccaattttgtaaatgttga

SEQ ID NO: 683077 - DNA, 213 bp, Homo sapiens
attcttattaaaaacctctaaacgaataaactgatatcttttctgaacaacatagtcgtaaaagcattgaaacatttcacgcccaatacctgggttttggatttcctgcaaaagataaaaagcgcgaatttcagctacattattttcaggatttaaatatccatctaaaaaaccctttattttttgatcttcattataaactaacaattgatg

SEQ ID NO: 683078 - DNA, 188 bp, Homo sapiens
atcagtctgggcacatggatgagacccgtctgtaccacacacacacacacacacacacacacactctagataatataagtgaaaaagttgagagcaaagcccataatgctataactttcagtatacaacatattatggaatgtggactttgatgtgtagttagagatagtggggacgcagtcagagag

SEQ ID NO: 683079 - DNA, 927 bp, Homo sapiens
  misc_feature (832)..(832): n is a, c, g, or t
gtgggcaagataccctacatgcccgcgtgtaccgcgtagtgtcgcccatggccctttcggggctctctttaggggctctccttcatttggcgctccccggggttcggtcccaaaagtcctctctcggagagtgtggcgttgtgaggcgtttctgatagacttgaagttgctcatggaacttgaacatcgcccgcctgattctttcgggttctcccgcagtgggcccccgattccattcgattggttggtcccgcccgtgtgttcccgtcggctccgagggcccgattccttccggcaaacacggctttcctctctgaccccccaaggcctatgtcttgtgaaaccttacccgttactccccccacgttttgaaaaacagggtcttcttccccaagggaagccccatcttcatccattcatctgagaaatctttcttcccgaatgcgtcaccccaaggtctattccaactatcttttagccattggagacgaaatttccttgaaaacatatcgctgaacccactttgcttataacaacgtattacccgttctagattcaacattcttgtgaaccccctaatcatcggctgtccttctttatcattaaccccactaggtaacttttctccttccccgctttataaaacaaattggtcccccggatcacacttccccggaatattgtttctagccccaatagcccactttcatattttttacaaatgggaaacccccccccctgtgcttgactttttttcaataaattgatacgagaatttctattataaggaacaactaatttagtcagcgcagttcgttccacaatatggcanactatacttgaaggggaccacccacaaaaaaaaaaagggagaaacaaacccgtttttttaaaaaaaaacccggtgtttttttgggcagacaaaac

SEQ ID NO: 683080 - DNA, 1440 bp, Homo sapiens
tttgttttcctcccccccgggggggtttgtttgctcccctctgtctgtgttgtgtgtggtgttgattttcaccgcccccccccccctctgtgttgggtgcccctccctgcttctttgtttggtttgcgtacctcttctgtcctccctgcaccatctagggtggtcaccatccttatggtgcctgtctattactactacctccctctccagcactatgtagtttgttcttcggtctccgttcgccaccaacgttgtgtgtgttccgccgcggttggttgggtggccgccccctcgttcttcttgtcgtcctccccctctcttgttgattgagttggtgtttcttcccgcggcggtggtggtggtcatctccgcttgttgttgctcccccccccccctcccctgcggtgttatagggaccactcgccgctgctgtggtgatagagcacgtccccaggagtgtgccctccctcctgctctctctgtgtgtccccccgcgctgttgtgtggagacacactcaacagcttgtctcgctgtgttgcgtggtcgagagagaaatagagagattattgtgcgcccgccggtgtgtggatatccccgccgcgtagcgcgccgccgctttgttgtggtcgcacgcagagagtcgttgttgtgcgccgcacctcccgctgtgttgtgcgccccccattggtgtgtcgcgcgcgtggtgtgttgtgtagcgcccccccgcgcgcgttgtgctgcgcgcgctcacccatcgtgtgtgcacacatcatcgtcgcgcgcgcagagtagagagtatgcccacacaacgcccccccgctcgtcgtgcttcgcggcaccgtcgcgcgcgagagttctctctcacgcagcgcgcgtcgtgtccccgcgcgcgtgtactacaccgcgcgagagagcacacaacacgcgcgcgtgtgtgctccacgcgcgcgcgcgcgtcggtgccacgcgccaacacgacgcgggcgacacacagagcgcgcgccgcgcgcgcgaagagacgcgtgtgtggagagagagagagaaactcctcacacgcgcgtggcgtgtctcgcgcccacaccgcgcgcagaagagagacacccccgcgcacagaatagagtgtgcccacaccgcgtggggaccccgcgcgcgccacaaacacacgtgtctccgcgcccaaagaggggtgtaaagagaggggcacacccgcgtcacacacaccgcgcggagacacacacgcgggggcaagctcccccacaccccccccacacacacccccgcgggtgtgtgtgtgggaaggcggccacccgagaccggtccccaaacccccccaccccacccccccccgggcccgcggggccccccgcgggccccgccaaatgaccgggaccccaaaaaaaaatgtgtctcccgcccccggtgtcccccaaaaaaaaaaa

SEQ ID NO: 683081 - DNA, 105 bp, Homo sapiens
aatcgagctggaccgccagcactcttttcttcatcctgtcatcattgtataactatttattttgagacggagtctctctctgtcacccaggatggtgtgcagtgg

SEQ ID NO: 683082 - DNA, 181 bp, Homo sapiens
ccccaccatgtgtgctccagaggcattgagtgtagctataaggcagagacagatgccttctcgagtacggaacttacttgtgtttgaagcctccaagcattctgtcccatacgtactggggattagcagctagatccatgatctttagcagcagagttgggtcctgctccctcacagagtc

SEQ ID NO: 683083 - DNA, 91 bp, Homo sapiens
  misc_feature (5)..(5): n is a, c, g, or t
atganctggtgactgactagactagctgactgctgcatgagatagtatagatgatcgatcgagtagatagatcgagtcgagtcgagtgact

SEQ ID NO: 683084 - DNA, 949 bp, Homo sapiens
gactcccggaagtagatagtttgtcgagacgggtgctgacgccttgcgtctctttacttctacgcagtctgagcctatcggatgacgccacattatcagaacctgggagagtaggatacaagcgcgcagactggcagaggaaggcgttaacctgcttggctcgaggcctcagttggatcgcagcagtggtgggtgactcacatagtaggtaaggcacttctcgattgggaaccttcgtctgttgttaaacgtgggcacgagtgatttgagttccggggaacagagtgtctatgcatctatatgctcatggtcttgccaagatcgcccgaagggctggtgatcatgttctcggctcgctatcctgcgactctactctggggttgcaagaggtcctcttggtttagcctcctgaaaataagcatgatgaatacgggtgctttgcgtttgtattacaaaacagcacccaaaggggtccaaaggaatgatttatacgatagtatctgagtaaaatttgctagcgagtcagagcgattaactgtcggaatttaattgggtagcggcaagggaatgggccgtaagtgttcttcctatggaagaaattgaggtgaatgggtttttcggatatgaagacttgagtcgtgtacttaggaaggtaaatatctttgaaatttagagaaagtgttagggacaggaaagttaccttttattgttggctaagagtggggctgttcatgaaagcctgtaagagtgtcatttgttgtgtcaatttttcttttggaactttgactttaagagaagctgggggatgcaacatgttcttcaagaataaggaacacggcgtttattttacctttttcgggaaattggaaccaagaaattgggatctgggctgagaaacctggggaattatttgagtgttgggtaaaaagatgtaatttgtttctctgca

SEQ ID NO: 683085 - DNA, 253 bp, Homo sapiens
gagcgactgagtcgtccgtgatgaacaagaggcgaggcttttccgagatcgtctcagtgatggcgcttcggtcgcagttttgggggttctcggtttgcaggaaccctgggtgcaggttctcagccctgtcaaccagctctgagccggcagcgaaacctgaagtggaccctgtggaaaatagaagctatagccccagaattcaccaaccggaacccccggaacctggagctattatctgtagccaggaaagagc

SEQ ID NO: 683086 - DNA, 123 bp, Homo sapiens
ttatggggattattgaatatattattggtacgggatgaaaataccaatattggctggtcctgacctacacaaatggtgattcaataggtaacatcatggtaggttataaagcatgagaatata

SEQ ID NO: 683087 - DNA, 137 bp, Homo sapiens
gtcgtccgtcggccggcgcgtcctcctgctctcctccgcagcatcatggcggagccgagcggctcgcccgtgcacgtccagcttccccagcaggcggcaccggtgacagcggcggcggcggcggccccggcggccgc

SEQ ID NO: 683088 - DNA, 105 bp, Homo sapiens
ttactgactttactcctctagatagtcaagttctgacctgtcttctcagctgctccgccatggcctgtgggcctgacccctgggggacgaatccgatggcctcat

SEQ ID NO: 683089 - DNA, 767 bp, Homo sapiens
  misc_feature (32)..(32): n is a, c, g, or t
  misc_feature (88)..(88): n is a, c, g, or t
  misc_feature (135)..(135): n is a, c, g, or t
  misc_feature (148)..(148): n is a, c, g, or t
  misc_feature (207)..(207): n is a, c, g, or t
  misc_feature (282)..(282): n is a, c, g, or t
  misc_feature (327)..(327): n is a, c, g, or t
  misc_feature (333)..(334): n is a, c, g, or t
  misc_feature (338)..(338): n is a, c, g, or t
  misc_feature (353)..(353): n is a, c, g, or t
  misc_feature (395)..(395): n is a, c, g, or t
  misc_feature (398)..(398): n is a, c, g, or t
  misc_feature (406)..(406): n is a, c, g, or t
  misc_feature (433)..(433): n is a, c, g, or t
  misc_feature (523)..(523): n is a, c, g, or t
  misc_feature (539)..(539): n is a, c, g, or t
  misc_feature (559)..(559): n is a, c, g, or t
  misc_feature (571)..(571): n is a, c, g, or t
  misc_feature (573)..(574): n is a, c, g, or t
  misc_feature (589)..(589): n is a, c, g, or t
  misc_feature (616)..(616): n is a, c, g, or t
  misc_feature (664)..(664): n is a, c, g, or t
  misc_feature (672)..(672): n is a, c, g, or t
  misc_feature (694)..(694): n is a, c, g, or t
  misc_feature (696)..(696): n is a, c, g, or t
  misc_feature (749)..(749): n is a, c, g, or t
ctcccgcacaggcctccctcatcccgtacacngcaccaggccgcttcgcagcccactcaacacgtccaccagcccctccgtagtttcnggctcagctccacaccaagctccaccagcatctctcccagggccttnatcttcttctgtnccacagagcttggcagcttcatccgttggctccgcagcgtgacatctgcagacttgaantctggaaacttgacgcctgcagtctcaggaacagccggcttctcagcctcctttttctggggtagcttctttttnggggccttgcgttccgtgcgccgctgctctgcagttgtgtctgcngctgtnntcancttctgcaggtcctngctgcgtttctcccgctccttcttccgggcctcaatcttgcncantccctgtngcaggtactcctcctctgccacctgcnctggggtccggttgtagagacgctcaagctgttccttccgccgtcgttcgtgcccagcatcaaatactggtatcttaaggtctgttcctngcacagcccgcacgtnggcaagcttagcacagattntggtagttccgngnntttcaggtcttccanagaacgcttcttgaactgctggggggnataccgggtatggataacaacaaaacgcaggtcaaagcggcggctgangtcaagangttgtcagtttctccttagtcnancatcaccgtgagataagctgggactcttctccgagtcacaggacttcacagtntattaacctggaaagggt

SEQ ID NO: 683090 - DNA, 337 bp, Homo sapiens
  misc_feature (13)..(13): n is a, c, g, or t
  misc_feature (132)..(132): n is a, c, g, or t
  misc_feature (252)..(252): n is a, c, g, or t
tttttttttccanagcacattccacccagtgggggctttattcagtcacgtccccacgcccacggttccctccaccaggcagacagaagggagagagcgcacccacacgtgtcaaagggtgtcccaagcccnagtgtgtgggccaccaacctcaggaagacgtggtccccacctggagcttccctcggctgccctggcccttgagcccgtcctgaggatttgtgctttgactctgacgagggagagagcccnaaaggccgagggacaaagctgccagcccactgcctccatgggggccctcggagggcagacggtggagcggcgcttcctcagtccc

SEQ ID NO: 683091 - DNA, 176 bp, Homo sapiens
acggacgtccagctgagatctcctaggcgccggcgtccttaaaaaaaaaaaaaaaaaactgttactcttataaataactcccaaataactcacgtccctcttcccgaactacggaaccccaccctcctctctggggaggggaccctaggacgtcgagatcagagggcaccaccccc

SEQ ID NO: 683092 - DNA, 133 bp, Homo sapiens
gaaaaagatttctatcttttatcttagcgcattatggaaaaaatattaactgtcctgaatatttataatttgtaggaaaaatatgcatctattttttcttgacttctttatatagtaataaaagttattttgg

SEQ ID NO: 683093 - DNA, 410 bp, Homo sapiens
  misc_feature (206)..(206): n is a, c, g, or t
  misc_feature (213)..(213): n is a, c, g, or t
  misc_feature (410)..(410): n is a, c, g, or t
agatcttggtcagtgatctctggggtgatctctcattctggtcatcggaggatcgagtgtgaattcctgaagaacgttggggagagtgtggcagctggccttatgcctctgtgcattgaagttgatatcgatgtggagcaggagggaaaagaagccggctgaaccccgtctctccagagagttccagcacagaggagaagagcagntcacagncaatgcagttgctgctctgaccccagcaatgctgggtgggaattgttgagggcgccacgcatgtctcttggcggagcaagatgagaaaagatcgtcttggaggtccgaagggggcgccctgagggaacaggatgggggtcggaataaactgttcagggagggatcactttgaggttcaaggtgaatccttccttggn

SEQ ID NO: 683094 - DNA, 347 bp, Homo sapiens
ctctgacttggcccattctatgcactctaaacacagctggacctcgtgccctgtagctgcttccatatcaagaaccagctcaagaagagatcggaccaggcaagctgctttagccttgctgatggaattcaagaaggttcgtacatacttcaggagtcctccaagctctacagcttgtccagtctttgccaggagagatccacagttccgagtatgctgtgctctttgacttgcatgcctttctcgtttcctaatgcacgcttcacatatgagagtggagtatgtctatggaggcctcgcggtcggtgctgagtagagtctgggctctctggaactccaccagcgcc

SEQ ID NO: 683095 - DNA, 119 bp, Homo sapiens
tctagaggatcccggctaatcacagctcactgctagtcgtcaaattcccgggctcaagcgaatcctcctgcctcagccctccaaagagttagtactacaggcatgttgcatcaatatcc

SEQ ID NO: 683096 - DNA, 120 bp, Homo sapiens
gttaatttgggtggcctcgagagagtttgtcgggtaggggcacggcgggagggggtaggagaccgacatcgtttttttctagggattgggtgtcctcgagagttttggtcgagcgagagg

SEQ ID NO: 683097 - DNA, 126 bp, Homo sapiens
gagcagcgcgattggtgtacgcctctaactcggtaaccgtcttggtcttcacctcattccgccggtgctcacagctcagaggctcacgctccagcacgttagcctgcacgatccagttccctgagt

SEQ ID NO: 683098 - DNA, 412 bp, Homo sapiens
atacaatattaaggcagcaattttcaaatgaaagaatgtaatgagttccaggtgggggttagtagatttttttcagtaggtcaagttgagttgaggtggctactgtcagtgtcaatgccctgtctgaacaagttttaatttaacttcaagcaatacataggcttttggttagactgtttgcatatatttgtctactgctgctaagaggcaaaataacctttttctcgagaaagtgagataaaactatgattgcaaaaatgtttattttttaatcttttcatgaatcaagtaattttatctaatttattcaacaaatatttattgaatagttactgtgcataaggcccagttgggaatatgagagaatataatattgatatagattttatcaccaagaaggtctgagtcttat

SEQ ID NO: 683099 - DNA, 317 bp, Homo sapiens
  misc_feature (52)..(52): n is a, c, g, or t
  misc_feature (57)..(57): n is a, c, g, or t
  misc_feature (94)..(94): n is a, c, g, or t
  misc_feature (104)..(104): n is a, c, g, or t
cgtcatagccgtttctagaggatccacaattcgccccggatcactgaaggcngaggnctattgcttcctggcttgtagaggccagaggagatgnttctaagttngggctgtggattggctgatttacagtttttggaatatgtatctgttctgcccaggttttcagatttaattgttcacgatagtgttttttaaatctttcatctactgttacttgcatctctttacttttcttgattaatcttgccaaaagtttgtctatcttataaaatcttttgaaataactagcctttgattttgttcatctatattttgtt

SEQ ID NO: 683100 - DNA, 125 bp, Homo sapiens
cagagatcacgtcattgcactccagcctgggcgacagagcaaaactccctctcaaaaaaaataaaaataaaataaataaataaagttagtttgtatggaacaagcactcctgggacacccctctg

SEQ ID NO: 683101 - DNA, 235 bp, Homo sapiens
  misc_feature (9)..(9): n is a, c, g, or t
  misc_feature (14)..(14): n is a, c, g, or t
  misc_feature (24)..(24): n is a, c, g, or t
  misc_feature (26)..(26): n is a, c, g, or t
  misc_feature (32)..(32): n is a, c, g, or t
  misc_feature (218)..(218): n is a, c, g, or t
aacaaatgncgggnagacgacctntncctgcnaagatgtggtttaactagcattgccaaggtgtggagaaaagcgttctgccagcacagttggtagtagcaccctgagctctctgtcttctaggtagcgggggacaggcctgggtgactggcatgaacccagcttctctgttgcaacccccagcttggaatctccagtcaccatggatgggagaactnacaggcagggagaaagc

SEQ ID NO: 683102 - DNA, 234 bp, Homo sapiens
ccccccaaaaaaaaaaaagggccttctgtccgggggcccctcccccccttagggctgggaacccccctgggctgggtttggggtcccagggagggggggcccccccccccctaaaccttttcaaaggccaaagaagccccccccccccccccgggtttcccctggggggggggggggtttttttttgtcccccaaaaggggaaaaaaaaaaaattcccggtgtttttttgggga

SEQ ID NO: 683103 - DNA, 278 bp, Homo sapiens
ctggatactattgatagtaagtaacctaaacatacagttttgtttcaaaagaaacatagtggaagatcaaaggcacaggtgccaacggaaacgtgtacgtgcagcttttacccgacaagctaactatcgctcgccctaccactgacaggcatccatgaacccctgcacgtactcattgctggccacttctctccgcaccagcttctatacctggcttactgaactgccttctagcactacacaggagcctgccccgaacacccactgcttacctacgc

SEQ ID NO: 683104 - DNA, 756 bp, Homo sapiens
  misc_feature (54)..(54): n is a, c, g, or t
  misc_feature (66)..(66): n is a, c, g, or t
  misc_feature (75)..(75): n is a, c, g, or t
  misc_feature (104)..(104): n is a, c, g, or t
  misc_feature (107)..(107): n is a, c, g, or t
  misc_feature (161)..(161): n is a, c, g, or t
  misc_feature (170)..(171): n is a, c, g, or t
  misc_feature (236)..(236): n is a, c, g, or t
  misc_feature (238)..(238): n is a, c, g, or t
  misc_feature (244)..(244): n is a, c, g, or t
  misc_feature (261)..(261): n is a, c, g, or t
  misc_feature (271)..(271): n is a, c, g, or t
  misc_feature (304)..(304): n is a, c, g, or t
  misc_feature (306)..(306): n is a, c, g, or t
  misc_feature (318)..(318): n is a, c, g, or t
  misc_feature (367)..(367): n is a, c, g, or t
  misc_feature (376)..(376): n is a, c, g, or t
  misc_feature (414)..(414): n is a, c, g, or t
  misc_feature (426)..(426): n is a, c, g, or t
  misc_feature (622)..(622): n is a, c, g, or t
  misc_feature (690)..(690): n is a, c, g, or t
  misc_feature (748)..(748): n is a, c, g, or t
gggccggggccaagggtgggctgagacctgggccaggggtagccgttccgaggngttatgcctgancagtttggngatgaggtctgggctccatgggcacgggngcngggaactttaggttcaccttgatgatgcggcgataggtctcgttgtgtgatggnctctcaaanngtgggtttttcaccagcagctcatagcaaagttctccaatgcaccatagatccaccttcttattntncatgcnctccttaatcatctctnggggtaggtngttcagggtgccacatattgttttcttcctcangnagggcgcatgcncagaccagccgaagtcagcaatcttcagctctcccttgagccctaagancagattttntggttttatgtctctgtgaatcaccttcttcccatggnagtacattagancatctgccaactcctccatgatcgtggctgttcgctgctcgtcaaatgtgcagctcttctgcagctccttgtagagctccccgcggggggcatactctagaatcaagtagatcctcctccggtcataaaaatagttgtagagacgcaggatgttgggatggtgcaggtgggcctggatttcgatctctctgcgcantgagtgctccacgccctccttctctatctgggacttgaagaggaccttgagcgccacgatgaaatggnttttcttctcccgagccaagtacacgtttccaaacttgcctttggccagaggaggccnatctcaaa

SEQ ID NO: 683105 - DNA, 683 bp, Homo sapiens
tatgacaaaaataccattgactgggtgacttaaataacagacatttatttttcatagttctagaggctggagagtcccagatcaaggcaccagcagatttggtgcctgacaagagactgtttcctgattcatagatagccctctgctcattgtgtcttcacatggcagaaagaagggcaagagagttctctagggtcctttttataagagcactgctcccatttgtgaggactccaccctcatgacctaatcatcccacagagacctcacctgcaaatatcatcacattaagaattaagcttcaacatataacatattagggggcacaaacattcagccctcagcagaattaaagccctacaaataacttatgaaagtcgattgtaggtaccttatttaatgtctagcaaaccatactctctttaacacagttttctggtgcttgcagttgagttgaatcgtgtcttggtgaccataacaggaatcacaatatttaattttcagttctagaatcaggatttaaaatacaggcaagtcagtaaccttctgaaactcagttggctcatctttaacatggaaatggtgaaatctaccttacagggttgaaataatatggttgaaagcttttatcaaagtgaagtaaaatattgtcgtgagtcatacaattttagtattaaaggtat

SEQ ID NO: 683106 - DNA, 264 bp, Homo sapiens
tagaggatcccccctggttctggcttaggatctcacacacaaactgataatagatttgtatcatacagaatcagaggcatattaatggactggtaaatgtcgataaagaggtattaatatcctagaccttgatcaactcactttaaactggtctctgatatcctcatctgtcaaatgagtattacgaccctctgtacttcccatggtagtatttttgtaggagcacatgctattatgtatctagaagatatggcctgacaagca

SEQ ID NO: 683107 - DNA, 104 bp, Homo sapiens
gagttggcaagactgtactgatcatggagttaatcaacaatgtcgccaaagttcatggtggttactctgtgttgctggggttcggcgacccgaccctgaaggca

SEQ ID NO: 683108 - DNA, 188 bp, Homo sapiens
cggctcggtgtagaggatccccccttaagtgctgacacgcctgcagatgataagtaaactgtccatggaaacacagctagtaataagccctagagcaggttcttcaagtgtgttcgtaaatgctattttatgttggagaccaaatcctcccatccaccttaggtactggtaaatatcttattgtaccc

SEQ ID NO: 683109 - DNA, 138 bp, Homo sapiens
gtctttgacgtcggtgtgcattgcatcgtggatgagccaggtcacttattacattaccaagcattggtgtgtacgtagtagttactttgtactgaaagagctcgctgaggttttattttcggaccaaaaaaaaaaacc

SEQ ID NO: 683110 - DNA, 152 bp, Homo sapiens
actagggtattaattttctttaattagggttattcacattttctccttaaaaaaatggctaatttactgggccttttaaaaagctaatttttgggttatcaccacttaaggttttctgaggcctaatatttcctattttaataacgggtccg

SEQ ID NO: 683111 - DNA, 1706 bp, Homo sapiens
  misc_feature (409)..(409): n is a, c, g, or t
  misc_feature (539)..(539): n is a, c, g, or t
  misc_feature (1197)..(1197): n is a, c, g, or t
  misc_feature (1484)..(1484): n is a, c, g, or t
tcggttttctttgttaatcccctgacgattggtttaccggtggtgcgccatcgtgtcagacgctgccgtagactccagcatcctgatggtcccctactcaatgcgtactttaatggcgaagagagcaatgggaacgttgatgagacacgatggcaaagaaatttgggaagaagaggacggcccgcttgcataactgggaaatggcgtaatctgattgaagatattggcgtggcagtgatgggctgtacaacttgaggtacgtagcgacaggtaagacggtagaggaatgcgtgggtgaggagaaatgatgcgatggatggaaagaatgagaggtgactggctgaggtgacataatgggagtggtagtactgtataggaattgacgcgcaaaggcatcgaacgatagcangacttatctgagtgcaaaaagacaggagtcagagtcttagaaggagtgtagactttgactgcgactgtgactctggaatctgtgtcgacttagtccacattggaaatttgcgtgtaagctaagcctgagngtgagtgtgagtgttgagactctttgaggagagcgacattaagaataagtgccaaccacagatttaacatagcgttgacacaggaaacacacagaagagaggagtgccagtttggccgcgtcgttaatcccttgataagtcttctaaacccaccttaccctagggtggtttgctcaggataactccgaaaacattataacattagataccgtgggaggggttcctcacacctattaccgaataggttcagattatggccccaagacggcttggcaaaggggccccataggcccccaattaaaccgagggtagccgagaggcaaaaaggtaggcgacaattaatcttcgagggagacaaaaaattgtaatcgatcctaagcgggcggatacattgctccaaaagccagaacctctataaaacacttcctaaaaatgcacacacattatcgtattggaggactttatgggagaccaaccccaccgggaagcagaaacagagcggacctcaacgaaccaaacatttgtaataggtacttaggacaccaaaacgttattaccccagtaaggggggtatcctcggcagatagagacattggtggatctggaatcctacactcttataatttaggccagttggttcaaccgttcctcctaaaanggatatagacggtgtaaaaaccacatttttgcgcgctcattgtggagtcattttcccaacacgcggagaggcatattgtgacgcaccaaatcttggttccaaactaacctcaggtttacacggggtcgacactatgttgacatttacggtatggaccgagcgggatgtgtcagacaaccccccaatcatgtgctttggacatgttttgggaattgccggcctctcgcgtcagtgtgagaacttcgagaactttcacgcaatgagcgccctaattcccgggagacatnacacgggtatcccctaactgggtgtacaccttaaaaagtgcgccccttgttaggagtattacacaatagcgaacggttctagtcacacagttgtggaacccgtcttgtgtcaccacaataactatagaagtcgaggaggcaaaaagggggagagaacatacgaaatcacacatcggttttgtgggtcacaagagatatgaggagcagaacatatagggtgga

SEQ ID NO: 683112 - DNA, 381 bp, Homo sapiens
gttcgaactcgagctctggtaccggtctcatcttctgagagtcctacacccaggattaggagaatgatttttccattattcattagttctactagattacaaggtaggtctcatgttataacgtcccccttctctcccaagatctccagattcatacttaccatgatgcctgagaaactgattccttctatatatcacacgtagttggtgagtttattgctggatgcttaggaagtttgcccattcgggaaatactatagtatgttcacgattatactccaaagtgcaagcgtattcagcacacaacttaagcagcctccagacttccgagaccccattttgccctgcttacaacctgcgtgagattgtttatctctacat

SEQ ID NO: 683113 - DNA, 667 bp, Homo sapiens
gcgcatgcgcgctctcaggataacaggccctgcctgggacccacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagcaacaaaaaaaaaaataaataataaaaaaaaagaagagcggagggcgtgccacagatcttttctctctctccggtggagcgacactctattatatcacaccccatcgttgtcttgtattgggaaagagggcttcgctctcctatcgtcgtgctgctcttcgttttatcactgtgacgcggcgcacctgtctctagtatataaatacataagaaccgcgctctatctgtatgcgggatgcaaatattcatgccgatgccctggctcgataacactcttagactaggagaggcaataacacaatcactcactcctatatccgcctgatggctagagacgaaaataatgatgagcatgcaggaggtcacatcaagtcactagatcgtagactaaattaatacactccccacgcgaccaacgagagagacagatacatacatatctgatctcatctgttgacgtaaattacatacgtgtggggaaagtatcaaacacgccacccaacgtgatgtttgatctgctatgctat

SEQ ID NO: 683114 - DNA, 123 bp, Homo sapiens
cttgaaaacaggctgtacctagtcttagattttttttttcctgtagcgccaagtatatagagtaaaaatcatagttggttcatttgattacaaaacatgaaacagggttgatgagtggcagag

SEQ ID NO: 683115 - DNA, 786 bp, Homo sapiens
gactcagctgagctggggaacactgctgtcgtgtgaatgtctacagtggccttgttggtgcccacatggctgtgtggatggaggaagctgtccctgacccagtgcatcccccagtgtcatcacggtggaagcgtggagggcatgtgccctgccctgccctctccttcacatgtgtcttgtttgcatgtggactccatgaagaccattcttggtgagcctgtggattgtgggtgtgctggagcttgggtgttttgggttgcaggtttccatgtggttgcatgtacagcatgtggccgtgacatacttgtgccctgtgactcccattttccaatgaacagccatgtgtgttgtgccatccctgtgtgtgctcatgtgtacacatgttggggtgtcgtctctggaatgccaccttgttgttcggtttctttcacatgttgcactgttttactttttccgcccttcgagcacttacaacaaaccgttctcaccacactcctgggagttggtatctccttggttggccagccttgctaaacgctttcacggagacgaatatctatcgtggttgtgcatgcattggcagaaggcctttagcgaacgacagggtgttccccaattggcatggtgtgaccatgattgacgatgccccccttgttgaggaggttgagcccctgtgttgccgtcgcccccttaagtgtgtcagggccattgcttgctgcccggggtcggcgaagccaccgccctggcgactggggtaacccccaggcgaagggtgggagaagcccc

SEQ ID NO: 683116 - DNA, 926 bp, Homo sapiens
  misc_feature (926)..(926): n is a, c, g, or t
tgtactgaagagaaagacgtgcatatgattaagaccctgtgtcttgaagagaaacctgcagcagagatgatggtgaaagtaaggcacatgtcactaagagtgggaacagaagagtggaggtcgtgttgtattattggctaccaccatagatcgggagatctgtcgccagtaacaaggaaaaatgaagtgtaaatattggagaggaacagacaaaaatgggatgaaatggtcatctgacaaataatattaagactcctgtggtatggattgagcagaggggatgagatttcaaaaaaaaggactatgaatgtattagaatggggaatatgatgacaagtgggatcaggaagatgagtgaacattaatggaactagttttttttacaggtggaggtagtatgtgctccaaagggggaccacttgaacatgaatataaacaaatgtgaatccagagattagatacagaatatatggaaaagctatgtagtaaaatgatatgagacttgtgaatagggagatattccttggaacatgtgacaaatgcttaccggtctatttatgagtaatgaatgctcaggaaataccgcaaaaggatacttaccgggggctgaatgggtgtagcccaacaatgtaaaaacaaggtggaaagtccataaggaacagacggcggaaaaccttgaggaatatatagttgcggaaagggcaccaaggagccgggtatgaacaaaaggtcccaaaggtgaggcggacggtcacaagtgacgcaggacaacgtggaaccgaaccggatcaaaagcacgaggaccgcacggtcaaccaggtcggtgaggtgacggccccgccgcaggagacacaagcggaagcaacgtcaatacatcgcagcacaacaatgccgtcacaacgagacagcaagtgatgagcgcacgn

SEQ ID NO: 683117 - DNA, 168 bp, Homo sapiens
  misc_feature (128)..(128): n is a, c, g, or t
cggccgcttctttttttattttaatatactttaggaaacaacaatatacaaagctgcgctttcctgctatttccagataacagcaggaagctccacttacacaaatttagcttgtgaggctagacgcngtcagcacagactaacgtgctacacacacctatcaagtaa

SEQ ID NO: 683118 - DNA, 765 bp, Homo sapiens
aagcgcaacgggcctcgggaccctgctgggagaccgctggattcctcatcagccgcccaaaccctgtatcccaaggtacacgaagcgcaaaagcaaagcctcgttggaacagcgttcctgggccaccacgagaaggcggaagagcatcatgaagctaggattttaccccatccgcagggtcagcgtccacctcggactaccgtcaggatgagtccgacaattattgagggggataatcggccctgtctggagactggaaaaatagtgtcagcctgggtcacaacctcctgcccatctgcctccctgagaacgataccttctaagacctgggcttgatgaggcatatcgtcagtggcttcggggtcatggaggagaagattgctgcatgacctcaggtttgtccgtctgacccgtagctaatccacaggcctgtgagaacttggctccaggagaaagaataggatcggtatgtgttctctcataaagatgtgtctgttgctggacacccatctcgtaagagcagatcgcctgccagggggatattgggggcgtctattatgcagtaagggacccgaatcactgatcgatgcggggacacgggcatcgtgtccaggggtcatcgggtgcagcaaggggctaaggcttctacaccaaagtgctcaacaacgtggactggatcaacaaagagatggaggaggaggactgagcccagaattcaataggtgtcgaatccacgagagcagtgtgtaacacagtgcaaagaca

SEQ ID NO: 683119 - DNA, 101 bp, Homo sapiens
gaggatcccggcgacatttccaattagggagatagttggtattaggattaggattgtgtgaagtatagtacggatgctacttgtcccaatgatggtaaaag

SEQ ID NO: 683120 - DNA, 297 bp, Homo sapiens
  misc_feature (235)..(235): n is a, c, g, or t
aattgataggggttgaagaaaaccggctggtttttttggtttaaggatattttgtttttgaagaaatttgtagatggagttaagggggggtagttaataaagagttaaaaggaggagttgatgggtggatttggggtaaaagaagattttttaaggttttaggaaatagggtttaagacttaaaggaaggggtcaggccttgaggttcccaaaaaccttacccgagggtggccantatggttatttttttttttaaaaaagccacttaccttcaataaaggatttacatggggggga

SEQ ID NO: 683121 - DNA, 122 bp, Homo sapiens
aagaaaaacatacgatagggacacgaatcactattaaagtttgatttttaaaatccccataaatcttttctgtcctaaggtagttgcaaaataaactcataacatggatagtcaacgtagga

SEQ ID NO: 683122 - DNA, 931 bp, Homo sapiens
  misc_feature (931)..(931): n is a, c, g, or t
gactcgggcaccggagacatgtcctcaactcactcttcagcttccctgctcgtgttgaagtccagccggtccatcatgtcctgcagtgctgaccagatcgctgaattcaaggaggcatttctcctgtctgacagaaacaggtgattccaacgaatcatcttaatgcctcagtgtcagtgagatgctccgttcgagctcgtggggcctacaaaaactcccaaccaagtgtcacgaggtcagcgaaagtttcatgtcgaaaaactccagcaaatgtaaggagttgtgatatgtcccacgataacattcgcgttcagacccatatttctgcctattgatgcatgccattatccaatcatacatgcgaccaggccacctattacacgacttagtcgagggtctgtgtgtcttcgagaaggaaggaaattggtacgagtcttgggtgcggcatactccgacatgtaactagtcaaccctgtgcggacctgatgtccgctggaagaacgctgaaccccctgatggcaggtcaggaaggactccaaacggttgtcgtcaaaatacgaaggctttgtctagcctcatcaatgtctatctgaatgggctctcaagaacccgcattgctttaggaagacggctggaaatttattttaatctacatccatgaaatactctccagatctgttaccatcattcaggaaaaccaagcatctggcggtcagaatgagcactccctgaatttatacctctcagtttctctgaattgatcataccacaacaagtgctgtggccagagagagaatcatttgatccggggaaaagagaaaaaattgggggtcccgcccaagttaaaagggggggcatagagagggagggcaagacggagaaggggtcaaacgggggcgggaaacagtggggtgttagcccccccgcgggn

SEQ ID NO: 683123 - DNA, 363 bp, Homo sapiens
tataggattccccgtgagctggacacttgcagtgagctgagatctgcaccacttcctggtacatcaaggcaagaacccggcacacagagagcctctctccttgcaataaggcaggtgtctaattgcgccgactaacaaaagctacctacagacggctaaactaaaagagcacctgtaacacacgcccactggggcttcaactataaacattcacccctggacactgccatgggtctccctacctgtctgcatgctctcctagaggtttgagcagtggggcaactgcataaacgaaccacacccgcatcgcatgcccttcgagggggataacacgaactattcccatttcctctgagacgccaa

SEQ ID NO: 683124 - DNA, 861 bp, Homo sapiens
ggtgaccgacgccaacatggcggcgccagtgcgtccacctgctcgtccgcaaaggttctcatagaattttctcttcaccactcaatcatatctattttacacaaggcagtcaaggcatgtccaaccaaaggaagaaatttcttttttcggagaccaagaggacgatatttccaacaacaggtaataggtttgcgccggccttggccaggtttccttcaagactacattcgcgggttccctaaaggcacctattaaaagaaagccagacttaattgtgaaccgaaccacgggacatttgtgtaaccccaagaacggtgggggacagcccagggctatttacgcaacgtttcacaggacattggaaagggattccacgaattctccaaaggggggcttcacaatcacagggctttgggtccaaaggctgtagggtccccctggcccaagggttcctctcccattctttgtggctgtgggagacaacagacatggttccacacacgggggtggggcagggtcctacaacccaaagaagggactttttacaagaaaaagcggacgtctttaacctattaatagggcgggggcagaacaagataagcacgtcccgttcttctattttgattagacccttattccttacctagtataaagacatagttatccatatatcaaaggtgttagcgacccattttcataaagttattggggtctagaagacaaaagattatatattcgtgggttgatacaacaattcaagacgtgggggtattgatcagcaagaaacctatctcagggataacgacgcgcccttgtgggggatttgggggagacaacagaggggaaaattatggcagcgta

SEQ ID NO: 683125 - DNA, 413 bp, Homo sapiens
gtaggatcagtatggtgccaagttctatggaagaaacagcagagctcctcagattaccaatcctccattctagtctcactgtgccgtgaactgccagtgggtcttagggatgtcggcccctgcacctctttcaggtcagtttccttgactgacacataaacactgaaggctctctgtggcttcttccagctatctaacatttatattccatggctgcttccagatgttttcttatcctgggttaccacctacattgtttcttggggagaaggatgcctgactcctacagagtaatgagacacaaggagggtgcctgagccatttctacagactccaagaggttctaaccagcccaggtcacttccacttttgagacctgggcacacattatggagctccataatgtgtgccca

SEQ ID NO: 683126 - DNA, 482 bp, Homo sapiens
tgggtgatccagcttcagagaggagaacacggggacttgagttcactgttgcggtgaagtcctgctctggccccaggcagaagtcaagatcaaagctcacactgcaaatattgtgctgattaaaaccaaactttctgcttttgatgtgggccaacctccattgctggtaggaacaaaggaggagtatagcaaaaagatactagcaatgttttcttatcctgggttaccacctacattgtttcttggggagaaggatgcctgactcctacagagtaatgagacacaaggagggtgcctgagccatttctacagactccaagaggttctaaccagcccaggtcacttccacttttgagacctgtggacacgttatgatgttatgaaatgccagagcaggattaccaaaactctcacatatttgtaaatgcttgtattttgcaaatgacccttatttacaaccaaaataaaacttcgtttgggaa

SEQ ID NO: 683127 - DNA, 483 bp, Homo sapiens
tgggtgatccagcttcagagaggagaacacggggacttgagttcactgttgcggtgaagtcctgctctggccccaggcagaagtcaagatcaaagctcacactgcaaatattgtgctgattaaaaccaaactttctgcttttgatgtgggccaacctccattgctggtaggaacaaaggaggagtatagcaaaaagatactagcaatgttttcttatcctgggttaccacctacattgtttcttggggagaaggatgcctgactcctacagagtaatgagacacaaggagggtgcctgagccatttctacagactccaagaggttctaaccagcccaggtcacttccacttttgagacctgtggaaaacacagatcttatgcaatgaaagcacaacatcaccacaactaatacactaacttctaaacgcttaaaacacaacgtcacacttataaaacacaacggcgaaacttcgaaaacacaa

SEQ ID NO: 683128 - DNA, 981 bp, Homo sapiens
  misc_feature (981)..(981): n is a, c, g, or t
gagcgggggcgggcttcgagatgcctcccgagccgcctgcgtagccccgacgccgcactccataccccacaggctggggacgggcccgggggcggctgtgtgggttcgggagcggagttgcagaatccgaagggacccatggggttctttctccgcacgtgcgtttatgggatggcattatgggccccatagacatcaatgacaaatactcatgctaagatccgatcctcgaagttcaattgaactcgctcgaggaagagcagatacaccgtcgtggtgattgtgagcactgtgaagagtagaggcacgaacaggatcgttcccatgcaccagtcgggagttgttgcgttgagctagaccatggtagttgaattactatcgtggtgagcgatttgttgcaaccatagttgaggcgtctacagaggcaaggggcaaggctctactgtttgacagtcctgacggtatagacttatgagcgtgcataacgcattgtggaagcatttacatataggaacttgtggtcgttacaccaatgaaaatgagagtacattgttgacacagtgtggcagaaattgtaccaaggaaacttgctttccttggctacgtaccaaggttcatggcggttcaagtttgacacagggtggtgacaacgaaaggcccttggcttgtggaggttccatgtaggaacatgttcagttgggacaccatatcatacatttgaccattggaggatatataagggggaaatttataggggcctggataaacagcgcaaacaaaacatttgcgtggttatgtaacacgtgtgagttgccacatggccatgacttggcacgcggtttatatataaaggccgaaaggacagcaccaagtattatcccctgggacagcttggggtaaccacggaaactggacacgaacgtttgcacattatcctactgctatgtgaaagttcagagaggcaagaatagggtgggaaan

SEQ ID NO: 683129 - DNA, 499 bp, Homo sapiens
gaagaattcgccgtagcggcaccagcaggccagcacgtccaccccacctccccctcgcagcgggtgggtcccgccgccagcttccggcgagccgccggcgggcggcattgcgctctccgggccggttcttgactgacggatggcgtcgccgggtggcgggtacgcggaccggccagcgccgccgctggacgggatgatcacggtggacgggggcgggggcaggacgccgccgccggcggggctgccgaggccgccaggttccgggggctgatgcagcagccgtcgcggctggcgtccggggtgcggcagttcgcgtcgcgggtgtcgatgaaggtgccggaggtggtgccgggcatccggccgggcggcgggcggatgacgcggatgcagtccagcgcgcagatggggctcaaggggctgcgcttcctcgacaagacctccgggagcaaggagggctggaaggccgtcgagcgccgcttcgacgagatgagcaaggcca

SEQ ID NO: 683130 - DNA, 819 bp, Homo sapiens
  misc_feature (216)..(216): n is a, c, g, or t
  misc_feature (312)..(312): n is a, c, g, or t
  misc_feature (702)..(702): n is a, c, g, or t
  misc_feature (709)..(709): n is a, c, g, or t
  misc_feature (716)..(716): n is a, c, g, or t
  misc_feature (752)..(752): n is a, c, g, or t
  misc_feature (760)..(760): n is a, c, g, or t
  misc_feature (762)..(762): n is a, c, g, or t
gatctcaccagtttgcatgtgaggatggctactgcctccacggcagcacgcgaccggtaaggtctttccacgacagcgtcgattgttccgatgacctcctctgccataatgtcctgcagcgctgtggcccctgtgaacaatactctgctgctgcaagtaggccaccacctgaagtatcactatcaagaccaagatggtagtgttatacccgacggnagtcgagagaagccttggaagggtcacctggcgaaggctggattgacgactgcactgaagacatgagatgctccaatatcacattcttgaagtggnatctgcggatgatgagtacatgcggtcgcgctcgattgcttccactactcgtgacacgagaacctcatatctagtaccgagtactgacatgatgacctgtagacacggtaaggcgttgcggatcgtgactttcctgtgcgattgctgggcttcatggggcattcattccaacgcccgtaccgaactgttcgctacagcgaaaccaggtcctaagatattctaaaggcccgttactgggagtagatgggaagcacttgcactgatctcccgtggtcccccccgacatgtccagtcaggggcatcgcggtgctcaacaacttcggatacttgattggcggggacaacaatgtccaaggatttcgagcagagtcccgatgctggaggtatganccacggnacaaccnctggttccagatccagtccctgcagcaggagcacgncgactgtncntgtgtgtgtaggcaggtacatctacgctgtggcgggcgtgactaccagcaatgacct

SEQ ID NO: 683131 - DNA, 383 bp, Homo sapiens
  misc_feature (60)..(60): n is a, c, g, or t
  misc_feature (149)..(149): n is a, c, g, or t
  misc_feature (164)..(164): n is a, c, g, or t
  misc_feature (181)..(181): n is a, c, g, or t
  misc_feature (219)..(219): n is a, c, g, or t
  misc_feature (221)..(221): n is a, c, g, or t
  misc_feature (263)..(263): n is a, c, g, or t
  misc_feature (268)..(268): n is a, c, g, or t
  misc_feature (344)..(344): n is a, c, g, or t
  misc_feature (349)..(349): n is a, c, g, or t
atggaaagtaaaagtacagaaaatttgttaaaggaaattaaaatggagatcatgtctcantaatctctgagcagacaaaattagttaggtctcataagtgatctcaacctcgcttgatttgcaaatacaaacaaaacttacattatttnttgtagctgcatatngaaaaaagagaaatgangctcaaccagtcagaagtagccaacaaccttatataantngaaactgtccaacaaggtaaacagacaaacaaaaaacaatanaaaangttgtgctaccaccaaatgatttctttggttctacattttttcaaataaatacttgcttcttacactgttcaatgnagganttcaattatcttttccgtcctgttatttataatt

SEQ ID NO: 683132 - DNA, 329 bp, Homo sapiens
ctgcagcactaatatcgctgtatccactagatgccagggcgcatgagttgattgtgaagctgtgcagtcgtcctcgctggtacttcatgagtgttgcgactttgttctgtgaggaccctcaactggccttcgcaatagactttttgactgggtacactgcgttgacctggatagccaaacatggtgacctcagggcccttcaggacttggtgtctggagcaaagaaggcagggattgtccttgatgtaaacgtgaggtccagttgtggataataccccgctggcacctggcagccattcacgggccaccagggggtccggcgggtaccg

SEQ ID NO: 683133 - DNA, 825 bp, Homo sapiens
  misc_feature (766)..(766): n is a, c, g, or t
  misc_feature (825)..(825): n is a, c, g, or t
gaggaaaaacaataatttacagatttttattactacgactttacgaacaacactttaaaagggggaaaatataagagaggggggtatagcaccacctcatagggttttcccctttgtttccccacaatttttttaaaacacttttttagcgcacataagccaagattagaatacctttcctcgggaaaatgtgaacattccacaagtacattttgtttgttagcccacaaacaacgcccaagggcacacagagggttgctagaggccctattgtgccaccaaacaaatgacccaacattactctggggtgggtcatattggaatccctggtctttaaaaagggaacggggtgtcttttctgccaccttgggagatttatctctaacaaaacacatttgtgtggaaccctttcttgcattaccctttttctatagaggcgaacccacagtaatgaaataaaagcttcctctccccacccgatttttaagggagagggttagtctctccaatatggcctctataacggttcttttttaaataaacaaaataagtggtgggtgggacacgtcctttgatacgccctggctcattgtggttttttctcggccaggtgtaaccacactcttgggtgtatataccacaagtatcttctataacacacacgagtgtgtattagaaaattatccaagacatggctcctatatatttcttagcaacccacatgtggtatgtgtggccacattattattttaaaaaactctttcancttctctaatagcgagaggtggggtgaaaaaaccttggcgccttaaatctttctcaaan

SEQ ID NO: 683134 - DNA, 685 bp, Homo sapiens
cgacttcttattcctaatctagaagaagggagaaatgaaatatgcctaaagctgtagggtaaaaaagccacacattttagctgacagggaactgtgtggtgtttttgtgcttagcaaagatttgaaagtttgtctaatttcatcacaaacacagaatgaccttgtttgacactgattttctgtgagatagtttatgtcaaacaagagtaccatggcctaactatgggcacaaggcaagctcccagcaacaccaaagcctgcaagttattgtcaggccagttcccaattctcagggactgtttttcttaaaagtatgcaaacatataattacaggttgagatgaatcatatgaaggaaataaatggggtactgaatagaaacagtagttggggagctactcaagacatggtggccgggcgcggtaggtcacgcctgtaatcccagtactctgggaggctgaggcgggtggatcgcctgaggtcaggagtttcagaccagcctggccaacatagtgaaactttgtctccactaaaaagacaaaaattagccgggcatgattgtcagtgcctgtagtcccagctacttgggaggctgaggcaggagaatcgcttgaacccaggaagcagaggttgcagtgagccgagattgcaccattgcactttagcttgggagatgagcgaaactc

SEQ ID NO: 683135 - DNA, 222 bp, Homo sapiens
gtgctatgagcgagataaccaccacactccagcctgggcacagagcgagagcccatctcacaaaaaaaaaaacctttcaggaaaaaatagaacaaactcgttggggatctaggcccaggcagagttctttatacttaaagataatctgtgaaaggaacacttaattgaatttcattaaaattaaaagcatttgctcgggaatcctctaaagatcaacctgca

SEQ ID NO: 683136 - DNA, 324 bp, Homo sapiens
aagaatatagcgagacccgtctcttagaaaacgatgatgatgaaacagaggacggggcacgtgcgggagccaggggcctgggaggagccgagaacagccttaacctcggggatagaggccaacagggaacgacagagacagtatctagttagagccttggctccatacaaggatgatttagccccgagttcctgagtctattttatgccccttacgtactttgatagaactaaggaaatagtggtttagagtgaagggaaaggagacccagaaacattttacgttgcttttacttctgtagtgtagatagccccgggccgaata

SEQ ID NO: 683137 - DNA, 972 bp, Homo sapiens
tcaggccactttcttcagactttaagtgtgtatgtaagtgtgggtatgtgtgtttcttcaagtgtgtgtgttccaaaataaatgtgttagtcttccctccctgttcctttaccgttttcatttgtccaagcagtctactagagaaaaacatggtaggcttgagaacataaaggaagaggcatgtattggacatggtatattgggccctttctttatgttataagttgagtagtagccctctaattgtagttgggcaagtacagccaagcaccctgactcttaaccttattatgagaacttcctttttaccccttttatgttttgtgcaaaacagagatggggttgaggaaggagggttggcgagcaaggccagcttctgccctacagaatagggtgtgtcttgtttttttcaagtgaggcttgggaaagtgttcaaatgagagcagtcttaaggtctctaagagatggggaatgtgctatgtatatcctgcctgtgaaagcccaaacatatgggagaagctagaggatactaaaaagcaatgaaatgtgatttggaagttagaacgatgttttaaaaattacattataaatgtcaggacatgcttttatgtgtatatccgaaggggaaagccaggtacatccctgcaaagttttggagctatatgactgtggggaatggagctgtgaattttaacacgtactggcttgcctgagcaatgagccaacgctagccacgggatccacatgggttaggaagggccacactgggaggctagggcccaggacagggggcaagacataaagccctaaaaatgggcaaggcggggatgggggtaagctccaatatgggcgcacacacttcccactgtgacaagcgatttgaccgggaacagcggacaaaagtcctcggttggcagaaagaggcaacccccagaggagcacacacctcacagagaagatatatagggttac

SEQ ID NO: 683138 - DNA, 131 bp, Homo sapiens
tttacgccggcgtcagtggactgtgtacactatgatcattgataccaattaagctggacttggatcctcttcgcttattttctagttctatgtcctatcatgatgaatataccccatgcgtggattgccag

SEQ ID NO: 683139 - DNA, 179 bp, Homo sapiens
tgttatcctgtctctcacggactactataattagcccttactggccctagttccttattcctcaattctactgcaatgatttacttatagcctttgctcaacacaaacaaataaaaccctttcaatgatctataactagaatacaagttcgaattctctgcccttacattcaatgaccc

SEQ ID NO: 683140 - DNA, 392 bp, Homo sapiens
gagaagtcctggctctggggtcaaagaaaggatggcctgagagcggctcgactgcgggagtagagcaggctgtgcacgcccagcgcgagggcccgcgggcacgcgagcggcgccgagattccctgcgcgtcccagcagagtcctggaccagcgggggacccctccccatattaacccacgcggcgcgcaataccatgccacacttgggagagccgcactcacacacccgctccctcgtgcaaacaccggcatgcacgtgcacgccgcgcttcaccggacagcgcccggactgtaccccgaagtcgctgcggcttctcgcgccttcctgccgcgctgggtagcctgatccctgcccctgccgagtcctcacctgggggcgaggaggacgcgca

SEQ ID NO: 683141 - DNA, 306 bp, Homo sapiens
gggttttttggggggggccctggggtcccccacccaacaaggtgttgcccttttagaagggcccccaataaaaactggggcagtttttggggggccaaattaaaatttcgggagggcccctttttaccaagggcaaggtcccccggaagggggggggggcccaagggtttcccccctaaaacattttttatttagtggggcaaaagggtctgggccctgtttaaaaggggggcccccccctgggaaaattgggggattatcctggccaaaaaaaccagtttttaaaaaaaagggccctttttttga

SEQ ID NO: 683142 - DNA, 143 bp, Homo sapiens
ccttcatcatacctacctgagcgtgtgtgtgaatgtgagtaaatgtgagcgtgtgtgagcgagtgcgaatgtgtgaatgtagtcactgtgtgtgacatagagcatgtgtgaatgtgtgtgcgagtgtgtgagcatgtgtgaat

SEQ ID NO: 683143 - DNA, 268 bp, Homo sapiens
aatctcccactcccacactaaaaaggaataaatgaaaattgcagcatgaacaaaaccagagtggagacatgggccatttcctgggagtggtcttgagccaacgagggagctgctctatggtccggtgcttgtaactactgacgggtctccgtgggcacagatagataaaccacaccaagttatgaaaagagacacgtaaattttacttaatactagcctatctctaccaccactgaccccaagtggatgaagtgtagttttgcatttg

SEQ ID NO: 683144 - DNA, 239 bp, Homo sapiens
agaggatggcggacagcgtcagaggtacttatcatgaatcctgcccttcgtcagacaaccttgatgtcatcgtatatcaacgtcctgcgcatcccttctgagccacccgcccctgtggtgcataaaccctgggtctggggtgatggtgtgaggacccatcatctcatctcactgacaccgagacaccgacttggcttctgtgtgtaggttaagttcctactaaatgtttctttccaaga

SEQ ID NO: 683145 - DNA, 293 bp, Homo sapiens
  misc_feature (290)..(290): n is a, c, g, or t
aggcaggaggatcacttgagccccggaggtcgaggctacagtgagccaagagtgcactactgtactccagccagggcaagagagcgagaccctgtctcaataaataaataaataaataaataaataaataaataaataaataaaaacaaagttgattaagaaaggaagtataggctaggcacagtggctcacacctgtaatccttgcattttggaaggctgaggcaggaggatcactttagcccttgtgtgttcaagaccacaaaggtcaacatagtgagacactgtatncac

SEQ ID NO: 683146 - DNA, 351 bp, Homo sapiens
gggcccgagttcctgtccagtttatttattattcaaataggaaaaattcctttccaggttgttttactgtagcttataatgatacggtagttattccagttactagtttactgtcaaagggctgcctttttcagataaatattgacataataactgaagttttttttataagaaaatcaagtatataaatttaggaaagggtttttttagtttttgggttgtttagactcaaaaaatcccaaatttgtcagtaacaggtagttgtttagttataattcagagggtacagaatggtaaaaattccaatcagtcaaaaggggtcaatgaattaaaaggcttgcacctttttca

SEQ ID NO: 683147 - DNA, 1164 bp, Homo sapiens
tgtaccggcctcggaaattaggagatatagtgggatccaggccttctgggatgtcctcagtgctaatgcttgtgagagagaaagagagaactactaaggaacatactattgatttaaactcgctcctagtgttacttgtggtctgtgtcaccgtatctcaggaagtccagccagcttgactggcgacacacccctccggacatccagcgtgacggagcccacactgccaccatatgtggccgcctgagaacctcgtggccccgagacgggaactggagagaaccacactagaatggacacaatcgaccactacacacgaccactccctaccatctacggagacacaacaagcgaaggagtgcgcggggaccgaaacaatcacaaagaagggacacacagaagcgacacaccaaagcagcacacaacaaacgcaaaacagagcaaccaccagcacggcaataagggacacgactgaacgcaaaaacagcagaacaaagacggatcacaacaagaacacaccgaacacacaacagacaagaccgccaaatagagaacaccacaacagtccaccacgcagaacaacaaacacagggaagacagcaggatgctcgagaacagccgagacagcgacaacagacagacgaaagcgagatacacgagaagagaccacaagccacaacccgagaacccacgcgatccaaaaacaacataacgcacgcgaaaaccgaaccaagacaccaaccgcaacacgacaaacaaaccaatgcaacgaacagcacacattccggaccgggacaacaagacacacaaccaaaacaaaacacacgagatgaacacaaaaccacgcaccacagaccaacaacagcacacagcacccggacaacgcatcaacaacacacagccagataaaaacagcaatcacaagtaactcaagaccacgacacgacagcgcgagacacgatagatacagcgaagcaacacaaggtaagaatggcttcagagcacaaatagccgcacaactgacctcgccacccccaacgccgtccagaacaacccgagcaaaaaataaaacacaacgaacacaggacaaagctcgataatgcacagaggcagaaaagaggacactacacaactagacaagcaacacacagaaacaacccaaaa

SEQ ID NO: 683148 - DNA, 517 bp, Homo sapiens
atgcattgacatactaatcgagaaagaatatctggagcgagtggatggtgaaaaggacacctacagtgacttggcttagcccttctgcgaacggtctgactgtgtgacccgtagtcaagatcagttcatgtaggacaacgaatgcaataataactcaggtgcatagcagtcagcctgccgacattgtacctcccttttaaaaactgagcacgcaagactcccatctagcctggtctcggtatttcactatcggaactgctcaggattgatacattctcaagtctgtaaatactggacaccaacgccatttaccctaatttaagaacagcggggactgaccctccgtgccgagggctgcatgctaccgcactaagtcaatacatgggctccccgattcgcagctgtcgtcttggcagcacttgtcacgttggcagcactttgagagcaagtctgagtggacccacatgtaacctgctatgaaaaccatttgtatagtgtgtttcatttttaatgtgtg

SEQ ID NO: 683149 - DNA, 856 bp, Homo sapiens
tctatccatccattgatctacctacctacccatcatctaccatctattcacccatccatctcatccatgcatccatctatccatccatctacctacgtacccatcatctaccatctattcacccaaccatccatctcatccatgcacccatctattcatcttcctacctacccatcatggaccgagatgtttggcactgggctgacacttagcatcggtcacatgatgggtacggtaggtagatggatggatggatgcattttatccatcgtatcgaggcagttgatgtagggagttaaacaagaccagctacgcagaatcttagcatactcctctaattaccacataggatgaataatagcagttctaacgtacgacctaacataaccattcttgatttaactatttatattatcctaagctactaccgcattcctactactcaacttaaactccagaccacgagcctactactatctcgcacctgaaacaagctaacatgagtaacacccttaattgcatccacctcctctcccttaggagaagctgccccggtaacggtttttgccaaatggggcattatcgaagaattcacgatagaactatagctcatgatcgccaacatcataagccacatcaacctccttaactctacttctaccttacgcctaatctactccagctcaatcacgacggactccccatatctaacaaccgttctagtaagcatgacccgtttgaccttacaaaagccgaccattacttcccaagttttcgcccttacaagttgtcctaactagttcccctgtatataataatctgtaagaacaaaaagggggcgtccaagacaccagag

SEQ ID NO: 683150 - DNA, 575 bp, Homo sapiens
  misc_feature (260)..(260): n is a, c, g, or t
ttattttacccagcccccattcaagatggagtgactctggttcaaatgcctctgacacatgtgcctcatgttgggcatgagacctcactgtgtaggtgcagagaagaccctgcctaaacatgcctacacgttgctcctttttcctgcctcaacttccttaaaatgacaagagcagagccctttgggagctaacatcaggactccttttctgtactctgctccgtgtgctgctagagccacaagcctattaaactttgccngaaacaaaaaaaaaaaaaaaaaaaacaaaaacaacaactgtttccggcgcgcctcgcggcccctgcgaaaaaaaagcctcttaaaacaattcgcgttgggggcacgcggggcccccataaaggaattaggcgaacggggcccaaatggcggcggttctccagagggagcaccgcgggacaagtgcacacacggcgtgggatcatcctcgacaataaaaaacagcccgcggggcacacgcccgtccgaaacaaatcccacagggacttccagggcgcacaacgggccatcccacaaggccacagagagccgacata

SEQ ID NO: 683151 - DNA, 129 bp, Homo sapiens
ctcattagagactcagtgccaggatttttattaggggcagtcacattctgcctgccacataccaaaattccagactttcacaagaaatcaggtgttcagcacaaaccatattgtttcacaaataattta

SEQ ID NO: 683152 - DNA, 916 bp, Homo sapiens
  misc_feature (681)..(681): n is a, c, g, or t
  misc_feature (916)..(916): n is a, c, g, or t
ggaacgcgtgggcggacgcgggtgggatcaactgggatgtttcactattaagtctgatgtgtggtccttggaatcctcctatacgagatatgtcacctatgggaaaataccctatcccagggtagaactaatgcgcgacgtgatgaccgcctgtgccagggctacgggatgccccgggtggagaactggccagatgagctcttatgactattatgaaaatgtggctggaatagaacaggcatgaatgagaggaccaaggtatgactacttacagagcgtccttggatgatatctactacgagccacgagtaagggcaattatccaggacgagcgagccgttagagcacagggtagacccgtgcatttggcatggtgtggctgcctcattgagagaggaataagtgagccatcactggttgctacttatgatttcatgtgcggggatcatctgcccgtgcctggatcctgaagatagaggctaacaacttagctcgaggaatgaacaccctctaaatgggaaagtattcttgtactcttagagggattctccatcagttgctacttggacttgtcctcggcagctggtagatcttgctctgttgacaacatctgagtgcgagcgttgagaagaaaagctgctatatctctgccaagaaatgcaacgcaaactaggctctatntttacaaagggacccttgggactcaaagttttcagagaccattggaagggatcccccataaatggacgagaagtgaagggtcgttaaaagggtaaaaagcggggattatactggaagacattattggggctagggttactgtttgaaaaaagaagagttatcaccgttgtaattgggagggagcagttaaagtggtccacaatagaggtttcgtcacccagatgggagtacagtn

SEQ ID NO: 683153 - DNA, 461 bp, Homo sapiens
  misc_feature (220)..(220): n is a, c, g, or t
  misc_feature (350)..(350): n is a, c, g, or t
aaagtgcagcaacatggacagggagggcagaggtaggacaacaccagggcaggcagtggctggggataagcaggagtatacaatagaagaagaaacggctggggtgaggaaaagcggatgctacatatcaatgtgcgcactttgccaggtaagtcgtaacttaatatggaggcctacctacaggtgtaaaacccccctactaagcatatacctaaacccngagtcgttgaccctaggcaaggcatcctaagaggtttatgccaggcagcatgatacgaataaaaaagttgggaacaacaatgtggaaattaacgacactcctacgcggtccaaccttggggtagttgcangtggcagtgcaggcgtacgtaggggtggtatatatagggctaagggttttgtggtacggggcttttccttttcttgcttttttggtttaggcttgactttttacacgtgct

SEQ ID NO: 683154 - DNA, 116 bp, Homo sapiens
ggtgggttccttgcagagttgctgtgcgcacacggagaggccctagagagcctcatggatgtaactagagaagaagagggttcctttatgtttttttaaaaaatgatttttaaata

SEQ ID NO: 683155 - DNA, 100 bp, Homo sapiens
acctaaggatccagtgctactccacaaacagagtgctacctccacacaacagtgtatagccagtggaatgtggcagtgtgctgtttgtggaggtagcact

SEQ ID NO: 683156 - DNA, 944 bp, Homo sapiens
aagtttcttcactcatggggatgtggtaccattggtgtcaggagccctgggggcatgctgccttgggatagctgcttgccaacacagacgtgtttctgtccagagccccagaatagcggtcctggagtacctggaggatatagacgctgagaatacactggaggaaggaaccgaaggactgttcaagagcacaaggagcgtatgggacaagaaacatggagctgtggattagtggccgtgcgggaggccaggctgtgatcctcgtgtcgcagaggagagctgcggagtctgtcctcccgtgataatagctatgtggaccagctggggcgtggcccgctctagtgcagggggtaagaggagcacagtctaggacgtggaaggtgagaggactttccaagctcttattgtcacctggaggaagatctttccttggagtgagcacgcgagacgaagttctaatgggtccacaacaggcgggaagattgactgtcaactggggattttatccgggactgggaagtgtggtacaacttcttccggagcctggaacggggggctctctgggaaaacctggaggggggaggcttcatacttggggggaggtgcggggggggacacggaaagcaggctttttcttgagcccgggaaacaaatttggggacccaggtgactcttcgagcgtgggaagaaggaggcataataagaggctcaaacaccaaccaatgggtgccccgaaggaaacaccgatgggtgggaaggcgcccaccaaggcgaagacaggagagacaaccgcagtcaagagaagatgtatcacccagacccgaagggagggagacacaatcaactcacagcggggagagagagatagaacatcggatgtgacgacagacaaacccacacacactgtcataagcgacgaacaagcgatcagcaacatcagagaa

SEQ ID NO: 683157 - DNA, 398 bp, Homo sapiens
  misc_feature (4)..(4): n is a, c, g, or t
  misc_feature (12)..(12): n is a, c, g, or t
  misc_feature (55)..(55): n is a, c, g, or t
  misc_feature (102)..(102): n is a, c, g, or t
cccntgggcctnggcagggaatcttcctttctccccttttaaatccctgggagcnactgctgaggtctgagccgttctcccaggcccccgtgctccccctancatggagcccagctcagggactgaaacctggcggtgtgggctggaatcccaatgcccccttactgaccaggaggccaggacgacagagacatggccatgcgtctgcagccagaaccccccagcccctgggccgcctcccgggggctgccccaactttcccagcctctgagcttgagtttccttgggacccgcctggccccagaccctgtgcccacccttcacctgcccggggccacgaggacgacggctgtgagggcacacttactagttgggaatataaaaatgctttaacttgc

SEQ ID NO: 683158 - DNA, 167 bp, Homo sapiens
  misc_feature (131)..(131): n is a, c, g, or t
agacgtccccggtagtggatcttggcttctctttcctcttctcctccaggtggtgtcactgctggtacttccagccaactcgtgagccaggcgccccagataggcaaacttctgtaggcttcagacgcacngaccttgagggcagcaggaaccaccatccgcttttt

SEQ ID NO: 683159 - DNA, 176 bp, Homo sapiens
cagtatatcaagtaaaaccaaccaatatattttacccaaaaatgttaattaaactaatttgggcatggacaaagaattctttctgtattcaaatggggctaattcagactccagactgaattttaattcaagttctttctcaagtctataaatattaaactgattatttcattcta

SEQ ID NO: 683160 - DNA, 311 bp, Homo sapiens
ctaccattctacccacgtgtttaagcaattctcctgtctcaaactcgcgagtagctgggattacaggcgcccgccatcatgcccaactagcttttgtattttgagtagagacaaggtttcaccatggttggccaggatggtcccaatctcttgacctcgtgatccgcccgcctcggcctcccaaagtgctgggattacaggcgttgagccactgggttgcggtctcactcatcatatatttttatgaactggtccattttggatgggttgcactcaaattattttgtatttgtccagttaatctttgttac

SEQ ID NO: 683161 - DNA, 255 bp, Homo sapiens
ggaataactaagtaaaataaaaaagaaagacagacacagccaagttctgctgttcatttggattcaccccgcgagccaaggacaactgtgcttggatttcaggagcccaagtatgttacactcttatgaaggaggttttccttggtctttctaaggtaggtccactaaggatcttaggtagagcccccaaacctgcttaaagataaccttccccaaaccagtgaactattgatctctatatagagggtgtgattt

SEQ ID NO: 683162 - DNA, 314 bp, Homo sapiens
gctcggtacttctctcctcccactcgcctctgagtagttgggatgacaagcacacaccacacaccaccacacccggctaattttttttagagatggagccttgctgttgttgcccagtcgggtctcgaacttctggcctcaagcaatcctgcctcagcctccaaaagtgctgggattacaggcatgtgccactgcacctggaccagtgtgtatttcatacttagtgctcatctcagtttggactggccacatttcaagtgttcaacagccacatatggcttgtggccaccatattggaggtgggaggagaggaa

SEQ ID NO: 683163 - DNA, 392 bp, Homo sapiens
  misc_feature (59)..(59): n is a, c, g, or t
  misc_feature (179)..(179): n is a, c, g, or t
cgggggaaaaaggggattaaaaagtggaaaaagatttaccctagaagtcacccttcgantggggggcaatccctgggggccttcctttccccccttttgaccctcaaccaaacttgcatggccatggcagggcctcgggaaacccttcaggagtggggaagggtttttcctccatgatngcccctcctggtccccccacaaatcagggacagaaagtttgtcccctttgaaaaaccctttccaggcggccccctgcccatttggacccattgccccgccaggagcccccaagtatgtgggaggggacgggggggacgagcttggttgttttgcggcccccgaaagctttttgttatcctaatttttgtaaaattaaatgattgggccccata

SEQ ID NO: 683164 - DNA, 759 bp, Homo sapiens
agcggagtggactggacgtcattgccgggaacgagcgagtcgccgctgcagacctagtgactgtgcgcctgtatcccgattgtcttctcctccaaggtctacatgattacctgacagtttactaagtaagaccactgcaattatggccatttcttcacatgaagcgttcaagaagtgagagactgtcgctagaaaatagacatgatttcaaagttatgtctcattaatctgactgtggatatcatatattctacctcctataggtaatgcaagaacgtgtgttgctgggaagcagagaacgcgaagcaactgatagtactcttgtgtctacacctacagcattacctgtaggtatacgccacagtcagtctacaatagaggttaagcatacaatacatacataacgatgtaaatggaccaaaagtgaagcaacattcttgcacgtacagcaacgtgtatactctaccaaagcaagccatggtcttacatattgggatcttacgaaaccttacgccactgtctgctacaccaaagggcacttacaaaaaagtgacacatatgtatgtcccgatattaaacagtactttgacctctgttatcaaaggctgatattatggccaatcaagaatgagaatgatttcaccgtttagctcacatttaagccaagttcccaacatctctaagaacaagtatcggatcagtggctggttaagacagaacaacatcaacaaggcatcaagatctctgaaaacaatataa

SEQ ID NO: 683165 - DNA, 122 bp, Homo sapiens
gatgggctactctccgaacgagcccctgaacttccacgccatgtaccagcccttccgtgagatgatacacgaggctcagcaggccatggacatccaattccatagcccggccttccagcacc

SEQ ID NO: 683166 - DNA, 1856 bp, Homo sapiens
  misc_feature (1414)..(1414): n is a, c, g, or t
actaaaacgtacgatcattctccctatcataggaataatattataattctcttcatagactcaactactccctccactcataatctaattgtccttatgtaatgcgagactatactcatatatccgtgtgattgccctcttattagccttaacatcatctactacaaaccatacaaactaaaccttacattaaccttacatctaatcctccaagtaactgcgtcgacgcgtacatattgacgcatataacctgatgctcgtatatcgtactgcccttggccgcagcgcaatgcaagtgctcgtaggctcctatgcacctctgacctcatgctccattacaccttatccgacactaccattatatgagtacatacaagactagacgggatcaatacagaccttacacatccctattatccaatcagacatttacaattagagtcagatcacacatggcatactctagatacttccatactcagacggaatactcgaaacccgatgcatacctcgtggcgcagaaacataaagtacgtatttcaaatctagcgcataagtccatagcatgtaaacacccacaactcaatatgcacctaagaatctaactgggggccgatacatggaccgacatcttcaccctttaagtatcgtggtttttgaaaccaccaaataacagtacgataacggtaaacatgacccactggaaatttttgaagacggtacggctactccgcccacttttacagctcacattaatattcacattcctcaggcaattaccacgcataagaaacggattccttgtgggccattactcctaatagtaaggcttagatctcacccatcgaattttacgggtcatatcaagaccatacaaccaagaatttggctagcagtttacacggcgcggaaccgggttccttaaaatagtccactacaccaccgcttaagatattctcacactcggtgttaaccgaaccagaaacaccagagcggtgcgtattactaatccttacgcttgagttatccaataagtggtccttccttggcagaaacttcacttgtttgtgccagttcagaaatcacaatcacagcctatttaccaatgagcgcccaatacgcatacccttaagaaaccattataactttttaccacgcacgttaatcacaacatttcttgtttatggaaccaccattacgggtggcaccccgcgataaataaatcaaaccgggcgataatattaatggacaaaccacacaccccccggtaaattagtacgcgcggcatttcgtaaaggaacgcacagaaaaaaccggtccactaggaaaatcaaggaacagatgaagcacagagtctacagcatattacacgcataagatagacattaaacgaagacgcacgaaaagagagagnagcatccacccaaatattcaaaccaagatacattaacctcagccacgcgcatagcaattgaacaccagacacagcaacacaacagcacgaaaaaagggcacaaaacacaaaacacaagacaacacgacaaacagcaccggatagcaaggtggacaccagaggacaaaaaatagagaagatagcgaacaaacacagagacgaaacgaggagaaacgagaaacgaaacgagacaaccacgaaacaggagaaggcagagaaaagcacaaagaagaacacgacaaacacaagagcacgcaacggacaagagcagcaacaacgcacgaacagagcagcagcaaagcacgaaacacgaacgaaataacgaccacaaacaacaagaaagtagagaaagcagacacagactgcagaagagtagaaaagagcagacacaaatcacaaaagc

SEQ ID NO: 683167 - DNA, 249 bp, Homo sapiens
atgttatcccaacacacactttaaatgtttgctcttttctctcagtctctatattttatgagatcatctggaaaaaaaaaagacctgattggtggcgtgtggttggcttggttaaggtaaagttttactacaaacccctcataatagagttggtattggtttggagggaaacttggtatttgaggaaataatagtctagttggtgctatagaactagagacagaaagtattttcaagtgtggggcgata

SEQ ID NO: 683168 - DNA, 1952 bp, Homo sapiens
  misc_feature (778)..(778): n is a, c, g, or t
  misc_feature (798)..(798): n is a, c, g, or t
  misc_feature (1188)..(1188): n is a, c, g, or t
tggccttaaacaatgttttttgtttatattaaaaccactttatacaactctccactcccattctttataggttgacgggatatggtggcgctaagtgatttatctgataaccattttttctattttcagaactccatataactccaaggtgcctctcgtgaattatttacagaggtgtacacaacaacagagtgtgggaacagtgtggcagagaagagacagagagacggaaacagacacagaggggcaccatagaggtgtatcctccgcgagttgtatagagagtttttgtgtgtctcccaatgtgagaggggggaaatgacaggcaaagtcttgtgacagagcatatcattctttggtgtgtagtgactcttttaactacatctactttatatcatacccgtggcgtgttacacacgtaatacatgtgtctttttcaccacaaatatataaaaattctacaagacgagagcgtcttatcccccgatgagagcgccgtgtatacaccctacagagagagattattacgcggctcccgtgtacaaacaccaagagtgttttttcttcccccaaacatgttgtgtgtcttctataacctataaggcatcttataagccacacacggacacaatttgcttcccacgcaaaatataacaacgtcatgaaggtctacaccaccgccatcttcttacaacacggcggcgcgggcgcaacaacactctccccccaataaagggataaccataactttcttcgtggcgttagtagtacgcgcaancggtgtaggtctattactanaaacaggcagcgggagcaccaacatctaccccattcttatcttgtcgcccgccatgttggggatgtagcacagggctcttctatacgacattatacaccaatttctaccaagccggaaaagcacacctttcctgttgaacgaccaacattttctgcacaccacctgtgttgctgtcttactatgcactctaacacaccacaccacggtgcggccagacacgcggaccaacctgtcagaccatttctttcccccgccctaataagcgtaagacaaccaccgactaccactcacacatcgtgtggagacacgcctctctaaaactctttttgtagacacacaccacataagactagtcgcccccaccgagtgtgttaaattcttgaaaagcncactaaagtcgaacgagagaacgtcttactgcagttacaagaagcgacgcacagaaaaacacccgacggccttttgtaaaaaagaatcacagccgcccaaggccgacttatttcataaacacgaggtgctgctctaatcacaccatcaaatagtcgacgcgccactacaaacacatcgctcgcgcacgactaaaacatatacggagagctcttattaaatcactgccgcaacgatacgtacgcctagtatttaccacccgcctacatacagcgatgatagtcgagtcctcaccacactggaagatcagctcggaccactataaaggggggggcaccacaaacacacacgggtcttccccgtgttctccggctcctccctcagctagcacctcaacaagtggctcgccgtcaacaataattggttagattaagcgacgcacgaagagccaaccattcataagtacgccagcaacagacaccacacaactcatcatcacaaacagacaaagcgtattgctccagtccgcccacgcacacagttatcctcgtgcggatcgcttgcacgtgagaataacacacatagacggatcagtgcacacagttatagatataataccacacagcagcgaaccagcgctcagatcagtccagtctacacaaacagaaatcacttcacgtcacctaagcaattcgacgtacacaatacgatgtcactcagcatgaatacgttcttagacttatttatatgtactcatatcacttat

SEQ ID NO: 683169 - DNA, 162 bp, Homo sapiens
ctctgagggcagtagaacgggtggccatagccacctcctgggtatagaagctttgtagttcatagcttcgagttagtgtgtcctctaggacatactgtccagcctctacagcattagctgtggtgaagcaaggcaacgtgtctctgacagggactatagtct

SEQ ID NO: 683170 - DNA, 463 bp, Homo sapiens
aatagtaggtgtatatatttatggaatatatgagatattttggtacaagcatgcaatgtgtaataatcacatcatggaagatggggtctccatcaccttaagcatttatgcattgcattacaaacaatccaatgatactcttttagttattacaaatgtacaattaaattattattgactatagtcaccctgttgtgctatcaaacactaggtcttattctttctatttttttgtattcatcagccatcctcacttaccctccaaccccccactacgctttccagcctctggtaactatccttctaagctttatgtccatgagttaaggtattttgatctttagatctcacacataagttagaacatgggaaggttatctttctgggcctcatttatttcacttaatataatgaccttcagttgaatttattttgtctaaaggttttcttttaacattggttt

SEQ ID NO: 683171 - DNA, 226 bp, Homo sapiens
ttcctggagcagtagagggcaatcgttaagattgtggattgactgttgtgtactggtgaaggattctggatttggccgggcacagtggctcacgcctgtaatccccacacttcgggagaccgaggcaggtggatcacaaggtcaggagatcgagaccatccaggcaaacacggtgaaatactagaaaatacaaaaaaaaaaagccgggcgtggtggcgggcgccgg

SEQ ID NO: 683172 - DNA, 250 bp, Homo sapiens
ctaattggttcttcgatgacggggggaaggaaggcaattgggtcaagctaagtggctgggctggggggcagggcaccggagaagatattctagaggcggctgtgggtgtgtgtgttgggaggggtcctgccaagacacttactccttcaggatctgcagcttctcccccttcagcatctgcaggtcccggtcgttcatggcattgtagttatacagggctaccacgaagcgtcatcgaagaaccaattag

SEQ ID NO: 683173 - DNA, 3163 bp, Homo sapiens
ggcacgaggtctccaaaaaaaaaaaaaaaagaagctataatatatatctagattaactaatggagtgctctgtgaatattcattaactacattttatctatttactatattttatatgggtaagaccagtggtcatccgtatttcttttgaaagcccacttgatcaggaagtttatattttaagcagtatgtttgcacaatggtcagttcacatttgattgcttgtattactaattagaggtaaaacttctattttttcttgataattctgtaggcaaaaaaaattggggaaggcaaattacaatcattcttcttctgtaatactttgggacaatttttaaacaactcagacccatgtttaaaaacgagttttgtgtgattaacccttgtatagtatccagttactgtcttctcttgaagtggtggttctttgagaagtagaattattttgtaacttttcttctcccagaaacagaagaatcaaatactattctgttaggattctatctagacctgtgactcttagtataataacccttttattattattattattttttttttttcagtaatctataaagtagagttgcttagttttgagcaatttagggcttttcttattggccagtaggttattcattttgctgctaaatataatttttgggttaattttaacattatagtgctggccgcttggttctatgattacctaaaaatctagtttttttcctccataggtagatgtgtgtgtatgcatacccccacacacacacgtacatatatgttgtcatagagaggtatttcaacccttatttcaaataacagtagaagatacgaacatgaatttatattttgtaaaaatgtcattcatccactttgttttccattggaaatagttttataagaagggttccccttgctctctccacttaacaatttcattatatacgtagaaaaagcagccgacttaagggcttgatgttttttcaggccttgtggattcaggtttccagtttcccagtgcccttaatggatgttatgaatgcataagcacattttcttttaaagaaagaagttagatttatagtgttatttcttacttgctatatttctttgcactaaaaaagagctatgtgtttgttttataggacactttagtaccgtattgcctacaataactcagtttgctccttaaattccaaactctgggaagttgataaataacttccatgatcacttgtaaaagttacatgcacatctgaaaaaaaatcacaaatctctatgacagtaggttatgttttgagcttgttaccttgcagtattcttctctgttccataggtgaaaacaaagggtgacagaggttatcaggcaggaaatgcctaaatacatacatctctgcatggtacaatttctcatattcatgtattccataaacagtgttttttctctgtttaagcagactgttgtttcttctgagtcagtgatatgtgatcttcgttggtttcattttgtgaagctcagtctgtctctgtaacatactttaggatttgcaccttgtgctccccaggaattatgttagtgtccttttctatgctgtcttcaaggatggacagaggcctaaaccacaacaacaacaaaaattagaaaaaaaaatacttagatttcggtaatcatccataggaactcatagcatcagtctcttttctctgtgaataatatctttgtgtaagttgtcataaaaaatcaacgttagaagatgacaattagatttcttcttaggtattgagggtaagaagttgtaaagaaagaaaattcgtgtttcaactaaaagattggattgcatatacctttgaagtggttttgtaaaaaaagttcagttactaaactgagtgtgccctgtaatcctttttgagtgcactgaagatgctttgaaaatactttgttggtcttcacattgtgcatcatgtcctgcaacttgtaaatatgtgcatgttgtttatgtttgtctgcctgtctcttattgcactaaattctgcaaggtgaataatttttttataccatttatttggaaaaagttcctcctccaactcttcttcactgaccttttaattagttggtaaacttagaaaaccaggtaggatttttgaagccctgagtttaaaagaagaatcgtggctatttgacatcatccttacattcccctgacttaaaaagctaacaagaagcacgagatcttccacctcattttagaaagcttttctacagaactatatgcttgcttatagctacctatctacagtttgaacagggagaaagggagatatgtatgtctggttacatcttccttcactcttgaattggctgggacagcaagcaacaacagtttgaggtccagtgacctacgtaaaatgagtgtcgtttgtgtcaggggacacatgtaactgtgcaacatggtattttctacagggagggctaggaagggtggttttggaacctaacctactttgtgtcttcattgtcagaactaaggttggaaatgccctttaaaggacttggtgaggcatatgctaggacaatagagctgctttagaaagaaattgagacatgttttgtcaggacagataaaagtttaatgcaggcttttgaacagatgttttaaaacaaatttgaccttaccaactatttttttcttctagccaaatcattgtacaggagtttcatatatgataaaaagtgttttgttattgtttttgctttcttggcaggggagaacccctaccattgtgagcagttactgtcactctggctgaatggacaaatagctgtgtaaatagcttctcataaaacgcttctactgatagctgtttgactttttcttcccgttatgaatgggaggaacatttgtaaacttcctttctgggtagctaccaaaaaacgtactggcttatggtcccatgtgaccttgtctccgttaagcccagaatctgagtgcctttagcaagtgttagcatttcacagagagaagagagacagaattattgctattaatcaccattcataaataggagcttggaataacaaaggtctgtgtgaattctgttctacgtcttttttttcccttttttaaataaatgtcaatttgatatcaagtaaaaaaaaaaa

SEQ ID NO: 683174 - DNA, 3097 bp, Homo sapiens
ggcacgaggtctccaaaaaaaaaaaaaaaagaagctataatatatatctagattaactaatggagtgctctgtgaatattcattaactacattttatctatttactatattttatatgggtaagaccagtggtcatccgtatttcttttgaaagcccacttgatcaggaagtttatattttaagcagtatgtttgcacaatggtcagttcacatttgattgcttgtattactaattagaggtaaaacttctattttttcttgataattctgtaggccaactcagacccatgtttaaaaacgagttttgtgtgattaacccttgtatagtatccagttactgtcttctcttgaagtggtggttctttgagaagtagaattattttgtaacttttcttctcccagaaacagaagaatcaaatactattctgttaggattctatctagacctgtgactcttagtataataacccttttattattattattattttttttttttcagtaatctataaagtagagttgcttagttttgagcaatttagggcttttcttattggccagtaggttattcattttgctgctaaatataatttttgggttaattttaacattatagtgctggccgcttggttctatgattacctaaaaatctagtttttttcctccataggtagatgtgtgtgtatgcatacccccacacacacacgtacatatatgttgtcatagagaggtatttcaacccttatttcaaataacagtagaagatacgaacatgaatttatattttgtaaaaatgtcattcatccactttgttttccattggaaatagttttataagaagggttccccttgctctctccacttaacaatttcattatatacgtagaaaaagcagccgacttaagggcttgatgttttttcaggccttgtggattcaggtttccagtttcccagtgcccttaatggatgttatgaatgcataagcacattttcttttaaagaaagaagttagatttatagtgttatttcttacttgctatatttctttgcactaaaaaagagctatgtgtttgttttataggacactttagtaccgtattgcctacaataactcagtttgctccttaaattccaaactctgggaagttgataaataacttccatgatcacttgtaaaagttacatgcacatctgaaaaaaaatcacaaatctctatgacagtaggttatgttttgagcttgttaccttgcagtattcttctctgttccataggtgaaaacaaagggtgacagaggttatcaggcaggaaatgcctaaatacatacatctctgcatggtacaatttctcatattcatgtattccataaacagtgttttttctctgtttaagcagactgttgtttcttctgagtcagtgatatgtgatcttcgttggtttcattttgtgaagctcagtctgtctctgtaacatactttaggatttgcaccttgtgctccccaggaattatgttagtgtccttttctatgctgtcttcaaggatggacagaggcctaaaccacaacaacaacaaaaattagaaaaaaaaatacttagatttcggtaatcatccataggaactcatagcatcagtctcttttctctgtgaataatatctttgtgtaagttgtcataaaaaatcaacgttagaagatgacaattagatttcttcttaggtattgagggtaagaagttgtaaagaaagaaaattcgtgtttcaactaaaagattggattgcatatacctttgaagtggttttgtaaaaaaagttcagttactaaactgagtgtgccctgtaatcctttttgagtgcactgaagatgctttgaaaatactttgttggtcttcacattgtgcatcatgtcctgcaacttgtaaatatgtgcatgttgtttatgtttgtctgcctgtctcttattgcactaaattctgcaaggtgaataatttttttataccatttatttggaaaaagttcctcctccaactcttcttcactgaccttttaattagttggtaaacttagaaaaccaggtaggatttttgaagccctgagtttaaaagaagaatcgtggctatttgacatcatccttacattcccctgacttaaaaagctaacaagaagcacgagatcttccacctcattttagaaagcttttctacagaactatatgcttgcttatagctacctatctacagtttgaacagggagaaagggagatatgtatgtctggttacatcttccttcactcttgaattggctgggacagcaagcaacaacagtttgaggtccagtgacctacgtaaaatgagtgtcgtttgtgtcaggggacacatgtaactgtgcaacatggtattttctacagggagggctaggaagggtggttttggaacctaacctactttgtgtcttcattgtcagaactaaggttggaaatgccctttaaaggacttggtgaggcatatgctaggacaatagagctgctttagaaagaaattgagacatgttttgtcaggacagataaaagtttaatgcaggcttttgaacagatgttttaaaacaaatttgaccttaccaactatttttttcttctagccaaatcattgtacaggagtttcatatatgataaaaagtgttttgttattgtttttgctttcttggcaggggagaacccctaccattgtgagcagttactgtcactctggctgaatggacaaatagctgtgtaaatagcttctcataaaacgcttctactgatagctgtttgactttttcttcccgttatgaatgggaggaacatttgtaaacttcctttctgggtagctaccaaaaaacgtactggcttatggtcccatgtgaccttgtctccgttaagcccagaatctgagtgcctttagcaagtgttagcatttcacagagagaagagagacagaattattgctattaatcaccattcataaataggagcttggaataacaaaggtctgtgtgaattctgttctacgtcttttttttcccttttttaaataaatgtcaatttgatatcaagtaaaaaaaaaaa

SEQ ID NO: 683175 - DNA, 1375 bp, Homo sapiens
ggcacgaggtctccaaaaaaaaaaaaaaaagaagctataatatatatctagattaactaatggagtgctctgtgaatattcattaactacattttatctatttactatattttatatgggtaagaccagtggtcatccgtatttcttttgaaagcccacttgatcaggaagtttatattttaagcagtatgtttgcacaatggtcagttcacatttgattgcttgtattactaattagaggtaaaacttctattttttcttgataattctgtaggcaaaaaaaattggggaaggcaaattacaatcattcttcttctgtaatactttgggacaatttttaaacaactcagacccatgtttaaaaacgagttttgtgtgattaacccttgtatagtatccagttactgtcttctcttgaagtggtggttctttgagaagtagaattattttgtaacttttcttctcccagaaacagaagaatcaaatactattctgttaggattctatctagacctgtgactcttagtataataacccttttattattattattattttttttttttcagtaatctataaagtagagttgcttagttttgagcaatttagggcttttcttattggccagtaggttattcattttgctgctaaatataatttttgggttaattttaacattatagtgctggccgcttggttctatgattacctaaaaatctagtttttttcctccataggtagatgtgtgtgtatgcatacccccacacacacacgtacatatatgttgtcatagagaggtatttcaacccttatttcaaataacagtagaagatacgaacatgaatttatattttgtaaaaatgtcattcatccactttgttttccattggaaatagttttataagaagggttccccttgctctctccacttaacaatttcattatatacgtagaaaaagcagccgacttaagggcttgatgttttttcaggccttgtggattcaggtttccagtttcccagtgcccttaatggatgttatgaatgcataagcacattttcttttaaagaaagaagttagatttatagtgttatttcttacttgctatatttctttgcactaaaaaagagctatgtgtttgttttataggacactttagtaccgtattgcctacaataactcagtttgctccttaaattccaaactctgggaagttgataaataacttccatgatcacttgtaaaagttacatgcacatctgaaaaaaaatcacaaatctctatgacagtaggtatgtttgagctgttacttgcagtttcttctcgttctaggtgaaaccagggggcgagttccgcgaagcaatactcatcgggga

SEQ ID NO: 683176 - DNA, 206 bp, Homo sapiens
tgtgcactctcctatatctactctctggtggtcatccttcccacgacccgctgaaggagcgcatctccctgccttctcggaggagcttctccgtgtctgcgggctcctggcactgctcaacctactgcaggggatggggcgtgtgctgctgtgcttcgacatcatcgaggggctctgctgtgtagatatagaagagtgcactttag

SEQ ID NO: 683177 - DNA, 338 bp, Homo sapiens
  misc_feature (36)..(36): n is a, c, g, or t
  misc_feature (93)..(93): n is a, c, g, or t
  misc_feature (171)..(171): n is a, c, g, or t
cacaatcattttttaatgtgagaaacccaccagganatggttggtagttgatttaataaatgctaataaatacccattgttctaaattgcctncaagagtttatgcaacatattggacatagtctttttttttttgagacggagtcttgctctgtcacccatggtggagtncagtggtgtgatctcggctcactgcaacctccgactcccaggttcaagcgattctcctgcgtcagcctcccaagtagctgggattacaggcacatgccaccatgcctggctaatttttttgtatttttaatagagacggggtttcactgtgttagccaggctcgtgc

SEQ ID NO: 683178 - DNA, 136 bp, Homo sapiens
cgcagccccgcaagacggtggtagattcctcatctgaggcctggcgtggtggtgctggccggtacactgcttagtgacgtgacacctggttggctcgggaggtggtggattcttcaccgatcgcctatggcttgtc

SEQ ID NO: 683179 - DNA, 421 bp, Homo sapiens
ccgcatggtagcaacactacatgtgagcagcatcacatggtagctttaccacatggtagcaatatcacatggtagcaggaccacatggtagcaacaccacatggtagcaccacgtggtagcaataacacatggtagcaacaccacatggtagcaacaccacatggtagcaatgacacatggtagtatcatcacatggtagtaacaccacatggtagcaacaatacatggtagcaatatcacatgtgagcaacaccacatggtagcatcatcacatgtagtaacaccacatggtagcaacaccacatggtagaatcatcacatggtagtaacaccacatggcagtaacaccacatggtagcattaccacatggtagcaatatcacatggtagcaacaccacatggtagcaacatcacatggt

SEQ ID NO: 683180 - DNA, 125 bp, Homo sapiens
ctagttgttcttcactgaatttatttattctttgtctaaaggtataggatcttctttgtctaacaggtatagtttagggttttcattctcttgtgaaggctcctatattatctttgaaaattagg

SEQ ID NO: 683181 - DNA, 412 bp, Homo sapiens
actaagagcactgaagttagtctgccggccattgcaccttagtaggtatagcagcctgtgaagagcgactgggtgaaaccagtcccagaagaaccggtgtgacacatactgtcctttgcccgcttgccagttagccatggcccgtttcataaaagcctcgtgggttgcctccttgtttgcagccttgccaccccagacagccagtgcatgtggcttgcagggccggtccataagagaaccttagtttccagggctttggtagaggccaaaggttgatagcattgaggttgagagtggcatcctcttcactcatgcccccagacaaaaagcagatgccaggcacagctgcaggcacagtacggtggagagctgttacggtggccatagctacgtgttctggagtatacctcct

SEQ ID NO: 683182 - DNA, 269 bp, Homo sapiens
accaggctggccttgaactcagaaatctgcctgcctctgcctcccgagtactgggattaaaggtgtgcgccacacctggctgatgttaataatcttaatagaaatacttatttaaaagattttaccagcatcaaacacaaagaagaaaggtggaggaatatagttggatagataacaggagggaatacaatgtgatgcagtttggtatgactaacataagtatatttgaggagataattatgaaactttgaaattataagtttctacat

SEQ ID NO: 683183 - DNA, 122 bp, Homo sapiens
ggtcattactacacatttttagtgtgcttaaagtagatagtatactttacatttataaaaaaaaaatcaaatttagtactttattttgtgtgtgcctgtgatgttttctagagtgaattgaa

SEQ ID NO: 683184 - DNA, 398 bp, Homo sapiens
attgagaagtgcagccagagtgaatcatcttgttgtcatgatcttggactttggaatgatactgtgtgatgtggcagtcagcaacagtgggagctcgaagattgatgcactgtgcatgttcaagcaacaaagtctaaaaagtgccagggcaatttcgtctcagtatatcacatgcacagcgtaaagtacgaagggcagaagaagccccatgccgctgttaaggcagggaagaaggctcactggtcctccgtcgtcagaatgtgagttccaaggctccaatgctcagtacgtcttcttgtgctctccttgcaggtggctcgctctgcttccagtatagtctgtgcctctatcagcagagtcatgttcatagtcatcctccacggtgatgtacccttggg

SEQ ID NO: 683185 - DNA, 982 bp, Homo sapiens
acgagtcccgcgttctctccttgaatccactcgccaggccgccgcctctgccgccgcagcctgcacacgccgcccctctcctgtgccaggaacttgctagtaccatgcaccatgccctaccaatatccagcactgaccccggagcagaagaaggatggctgttgacatcgctcaccgcatcgtggcacactggcaggggcatcctggcctgcagatgagtccacgggggatgcgattgccaagcggctgcagtccattggcgaccgagaacaccgaggagaaccgggcggcttcatacctgccagctgctgcatgacagctgactgagcgtgtgaagcccgtgcattgggggtgtcatccctcttccatgagacactctaccagaaggcggatgatgggcgtaaccttcccccaagttatcataatccaacggcggtgttgtgggcatgaaggtagacaagggcgtggtccgcctggtgggtacactatggcgatgactactcagccactggttggatgggctgtctgagtcgctgtgcccagaacacagaaggacggacgctgacttcgccaagtgccgtagtgtgctgacggactcgtggaacacgcccgtcagaccctcgcgatgatggaagaccgccatgtctggccgtgtttgcccggatctggcggagaaggcgtgagcccatcggggagccgatatccccctgatgggggaccagactgaaagcgcgcagatgtgccgagaaagagcagcgccgacagaagaccggtggaccccacatctacctgaaggcctgacagcccaaagggacccagccagctgcacagacgacaccggagatgcacgcgcacgcaggggcgcaggcccgcgcagcacacacgggcgccaagcgggcgccaccacagacacgcccgcacaacacaacgcgcccagacccacgccgcgccacggacaccgacccaaaaccccacacaggcc

SEQ ID NO: 683186 - DNA, 86 bp, Homo sapiens
ttttttcccccccccccccccccccccccggggtttaattttgtaaaggggggggggaaaaaaaaaaaaaaagggatttttcccca

SEQ ID NO: 683187 - DNA, 308 bp, Homo sapiens
acagtgcttttgaaaacacctcaaacttttctaaacatgaaagaaatcatagtggtgagaaatcctagaaatgtgaagaatgtgataaaggtttaaatggttgacacacttgattggaggtaagataagttatactggagaaaacttttacatgtgtgaacagggtgacaaaagttttaaccagtgctcacactttacttaacaggaaagcatttatacttgagaaaaattgtgcaaatctaaagactgaaaaagccattaatacatgctcacattttactgaacatcacagaggtctacttaataaa

SEQ ID NO: 683188 - DNA, 546 bp, Homo sapiens
  misc_feature (6)..(6): n is a, c, g, or t
  misc_feature (10)..(10): n is a, c, g, or t
  misc_feature (286)..(286): n is a, c, g, or t
  misc_feature (371)..(371): n is a, c, g, or t
  misc_feature (379)..(379): n is a, c, g, or t
  misc_feature (387)..(387): n is a, c, g, or t
  misc_feature (390)..(390): n is a, c, g, or t
  misc_feature (422)..(423): n is a, c, g, or t
  misc_feature (441)..(441): n is a, c, g, or t
  misc_feature (460)..(460): n is a, c, g, or t
  misc_feature (462)..(462): n is a, c, g, or t
  misc_feature (490)..(490): n is a, c, g, or t
  misc_feature (492)..(492): n is a, c, g, or t
  misc_feature (528)..(528): n is a, c, g, or t
agaagnacgnacagaaggggacacagtgttagacagaatccagggcccttaagccaagtgctccactggttaatattcagacatcagagcaaattagaattttgggataggggttaaaaaatcgaggcatataactcagataaccgaatgcttcaaatctccaccatgtcacacaagaccaggctacaactgcatatgatttgacgtggtttgttaactgctctctaacatcaacagaagaactcagcagggaatgggaaccagaatgccttaatttagagaccanggagtggtccgccatccattaatagtttccaaagattgggatggtaagagtaaccccaaaaccctccatttagggtttctcaccnccatcgtncttatttngcngtgggccaaccttttaaattggattttcctanngcccatgagggtttaggncctttttccaccaagtttngnggtggatttaggcagacccctttttggnancggaaccggtacggctttaatccgatggcaaggcanccaaggcatcgtagtgtg

SEQ ID NO: 683189 - DNA, 183 bp, Homo sapiens
cgttctggcccaccgattccatggcaaccccttgatacgggctctccgtattaaggaagacactagtgccatagcaactgtaagcggttcggtaccccgtgatggtgatcttcaggttctggccttcctgcacctcgatacatctgatgatggataggctcaaacgaggaaactccattcatg

SEQ ID NO: 683190 - DNA, 711 bp, Homo sapiens
agccatgtacattcagaggatcatagtggagtcttggcagcttcgaatatcatcaagaaggtgacatctgttggcgatgacgagaggccggtggtgttctggcacggttacggtgatagctataactctacagctatgcagcacgtcattggaatagtgcgagagaccaagcctgattcgtacacctattcgattaagctggacgacgatgactcgaaggaccaacggttatccatgttcagtgatgtcaacatggatatcgactatgtttgcaaacagctcagggaggttgattctcttgccaatggctttgacatgattgggttctctcaaggaggactgtttgccagggcagccgttgagcgatgcgcacttcccgttcacacactgataacgtttggatccccacactctggtatatcggaccttccaaagtgctctccaaatgattggctctgtaagaagaagaacgacgcattgaccaagccgggaaacatttggagagattgggtacagaataccatcgtgccagcacaatacttcagaagaagagatgactattacgaatatctggaaaaatctgccttcctcgctgatgtgaacaacgagagagaaaacaagcaacaactgtacaaggaccaatttgggttcctggaaagactggtactcatacaattcgagcaggaccagacagtttgtgcccaaatgtaa

SEQ ID NO: 683191 - DNA, 411 bp, Homo sapiens
taccctggtcgcaagtcgagactgcagtgagctgtgacagagccaccgcactccagcctgggagacagagaacctgtctcaaaaataatactaagtgggaaggctaaaatgaaccctgtagtggccgggcatgatggctcacgcctgtaatcccagcactttgagaggccgaggcgggcggatcacgaggtcaggagatcaagaccatcctggctaacacggtgagaccccatctctactaaaaatataaaaaattagacgagtgtggtggcgggtgcctgtagtcccagctactcgggaggctgaggaagagaatggtgtgaacccgggaggcggacttcactctagcctgggggacagagcaagactccctctcaaaaaaaaaagggtaataccatttaaagctttttc

SEQ ID NO: 683192 - DNA, 113 bp, Homo sapiens
ctagacgatcccctcgctatacatcggcacctcattcatcggcacccgtattgaattcaagtttaatatttagtatgcagtggacctctagagctcatggtgccgatgaatag

SEQ ID NO: 683193 - DNA, 559 bp, Homo sapiens
tttaaatagcttacaaggaatagtggttatatttatagaacattttataaaacagatttacacttgcaacaccaacaaaagcttgaaaataaaagtttacctaaagtaaaattggtggctgggtttggtggctcacgcctgtaatcccagcactttgggaggccgaggtgggcggatcacctgaggtcgggagttcgagaccagcctgaccaacatggcaaaatcccatcactgcaaaaaatacaaaaattacctgggcgtggtggtgcatgcctgtaatcccagctacttgggagctaaggcaggagaatcacttgaacccaggaagtggaggatcgcttgagctcaggagttaaaagaccagcccgggcaacacagagaaaccccccactctacaaaaaactttaagattacctgggcacagtggctcacacctgtaatcccaacactttgggaggctgaggcgggaggatcatttgagcccaggaggccgaggctgcagtgagctacgattgtgctcctgtactccagcctgggccacagggtcacaccctgtctc

SEQ ID NO: 683194 - DNA, 84 bp, Homo sapiens
tttttttttgcatttaacaatattttatttatcaaaagacacttgtctttctcaggtaagtgaaggtctagagatgaaacgagt

SEQ ID NO: 683195 - DNA, 771 bp, Homo sapiens
tggtaggtgcttggtaatcaatcttgcagtgtaaagtagtttgggtttattctttctttcagaatattaacttgaatgaatttcagggaaaattttgatactactcattttttttttttttttttggaaacagggtcttgccctggtcacccaagctggtgggtgcaggggcgtgatcacagctcacggcaatctaaaacttccgggcttaggtgatcttcccacctaagcctggtggggtacgctgagactataggctttgtaccaccacactttggccaattttggtgttttaatagagagggggttccacgttggtggttgtccagaatgggtcttgaactccggggctcaagccattccaccggtgcctcagcctcccaaagcgttggggatttacacacattgagccaccacttcccagcttgctaattggttttaaataccttttctttgggtgtttataaccctcattttattaatatgtaggaatagaggttagtaagtctatcaaatagggggcagctttaaccgcatcgagatggtgaccttaacctagttgaacactagagggactctcaaaactaatcacggaagttggagtccagagtatatccagagtatatacctgggtttcacaagtgtggcagaaccacacagtttttccccccaactctgtggtttccaacaacgacctaaggtatatgactaaaaattttcaccgtgggaacttatggggtgaataaattctcaggtaatagacctttttaa

SEQ ID NO: 683196 - DNA, 204 bp, Homo sapiens
agttagtcgggacgaactgtagcagccccatgttacacagcctctgaaggttctccaccaccgaaaaaatgttacgcctcttgtacagaagctgctgccgaatggggcctggggagaaagcggatcagcgtgtgcttcttcaggcgggtcgttcagacaattcctccagtgttgtccacccttggtagctgacttggcacaatc

SEQ ID NO: 683197 - DNA, 168 bp, Homo sapiens
tgtggtatttctcagtctgtctacttatcactctggattcttatcactctgggtgcatcttattgcacaccagactgatcaacatgttaggtacatctgcatcccagatgtgttcatttgttgatgggtgctcaaagactacttcttcactgtccctctaacaagaga

SEQ ID NO: 683198 - DNA, 103 bp, Homo sapiens
atgagacatctgataaagctcttccagtgtcaggatttgcgtgcctgggtcgcctgtgacggctagcggataaagaagacctggagattctcccgacccaggg

SEQ ID NO: 683199 - DNA, 777 bp, Homo sapiens
atttactttgtggattttgctgctgtcgaacgagtggattcgcctggctgtaggaattctactcgaggtttatttgatgatagcggattatatgcatttatctatcgtacctttgctacccaatactatgtcttatatgcttacatttattatgttctgtgacattatcttcaggattactatagagtccggtgatttagtcttcatcgagtttatagttttatatttgctctatgctctttatggttgtcttgttgtttgatctattccatattttctcttttcttctgctaaatcctgttctttgtgattttttttcttttacttctttttctctatctttgtatgttgtttgatgttttctatgtttttatctcacgtctattgattttcgttctatactagcttttcatgttcttatctccatcttgtctactcatatgatcattaatattacttttctaactttatttttcttttctctcctttatattattctttattactctgcttgattaatgctctgtattttcttatttatgtgtgtattgtaatgttaatcaatatgtaatttttatttcagtattataccactcttagtgttgtagttataatctattatgtattatatgatgacgttgtttaatacaatcttgtgatatgacgtttagatatgatcatgtctaatatcttatactttttatattgtatttgtaaacgtcttgctacgctgttatgcttatatagtcatcacgctcgtatactatattcttctta

SEQ ID NO: 683200 - DNA, 894 bp, Homo sapiens
tggttgtctttggcttgcgcgtttctcgtccattattggttcgctgtggcgcattgtatacattgtactgccgaaccctgtttatggtctgacactggtccccgattgctgtttctgttcatgttgtgtgctcggtcctgtgctcattggtcctctttgtggctcgggtctatgtactgcccctcatctgtgtgttgtcgttgtgtttggcaccttcttcggtgtcgtttgtggcttgtgtgtgtgctattttccccccatggtgcacttcccggcttggtaatttccgaatgcttgcatttagtgttggcaagtcgcatcgctgtttaataatgttgcaatttctgttaattattcagaactgtaattctgcaaaatgcccaactagttgagcgttctgggactacgctggactctcactgctgaatcgtcacactggataaagggttcgatctggttgcaagttgaatatgacctgacaatgtagcctctgtccttgtaagtcacgttgacttgccgcacatctctttgtgtaccttgtatcggtactggcagaaaagtcaggtcttcaaaagccataggcttttccttgcccttagctgtaataatgcatcgtgattctcgatgtgctccagagctgggtttctgtccatcacctgtgtagtgggtccctgtgcttactactctggcccacgcctcacccccttgctcccgtggtcttcgggagtttgcgacattgatttgaagatggatcggtgttctcttgagagcaagtgagattcttagaattaagtgccaactatacagtgttataacatagctataaggtgcataggtgctgatttgtgataactgatagataactgatgtataaacggaggacatttatatgca

SEQ ID NO: 683201 - DNA, 550 bp, Homo sapiens
  misc_feature (118)..(119): n is a, c, g, or t
  misc_feature (495)..(495): n is a, c, g, or t
acgccgtattatatagtgtaaatctgtgtctctccccaaaatgtacaaccagtgatatagaaatcatgtggcagctacactagagatgtcaacgcatgctatgggcgttgctcctctnntcccccaaatccaatatttactccacagaaacgtataggcttagagaagttctagctacaagactgcaagtgggaagtgggggtgactgagggctggggcggggctacccccaggtccagtgtttcaggtgatggaggaggaagaagcccaagctgaggacaagtacaggagcaggcacaaggaaacattttcctctccttcttgtcttcctcacccccagattctcagccagtggggtccagtgtgtgacagggagagagaagctgggggcgcagccacctctccaggaaatcagtgttgtccagtggggcccaggtgctccaatgggccatgtccagtgtctatcctatatttctccccacccttccccaagcnatggctagagggagggtggagaggatcccatcaaaggaccagctgggtggcgacg

SEQ ID NO: 683202 - DNA, 170 bp, Homo sapiens
gatttatttttggttcacatctcaactatcacagcagccgggcccgcggcttcacatttgtaatcccagcacattgggaggctgaggcaggggtatcacctgaggtctggagttctagaccagcctgaccaacatggagaaaccccccgtctctactaaaaatacaaaat

SEQ ID NO: 683203 - DNA, 232 bp, Homo sapiens
gggccccttttttttggggttttttccccgctttttttgaaaaagccaacccaaaagggggggggggttccccccaaaggggagggttttttattttccccccccccgggggggggggggctttttaaacccttatggggaaaaaagggggttaattttttttgggcccccccctccccccctttttgggggggggccttggctttttttaattaaccccaaattcccccca

SEQ ID NO: 683204 - DNA, 512 bp, Homo sapiens
  misc_feature (10)..(10): n is a, c, g, or t
  misc_feature (337)..(337): n is a, c, g, or t
ttaaaccccntgggctaagtatctgacagtctcacatcctcaaccagtgtgaattaagtgtcccatagcatcagctcaggaggacactctgggagagtgctgaccaaaaaaagggttattaatactgacctactacttccaagggcagttctgaggtgattagagctttttttaaaaaccaagtatttggggatcctcagcagaggtattcatacagactcccaaagaactatatatgttcctgagaccatcgtttagtctacattgctcttcccagagactgacagatatgaccagtcaaagtgcaagactacctacccactgccatgaaaaccantgcaggaaacctttcccttccctgaatgagatttttttttccctttttatgtggggtaattatttgtgacccaagtgtaatttggatgatttccattaatatcaactcttgaagcctacttgtactgattgagattgtatttgttcctaataaaagtggatctggttgtactgtc

SEQ ID NO: 683205 - DNA, 291 bp, Homo sapiens
  misc_feature (190)..(190): n is a, c, g, or t
cccccgggtttttcccccccgggggccccaaaaggggccccgggcccgtttttggtttgggcccccgggggccttgggggtcccccttgtttttttgggccctttccccggccccctttgggcctttttaggggggccctttggggtccccccccctttggggggccccctttccggggcccccttttgnttgcggggccccaaattggggggccgccgggcaagacccccccccccccccggttttttttttttttttgggcccccataaatttttttggtttcaggtta

SEQ ID NO: 683206 - DNA, 116 bp, Homo sapiens
gcctgcacaagaacatgaaaacacctgtggttcttcctcctgctggtgggcaagcttccaagattgcagtcctgtcccaggttgcaagtttcatgggagtttgggcccaagggctt

SEQ ID NO: 683207 - DNA, 889 bp, Homo sapiens
tcaaatcccccaggaagggtttattttttttttttacaaatttccggtccgggggttccctgtggtcttctttgtggcccctttgtgcccaaaaaccgcgggcggttgggccggggcccaaagcggaaaaaaacaacaagaggtttgtaaaattttttcttttcctccagggaagtaatccacgaagctcttttcccctttttatatataaagagttctcgcgaagagggcatatgataaccgcggcgccgcggacacagcggtgggtgtggcccagtttcacagatttctttacagaacaacaaggtgtgtctctccttttgtggggggccacaagggtttccgcgtggaggaaaagagaagatatagaattgtgggaagcgcggtacacatcctcttagcgccgcgtcgttgaaaaagtgtgggcccctcgggagagagaatctccgcgggaaactctgtttccacccgcctcctctctggagaatcatccacacaaatatatgggccaacaagtgggcccggggcgccccaccctctcttgtgtgagaaaaatatgcgcgcgcgcaccacctctagaaccctcttcccttcacagcgcgctatagacacccccgacggctccccgcggagcggcagacaccccttattgcggggttgtccccccgagaacaccggaggggcgagaacaaaccacaccacaacgtgggcccccgaatatgtggcgcacacccccaaaaacacatggacgacacacacacgggagaacaaaaacagaggggccgccaccccatttgaggcacatgaacccaggagcgaccctaaaccacgccggcgggagagaactcctaacacacgggccacccaaggagtgctgcaaaccccccag

SEQ ID NO: 683208 - DNA, 120 bp, Homo sapiens
acgagactctggaacccctgtgctcttctcctcatctagtgaccctgaggtgatggagttttcaagtccttccagagaggtgcttcagccgctacaagagcagaagcacgtgggattgga

SEQ ID NO: 683209 - DNA, 223 bp, Homo sapiens
ggaaaaaacccctttttttaaaaaaaaaaaaagccccgcgggggtgttcctttttggggtgtttttcggttttccccccccccccccaaaacccgggggggcccaaaagtttcttttttttcccccgggggaaaaaccggggatttttcccccctccccccaaggtggttttttaaaagtttaatgggggtttttttttggataaaaaggggggcccttggga

SEQ ID NO: 683210 - DNA, 1157 bp, Homo sapiens
  misc_feature (2)..(2): n is a, c, g, or t
  misc_feature (89)..(89): n is a, c, g, or t
  misc_feature (117)..(117): n is a, c, g, or t
  misc_feature (213)..(213): n is a, c, g, or t
  misc_feature (219)..(219): n is a, c, g, or t
  misc_feature (246)..(246): n is a, c, g, or t
  misc_feature (304)..(304): n is a, c, g, or t
  misc_feature (308)..(309): n is a, c, g, or t
  misc_feature (311)..(311): n is a, c, g, or t
  misc_feature (320)..(320): n is a, c, g, or t
  misc_feature (322)..(322): n is a, c, g, or t
  misc_feature (332)..(332): n is a, c, g, or t
  misc_feature (380)..(380): n is a, c, g, or t
  misc_feature (415)..(415): n is a, c, g, or t
  misc_feature (422)..(422): n is a, c, g, or t
  misc_feature (434)..(434): n is a, c, g, or t
  misc_feature (437)..(437): n is a, c, g, or t
  misc_feature (453)..(453): n is a, c, g, or t
  misc_feature (505)..(505): n is a, c, g, or t
  misc_feature (536)..(536): n is a, c, g, or t
cncctgaccccatgtaccaaatatactcttttgtctttctctttattcccacgttcgccctttgttcagtccaatacagggttttgggnccttaacagtgctatattaattggtatnattatttctgttgttcccctcttgtttttgtttttttttttgagacagagtctcagtctgtcacccaggctgcagttcactggtgtgatctcagcncactgnaacctctgcctcccaggttcaagcacntctcgtacctcagactcccgaatagctgggattacagacaggcaccacacacccagcnaatnntngtatttttngnagagacgggntttcgccaagttgaccagcccagtttcaaactcctgacctcaggtganctgcctgccttggcatcccaaagtgctgggattanaagaatnagccaccgtccntgncgtattttattatatngtaatatattttattatattagccaccatgcctgtcctattttcttatgttnaatatattttaatatattacatgtgcagtanttagattatcatgggtgaactttatgagtgagtatcttggtgatgactcctcctgaccagcccaggaccagctttcttgtcaccttgaggtcccctcgccccgtcacaccgtatatgcattactctgggtctactattatgtgtgcataatttataccgtagatgtttactctccaaaaaacataaaaaccagaaaaaagaaaaaaacaagtgggtgagaagcacgaggacgcccatgagggactagttgttattaagaacacataaatatataagtaaatgggagaggctcacaaaagatagaatgagttggcagatagtgtatacaaaggagtactactagaggaagcacccgtgtgatagatagactaatatatggatgagagagagtgatattgttatacccaaacattgaaaaaaaacaaacgaccgcgcgggaggggtataaccatggaatggtatgtttgtgaaaaaagataacactacagtgatgaggaaaataaatgagagaagtagatattataggaggtatatagatataagcagggagtgatcacttaaatagaagtcgtctagtatattattataacatatttacgcctcatagcaaagtgtaggctg

SEQ ID NO: 683211 - DNA, 116 bp, Homo sapiens
ccatcccctcagcctgatacttctcaagctttcatcattcctccacagctttcatcacttccgtcatgcacattcccagtcatccatcattcacagtcatgccatggcagcacagt

SEQ ID NO: 683212 - DNA, 871 bp, Homo sapiens
taaatttacacagacgttaaattagcttcattaacaggagcagggattttttttttcacagtctccaatgggggcctaaataacttcattaggcaaaaaggccagttaaaaaaaaatctatgcaaaatcctaaaaataacagatgtgggggctcctcaaaaaaaggcaagctggactaattatcagcaagtctctctaatgcctccagttaactccagaaagcaattctggttgggcaagtctctaactatcccatgattttggaaacacaagggcccactaataactggctatccctaatccaaagccctattagccactatcagtgttttcctattttttggggtggtcatctctgggtcttaacaaacacatgcgggtgtgtccccacaggtacatttcaccaccactatgtgtggacccccaaaaaggtcacagacgcgctgcgtctctggtgtttggaacacattttccgcggggaatattgggtgttgagtgaatcctgagtatctgggtgttaccataacagactatcctcggggggggaatcacatctctggggtctctctgggccaagtctgcggcacaattaatgtggtcttgggccaaatagggagccacaataaaatacaccgggggcggggaaacagactccttatcgtgggccgagttggtggccccctattggtgaattctttacccggagggaaatatatccccaaaaacaaaaaagtgagccccgcgtgggtgacagcgggaacactttaacatatatcagaaggagagcgcccataaatttctagaaggtgtatcaacacgcgggcaaccttagcggggggaaataaaaaagggggtaatgtcaccggggaaa

SEQ ID NO: 683213 - DNA, 961 bp, Homo sapiens
ggttggtttgcaggatcctcagccatgttgcaaacgtgaatgtaagcctgagccagctgcgtggactggtgccacgggggtgatcttgtccactgtccccctgggtacacgcaacatattctcctggcgccggaattgcctctggtcttgatatgcattaagccctgatggcgaccggtggctgcaggtgggtgcatggtatcttcacctttggaagagccgggggtcttccgtgttgcgttaaatgtgtgtaaatagtttgattgtatacggggtacgaagtgtgcgtcatcaccatcttgacattcctcttcctctcctccagaattctcgctcatgacgcatgcattaagatagtgtgcatggtgggacgcagagcctgtatgacgtcccactctgagtgtcttaagaaccagggctcagaagcagcctctctgttgctgtcatctcagatactagcaggctccctcgcatgcattctcgcagcatagcaaggcagctcctcgccaatctgcaggcgtggactcagtgtgctgtactggtcgttgggtgctaggtgaacatcgtcactcgcagaattggaatcctagatcacatcccccagtgtcaagtggccgagggagccccagcccaagatggcagctgaaactgttgggcagggctccctcttgttggccatgtacccaggggctggctggcttgcatttgctctccccggagacaggcgttcttctgaagcacaacccgtggctagccaaatcccaggtgagtgctcaaaagctcagcttttgggtcctggtgaccggcctaatgggatatccggtgatcacctggtccacccttcctggtaggggttttcgggctggcttggacataagtcttagtactgataactcccggggatactggggatttggtaactggcgattttaaactttgctagttcaaccttttattgtgg

SEQ ID NO: 683214 - DNA, 436 bp, Homo sapiens
accatgaaaggtgtggctgtctgggattctgtggtgacaaacttaagcatccgatcaagctggggctattccttcaaattccatcctgtacgctgtcactctagaagcagctgctgctttgaacacctgcccaccctccttcccaagagtttctatggtgttggccccttgtgtttcctttaccagtcatgccatactgtttgggaagtcatctctgaagtctaaccaccttccttcttgtttcagtttgtacagattgttattattgtctctgcccttgctagaatggggggcataatctgtgccttgttcccttgtccagtgtggtttacccttgacctcttccttcctccgcgctttgttttgtgattcagaaaactgcttgtcacagactattttttttttatttataatgatatatgcttttaacataaac

SEQ ID NO: 683215 - DNA, 129 bp, Homo sapiens
cggtaccttcctctcctcccacctccatgatatggacaaattccaatgcctaaccacatgagatgcaaaatcacatgatcactggatgtacttgccactactctaaaaaatgccagacaaatgacacta

SEQ ID NO: 683216 - DNA, 269 bp, Homo sapiens
  misc_feature (246)..(246): n is a, c, g, or t
ctgaaagacaaaaagtagttagcaaggccgggcacgggtgtacgcctgtaatccctgtactttgggaggctgagagagggcggatcacttgaggtcaggagtttgagaccagcttggccaacacagtgaaaccccatctctactaaaaattcaaaaattaaccgggcgtggtggctcatgctacttgggaggctgaggcaaaagaatcgctttaacccaggaggtggagattgcagtgaggttcancctgggtcacagagctagctacg

SEQ ID NO: 683217 - DNA, 456 bp, Homo sapiens
  misc_feature (101)..(101): n is a, c, g, or t
caaaatccggaaacacattccgggcccgaggtccaccttttccccccgccgtcgaaggagttggcccttaacaaactggttacccttacgtgcctggcacngggtttcagccccaaggacgtgttggttttctggttgcaggggtcacaggaatttccccccaaaaagtaccttttttgggctttccggcaggagcccaaccagggccccccccccttttgtgtgaccagcatatttgggggtggaacccaaggattgaaaaaagggggacccctttttttgcatggtgggccccggggcccttccgttggcctttccccaaaaaaccatcgcccgcttggggggtaaacccccccatgtcaatgtgtttgttgtcatgggggggggggggggcccctgttttttaaccgcccgcctgtccccccccctgaataaattccatgttccccccagcca

SEQ ID NO: 683218 - DNA, 654 bp, Homo sapiens
tacatgatggttcatttcaagcgagcatatgcgagaatgagagtgactcaggccctatagacctcacagtgagatgtactcactatgggctactgggcaggatatagccagtgtgagtgtcctctaatcccagacattgttctcgcttcaggaagtatatataggcattatatcttgtgaacaggcacaggtggttctgcatagagatgttcatatgagcagactacttgtggggacatgccgttatgtacaagcgcgcagatttagaagaacgcggaagaatcggatttccaggtgtctctcattccagacacgtggtgctccgtcatgtgcaacgagggagatggttttcgagcatgccgcgtgacgagtctgaatggtcccggatatacgaggatagtgaatatgcgccaaagacgctgcaaatcccctggaactgtggcagaaagctatcgttgtgttgtgttaaaaacctccctgactggtgaatggcatctcggattgatggggaccaagttccagttgtcaactcggcaagttctggccagcgacgttcgttcagactctaatcgtgtcaatcatctttcattatctatggactggtggttgacgcacgttctccagccgcaacttgggacgagctggtctcggaca

SEQ ID NO: 683219 - DNA, 721 bp, Homo sapiens
gggtagagagagaactgagctccgaagctgtggtaaattctggagtcctaataatgcctttgcttcaggagctgggttggtctgcgggattagtacatgtgaggccgataaaggaccctgtcgggaagtctgggtcactgtgcgagggagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtggtgatccgcacagggccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgcttta

SEQ ID NO: 683220 - DNA, 958 bp, Homo sapiens
  misc_feature (898)..(898): n is a, c, g, or t
  misc_feature (905)..(906): n is a, c, g, or t
  misc_feature (910)..(911): n is a, c, g, or t
  misc_feature (927)..(927): n is a, c, g, or t
gacactgggggaggacctttacaaatgggcaatgttttgctttttgatctttcctcaagccctttgttaatctctgggttccttggtcatactcttgtgggtttcaaagcatttattccgggaagttaatacctccggggtgccttggttttttgtggggccaattgtctgtcggcaccactgggttattgctaatctcattgttttcatgagtgcttgcgtgtttcacgactattgtgcatgacgtcgtgcgtcttctgtgggggcttgcttcaccattggccactaattccatattgtctttttgtgggttccttagtgctggggaatactttcacgatgtgttctccctactagttatgggggtttgaggatgagattattctgaatcacatattttgtggggattatatgggtgtattcactccttatatcccctcggtagggcgcactgatagtgaatctagtggctctaccctttccttttcgagcatccatcttggggttctcgcaagccagttggcaggcacatctaccggggtgtggtgtgagagtgtatagtatttggttcacggtagtctggggttaagcgtcacttttttctcttcagtccacacatctaccttgtcagcacggttctcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttaccaaaaanataaaannaacnnagactagtttctctcnttccacccagccgattagagtatagtatgcc

SEQ ID NO: 683221 - DNA, 734 bp, Homo sapiens
  misc_feature (674)..(674): n is a, c, g, or t
  misc_feature (681)..(682): n is a, c, g, or t
  misc_feature (686)..(687): n is a, c, g, or t
  misc_feature (703)..(703): n is a, c, g, or t
gagacctgtggtctaactttttggaacatgcctcgggttctgtttatttgggcattgctctgcacgtggttaaacactccgtgtcagtgtggggttcacgatatttcagactcggaactcgggggctctcacctggccactctcatttgctttgtggtcttaggtgggatactttcagatttctcccataaaatggggttgagataagtcatctgaagccattttggggattaaggtgatacccttatacccccgagggcgcacgtaggatcaggtgcacccttcctgcagcgccttggtgtctgccagcccgtggcggcctcacggggtggtgtggagaggaaagagtggtgcggtagctggggttagcgtccctttcttcctcccagtcccacctccaccttgtcagctgcttccagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttaccaaaaanataaaannaacnnagactagtttctctcnttccacccagccgattagagtatagtatgcc

SEQ ID NO: 683222 - DNA, 117 bp, Homo sapiens
aaaggagttgggcgaggggggcaagacgtgggtgaggcgatgtggtagatgcggggcgcgtggggtgcgtgtgcgggcgaggtgcggttggggggggatcggccgtgggggggggac

SEQ ID NO: 683223 - DNA, 1087 bp, Homo sapiens
  misc_feature (50)..(50): n is a, c, g, or t
tgaagagtgaggtggcggagaagcgggaatcgcgagagcggagtagaggnaggagcaggtacgagaaggccgagcgagatgcacaagagggaggagcacgaggacgagaacagagaaggagaggcggaggagggagagagagggaggcggcggagggcgggcggatagtggagaggaggggggtaggtgggctgggggagggaaggggggggagggggagatgggggagcgggaggagtgggcggggtagggggagagaggcgaagtcgagggaggcaagggagaagaggaagtggggggagaaggagcggggggaggggggagagaggcagggcagaggggagcgagcaacggggaggaggggcagggagcgaggagagagcgcaggaggagagagaggggcgaggtgagggagggagcagacggaggggggaggcagcggagcacagggggagggcagggcgagcggcggaaggaggcagcagtcagaggccagggcgggagacagggaggggggggagggggaggggggaaaggggaggagagaaggaggagggagggaggcaaagggagaggaggaggacaagagcgggagggaggggagaggggagggagaaggggggggggggccggggagaggggggggggagaggaggcgggcggtgccgctaagggaaggggagctccagagggccaggggggagggtgagaggggttgaggaagtcaagggaagggaggcagtgggagtaggtggggtggcggagaggtagtgtgtgccagcgtgcggagtgcgcgtgatgttgaggtaggtggcgatgggtgttagatgttggtgtcccgtgtgtcagggagttgtgaggagcgcttagagcgcgatgtttgcggagtctttgttgttggagtatgttagtacgtgtttagagtagtatagtgaccgtgttaagtgagcacgtagtgggagcagggcttgtaaatgttttgtctaatgtttctaattgtcacccttttaagcactttatcacttcccaatttaactttgcacaagttacccatgtaaaaaaaaatgtacatttttcaaaagttgta

SEQ ID NO: 683224 - DNA, 801 bp, Homo sapiens
  misc_feature (42)..(42): n is a, c, g, or t
gcttcatcttgccctcatccagcaccccaatcggaccaaccnccgaagcaaggcgttgccttcgaaaagacgccgtgggtccttctcatcaagcgtcagcagtgaccgggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgcttta

SEQ ID NO: 683225 - DNA, 658 bp, Homo sapiens
agcggactttcagcgccgccgcctgcggtctcccaggccgtaactaccccaccgcctgccgcctgcgcccgcgctccagccccgccgcgcgcctgacctttccacgcgcgccccggcccccgcggcgccgcgcccgaccccgcgcgcgatggcgcctcggctgccgccgtgccgctgggcgcgctgggagcagggctgccccatccggcgtggagcacgaccgccggcgccgccagttcactgtccggctcaccggatgtcatgcaccgggccgtcctgctctatgagtacgtgggcaagcggatcgtggaacctgcagcacaccgaggtcccagatgcctacagctgggcgtggcatcgccaagcacctttgccaaggccgccctggacttcgtggtggaggaggacctgaacggcccatctcacctgctgttacatccagaagttcgtccaggagaacccccttgccgcaggtaccctggagctgcctgcagccgtacccctggcctgcaaagggcggggagcgctccctgccggacctcttccacgtggcgctttgcctggccccacgtgctctcagggaaccctggttcccacttgggaacaggagctcagaggttattttgtaggacactcatctgtgcccacgtccccgatc

SEQ ID NO: 683226 - DNA, 795 bp, Homo sapiens
ctgataggctctgacgtgcgtggtgcgtgaaaacgtcacgagacgccggggattatataagagcgcaggcgtggcgtatgcgcgcctctttctcaatgaccgggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgcttta

SEQ ID NO: 683227 - DNA, 193 bp, Homo sapiens
gaggcatcacgatgtcggtaaagcagctcagcggtcaggtgcaccagaccacccagcgggtaagaaaaaggacaacgggggaagcggtttcaaaaacaaagactaatctgggtatgtttttcttccccgactagcccgacagagtacttcgagtctcccttcaccatttccgacggacatcgtgatcctcggg

SEQ ID NO: 683228 - DNA, 99 bp, Homo sapiens
tctagccgcgcagtgcattgtcatggatctggagacgggtcacccacacggtgctatctacgagggctacgcctcccccacgccatctgcgtctggact

SEQ ID NO: 683229 - DNA, 659 bp, Homo sapiens
gatctgtcacagtacagtttgcacgacatctacgtacacacattagctcagttttcgtgtcaccaaagccaatatgtggttaggttcgtgtatgccgagaccatctatatgagggcccataaggcaccctccactattgcctgaggagatacaaaagcagaactaattgtgcatctgtactatgcgcacagagagggttgcagaggatccttgtgaaacactatttaaaagatgacgagtggggagaagtgcgaggaaataaggaaattagtcctactgggtttctggcctgcaccattgattcaatggagactggcgggaggaaatggaagactagggttggagatgggatgggtggggcaagggatggaaaggaaaaggcagacaactagtgcgttccatttataacaagtaatatatatcaaagacttaaaggagattaaagaccaatcagaataatttggcaactttaattcttaggaagatcaaagttccctccaaacctaatttgatgttttattactaaaagcaaagaccagtatggtacagtattactccagagaaattaaaggaaaatccttagggcggcttcacccacattcattttatgaatggatacctcccctaactcgaaatgctttagggaggtactgctacca

SEQ ID NO: 683230 - DNA, 869 bp, Homo sapiens
  misc_feature (42)..(42): n is a, c, g, or t
  misc_feature (809)..(809): n is a, c, g, or t
  misc_feature (816)..(817): n is a, c, g, or t
  misc_feature (821)..(822): n is a, c, g, or t
  misc_feature (838)..(838): n is a, c, g, or t
gcttcatcttgccctcatccagcaccccaatcggaccaaccnccgaagcaaggcgttgccttcgaaaagacgccgtgggtccttctcatcaagcgtcagcagtgaccgggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttaccaaaaanataaaannaacnnagactagtttctctcnttccacccagccgattagagtatagtatgcc

SEQ ID NO: 683231 - DNA, 985 bp, Homo sapiens
  misc_feature (42)..(42): n is a, c, g, or t
gcttcatcttgccctcatccagcaccccaatcggaccaaccnccgaagcaaggcgttgccttcgaaaagacgccgtgggtccttctcatcaagcgtcagcagtgaccgggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgggtgacttcggacagtgaccaggtatcagccctcggaggtgatgggtgtgaattcggccagagggtacagattacacctcctagtacaccagttcaccaggaagctggggcagggctctggcacaccaataggtccagcgcgagggtcactgcggtctaggcgtacaacttgtgaaggcctctgcaggcatgtggggagctggacagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgcttta

SEQ ID NO: 683232 - DNA, 141 bp, Homo sapiens
ttaccgcgaggttggtgtggactgtgacgtcgtctcccgcctgtttccttggattggcggcagggccccggcggggtgtgtgggccgacacgccttgccacggcggacttttcaactcacagatgcagctggcatctggga

SEQ ID NO: 683233 - DNA, 992 bp, Homo sapiens
  misc_feature (1)..(1): n is a, c, g, or t
  misc_feature (64)..(64): n is a, c, g, or t
  misc_feature (86)..(86): n is a, c, g, or t
  misc_feature (92)..(92): n is a, c, g, or t
  misc_feature (99)..(100): n is a, c, g, or t
  misc_feature (108)..(108): n is a, c, g, or t
  misc_feature (112)..(112): n is a, c, g, or t
  misc_feature (136)..(136): n is a, c, g, or t
  misc_feature (168)..(168): n is a, c, g, or t
  misc_feature (196)..(197): n is a, c, g, or t
  misc_feature (202)..(202): n is a, c, g, or t
  misc_feature (241)..(242): n is a, c, g, or t
  misc_feature (244)..(244): n is a, c, g, or t
  misc_feature (261)..(262): n is a, c, g, or t
  misc_feature (270)..(270): n is a, c, g, or t
  misc_feature (274)..(274): n is a, c, g, or t
  misc_feature (278)..(278): n is a, c, g, or t
  misc_feature (281)..(281): n is a, c, g, or t
  misc_feature (288)..(288): n is a, c, g, or t
  misc_feature (292)..(292): n is a, c, g, or t
  misc_feature (310)..(310): n is a, c, g, or t
  misc_feature (316)..(316): n is a, c, g, or t
  misc_feature (331)..(331): n is a, c, g, or t
  misc_feature (334)..(334): n is a, c, g, or t
  misc_feature (345)..(345): n is a, c, g, or t
  misc_feature (356)..(356): n is a, c, g, or t
  misc_feature (369)..(369): n is a, c, g, or t
  misc_feature (391)..(391): n is a, c, g, or t
  misc_feature (406)..(406): n is a, c, g, or t
  misc_feature (414)..(414): n is a, c, g, or t
  misc_feature (421)..(421): n is a, c, g, or t
  misc_feature (434)..(434): n is a, c, g, or t
  misc_feature (436)..(436): n is a, c, g, or t
  misc_feature (442)..(442): n is a, c, g, or t
  misc_feature (468)..(468): n is a, c, g, or t
  misc_feature (486)..(486): n is a, c, g, or t
  misc_feature (508)..(508): n is a, c, g, or t
  misc_feature (516)..(516): n is a, c, g, or t
  misc_feature (530)..(530): n is a, c, g, or t
  misc_feature (536)..(536): n is a, c, g, or t
  misc_feature (553)..(553): n is a, c, g, or t
  misc_feature (559)..(559): n is a, c, g, or t
  misc_feature (572)..(573): n is a, c, g, or t
  misc_feature (589)..(589): n is a, c, g, or t
  misc_feature (593)..(593): n is a, c, g, or t
  misc_feature (644)..(644): n is a, c, g, or t
  misc_feature (658)..(658): n is a, c, g, or t
  misc_feature (716)..(716): n is a, c, g, or t
  misc_feature (735)..(735): n is a, c, g, or t
  misc_feature (742)..(742): n is a, c, g, or t
  misc_feature (815)..(815): n is a, c, g, or t
  misc_feature (882)..(882): n is a, c, g, or t
  misc_feature (920)..(920): n is a, c, g, or t
  misc_feature (986)..(986): n is a, c, g, or t
nagattccgagaccagggtgaaaaatctgctctgaaccaacaaagcacccccactgtgcttggnagccgatcagccactgtgggangatganccaaganncccggacntcancctgatgcccccatctggagaatntcgggaaaaagcaggtgtggcgtctggaatgnactttattggacaagtggtggcccaagnnttggnctggaagaaatggggccctgggacaaaagaaatgagttnnangaggcccagaattcagnnctgtttgnagcnaggncanaagaagntggngggggagccaaggaagangttttntttgttggatttggnganttcggccaggngttgttgttcnttttgttttagcnggttttgggctgtttgaaagcngccagggggttatcntccagggnatagtgntccagcacggttngnacgttntccacaccatttagtgcaatggtttnggggaaggcagatagatncaatatgatccggtcattaganttgctgtnccagggccgcaggnaacgtngttatagggttgttggnggaagnttttttttttttnnttcacaattattattngagntgggtcccgatttatatatgaaatattctttatatggtgttcatccatgtntcttgtggtgtccnggaataggcggtaggagatgaagccatgggggtccacactatcaatgagtggaaactnattcatgccagtttctgangtaaagntgacaatttcatataaaggggcaagctgctggaacaaggtctcgatgcctgggcgcttcttaaacctccagcnagtggccagcgaccactcaggatgcaagatgacgccggtgagctccaaaacgagcgtgtagggtggntggtagtacggttcctgcagagggtctgcggagaaggnaaggtctggtgggctcgatgatcatctgtctataatctttgaaatatttgtatgtccggcgcactnctgtac

SEQ ID NO: 683234 - DNA, 966 bp, Homo sapiens
  misc_feature (351)..(351): n is a, c, g, or t
atgaccccaatacgcaggaattaatccccgcataataaaattagattaaccgctctattcatcgaccgtcgccgcaccccactccaggcatcttccgacagtgatgaaacttcggatcactccttggacgacctgcctgatccgtccaaagtcaccatcaggactatgcgctagccaatgtaactatctcatccagacgcctcaggacgtgcttttcactcaatcgcccacatctactcgcagacgtatattatgggctggaggtcagtccgtatatccatttgacggccaaggggcgcctgcaatatgtctttatctgccctcttcctgagcacatcgtgagtgcgaggncctatattgacgcgatcgatttctctgactcagtagaagcctgaaacatcggccaggtatcctcctgctctgcaatggtatagcggacgaagtcttcatcaggctatggtcctcccgtgaggccgagagttatcatccgtgagaggggccgataagtcattttacaagatcttagatatccggcatcccattagcattaggtgagcagaccttatgggtccagattgaactcgtagaaggcaggctcacttgcagtgatggacaggtcaacaaccctgcacgagagaatttccttgaacctgtcccactttgcatacttgcccctgttcattgtatatgccaagagcacattaggccagacagttccaaaccctgcctaattcgtgtggcaccgaaaaaaggggattcaaatactagcccccctagagaagtcgagctaccggaatatccggattaaaaatccacccttttccacaccgcttaattaagtagaactcaaaggacaggcccctcgggattaaggtttctctatccggttgtctccctttaatggacattttaaccgcgtaaattttcaccagtaacctccataggggaacgcaaaaagattattcc

SEQ ID NO: 683235 - DNA, 950 bp, Homo sapiens
tagtgtcgcgggtttcggcgcgggccacgcgtgcgggaccaggaatcccactcccagccgaccttgagctccagggagttcgtctcttagcgtctgcggaagtgctagcgtgcctcagcttcgttcaggcgcaggttgacaactacgagggcatcgaggccatggaacgtctggaatgtcctgtcgctggtattgtcaattgatcttaagccaagctatcccttcaggttacaataggaaaggtgcctctaatcaaggcgcgaagatatggcggtactaacttgtagcaaccacgttgtccgtgcagtgccacaggaggctaggagcagctgacaatggctggtggcgaaccagggcagtgtaggcgaggtgcgttcatggttcaccttttgtcaaccttgtctcaatttaagttgtcagcaagctcggcaggtggatatcgtgttagggacaggctgccgccaggaccaactccgcaccccgcgctaaccttcaatgcaggctgagcccttatcgcctgaatatctctgcagctgctttcctgaaccgttatctaggacgctatatgcaaggtcacacagagcttgctacatcgaatgccctctgggtggcacaggggggaggtcatgagaaaccgtggattacacccccttgtaaaattcctattttcagaagataatatattgtaagccggtcatgatgattatatgtgggtcacagttaatgtgaactaagcatacccccaagggtcctctcttccccaatataaacgccctcatttggtgaagctcaagggtggcgcctccggactggtggagaagcctggcagggtgataaattactgggctggaaaaaaggaagaaccaacccggggttccccaggggccgaaagggggataaggccggggcaggggcggcccgtttggcaggggacccgcccaaggggccta

SEQ ID NO: 683236 - DNA, 114 bp, Homo sapiens
cccactgtgtctcatcccacctgtttcatcccacctgtgtgcccatctccacctgtgtgctcatctccactgtgtgctcatcgccacctgtgtgctcacccccagctgtgtgct

SEQ ID NO: 683237 - DNA, 150 bp, Homo sapiens
ctttcatcctgtcagatgtctcccgtggcctgtgacttctctgctgtccctggcagatggcaagacgagaggcatagggggtgagggactttgagtccttgtcgatggagcgtgcgttatgtgcagacttgcccatgttcccacgagtcc

SEQ ID NO: 683238 - DNA, 150 bp, Homo sapiens
gcgcaggagataatcgcggttgccggtcatcagatagcattccagcacctcgtcccatttcgagatcgcgcgggcgaagcggttgagatcctcctccttctgccgcgccagcttgatcgagatgaagacactgacatgcagccccagcgc

SEQ ID NO: 683239 - DNA, 647 bp, Homo sapiens
tcctattaattaggaaacgtccccataaacagtacttgagtaaggcacctctcaagtcgaataaagtctccccaaggaaaactttaagtgtagagcagtttgcaaagtgcgaaagccgcacctttagccagattccttacaaaagtggggtcccatgaaagggggcaatgttaacaggtaaacaaagcagtaatcaggagggcgaacaggagtagtgtcatacctaccatggcaggttgcaagacagttcaacagatcaaagaatacgtgtcccagcgaccagggtgcacagaagtaccttttgctccagtccagcatatgtgttgtcatcagattggccaagaatgacttggaggtcttgaatgtgtcccatgcaaggccccaagggcactcatttcaccagcagtggcagcagctccagctcattcaatctttctttggcccttgcctcccagcccttgttggcctgtgggttacggggagagggatgcaggagcccttccacctggacctctggcatcaggcatgccaaagcccgtcgtgcccgctgctctgccagtcgcacaactgccgctaacagccgcacccacagcagctgcacctgccggcatagggatgcatcacagatcccaaggagctgttctcgc

SEQ ID NO: 683240 - DNA, 170 bp, Homo sapiens
cctccagcgagacatcccagccatggccatgcagagaatgctttgaccaggatgagctgggccagcttggacctccttcctgctcgggggtgaacatccagagttgtggcgcgatgagcttgacagtcaccaacccccaggagggttgcccaggccgtttagtagaagcg

SEQ ID NO: 683241 - DNA, 576 bp, Homo sapiens
  misc_feature (327)..(327): n is a, c, g, or t
  misc_feature (576)..(576): n is a, c, g, or t
cgaactttgtctatgacactatttttatcagttttttaggaaaaaaagagtcacactgtcagtgtttccagatgtttcccattccttcccctttatttggtctctgtgtggcactaaacttagaggcaggagtgctgggagacgtttgcaaggatatcagcctctccacaggttaaacccgaacacgcctctcttctggtgaggggccctcagggttaacaagcatcatccacgagggaccagggcaacaggctcctccgctggtccaggggccctcggggttaacaagcgtcatccacgagggaccaggacgacagctcctccgcntggtccaggggccctcggggttaacaagcttcacccatgagggaccaggacgacaggctcctccactggtccagggaggccctgattggggcgcgaagtccacagacgcatccctagctacggggtcccgtgtgtgcttagcagtggccagggcagcggtcagtcatggatatgtcctctcctgacttccctccgctccttcgggttcctcgggtctccttccaaataaacaactgaacgaaaaaaaan

SEQ ID NO: 683242 - DNA, 121 bp, Homo sapiens
acactgggtagagttcatgatctccaacatagggcagtatacagccagaaaagaggagacagagcaaacagctctactataacagctcatgtacaacacaccgaacgggtccagggccact

SEQ ID NO: 683243 - DNA, 473 bp, Homo sapiens
ctgtagctttggaggttggtatttatgttaatcagaaagaaaaggggaggctggatgcagtggttcatacgtctaatcccaaagtgctagaattacaggcgtgaaccacagatctggatgaaaatgatacatttaaatgagaaaaataaaggttaagtggagagatagccaataaccattgatatcaagactaaacaggaaaaatatcagtgtttcccaagttaattaatatacttaatttctattaatatgtaaatagaattcattatatagtctacataaataatttcaaaattcatatgaaaaagtaaatgagtcagaggatcaaaagacggcccaaattggtctgagtattgtgggttattgttaagctgatttaatattgtctcccccgacaaccatgcttgactagcttaaaagaaaaaaaaaaggcccaaaaggagattgggcaatgtggagacctgactagccag

SEQ ID NO: 683244 - DNA, 446 bp, Homo sapiens
  misc_feature (210)..(211): n is a, c, g, or t
  misc_feature (387)..(387): n is a, c, g, or t
  misc_feature (389)..(389): n is a, c, g, or t
gggtgcggcctttgtctctcgctgcagtcagagctccaggtctggttcttacttctcctaaaggcccaggctgtgtggccccgtgtcctgcaggtattgggagatccacagctaagacaccgggacctcctggaagccaaaaatggtgagagtgagggtccgacatcccgagagaggagaggactggttggaaccggtgatggctgtggnnggactcaggcctccccgcagtcagctccacagtctgcttcccccattctccttgctcagtcggccttcatcctgtttcagccattggcagctgcgctgacagccggcaccggcgtcttgtctcttcatgcgcgtgactaacctggcctggagcctctctggcagtctgcaccgcancntggcgtctctccagattgtgcaggaacagggaggtgggcagggagtcctgtcgggtg

SEQ ID NO: 683245 - DNA, 769 bp, Homo sapiens
tatatgtgtggtcgtgcaggtagaggcttactaaaagtgtgaaaacgtaggctgtggattaaggcgacagcaattctctaggatagtcagtaaaattagaatggtgaagatgataagtgtaaagggaaggttaagggttgattattggctagggtggccggctcccaattaggtcgcatgagtaggtgcgcctgcagtaatgttagcggttaggctgtacggccagggctatgggttgaatgagtaggctgatggttccgataataactagttagggggataaggggtgtaaggtgtcgccttgtggtaagaaggtgggctagggcattttaaactcttagagcgaaagcctataatcacggcgcccgcctcataaggggagtggccagtggcataggtctaacagatagtggggagggaagggtgctacatgagtgaggcaggagcccgaggaaggtcagttggggcactaaacaagtgcatcacggacacacatagctaataagagactcagcgtacgccccataaggggaagcgacagggaaccccatccgtccagacagctaaggatgagatataagaccatggtggagaggggggaaaagccggcttgttgaacaagaaaatcggggggggggggaccaccacgggggggaactaaacgcaccgaaactgggggggaaagccataaatgtggggccataattgcacaaattcggtcaattgcgaaggggcgcaccccctccggaaggggcccctaccctttaac

SEQ ID NO: 683246 - DNA, 824 bp, Homo sapiens
ggctccccagtcggcgctggcgcggagaattcatcgctgagatggtctaaagccccaggaaaaatggtgggaaaattcaccgtcgccaagtagtccagaaagagcgatttatggctttgttcttttcttaagctcccaatttggcttcatactttacctcgtgtgggcctttattcctgaatcttggcgtaaactctttaggtttaacctatgggctcaaaaagtatgggcagttgcatgacctgtctacctccttattgctatagtagttggctacgtgctcttgttgggattaacatgatgagtacctctccaattcgactccatccatacgatcacagagtaactatgcgaaaaatcaatcagcagaagaaataccaagaggaggcattccagccttaagagatatttctattagtgaagtaaacacagaatgttctttctgtgcaggcaagagaagtttacacgaaagagtgaatgtgtgtaccatagtaacaccaagcacgtatttattctgtagttgcggccattatactttggaccataaattaagttgacgcagtctctcttatgtaatacgagaagttccccaatgtaccttgaccttctcttagattgttgttccactgcactatcgtacatgttcagtatgggcactggattggactacctaccatattgcttcgcgaaacaaggagcgctcacacaaacttggggggcggcgggccagaaaacttttaacctcgtcggcgggcggccaatgatggaaccgcgcagggcccagggacgggccagcggggggtccccaaaagcgggcccggtgc

SEQ ID NO: 683247 - DNA, 267 bp, Homo sapiens
ctgaagtgctcgactctagagcactccccccttagtaaagaagattcaataggcatccagttaacctctccttatcagtcacactattgaaggttagagtatgcaagtgttttgtgtatatccgtcctttcatattagtttcctaggctgtatttcccacatatagggactctctctctctctcctctctctctctctctctttgtgtgtgctgtgatgctgtgtctctatttgacgcatctctccttcgctctcatctatgggagt

SEQ ID NO: 683248 - DNA, 266 bp, Homo sapiens
tttttttgtagagatggggttttgccacattgtccaggctggtttcaaactcctgggctcaagcattcttcccatctcagcctctcaaagtgttgggattataggcgtgactgctgtgcctggccaactgtgcaactttctagtggcaatttgatgacaacaggttaccaaaattctacatttagtaatatatcctagggaaataactgaagacggacacaaagaagtatgtttcgggatggtcacctcatcattatcacgggtcg

SEQ ID NO: 683249 - DNA, 353 bp, Homo sapiens
gagagagagagagagagagagagacagagtgagagagagagagagagagagagagacatagatacagagagagctagagacacatggattaagtttctcataattgacagctctaacctcgtgactgtatctcgctccccactgccattgcctaatggtgtagtcctgtatctgatgccagagtgtcgtccgttttcccatgcaggctcggatactgaatcgttgatcactcctggcacccctccttactcgacctatcctctctctgcagcccatcttcaaccctgtgcatcctccagcccaatcatctcattcagccccctctcggcttattgctccctattactcacccc

SEQ ID NO: 683250 - DNA, 1432 bp, Homo sapiens
tattttgcgtagtgttttttacgctacttgactagcgatcgctaagatgcctgttaccatcctgtttgcacccctcattgtgatacactcgtgatgcgtctgaccggcctgcgagcttacggccctgtgcgactccgtcacgagtaaataacatttttcatgcgaccggtaatcgcgtctatatatggccatgttatgtgcataggttatcgcgctgataacagtgttgtgagtccatggcgttgactcagtactatggcaacgggtggtggagctcgttctgcggaaacttccccgggtcttcccgtaggggaataactcgcctgaagtcccacggcaatggccacccttgctgcgtgttcttcttcatgtgctgctttcgtgtttattcgggtccttaggtggtccgccctggtccgtccccggcgttccgactctcttgtctgtctctcgctcgcccagtcaccaacctgcttggggccttccccagcactcggtcctcgttgcaatggcaatctcgtcccaaccagggaacttccgaagcctgggtgccagcgcgtgtattaaggatgtcttcatccgcggagtctgaagtggagtagttcttatcagacccttgtgattaagtgatttgtcgcccccgcaaagacgtgactttcgcgggacacttacgatccgacagtctgatctataaggagccacgtaatggacccattacacgccgcttctgacaacgtgcctggatagagtttcttatgcaccttctgtgaccacctctggagctggtcgcctatgcgcctggcgcattgatgtgccctgtcaacagagtttggtcgacaggtgcccaacgcacttcttcacaaccgttagtgttgcacctcctagccaacgcaacgtccctacgccagtcgcgagcctgacagctctcgctgctaaccctcacgtacctggcgaggttctatcaggagcccagatttcctgtgcccaaggcgacacttcacaacacggcctcttgctggaacttgttcgcctgacaaggtcacgggcacatatcatcccgcaccagcctggctgctccctggggccgcatctctgtgaattgcgggatcagggtattggggcaggcaacgtggattggtgtggtggtgtgcaaagcggaactgaagagcgtccctggggctctaaacaccatgcaggtcctcctctcttcctgccctgagcaccgcagccgtgagccagcagggggcagcagaggccaacagggagctcgacaggaccgggctccctgctgttcctgcccctttcttcctgctccccctcctagcctagggtagactttgaaactgtgctgtgattgatgacttctctgttccacaggccctccctcaaattcttgcctgggtgtggagacctggcctgtcccctctcccta

SEQ ID NO: 683251 - DNA, 710 bp, Homo sapiens
gagacaacacacgacatcaacaatgcatttggcccaggaagtgctaatgaacatacagtgccgtgatggctcaagaagttttgcaaaggagactagagccttgaagatgaggagtgcagtggccagtcatcggaaattgataatgaccaattgagaaaatcatcgaagctgatcctcttacaactataagagagctgcccaagaactcaatgttgaccattttatggtcgttcggcatttgaagcaaattgaaaaggtgaaaaagctcaataaatgggtgcctcatgagctgagtgaaaaataaaaaaattcgttgtttgaagtgtcattttctctattctatgcaacaataatgaatcatttctctatcggattgtgatgtgtgccaaaaggtggattttatacgacaactggcgatgaccagctcagtggctggactgaaagaagctccaaagcacttcccaaagccaaacttgctccaaaaaatggtcatggtcattgtttggtggtttgctgccagtctgatccactacagctttctgaatccaggtgaaaccattacatctgataagtatgctcagcaaatcaatgagatgcaccaaaaactgcaatgcctgcagccggcattgggcaccagaaagggcccaattcttttcacgacaacactgggccgacgttgcacaacaacgcttcgaacattgaactaattg

SEQ ID NO: 683252 - DNA, 1068 bp, Homo sapiens
ctggagtcggctggtatagtattctagcgactatgtattcgggactgcatagcatagagaagcatagtacttcaggcaacatgctaaaattgggcacccatgaaccccaactctcaaagccacagcatagtaaatagccagataggtaccagatttaaagatatacagcctagtctagactaacaaaggaaaactatgtatcgtagtaactaacatatatacaaccctcctatgacctaacaacactacacgcatggatggcccacaacggcacgacatcaactggcttaaccaaggtgaaataaggagaaagaaacagcacacatacaaacagaacacctccaacacatgacacacactgcatgacaatagcgcgcccacaccactgcatgcgacatacaccacctctacctacaggtaccactacactaagcccaataggagcgctaccccactcaccaacccataaaacagaaaaaccaacaggcaagagaaacacaggcgaacaacccaataggcacgagcaataaacaccgtcactagggacaataccacggaacacccgacaaacgcagacaaccccaacacaggcataccaacggacatacaactagcgacaagaaactaccacaacagcagcctcgcaactacgcaaaaagagaaccaatacataccagcaacacccacacaggaggacccacaaaaaaacacaaaagacccaacatcgcacaataaggaaccaacacgggaggtacataaacccatacaacagaaaaccacgaaataccaacacaagccacacacaaaatgaaaacccaacaacacccaggacaacagaaacccaagaacaaccaatggcacgcagaaaacattgacaacaaacacaaaaacagcaacaaccccaacacataaaccaaacagaccacaaaacacgacaaccacacaacaacagaactgacaacaaaaacacaccaaccagaaagccacgaaaacaccagcaatgcaaagaccacccaacaaacaaatgacaacccatacagacaacacacccacagagacaacatatac

SEQ ID NO: 683253 - DNA, 113 bp, Homo sapiens
atatcttatatgcacacgtgtatattgaggtatagcaattcactgttgtggcagttgtgtgtgtgcatgagtaagaaagcaagaacaagtaatcacaatagaatccactatac

SEQ ID NO: 683254 - DNA, 395 bp, Homo sapiens
  misc_feature (18)..(18): n is a, c, g, or t
agatcccaagctccaacnaagagcgaaactctgtttccccccaaaacaagtaaacaaacagttagtgacacacaaacaaaacacaaatgaaacaacaaaaactgtttggaggtatacttccaattttagtaccacataaagaatttgatattttgaaaaatgttgagtctgattcatttgtgtttcaagactcactcatggagaatgattttctgcattcacgtttgaattggataaggtatacacatgtataagcatctgctagatttctgtttcctcacagccaaaaaaataaaattgcaaatcagagcttttttaagaatggctgttatttgagtcaaagtggattatgacatgtgttagttatgtattgctacataacaaattgccacaaa

SEQ ID NO: 683255 - DNA, 929 bp, Homo sapiens
agcggagagagagggagggagggagagatgagcgcgctagacgcgagagagcgagtgagcaagcgagcacgaaacagaggtgcgagagggggggaataagaaagagagagaaggaaatggagagaaggccacggacagaaggctaaagggactgagactaattcatgctgttgctgtatgagaagagactcaaacatggttgataaatcatatgatgactgaccgaacaagattgagactaaggatgggtgatcaaacgcgagaagataaaggctcgagtcaaggccagtaatccatacatattctaaggctagcttcccgtgtgacacagtaacacagggaccatagcgtcaaagggaggagaaagaacggatgagtgtccgaagagctgcggtgaggcatgaaggcgtaagtaatgacaggatgaacgtccccattgttgcccgaatgcgaggtgcgatgaagacagggacgagggcagctcgactaacttgcctgaacggcacgtgccctaaggcacttggtctccaaggccttgatgaggccacggacaaagcatggatgaagactaccttacctgatggcaggaacgaattggggcgagggttgatgcatggcacgaagagcagtgcatggctcccacagtgctccatgcactcgctcaagaaggatgaaggacgggatcagctgatgacacgtaaatgtgcagcgtaaagcttccactgactaatctcgtccgtcctcgctagggctgaaggatgcgcaccaggccaatgggaggagcctaaacaagccgatgtgcctgctcgctgtcactagactggtgcctgacaccaacgcctgacgcagaaggatgcttgctgcccagggcaacgagaccaggtttccaacggcagactgggggatgagcatgccgaggttgatacgaa

SEQ ID NO: 683256 - DNA, 458 bp, Homo sapiens
tattgcagcactattcacaatagcagacatagaatcaacctaaatgcctatcagtgatagattggataaagaaaatgtacatatacaacatggaatactatgcaggcataaaaaggaatcaggtcatgtcgttcgcagggacatggatggagctggaggccatcatccttagcaaacttacacaggaacagaaaaccaaatactgcatgttctcacttacaagtgggagcaaaatgatgagaatacatggacacatggcggggaacaacacacactagggtgtgttggagagtagggagaggatcaggaagaataactattggataatgggcttaatacctgggtgataggattatctgtttatctaacctccatggcacacatggacgggagggggagaaggccggcatagcctgcacatgtatccctgaacttaaaataaaagttggaaattaaaa

SEQ ID NO: 683257 - DNA, 998 bp, Homo sapiens
aataaaaccaaagattacgggccctagttgtgtaaatttcacgtggacatacctgtatagtgttctggtaataatttgcgagaagctttctggactaatcgactaacggaactcacactagaagatcacgttcattgtcttatcagtgtgcctcacagggtgaaagacatagtgtcttactcaagctcaacgcagtgaactaggggatgatgggcactattatataccaaacaacatgtgtctcatcgttagaaacactatgtgatattattatatagttcaaggattcgttagcagtatagtcattcgtagctcaatacggaagaagtcaatcatggtatcttttacttatatatatagatatagctttagatcgagtccacataagtgcgctattttcttacagagaatgaaaatctgtgcacggaaaattggtatactgttatgttatccgaagctacatgttaggtaacatatatttttggattggatcaatatggtcctttcataagtttttggggactagttgcagatttaaagaagtttgatatgccttctaatttttatgtgagaaagataattggtgaaaatggacaattgcgtgttatctaacgccattgactaagtataacatagtggatggctagtaaattcattttaggtagacttgatgaagtcaaaggtatgactattatttattgtacattttgataaagagaattttggggaagtcttgaagtgcataaaattacttgatatcttttggcatttcatttttactatattgtacttctgaccaaatctttaattccctggggtgggtattttaagataatctttacctaataaaaaatggttgagggttcatacggaatcgaaaagaaggctatttgggtgatttgttcatttaggaacctggaaagtgatacgggaaaatttccaatcaaatgaacacttatagggatgggagaatttacatattaggaacaagagataat

SEQ ID NO: 683258 - DNA, 558 bp, Homo sapiens
  misc_feature (441)..(441): n is a, c, g, or t
ggtggcggctgggggcaggctgacatgggattgggaaactctttcctgttgcgtgcttcagggaacccagtatttaatgatgcctctgattggaagatgctgctaatctataatcactcaacatgacatggggtgtcttggttggtttaatggaaatgggctgcatcagttgggtgtgcccagcggtccgggaggaagtaggggaaaaaacaaaaaacaaaaaaaaaacacaataaagcggaggttgtattctagtgtggcagcattggaggagatgcagaaggtcttccaagatattctttccctcctcgggctcagtacaaggccggggttttccactagtgatggtcagagttacttccaagaactagaagagccgggtggagaccattccacaacacttctggacggtaatgggctgagtccacggagacccagggnggggacagggtctttctaagaccatgcagagaagtatgagtggtggctccatccttcagcccagggctgacacctgcaaaccactcactatgtgtgtatttattaagccttagagac

SEQ ID NO: 683259 - DNA, 561 bp, Homo sapiens
tttttttttatattctttgcattttttcttacttgaaggacagagaaatgtggcttaacgattaaagaaagttatggtagttagacaggattgctggctctacaccaacggataagaaaaacctatccctttccgtttgaggctgtataatcttattcttattcccctggtacgatgagatgcttccaaacgggatggtataagcctaatgcagattgacttgcattaccatggttaataccctactaggcatagatgcgcctctttatcagtgagcacgtgcatacttctcatcaaaagctgcgaaatcattcataagcatctttcaggagctactttagttgccttgggctagaagttcacgagctcaactagcgcagaatgccacgagatttgtctctccttctcaaaaagcgtgtgtatatctgcatggtatgtgcccgtacagaattcatcactttagaaacttatgtgtcatcgacagacatagcttattagcatggacgcctgctcaccaaggacgcagtgcaatatattgcggctattgcacttactgggtga

SEQ ID NO: 683260 - DNA, 299 bp, Homo sapiens
  misc_feature (104)..(104): n is a, c, g, or t
  misc_feature (172)..(172): n is a, c, g, or t
  misc_feature (175)..(175): n is a, c, g, or t
  misc_feature (190)..(190): n is a, c, g, or t
cctgaacggtgcgccctcaacgcaaggccccaagatgtacgcaacatcaacatgaatcgcttttcccggtcaatcggcggcacaatgcggcaagtaagaagcangccgcgcttttccgcaccatcgaccgaaacatcgcgattctcataatgttcaatgggataacgcgacnagntgcgttgccgtgatngcttccgggtatacggcattgcgaccgtaggcaaaatcgctccacatagtgtcggcgagaaactcgtagtgcgaggtatcgggccagttttccacatgcagcggatgaa

SEQ ID NO: 683261 - DNA, 187 bp, Homo sapiens
taacactgcactccagaaaacacaaccatgtaaaaaaaaatctcatcattggcatatattcaccagtgaaaacgaacgagatggagcagccgtatgcgaatggtgatggaagacctgcccttaggggaggaggtgaaggccaccagcctgcaggaaatcgacgggtacaggctcgccgattgtgccc

SEQ ID NO: 683262 - DNA, 114 bp, Homo sapiens
gctggtcgatctcatagcaggatcccccagcaaatccaggagggtgacgatgcctcccatgaacaatgccgttgtttgtaagcaggaagctgacgctgcgccatggatgtacgg

SEQ ID NO: 683263 - DNA, 1115 bp, Homo sapiens
atgggtcttttattataataccccggaggcgttcgttgtttttgtggtgcacccccttcgggctgttgtttcctcctcctcgtgggtagtctcgctcgatcactcacgccgcggtgtgtttgtaggcccccccccctttgtgtggatgaatcaccccgccggggggcccgcatgttactcacacgctctcccccgcgcagcgtgtttttatgctctctagtgtcgcccgcgcgtcggcgcgcggcgtgtgatacacatctgttttttcacacgcagctgggtggaacaccacagcttgtattgtggtacacccatctgttaggggtgccccctcatttatgtagagggggtggacaccacatcatatatagtggagacacaagcatgtgtggttgctctacacacaaaaaagcgacaggagcgggtggtgttcacacgcgctctcggtggaggattttctcccccgggggtgattttttttcgcgcggcgcccgctcacccacacagagtgtgtgcgcgcgcaactagagaaagtatatcttctctgtgtcgcaaaaagaaagttctctttcacagagagtgtgatgtctcacacacaatgctctccgcaacagaggagaggcgcgctcacaccacccacggggggggtttctttttatggcccggcgtgctccaaaagtatttttgtctcgcgcggttttctcccgtgtggtgtagagtgtatgaacgacgcaggggtatcaaaattgtggcgagattttggaaactaccttgtgagagtacccccagcaagatgcgtggtggaaaaagttgttttgtgtgacaacacctcctcacagcagccgcaggggtaacaaaaattggggggggagtacaaccccccagtatttggcagggcgcgacttctgtagacatcctgggataaatagggcagaataagatattgtctgtctcattccccccaccgttgggtgttttattgttggtgaccaacatccctcctggggattcctatgggccactgatgaagcaaagagaaaacccaggggggaatcccggggtttttttttttgggggggaaaaaaaaaattccaaaaaaaacccccggggtttta

SEQ ID NO: 683264 - DNA, 1623 bp, Homo sapiens
  misc_feature (207)..(207): n is a, c, g, or t
  misc_feature (249)..(249): n is a, c, g, or t
  misc_feature (296)..(296): n is a, c, g, or t
  misc_feature (543)..(543): n is a, c, g, or t
  misc_feature (1018)..(1018): n is a, c, g, or t
  misc_feature (1032)..(1032): n is a, c, g, or t
  misc_feature (1048)..(1048): n is a, c, g, or t
  misc_feature (1052)..(1052): n is a, c, g, or t
  misc_feature (1058)..(1059): n is a, c, g, or t
  misc_feature (1079)..(1079): n is a, c, g, or t
  misc_feature (1095)..(1095): n is a, c, g, or t
  misc_feature (1097)..(1098): n is a, c, g, or t
  misc_feature (1113)..(1113): n is a, c, g, or t
  misc_feature (1116)..(1116): n is a, c, g, or t
  misc_feature (1118)..(1118): n is a, c, g, or t
  misc_feature (1121)..(1121): n is a, c, g, or t
  misc_feature (1134)..(1134): n is a, c, g, or t
  misc_feature (1151)..(1151): n is a, c, g, or t
  misc_feature (1158)..(1161): n is a, c, g, or t
  misc_feature (1175)..(1175): n is a, c, g, or t
  misc_feature (1199)..(1199): n is a, c, g, or t
  misc_feature (1213)..(1213): n is a, c, g, or t
  misc_feature (1226)..(1226): n is a, c, g, or t
  misc_feature (1232)..(1232): n is a, c, g, or t
  misc_feature (1235)..(1235): n is a, c, g, or t
ggcgcggcggtagggaaggcgcctcccgcagtcgctcggaactgccgacccgagtgcttcccgcagagggctggtggtgggagcggagtgggtcgggcggggccgagccgggcctgtgggccgtgtgggggcctgggctggcgtgccgggcctggcggacggctgggatggtgctgcacctgtgagcgcctgaggacaaggctggcnggcctgagctgctctaagatgatcgacaagaacctgcggganggacggaggagaaggcggctgcgggagggtgaagttgctgctgttgnggtgctggggagctcagtggaagagcaccactccgtcaaagcaggatgacagactcatccacgaggatgggctactcccgaggcaggcacatgccggcagtacctgggcgggttgtctacagcaacaccatccagtccatcatggccatattgtcaaagccatgtggcaaccctgcagatctgacttttgccgagcccctccagagcaggacgagcgccaggcacgctatttgcactggtcctgcanccgccgagtgagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcatactacaagtggttcacagacacgtccatcatcctcttcctcaancaagaaggacctgntttgaggagtaagatnacancacagnntccctgaccatctgcttccnctgagtacacaggggncnnacaaatatgatgagncancnagntacatccagagtnagtttgaggacctgaanaagcgcnnnnacaccaaggagatntacacgcacttcacgtgcgccacngacaccaagaacgngcagttcgtgttngacgcngtnaccgatgtcatcatcaagaacaacctgaaggactgcggcctcttctgaggggcagcggggcctggcgggatgggccaccgccgactttgtaccccccaagccctgaggacgatggggcgcagaagatcacgctccccgcctgttcccccgacgcttttctcctcttatctctctttgtctcaggtccccctgttccctcaggtccagacgtaggggacggggtggcactaggcctcccggttgaagccctgcccttgcttgcgcatgcggtactggcttggaccgccttttggggctcagtcgggtttacccttgcttgccctgcttacggaatgggactgttagatccagatgttgtatggcctgtttcgcctggccacttccacac

SEQ ID NO: 683265 - DNA, 667 bp, Homo sapiens
cgggagtggccgacttttccagttgctgtccgtcacccctttctttgactcggaaagggaactccctgaccccttgctcttcccaagtgaggcaatgcctcgccctgcttcggctcgtgcaaggtgcgggcacccactgacctgcgcccactgtctgccactccctagtgagatgaacccggtacctcagatggaaatgcagaaatcacccgtcttctgcgtcgctcacgctgggacaatttttttttttctttcgagacactctcgcactgtcgcctgggctggagtgcagtggtctgatctctgctcactgcaacctccacctcctaggttcaagcaattctcctgcctcagcctcccaagtagctgggattacaggcgcctgccaccacactcagctaattttttgcatttttagtagagacggagtttcactatgttggccaggctggcctcaaactcctgaccttgtaatcaatccacctcggcctcccaaagtgctgggattacaggcatgagccaccacacccggccaaaaattttaattcttataagttcaagaaaaatagaattaatgcctatgtggcgcttagaaaatatactccaaaagtttggctcttgggatgcaagcccttgactaaataggaggttcagaaagatcctgaaa

SEQ ID NO: 683266 - DNA, 329 bp, Homo sapiens
  misc_feature (3)..(3): n is a, c, g, or t
  misc_feature (162)..(162): n is a, c, g, or t
  misc_feature (270)..(270): n is a, c, g, or t
  misc_feature (283)..(283): n is a, c, g, or t
  misc_feature (293)..(294): n is a, c, g, or t
ccntggtttaatctatgcacaccacaatactatgcaccatgttcacctcctattcaccactccactaatgcaccagttcacctcctattcaccactccactaatgcaccagttcacctcctattcaccactccactaattcaccagttcacctcctattcancactccactaattcaccagttcacctcctattcaccactccactaattcaccagttcacctcctattcaccactccactaatgcaccagttcacctcctattcaccantccactaattcancagttcaccnnctatttctacaccagaaccccatagctggttacag

SEQ ID NO: 683267 - DNA, 702 bp, Homo sapiens
ggcatctctatactactaacagaccggaacctcaagaccaccttcttcgaccccgccggaggaggagaccccatttctataccaacagcctattctgatttttcggtacaccctgaagtttatatgcttatcctaccaggctacgtgagtaatctgcccatatttgtaactgtactactccgtgagacataaaagataccattgtaggaatactttaggtaatggtctagagagtatgcatagtcagattggcttccatagaggtgtatcgttgtgagcgaaagcatgatagtttacaggtaggaatacgacgtagacacacgagtcatatttcagccatccgcgtacacataagtgcatcgcgtatccccaacgtgcgtcaacagtattatagctgacgtctgccacgaattccacgggaaggcgagtatgaaatcgatcttgctgctagtagctctagagacgcctgatggattgcaatctttactatttcagccgtgaggtgcgccctgactgggcagtttgtattccagcaagtcgctatcactaagactatgcagtatctactagagagcacgtgacgtacgtgtgtagactcactatccatcatattgtccgtaatcaattaggagcctgtattatgccatgcatagagaggcttgatacacgtgatgttcccctatttctcgaggcataaatcca

SEQ ID NO: 683268 - DNA, 654 bp, Homo sapiens
  misc_feature (18)..(20): n is a, c, g, or t
  misc_feature (44)..(44): n is a, c, g, or t
  misc_feature (66)..(66): n is a, c, g, or t
  misc_feature (133)..(133): n is a, c, g, or t
  misc_feature (135)..(135): n is a, c, g, or t
  misc_feature (164)..(164): n is a, c, g, or t
  misc_feature (168)..(168): n is a, c, g, or t
  misc_feature (200)..(200): n is a, c, g, or t
  misc_feature (233)..(233): n is a, c, g, or t
  misc_feature (303)..(303): n is a, c, g, or t
  misc_feature (510)..(510): n is a, c, g, or t
  misc_feature (534)..(534): n is a, c, g, or t
  misc_feature (569)..(569): n is a, c, g, or t
  misc_feature (575)..(575): n is a, c, g, or t
  misc_feature (621)..(621): n is a, c, g, or t
taactgaagctcccttcnnntagtaatttctcactatgatgtgncgacatcttgtgtctgtgtggnatgtgtgtttgggtttaaaaaattcctaaaattgattctcttctgaggtcctaaagggtcttttgcngngagacttcctcaaattcgtcttttacaangctntaggagtcatctttgtgaaacatagattttcncattttacaactgtgtaacaacttattttttgncaagtattgggattagctactggagttagtaaagtgaatattagggtgcttacttttgagaaaaatgctnaaaaatagtatagccatcatttactggaacttttttaagtgctaggcacttcatgtatttatcccttataatagtccttcagtgtagatattattagccactgttacagatgagcagccattctcagaattctgaggactcacatagtaattcattaggcaagtgataagctttatgataaatacttgaaagggaccctaagagcantagaggagggatcatcctagtttnagagttggaagattataccgaattaggcctccccngagaanatgatgtttttaggccgagctattttaaggccagttggaccctggnccaatgtgttgattggaatgagtgtgtgttcgg

SEQ ID NO: 683269 - DNA, 1029 bp, Homo sapiens
ctccaccccgggatacacagaacctcatctcctacggtgctagaagcctgtagtagggcaggatgggcaggaagagctagatccgcggagtctgcggcgcgggtgaagatctggcgcgtaattcccgctgataagattgttccgtgcccgccaagcctcctggactatgcaggatccgaattccctgagcgcgttgtcgtgacttataggcgcagacgttatgagatgcccggggcattaagagccgcgctcgccgtggttagccgtcaccccctagccttctttaaggcctctcagggctgggcccaagtgcccagacgacaggtcacccaggtggccagtaggacaactgcgggcctcatcttccaagtgattacaggaaagtaacgaccggtgactgcttgaatcctccaagaatgtctgtgagacaccgggtgagatagatcgcattatgtcacgatctcggtgaatcaaagcgttaccgtgatgtggctcctatctgtgggaccgtgctcgtacgccgtcctttttcctaaaccttctggtttttcctttggaacactcctggtaatgcccctctagccctcagtatcagtggggtcttatggcgtgatggtgatgtgggcgtgtaagctcttgagggtggggtcgggcggagcaggtctgtagtgctgtggcatggggtgtcccgtttccgttgtgcagatgtggcccgtggcgtcgggattctactttggccgctctcctcttgaagcaggataactgcgagggcatccccatcggcctggattcgtctgctgggggtgggcttcgccggtggctggtcggttgtccccgtcgtggactcagaccggcctacatgggacacgcgttgcaagcttcgccgctgtgggcttaacgggagggccgcggcctacggcggagctcttaggaagccctcggatccttttagcacacatttgtcgacgggcccttgcacctgggtggtgccgacccgttcctctcgctcgcgcttctctccccttgagc

SEQ ID NO: 683270 - DNA, 185 bp, Homo sapiens
  misc_feature (116)..(116): n is a, c, g, or t
  misc_feature (118)..(118): n is a, c, g, or t
  misc_feature (166)..(166): n is a, c, g, or t
  misc_feature (179)..(179): n is a, c, g, or t
ccacgggcgggaaagacacaagcatcatgcagtggcgcgtcagtttagtacccaccgagagctgtggggagcagcagtgggcaaggaagacacagactcgcattacccttggtcanangtgatttctgttttgtttaaaaaattcttacaaacctcaggataactntaccctccgccgnctacct

SEQ ID NO: 683271 - DNA, 291 bp, Homo sapiens
ctgtgcacgatctcatagcaggatcccctctctagcactgaggacgcaggcgtctatttaacgaactgaaagtattggaaccctggccctccctcccacataccagacaagcagtgaagcttaaggggctactctcattcctcccagagttctacacagttcctcacacctcgccacacagcttcctgcttacacttcactacctcagtgagtttctgtttgctggtttgctgttgttgaattttttttgttttatctgcctgacttccgtcaccatcctctgtctagaga

SEQ ID NO: 683272 - DNA, 117 bp, Homo sapiens
gcgccttttccctccttccgctcagctggggcctctcgtactctcttccgtggtgtgtccttttatgctctgcaaactttagcatcaaactggggccatcttctcacacagtttcac

SEQ ID NO: 683273 - DNA, 1100 bp, Homo sapiens
cgcaatagtcctctgggacgaaagcatggccggaaagcagcttgtgtcaaacgagtcgttacaggtagtcataagtctcagtattagacattctgagaggaacgatagaagagtgagaccgtagtctagaataccagtcggagagactcatggagagttgggagctagttgactagcgtagtgacaggtagcgttgaactgaacatcgacagagcagcagagcgtccaaggctacatacttatagtaactgaagcacgattcgaaagaatcacataagcgacggctacacgacaacgtgtcacagtggatatcaagagaacgtccaagcaaaacattccatacttatccagaggccccatctatgcatggcaagacgggaaaccccgttgggaacccgacgaagacatggtaccatgcacgttcacacagacggatgtggacactggacagatgcgtccttaaaagatctacatgatagaccatttctaaaagagtagtagcattgtgacaccgtgccataaggatacttggaactgctaaattcactgcaatgtcacacataaggttcacttaacagtgcaaaagcgattaacaagacatcatttccttgcatttgccatctacattcactatcacgataattacggatgtcacgacttgcatctcagtgttaaatcttttactgactacgatgtacttacagtaacatcatgacaaattctacttgtacactatagaacgtgaatttgtggcacggtagacatggcttgtgcctatttagggattcaatgggcacttagagaacgcaatatttgtacttacagtaaactaaagtggccaaaaacattccaatgggcataactgcactggatctcaagacttaaaatacataccgtatgacaagataccaaacactccccaaatctggatagagtggatactaagcaaaggagggagacaaccaaaagcgacaggaaccgcgccaggacataggagaccagtcgccaaatctcaccaattagcgagtataacccaggtaaggcgcctctaaagaccacgtgagactcagagagacggagccccagcataggaacaacac

SEQ ID NO: 683274 - DNA, 327 bp, Homo sapiens
acgcgcaccgccgttcaaatctctttccgctatgtaagatcctcctcttttaccacgatccttacttggaaggaagtccatggactaaactcctctcccaggcatgttttaccctaactataagctcttagcccacttgattcatgctactttgtaacaagactttccttctcctaagacagtccccaatgtgaatgaagctcacaggtcttagatgtaaagctggtcgatgcaattgaatcgcagtacaatgtgtgccttcaggggctgatgtactgtttgaaccggcgatgccaaagtggtctaccgagctctcattcggactca

SEQ ID NO: 683275 - DNA, 150 bp, Homo sapiens
tggatcgtcagaagctgttgtaaggcatgtgtgtgaactgaggaagaggcattagtgccacacaagtgacataccctctggagctggttgggcctgatccttatgacgatttggaatcatacataatgcgaagtcctatgattagtgtta

SEQ ID NO: 683276 - DNA, 147 bp, Homo sapiens
gcggccgcctactactactactgctcgaattcaagcttctaacgatgtacggggacatgtgaacccaggaggtggaggttgcagtaagccgggattgtgccactgcactccagcctgggccacagagtgagactccatctcaaaata

SEQ ID NO: 683277 - DNA, 345 bp, Homo sapiens
taaaggagagagtctggctctgtcacccaagctggagcacaaggggcgatctcggctcactgcaacctccacctcctgagttcaagcgattctcctgcctcagcctcccgggtggctgggattacagacatgtgccaccactcccagctaattttggcattttggatagagatggttttcaccatgttggccttgatgtcttgaccttgtgatctgcccgcctcaacctcccaaagtgctgggattacaggtgtgagccagctggaacatttttaaatgaggctaggaaaggtacaattgtttgagcacttttaatatacatataacgttctgatacggtttgga

SEQ ID NO: 683278 - DNA, 175 bp, Homo sapiens
gagagatggccagcaggaaggcggggaccggggcaaggtggcagccaccaaggcaggcccaacgtgggttcttccaaccggcttttccatgtttgaacaagcccagatacaggagttcaaaggaggccttcagcttgtatcgaccaggatcggtgatggcatcatctgcaaggca

SEQ ID NO: 683279 - DNA, 946 bp, Homo sapiens
attctagaggccgaggcaggtggatcacgaggtcaggagatcgagaccatcctggctaacacggtgaaaccccttctctaataaaaatacaaaatattagccgggcatggtggcgggcgctgtagtcccagctactcgggaggctgaggcaggagaatggcgtgaacccaggaggcggagcttgcatgttgagccgaggatggtgccactggcactccagcctgggcaacaagagtgaaactctgtctaaaaaaacttgaataaccataaataaggtaactaacctcagtaacttaaaaccggcttggcaatttatacctgaaatttaaacaagtacacgatggcttgtggtaggccaaaataatggtcccaaaagatagctaggtccttgctctgtccgtgagaccaccaactctacacagtaaaagtcctccctcatggtatgctcgtggcctcttgccccttccaactcaattcaagttgcgggcccctgtcactcttggcccctgaactccaaaggcacacaatcctcctccaggctgtgcaagtagtattccctctgctgaaaatgaagctgtatatctcaggtcagtgtcccacaggcgcctgccaccaggggacgcgtggtcgggtcatcaggtggtcagccgatccagtcctgagtatagaaggagagcctgtgcggttgccgttgccacaagggtctgagtcggggaactcaggtcaccaatgtccccaggagggacttttgggccagggcgagggctcagtaaaaaccagcagggtggtgccacgtgccgcacaggggggggagcgcgcctgcctcggcgggaacaaccccgcgggggtctaaaaaaaagcggtcactgcgctgttcttcgtttctatcacactcattgtatcctagtgatcatgtgtcaaggatacacaaagcagaatcacgcgt

SEQ ID NO: 683280 - DNA, 140 bp, Homo sapiens
aaaagccccaggggggcctggggccggggtttttttggaaacctttcccaaaaattttttttgggggggggttttttccccccccccccctttttaaaggggtttttggggggtttttaaaagggtttttttttttttta

SEQ ID NO: 683281 - DNA, 387 bp, Homo sapiens
acgcaatgagggaggggtggcattgacaagttctatattgtccttcctaccatcttcggtgcctctgcagcaatatgaagttaaaaccagctactgtgatcagtccctgatttttggttcttatgaaggtgctttgcttcctgcttctgcctcctgcttctgctgtcttcctagcttctgccgtgtttctcccagggttcttggtgagggcttcctgcttctgccaatgaagagtatgcttcagcttgcttgaggaagctgtggaaccttttgtatctgttggtgatgtggaccattatttacaagccgtcaaagaatatgaggaagttgctgtatgacatactgctggcgctgttattatccatcatctctttttggacacttctg

SEQ ID NO: 683282 - DNA, 940 bp, Homo sapiens
  misc_feature (940)..(940): n is a, c, g, or t
ggcaaaccatgtctctactggaaacgcaaaattagccaggcatggtggtgcatgcttgtagtcctaaccactcgagaggctggggcaggagaatcacctgaacctgggaggcaaaagttgctaggttgctgtgagccgaattcgcaccattgcactccagcctgtgtgaaaagagcaaaactctgtctcaaaaaaaaaaaaaaaaaaaaaaaaaacggcccaaagcgggttttggaggggggtggcctctccattttggggaaaaaaattgtccaggggcatatagttcctttttaaaaaaccccattaattcccccgggcaacacgttatgcgtacccataaaacaacttttgtgtggaagttgtgccccatatatacacagtgtgttttccccctcgaagtgaaacactgtgggtgtttcccctgggaacacagaagccaacgtcgtcattgggcagaccattttagcaccaccggaatggaaagtatgacgcgtttaaaaacactgccttaaggggcctccgtaaagtacaaaactcgagcgcatagagcaatccgggtaaattaccactctgacggagtgcacaattcttagtaaattggactatttcacacccccagttctattctcattacacaatgggggcggtatcagcaacagtggtaagaccccaagggcttccgcagagagaaaacgctcgcgtgttttaccagttaagacacttggaggctggaccttatttgagcagaacattgagcgatgggctacacagcgtccttggacagacccgagttctttagacgaaaattttccgcaacagttccgggggaaagggtccttttagagaccaattagtccagagcggggcaatgatcagatagggcgcaacttatcccgagggacacatgcacggtgacaccacatcgctctttaagcan

SEQ ID NO: 683283 - DNA, 284 bp, Homo sapiens
cgtcgacggcggcacgtgcctgtaatcccagatactcaggaagctgaggcaggagaattgcttgaacctggaaggcagaggttgcagtgagctgagattgcaccactggactccagcctgggtgacagaggaagactccatctcaaaaaaagaaaaaaacccaaaaccaaaaagcaaaaattagccaggcacggtggcacatgcttgtagccccagctactcaggaggctgaggtgggaagattgcttgaccgctgggggcagggactgctcagtttgtcgacg

SEQ ID NO: 683284 - DNA, 491 bp, Homo sapiens
ctagggagtcgatatcactgggggacgggcctagagagaggagtcagctcatgattgacgttgtgagtccagagtcgagggttcattctagcacagctcactacctccccagggagcagagctggaatggagatgcctgtccagcgccccagtattgccaggggccatctgaaacctggagcactttcccaggtctccccagggtctgtgaccgcttcttgtctttctcttttcccagtccctgaaagccagaacacaaaggcagcgctgccctgacagcggttttcacattcatatgtagctcgaggaagcagcagcaccctgggcttgtgcctgtcctcctgcatgtgcagcctgcccaaaccataggtgatcacaagcctaacttcaccagcacaaacagaatttactgggacagataaataaagcttctcaagctttaatctctcaaggcacttaacaggaaatttcactttcctaggatacagtag

SEQ ID NO: 683285 - DNA, 712 bp, Homo sapiens
caaataaagcattcaccttagtgttagactatgtaaaaaaaagactgccagctttgacttgttcatttgcattactaggctagaaagaaccgcaaaatcgcatttttttctccccttttcaggaaggactgctagtccttcattatggccttgcggcttctcctatgaagataactggacgatcctaggcacatcttgaggcgggaaacaaaggaggcttgtgcaggactgcatctcaccaacgattaccatgaaatgaaattgctaccacatttgctgatcaagacataactgacctattgttagcaccaagaattatagcgggtataagtacaacttgggacgacggaaagcatctggtactagagactggatataaaaagcagccaaagctcaacggaaatttttcaaaaattgaattttagaaattggatagctgtctttgctcagccatagcaagtatggaggctgggatacatgctctctgggatggcatcaggtgtgcagtcatctctttgcacgagagtgagcttttgagttgaagatccaaagccagtctttgtacactgcagggtgtactctgaaagaccaacctattggacacttttgtatgtcccagcacatactgacgtgtaccttgttatactacgcgctacagcgcgaggtactcactccaaacggtgattggtatttgtgagagagtctctactta

SEQ ID NO: 683286 - DNA, 1227 bp, Homo sapiens
gccctgctgaattccgtgccgccgccggctcctgtgaagagaggaatgcgggagaggagcccacgtcgcctgtcacccaagtatctccagccgcgcagtcccgaagagtgtaagatgttcgccatgctccagagctcgtccttgtcacccccttctcttgatccgacgctggattccagaggttgcatacagaccaatttctgcatcagtgttatctcgatccagtaggctagtagtgactggagagggctctacgtgtatttaatggggcccagtaactggtgtgtctcagctaatccaaaggcgagctttcacgaccagttgcaatcagcagagacattgatactgctgccaaatttattggtgcacggtgctgcaacagtaggagtggctggttctggatgctggtattggaacagtctttggcaagccttatcattggcttatgccagaaacccttcgctgaagcagcagctgttctcatatgctatcctgggatttgccttgtcctgaagctatgggtctctctagtttgatggttgctttcttgatttagtaagccatgtaacaaattactgcttgacatgttggccattcatattaaattaccggactgtaatacctgtgctctcttactgtgactccgaaaactgtagtatatggtgtcatgggaatgtacgtcaatttccaaagccatctcactacacatgaaaacctttcacaacacaaccaaacataaaaaacaacccgaaattcttatactaatctacatctcataacctcatacacacaatacaaatatcaccatcaaaccatatcattccacctatactcactctataataaatacgaatcacaagcacacacaccacacatcacaacaaccaacagctaagcaccctcatcacaataaaataacactatcatcataacataacccccacaaacgcataaaacttatctaacaacgtgaatcaattcatactacagtaataccatccaaatctgactctacacctcataatacacttcatcaaacctcacaaacatacacacttcccagacacagcactcaactcaatcccacacccacataataatatatacgaagaagtagacaaatcgaaaaagtcaacaactaaacatatctaccacaaccccacctcctaatcactctacgcccacagccatcttcaaaccattacaatcacacagatgactcacaaa

SEQ ID NO: 683287 - DNA, 281 bp, Homo sapiens
caccttctccacatactaggccatttaccctgccaggtgtcctttttgacctcttgactcttgactcaaggtcagctcaaaggttccgaactcgggcctgggatgtgcgggggtactgaacctaagttatccggagtcgttttccctgggtcccttagtcgcgtccttgaggcacctcactctagatcggagccttcatgtcccaaactcactctagtgagtttccacatacagccccatgagtgcccggtagacacagcactagaatagaaaatctcgtc

SEQ ID NO: 683288 - DNA, 787 bp, Homo sapiens
  misc_feature (2)..(2): n is a, c, g, or t
  misc_feature (84)..(84): n is a, c, g, or t
  misc_feature (90)..(90): n is a, c, g, or t
  misc_feature (94)..(96): n is a, c, g, or t
  misc_feature (103)..(105): n is a, c, g, or t
  misc_feature (127)..(127): n is a, c, g, or t
  misc_feature (146)..(146): n is a, c, g, or t
  misc_feature (152)..(152): n is a, c, g, or t
  misc_feature (165)..(165): n is a, c, g, or t
  misc_feature (315)..(315): n is a, c, g, or t
  misc_feature (320)..(320): n is a, c, g, or t
  misc_feature (424)..(424): n is a, c, g, or t
  misc_feature (428)..(428): n is a, c, g, or t
  misc_feature (463)..(463): n is a, c, g, or t
  misc_feature (468)..(468): n is a, c, g, or t
  misc_feature (559)..(559): n is a, c, g, or t
  misc_feature (701)..(701): n is a, c, g, or t
  misc_feature (708)..(708): n is a, c, g, or t
cncctctataaagagctcaagtgtggagctgactcatctatagattaaggcatcacaaagtaccatagtcacttaacaaatgcncaaaanaaannnaaaagcnnntgttttacctttcaactgctgntgttatgtacaatctatcncaaaangcatagctgtgcnttcatgagctgattatatccacctctagaattttagaaacgggcccctctaagcctatggatactctcttaccttacaaagtaaaagcattttctattttaaaatttttatttctgtgtaaaacaaagaattcctagaggtcaaataatntaccnaacttaaagccctattaagtcatgaaacaaagaagattctggggtagaagtcaagccatttaatccccagtttcaggtattccccgcaaccatcgcatttcgcnagtnagatctattttttttaaagtctccccttcccaaanatccntaatcccttctgtaaaatccggtgtaaaactatggccccccgggggcccccccccttttctcctggtaacagagtaaatgcttttactaanagctgccaacatttctatcagtagtaaccgtaaggaggccgctggttgtaaccataatgtccatattgctggggatagtaaggttcttgtctgtgttgcgggtagttgttaccccaggatcgtccatgccactgattggatngattgtnacttggccacccccatctgttgtccctgcctctgaactgtctgttgtcttgcaaccgattgcctctgtttctttggttc

SEQ ID NO: 683289 - DNA, 257 bp, Homo sapiens
taaatgttaaaacatactttaaaaatatacaatgtaaaataataagttataaggcaactaatataagtaaaaaaattacaatgtaaataattagttataaggcaaagatcagagtatacatgtgctttccaccgatcaaagtggatgggcctgcgcccctggcgtatccacagaagccacgtggtggccctggccagcctgtgccaaggacaggcaggccccgtgtcctccatgcctctaacggcaggttttggagt

SEQ ID NO: 683290 - DNA, 393 bp, Homo sapiens
ctgtcttcaggaacttagagtaaattctagaaagtctctaggaataaagaaaccaaagacggtctggtcagtcacacattctcaggtttaaccctatcttataaaagtcttagggggaaaagttgggagtttttcttgaactgtacatatttcacatacttccctagtcttggaggtaggggaaacagatctagagatgtttgagaatctctgtgtaacttagagtatacccacaatatgtagtaagtgtattcttttgagacagaggttgaggtgttacctagagcaccactctccctgttaatcttggaaatgaactaactggctgtaagagcttttgttgaaaaagttcatttcaaggctttgggttttctaattacttctccaaaatga

SEQ ID NO: 683291 - DNA, 910 bp, Homo sapiens
gggggttggggcatggaattctacaggagactggagtcttgcttgtgtggatcctttgggtctccgagttcctgcaggtctgcaggtgctgcgccctgggaacctgcgtgcctcagccccgctctccctgcctgagagcacactttaggaattctgcataggatgtgacaatgccgtctgtctcactgagagactttctacatgcgctccaatgtactactattctagtttgttgcagttcacccatctttcgtacatactagtacaggacgtagttgatagattagactagactattgcccccagattgtatctatattatcagaaaacgaatcaaagtgtcggagggtcatactcaccgggcctacgaaaagaggataagctgaaatggggagctatctcgtgtcatgcccgtcgtagtgctccgatgcgatctgtttctctcgtatccagagtgggtttgacctttttcctggggtcctcccttgtgtatcagcgatcggtatgtgatgtgtcacggatatacaaggcgcaggttgtacccctcaccttggaggtttcgagggaaggaaagaggaaaagccaagataccactaccgggaaagaacgaacacaagctcatgaggcttacggaaaccaggccgagaagaaacgtgggagaagaaatttgacaaatacacagaggtcctcacagacccacggactccatggtctgagccccaataaagactggttattcctcatgcgttgcctgcccttctccattgttgccctggaatgtacgagaacccaggggcagcaacaggccaggtgccacaggacgcctggacatcgaagatggacacaggaaggtctagtcatccctcccgaatgtgaagcacagagaattggacggtttatctttacccag

SEQ ID NO: 683292 - DNA, 418 bp, Homo sapiens
cgtgcgacttcactccttcgtagtccctttcgtcttcacctgacagctatctggatttggacttctattgcggctggaagggcgacgtcgccgcggcttcatcgctcgattccagcttgctgcactactactatccgggctccagctcgcccaagggcggccactacaactacaccgacctgtacctagtccgcgacctatgccaatctacatcctcgagtattcctacacgcccagcgacttcttcagtcacgccccacagccagggcacctcgctaccttgacggcaccgcccacttccgacctgcgccagtgctggcggcctggtgggccacccctctgttacccacaagctcatgaaccacgtcaacatgcaacgcgattccatcggtccactacgtctactatcaggtcgggc

SEQ ID NO: 683293 - DNA, 279 bp, Homo sapiens
cacgagtctagtgggctgtctacaggtgtatgtcatgctgagctcccatgggagaagcccctgctgtgtcttcggcagtaggtgagggggagaagaagcactcccttctccaaggtccttcacaagcaccaggcttcctggctgttggggtagaggtgcagactttccctgctgagcccggcactgcgcctatgcctctgctgaaacttcccacaagcggaaagttcagggactcaaggcctgtgtttggattcttttgtcccatgcgtggattgccag

SEQ ID NO: 683294 - DNA, 192 bp, Homo sapiens
ggaagagagcgaggagctgtattctctattccacaataagatgatgcaagtattaatatcctatgaaagggtaaactgaagttggtatacctatcagaaaagggtcactcctggcaatgtacctcacagtaggacatgaggtccgcatgatgccttcgaaaccatattatactatcaataggaggcttctaa

SEQ ID NO: 683295 - DNA, 662 bp, Homo sapiens
ttgatttcttcagccattagacagggtattgtaacaggctcaatctggcacaggggtacgcagtgataaaggtcttaggggtagtatctcattaataacgcatacagttggatctgcaaagggacagcaggaccataccatagagagatatctcacggtcgtacctgaataaagctcacagagaagcatgctccgagttacgtgaaagactcacacatgaggtgatctgcataatcctatgcatctctcatgaacgcctcacagatttcatcattgcaggttcatcgtaggtagggtattcatgtggtacgtgctccagagcagctatgcagagcattgggtccaggccatctctgctgcagcatgaagcatggcttgggtgaccgaggaatgcacaatgactgtcataggatgtggcaggcagtgctgaggtactggtgtcataccattcagaggtcagcgccttcagtgcagcaggattcggacaagaagacgacttccctacaagttggctacatgttcaaacggctctgggtcaatgttatctccaggcagtcatgagtcgtttaagattccaggcctctgtgtaaagcatgtccagattccacagcaagctgtagttccaggacactgttcatttttgcaccagagagtcatgcagc

SEQ ID NO: 683296 - DNA, 149 bp, Homo sapiens
ccccccccccaccccccccccggggccccgggggagcccttttaacccaaaaggggcccagggggcccccgcccccttaagattttttaagacctggacctggggggggaactggtttttgggggggaaaaaagcccgtttttccttga

SEQ ID NO: 683297 - DNA, 125 bp, Homo sapiens
cggtaactgtacttgatttaatgtatataaaatattcagtaaggctgcttttcaaagaggatccactgtccatttaaaggttacatagttatcttcaatggggtagtattagtttgggagcagtg

SEQ ID NO: 683298 - DNA, 152 bp, Homo sapiens
cgtactagatcgaagcatctacaggatgatctacagtcagagagaatacagatacagtgctcacaggccgaagtcataaaaaaaataatccggacaggcacggtggctcacgcctgtaatcccagcactttgggaggcagaggtgggtggat

SEQ ID NO: 683299 - DNA, 272 bp, Homo sapiens
  misc_feature (19)..(19): n is a, c, g, or t
  misc_feature (46)..(46): n is a, c, g, or t
  misc_feature (141)..(141): n is a, c, g, or t
  misc_feature (149)..(149): n is a, c, g, or t
  misc_feature (157)..(157): n is a, c, g, or t
  misc_feature (216)..(216): n is a, c, g, or t
tcgggtagccccttgtaanccctttgaaccccattagggagttttncaagtaatcagttaatgaagagagaaagttacaacattatttggcttaatgagtcatagtaaagacgggtcttaatataaaaaaaaataattttnctaatgcnctttaaantgttttttgagaacatatgataaattacccttcaatgaaatattaagattggtatatgncctaattgaaaaaaattcaggttttagaaataaatgacatctattagtgtgtcaaa

SEQ ID NO: 683300 - DNA, 114 bp, Homo sapiens
aaaattttggatttggggctaaggggtgggagggaggccaaagctttgccccctcaaagggtaaactggggtcagtcctttttttcctttgttccaaataaaagatttacccca

SEQ ID NO: 683301 - DNA, 634 bp, Homo sapiens
  misc_feature (599)..(599): n is a, c, g, or t
  misc_feature (625)..(625): n is a, c, g, or t
  misc_feature (627)..(627): n is a, c, g, or t
aacaagcttgaggactacaactggagttttcagaaggtggagcagaatgggttctgtggcaaccaaggacatcttcaggaatatgcaccagggtctaaagcatatgggagcacagctgatcggcttcagtgagagtgtggttaatggtgtcaaagtaggctttctggcttctcctaggccactcattcagtgataggggctgtgtctcaaagcccagggaactcacttcattgatttggaacaaatttagcagtgcagaagacatctctaacctggtgtcacaaagaatcatgcagttttagagctagaagggaccttagagattatgccaaagctgaatctgagagaagtgtcctcccaggaaaacgccaagattctccaagacactttcatatcctaagccctgttctgtttgttcttgtgtagtaaattggcaaatttggcagtacagaagacatctctaacctgatgtcacaaagaatcatgtctggcccatacaaagtattctaactaaccatgtaagccactagaatgttaaactaatgctctggcactgaggtgggtatcttgagcatttgtgactttacagtttattatcngtattggttaaaatatatatgaacanangctaaaa

SEQ ID NO: 683302 - DNA, 195 bp, Homo sapiens
gtacacattcaagcatcctcgttccagtgagttcacctctaaatcaccacgatcatatgtgacaagcatcaagcacgcagcaatttagctctaaacgcttagcctagccacacctcacggtaacagcagtattaacctttagcaataacgaagtttaactagctatactatcccagggttggtcatttcgtgcca

SEQ ID NO: 683303 - DNA, 326 bp, Homo sapiens
caggaggggcaaaggaaaggagaggaagagaaggtcatgaatcttatccagggtaaattaagggtccactggtgcctgagggacggaacgcagagagacgacaatgttccggagatggggtaccacgaagggtgttttctcatgcacaatgcgcggctcggaatttgaggaccggacagtccgcacctgaaagatgagcacaagacagcggcttgacggcaaagctcaaaagggctttcccatttaaaacttcaacatctttacaaagtctgataacttgacactcctcttaggtttacttgtacccttctcccccagtgcttcag

SEQ ID NO: 683304 - DNA, 137 bp, Homo sapiens
ccacattgtcccactggaaggtcttcagtgggcgataacgtgcatggagctgacatctcctatgataacaatcgggaatacctactgtaaggacctgcctgagtgctgtgttacacttgaacttttttctttttctt

SEQ ID NO: 683305 - DNA, 806 bp, Homo sapiens
cacaacatgaagctggtgcagggagagctgatagacataccgggaaagatacacaaacgagactatcattcctgctctcaagcgcctgagtcatgggccttttctagctagtgggctacacactgcatcagcccccacatctacagcaagtactattctcctctactgaagatctatgacaaccaacccttcgtggttccgctgcatgtacatgctgatctggggcaagttcgtgctgtacaagagtatgtcacctgttggctggttcacacgaaggagtatgcagtttgtgacggggcctgggacttcaatggcttagaagaatggggcaaggccatagtgggatgcctgtgccatatcatgaaggtgtggctctgtgaaacaaatctcccgtttcacatgggcaccattgcactcattcaaggagtactagagcactcaaacgcccgtggggtggacccgcgtagcagtcttcaaacggatctcaagttccttggaaactcaacagaatctctctcagggtctctcgtagctgattcctggccctctgggcacgggctgcgactcaggatacctggtctgcttgccagatggaattcctcatatgtcatggtggaaagacccggctgcgaggctcattcaagagagcccgagcctggagcgagctggaacgcccattactgtcctacgagcccttctactaattttgggtgcaaacaagacctatccgactgggctcttcatgggttaactgccatgaatggctttctgcctcttcaaggtggggaccaaatgggtttagaggg

SEQ ID NO: 683306 - DNA, 298 bp, Homo sapiens
  misc_feature (37)..(37): n is a, c, g, or t
  misc_feature (58)..(58): n is a, c, g, or t
  misc_feature (75)..(75): n is a, c, g, or t
  misc_feature (83)..(83): n is a, c, g, or t
  misc_feature (116)..(116): n is a, c, g, or t
  misc_feature (132)..(132): n is a, c, g, or t
  misc_feature (158)..(158): n is a, c, g, or t
  misc_feature (162)..(162): n is a, c, g, or t
  misc_feature (170)..(170): n is a, c, g, or t
  misc_feature (176)..(176): n is a, c, g, or t
  misc_feature (228)..(228): n is a, c, g, or t
  misc_feature (256)..(256): n is a, c, g, or t
  misc_feature (276)..(276): n is a, c, g, or t
taaccaaaaaaaaaaaatcctgcctttttagccaaantgcctaggatgtttatttgcnccaaaaaccaaggttgnttttaagncccttggcgccattaaccccccttttttcatgnagatttccaaaaatgnggaatttttaaagccttttttttggnaaanataggtgnccccgnaaaaatcttgttttttttatggaccttgggccaatttttccttccctttgcnctttgggggtgggtctaaccccaactgnattgttttgtttcctccaanaaaccttttttgtgggcccgga

SEQ ID NO: 683307 - DNA, 288 bp, Homo sapiens
  misc_feature (172)..(172): n is a, c, g, or t
  misc_feature (204)..(205): n is a, c, g, or t
accttagaggatccccggcaggcaggttcgtcatgttgcccaggctggagtgcagtggctattcacaggcgcgatccactactgatcagcacgggagtttttgacccgtgctccgtttccgaacttggggccggttcacccctccttaaggcaaccttggtgggtcccccgnctcccgggggggttcacccatattttgatgcnncgaacttaagttgcggaacaccccggaattcgggcattaagcgcaactaacaagccccaagaaacttcccttggggcttcaaa

SEQ ID NO: 683308 - DNA, 662 bp, Homo sapiens
  misc_feature (481)..(481): n is a, c, g, or t
  misc_feature (657)..(657): n is a, c, g, or t
gattagactctaagatattcataaccattagtttattaatagctctataaaagttttccatgttctagggtcctgaggggaatggtctagataacctaacagacttttccatccctcatgattcattttactctattgaaaattatcttaaacagaaggaaacgaataggcctggtagaaccagattcgaaacagtgttgcttcagtgggaagggagtggtttcttagtcagtgcttgtggaggctgttactccagaggcagccccgcttctctgcagttagtaaatactactgtagcccagtggcagatactgcggacataaatcttaaagctagtaacatgttgttcttctaggaattccattcagctacagatttaaggtttatcagtagtatttccagaaagatggtccgacacagtggctcacgtttataatcccagcactttgggaggccgaggtgggtgaattgcttgagtccngggagttcaagaccagcctgggcaacatggcaaaaccctgtctttgcctgtagtacccccagctatttgagaggctgaggtggaagaatcactgagcctggggaggtcagggctgcagtgtgctgaaattgcacaactgcactccagcctgggcaatcagagtgagaccctgtctntaatt

SEQ ID NO: 683309 - DNA, 111 bp, Homo sapiens
aacatattgagacacaattctgtttaaaagcagtctcagttatgtctttatagcagtgtgaaaatggaataatacaggaaattggtaccggtagagtggggtactgctata

SEQ ID NO: 683310 - DNA, 202 bp, Homo sapiens
caaggaatttggggggattttccacccgaggtgtattgaaaaaattcctagtatttcagtaaaaaggcctgttgtgagatgaccctccgggaacttctatttgtttttttttgggggtcagggagaaactagcatttttttttttccaaactactttttgtccctgtgccagttgtaaataaagtttgaaaatgctttccca

SEQ ID NO: 683311 - DNA, 1113 bp, Homo sapiens
tctcgttacccctgcttggctccttgtctgttcttttacttctccgtcttcttttcccggctgacctgcttatctttctgtggctctgtgtttttctcctcttccgatttcatactcttttgtgttttgtcgtcgctttagtgtgtctctgctatttcataataatgtttggggctggctttcattttccttgagttctctccgtggatactccttctgtgtttttggtcctggtcctccaactccttctatttctgctcagtgtatatctcttgtggtcactgtccttttggtgtgtctcttctttctgctgccgccgccctcctgctgactgtgtacctaatgtgccttgttcttgatctggcgttgctatacgggtccctgtctggttatcgtccgtgggtgcgccttgtgtttctgatggtttcctcctcctcttggctgcttcgcctttcgctgttggtttgtcctatgtgttggggctcccatggtctttctcgtagtctctgtctaggtgctccttgttgtacccctgatcggtgtctaggccctatcgtgctgctctagtttggcctgcctttggcggttcatcccgtatcatcgctctttcctgtacctgtcccccctgtccccctttttactggacaccccttctctgctgtggacgtgtctgcgtgcacactgccgtctccatctggtgtgtttctcagtgtgttgcatgtcgtcgttgggcaaccccacctgtgggaccttatggggcgccttgctatatacctacaactggactccggccctctcctaccagtgcgcccagtccgtccacctcgacgtttacgaagccccccacttccacattttccttgtatggtgtgtcttcttatgctgcatggagaactagacgtcgattcatattgcaatataatatattgtgtgtattgtaacagggaggggagagagggggcgtatcgcggcggagttggcctcctgccgcctggtactcaagcccgcggggacattgggacggggacccccgccacgtggccctcccctctctgcaccgtactgtggaaaagatacacgcacgtagtctctaaagagtttatttaataggcc

SEQ ID NO: 683312 - DNA, 92 bp, Homo sapiens
aaaggaacccacccccaaacaatgccatccctggaatttccccccgctttgtgagccgtgtggtatgacctagtaaactttgtccccattca

SEQ ID NO: 683313 - DNA, 279 bp, Homo sapiens
tagctggaaatgtaatgtatccttttggcaccgtgtcttggtaggagtcctgctgcttgccactcttgtcctcataaacctgtgtggcacaatcttcagtgatgcagtctgtgggaggccagtgtgtgttggagtgtgagtcttgtctggctccccgcgcagcagcattgcaaagctcctgtggcatgttcttggcacctgtagctgtgtccccaaacggcgacgcttgtggatgaccatgcgtcactgtcttggagtacttgttggcttgggcttgtg

SEQ ID NO: 683314 - DNA, 1091 bp, Homo sapiens
  misc_feature (457)..(457): n is a, c, g, or t
  misc_feature (659)..(659): n is a, c, g, or t
ttttccccccccccgggccgtcccctaaaggtagatttttagccgtggacgtgtgtgccccccgacgtctccacccgggggaccctcattattttgagaagttggatttctcggccggcccgcgggtggcttctgttggggcccccccttaatggggattttcctacatcatttgttcggttggtgtgctcccgcccgttgatggcgtgggccgccgctgtgatacctggggccactttgtgtatttagcgccaaaccgtccacgtccaccctatggagcctctccgtggagtcttatccacccgagcacccggcttgttctatgcgctttggttataggcttcccacgtttcccaccctaatatggtgccctatgtgccacatatagagaggcctcgttaaatttttggcccacctcacactatagggagaggcgtgtcttcacatgtgtccaccntggagttgtgtgcccgcgcctatatgttcctccacaggcgttatacacccccccgtatggagcccacacagacccctgatacgcccccacaatatgcccactcttctaccctatttacacatatatttccacatcgcgcgcgctaagaatctctaacactcttctcgttctccgaccacacacacactgtttctcggcgccncatatatcccgcgagagatgtgccctcgcacacgcttatactccgcgaactatccccggcagatgcacatatccaccccaccacatgtgaacacactttcctcatatcacattctcgttatgggcctccacattacacatatattttctaataccacgcccacgctataatatattataataaatttgttcacatgagatttgtagagaaagcctctcgcctttcgaagcgcaaaaagttcctcataaatgtacgagagagaccctcccactaaaccctcggaggtgagctaatatggagtgccccccacccctaccaccaccactttcgagagaaacccctattatcactataaatttagaccaaaaggaaggaatcgaacccccccaagctggtttcaagcccaccccctggcccccctgactttttcca

SEQ ID NO: 683315 - DNA, 443 bp, Homo sapiens
cgtgacaaagctgcctttgcttttatcactttgcaaaacaaaaaaggggacatgttgggaacaggcccctgaatctggccataaactggccccaaaactggccataaacaaaatctctgcagcactgtgacatgttcatgatggccatgacccccaccctgaaggtcgtgggtttactggaatgagggcaaggaacacctggctcacccaggatggaaaacggcttaaaggggttcctgtaccacaaacaatagcatgagcgatctgtgccttaaggacatgttcctgctgcagataactagccagagcccatccgtttattttggcacatccctttatttcccataagaaatgcttttagttaatctataatctatagaaataatgcttatccctggcttgctgtcaataaatatgtgtgttaattctccaaaaaaaaaaaa

SEQ ID NO: 683316 - DNA, 655 bp, Homo sapiens
  misc_feature (94)..(94): n is a, c, g, or t
  misc_feature (96)..(96): n is a, c, g, or t
  misc_feature (186)..(186): n is a, c, g, or t
  misc_feature (194)..(194): n is a, c, g, or t
  misc_feature (199)..(200): n is a, c, g, or t
  misc_feature (217)..(218): n is a, c, g, or t
  misc_feature (223)..(223): n is a, c, g, or t
  misc_feature (234)..(234): n is a, c, g, or t
  misc_feature (240)..(240): n is a, c, g, or t
  misc_feature (248)..(248): n is a, c, g, or t
  misc_feature (253)..(254): n is a, c, g, or t
  misc_feature (258)..(258): n is a, c, g, or t
  misc_feature (273)..(273): n is a, c, g, or t
  misc_feature (289)..(289): n is a, c, g, or t
  misc_feature (295)..(296): n is a, c, g, or t
  misc_feature (299)..(299): n is a, c, g, or t
  misc_feature (303)..(303): n is a, c, g, or t
  misc_feature (308)..(308): n is a, c, g, or t
  misc_feature (316)..(316): n is a, c, g, or t
tgtagaaagagacatttaatacttctggttacaaaattcaggcgtacattttagattgccctggaccgtgcccaaagctgtgtgctcatctctncncccctcatgtacttctgacgaggggggtgcagggcagggcagagcagagcctggggtccggaggcttcactggaccacagggggaggggnatgtgaangtggnntggcccagctcccattnnatcgnttttgcattgngcgatntaggaagnagatnncggngctgcctgccttggnctagaggagatggttntggccnnttnccanagggngaagtggnaatgggacattttagggcagtcagacaatcctggcttgtggcatacttcggttcgggaaccagtttctcttgcttgaagatcgcaaggccgatttatctgtaaatctgtgagcctgtgcgcacgcctaaatcactcggtttgcctgcagaccctcaagaaagacaatgggttgcgcgatctgattcttttccctcctgttaggaggatggctgctctcccctcacactgctttcaccccacaggacgtttccacttgctaacgcctgcttttcctgaacactttattcctctaatcggcgctcgggcatcccgttttctagccttccagtacctctgcg

SEQ ID NO: 683317 - DNA, 258 bp, Homo sapiens
cgaagttgcttctcttgagagcctgctcacctgggcgcctcccttgaaagccgggtctaccccttgtctttgtgcacgtgtcctcccgtgtatggagcctccggttggggtgaccccctaggggctgccccctgcaccccggccggggccccccacccctgtttgggcctcgattaggggttaccaagaccctgcttttttcgggcccggcccctgcccttttttcccagcccctggcctccctagaatttttccaca

SEQ ID NO: 683318 - DNA, 242 bp, Homo sapiens
cggaatggtgagaccaccattcttgcccctgttcctcagggccgagaatttgagttgaacgcccgcaagtgagaagcgcaatgcgcgcttggcgtctgcgacaaggccttcttcgtctgcgtcttcgggctgcacgccacgcgcctcgatgggcacggctgtgaccgcgcctggcaagtctcccccaagctgcgcgagaaggagatattcgcgtaccggctttcggctaagtaatgaaagag

SEQ ID NO: 683319 - DNA, 496 bp, Homo sapiens
  misc_feature (94)..(94): n is a, c, g, or t
  misc_feature (96)..(96): n is a, c, g, or t
  misc_feature (186)..(186): n is a, c, g, or t
  misc_feature (194)..(194): n is a, c, g, or t
  misc_feature (199)..(200): n is a, c, g, or t
  misc_feature (217)..(218): n is a, c, g, or t
  misc_feature (223)..(223): n is a, c, g, or t
  misc_feature (234)..(234): n is a, c, g, or t
  misc_feature (240)..(240): n is a, c, g, or t
  misc_feature (248)..(248): n is a, c, g, or t
  misc_feature (253)..(254): n is a, c, g, or t
  misc_feature (258)..(258): n is a, c, g, or t
  misc_feature (273)..(273): n is a, c, g, or t
  misc_feature (289)..(289): n is a, c, g, or t
  misc_feature (295)..(296): n is a, c, g, or t
  misc_feature (299)..(299): n is a, c, g, or t
  misc_feature (303)..(303): n is a, c, g, or t
  misc_feature (308)..(308): n is a, c, g, or t
  misc_feature (316)..(316): n is a, c, g, or t
  misc_feature (339)..(339): n is a, c, g, or t
  misc_feature (353)..(353): n is a, c, g, or t
  misc_feature (369)..(369): n is a, c, g, or t
  misc_feature (399)..(400): n is a, c, g, or t
  misc_feature (405)..(406): n is a, c, g, or t
  misc_feature (418)..(418): n is a, c, g, or t
  misc_feature (426)..(428): n is a, c, g, or t
  misc_feature (467)..(467): n is a, c, g, or t
tgtagaaagagacatttaatacttctggttacaaaattcaggcgtacattttagattgccctggaccgtgcccaaagctgtgtgctcatctctncncccctcatgtacttctgacgaggggggtgcagggcagggcagagcagagcctggggtccggaggcttcactggaccacagggggaggggnatgtgaangtggnntggcccagctcccattnnatcgnttttgcattgngcgatntaggaagnagatnncggngctgcctgccttggnctagaggagatggttntggccnnttnccanagggngaagtggnaatggtttattaatgggagcttnggtactaggggttnggatatttgtttattngaattttttttttttgttttttgtattgtnnttttnntctttttttatntttttttnnnttgtttttgttttgtttttttttttattttttttttatntttatatatttttttcttggtttggatgg

SEQ ID NO: 683320 - DNA, 417 bp, Homo sapiens
  misc_feature (9)..(9): n is a, c, g, or t
  misc_feature (29)..(29): n is a, c, g, or t
  misc_feature (35)..(35): n is a, c, g, or t
  misc_feature (112)..(112): n is a, c, g, or t
  misc_feature (159)..(159): n is a, c, g, or t
  misc_feature (205)..(205): n is a, c, g, or t
  misc_feature (314)..(314): n is a, c, g, or t
atacaaganggttggcattgtacaagatnacttgnctgagtgtatggctgaaacccatactcctgctgccccaagctgtgtgaccctagaggaagaagccctatataaaaanaattagaaagacatggtttatttgcccagtttggagacctgagttancctagagcaagtgcccatttctattccatgcacaaaagtttagtanggtctattagtggtccgtgccacattaggtgagtttgtgaactgtgctttcttgggaaggagagcatcttgatggctcgctttcatcttattctgtctgggccatctcngggagaaattttttttatgtactttgcttatttttcagctggtatgtaagaggcatttgaccctattcttctgttcttacctctctgtgaagccctactttat

SEQ ID NO: 683321 - DNA, 565 bp, Homo sapiens
gttattcgtcactgactctcttactaaccagcgcaaacagactgttgatttccaactaaggatggggggaaagtgaaaacaatggaaataaaaggtcaaagaatccctcagcacttctccttgctgctgccatatgaagaaggatgtgtttgcttccccatctgccatgattgtaagtttcctgaggcctctccagccatgctgaactaatgcatgcgatttgttaatcatgatggagatctcagatgcttttgaagaggctgaactgatatgagaaagtcttaaccagttgttgcttctttgaagaagaaggaaggggccacaagccaaggaatgtggtggcatctagacactggaaaaagcaagaaaatgaattctccactaaagcatccagaaacacagctctaaagatccccagttttagtccagtatgacccatgttggacttctaaaccatagaattgtaagatactaaatttatgctgttttaaaccattatgttcatgataatttgttacagtagccatagaaatctaataaaattgagatacttctttccatttga

SEQ ID NO: 683322 - DNA, 1180 bp, Homo sapiens
ctatgttttatatactatatatatatatctatatatgtctatagctctatatatatacgccataccgtgcaaaagagacaacggaaaaacactcaaactacttcccacggaacacttggttctcactcggagaactccagcacaccaacgcagacgacaggacacgggacccaggcacacgcaatagcactccgacaaatcacacactgccagccggcttcctcctgacctgcaaacacagccgcaacctctcgcacctgagcgacacacgaggctccatgctctcacacgccagccctctgcaccacactcgacacccttggcctattaagcaaacactaactcacttcccatgcccctagccactctcctcctctcatggcccatcggaacactaagataccacgatgcgcacctgctcctgacgcgatccacgctgcctcaccccgcgggtctccctgatgctgcctccccatcactctctcctcccctgcgcacctctttcaccactctctacccgccctcccaatcgcccccgaacactcctgcgcgcggcgcctacgcttccagcacacacccccctccccctccaacagccctacgcctcccacccacacacccctcgcacccccccactccatctccacactcaacccctccgcacacctgccacgccggacacccacccacccctcaccccaccccctcgccactgcgccctccgcccccaaccctcacactcccaccacaacacagcaatgctcaccacccactctccatcgccgcaacagcccaccaaacccaaccccacaccaaactgccacacaacaccccgcccccccaccccgcccacccccccgccccgctgctcacccctcctcactggctctcacctcattctccctcctggcagtgccccccagcacccttcttcccatccccatctcctccctacacccgccagctgcacccccccacatctttccctgcccacctcccctcagcggccccctccacactcccgcccgcgcctcccacacccccctcacgctcccctctcctccccccccctcaggccacatttccgcacctcatccccctcagcgatctcttagctctcactcctgcaactccgcccccaacactgcgcgccctatccacaccctccctctccctgccg

SEQ ID NO: 683323 - DNA, 464 bp, Homo sapiens
gttattcgtcactgactctcttactaaccagcgcaaacagactgttgatttccaactaaggatggggggaaagtgaaaacaatggaaataaaaggtcaaagaatccctcagcatgcgatttgttaatcatgatggagatctcagatgcttttgaagaggctgaactgatatgagaaagtcttaaccagttgttgcttctttgaagaagaaggaaggggccacaagccaaggaatgtggtggcatctagacactggaaaaagcaagaaaatgaattctccactaaagcatccagaaacacagctctaaagatccccagttttagtccagtatgacccatgttggacttctaaaccatagaattgtaagatactaaatttatgctgttttaaaccattatgttcatgataatttgttacagtagccatagaaatctaataaaattgagatacttctttccatttga

SEQ ID NO: 683324 - DNA, 946 bp, Homo sapiens
agaaagagctgtccctgaaaatggtaacttgggtccaatacaagctgaagtgaaaggggcaacaggggaatgtaatatatctgagagaaagtctcctggagtagcaaataaaaagtttgagagcaattggatagtggcattggcaagtgcataaaatagctgaaggtttttcagaatccaagaaaaggtcatcagcaagcatgacaaatgcaacaatcaaacatagcagtttcaggacagcacacaggcaggcatttgaagggggcaggattccttggacagaaagcaacgttccctatctggcatcatcaccaagtacttccgcatggaggaactgactcacctggtactgcgtccccatctcctacaaagactactccatctcctcggcataaacaaaagtgattcttcaggtcaggagtacagacttgtgaaaactcaccaaaatgaatagtagtcatcgtgacatttagatgaaagttaaactttactgaaatttcagtacatgagtgtttgacactaagaactttacaagataaaattggacattcatttagtatcttgatgaaccagaattactgtggaatcaagtgagatacaataatcactatctcttgttgaccattgttggaaattgggagaaacttgtacaaagtacatttaagcaggatcaatttataaaagcagggagtccatttaaaacaattagcgacgataataggggatgggaaagcatatgagcagatatgaataggatggtgccatataggtggagcatcccattaagaatccatggggcaacgagcaagactgcataactaaacctcaccatcgcagggcaatggactaaaaaaggacacattgaagtgaataccactaggcctacagaactaggccgcgaaaacaacgcgacgcacaggcaacaaattgacgaaggcaaaaggga

SEQ ID NO: 683325 - DNA, 102 bp, Homo sapiens
cacgtggcttgtcgcaggtgtacggcgagctggcggatgtagaggaaggcgtgcatggtaggccacacccggctccaggaccagcagcttattagctattaa

SEQ ID NO: 683326 - DNA, 865 bp, Homo sapiens
  misc_feature (640)..(640): n is a, c, g, or t
tctatgattagattaacctagagatgtgtgtactcgccagatatgagttcttcatacggatagctgtcgctatgttgtcttcccatctccagtgtgccatatcgagcatggcggtctgtacccaagattgatatctacgtgaagtgttgaagctgtgtccatgtgcactccaggatccttatgatatgtgaggtcccttagtatgagttatgaatgggtaatattttaccttgaaccaattaatgcggttctccaatcacatattgcccctacgctggttgatttggtaactacatgtattttgaacgtctacagacctcacgcgagtcggaatatagtttagtcttgtgcccaattgagctgttatgcagtgttggaccagtttcattatggatgggcgaggatgtgacagaatgcctagtatgccctaatagagtctccgccgtgtaagatgtctgttccacaaggcttatacgtgaactgggttggcatacattgaagacaggtatggtcctactattgtctcctcatgatgtgacgtcctgcactcatgtgaatgtactctatatgctatccctaatgccacgtactacctgggcgttaagtagaatgtcggggcccgaaaaatgggccttgacanttttggtaccgaattgtagactatggtcacgcccgttatggttgtaaggctgacgcgcacgttacagtgccggatcacccatgaattgctggatggcccgacaatgaacataggcgctacggaaccttaatacgctcccttaagcctttagggagctaaggggccaacattgtgtttcccaaaactctccgaacataccggggcccctgtggggggcgcgcgcaa

SEQ ID NO: 683327 - DNA, 851 bp, Homo sapiens
  misc_feature (63)..(63): n is a, c, g, or t
  misc_feature (66)..(66): n is a, c, g, or t
  misc_feature (69)..(69): n is a, c, g, or t
  misc_feature (90)..(90): n is a, c, g, or t
  misc_feature (99)..(99): n is a, c, g, or t
  misc_feature (102)..(102): n is a, c, g, or t
  misc_feature (121)..(121): n is a, c, g, or t
  misc_feature (123)..(123): n is a, c, g, or t
  misc_feature (156)..(156): n is a, c, g, or t
  misc_feature (158)..(158): n is a, c, g, or t
  misc_feature (174)..(174): n is a, c, g, or t
  misc_feature (195)..(195): n is a, c, g, or t
  misc_feature (204)..(204): n is a, c, g, or t
  misc_feature (213)..(213): n is a, c, g, or t
  misc_feature (224)..(224): n is a, c, g, or t
  misc_feature (244)..(244): n is a, c, g, or t
  misc_feature (283)..(283): n is a, c, g, or t
  misc_feature (285)..(285): n is a, c, g, or t
  misc_feature (311)..(312): n is a, c, g, or t
  misc_feature (314)..(314): n is a, c, g, or t
  misc_feature (327)..(327): n is a, c, g, or t
  misc_feature (354)..(354): n is a, c, g, or t
  misc_feature (358)..(358): n is a, c, g, or t
  misc_feature (366)..(366): n is a, c, g, or t
  misc_feature (380)..(380): n is a, c, g, or t
  misc_feature (399)..(399): n is a, c, g, or t
  misc_feature (415)..(415): n is a, c, g, or t
  misc_feature (466)..(466): n is a, c, g, or t
  misc_feature (497)..(497): n is a, c, g, or t
  misc_feature (504)..(504): n is a, c, g, or t
  misc_feature (582)..(582): n is a, c, g, or t
  misc_feature (656)..(656): n is a, c, g, or t
  misc_feature (702)..(702): n is a, c, g, or t
  misc_feature (714)..(714): n is a, c, g, or t
  misc_feature (741)..(741): n is a, c, g, or t
  misc_feature (779)..(779): n is a, c, g, or t
  misc_feature (849)..(849): n is a, c, g, or t
acggggagagcagcgagcgagcgagcgagccgagccgagcctcccgccgtcgccatgggccanaanganctgatgggcacggccgagganttcgccgancanttcctccgtgtcaaaaaanantacctgccccaagtggcgcgcctctgtctgatnancaacttcctggagganggcatccgtatgtggttccantggagcgancagcgcaantaaatcgaaancaactggaaatgcggctaantgctggcctcgtccttcgtcttcctcaaattgctgggananctgaatggctgcgtcctggtgttgannangaaattcgtgcantaagcctgcttcgggctctttggaatnatanctctgcanaagattgcctaaanaattttatgggaattgaantttttgatgaggaacntggccctgggaggaggcctgttgctgctcctagcagaatcccgttctgaanggaaaagcatgtttgcgggcgtccccaccangcgtganagctcccccaaacagtaaatgcagctcggaggcagggtcttgctggttctgatgttcatgaacctccttcaatttgangccagcttcttttctattgtccagaaaatcgtgggcacagctctgatgattttagtggccattggttttaaaancaaactggctgctttgactcttgttgtgtggctctttgccatcaangtatatttcaangccttctggaccattccagtctacaancccatgcatgacttcctgaaataagacttcttccagancatgtcggtgattgggggcttgctcctggtggtggccctgggccctgggggtgtctccatggatgagaanaa

SEQ ID NO: 683328 - DNA, 265 bp, Homo sapiens
agaagccagggtgaccaaacgggccgttaaaaggggggcgcctcgacttatgctgaaagagaggcattaggcagtacctcccaggaggattgggacttgggatatttttaaccccttaaaaagaatagctgtttctatgttaaaataccaaagaacatggataaaccccacattccaaggtaggttaggtccacctatattgtagaaaattattagaatgactaagggtcacctcatcggtagatctatactgtttatactataa

SEQ ID NO: 683329 - DNA, 509 bp, Homo sapiens
ggagcaacgcggaggaaacgggtgtgaatttggagcgtacggaccatgatgagcctattaagcacgtcctagagagagacgacactgaaatagctccagaagcgctaggaggacgaattgagcaccaattcactatctgtgctcactctgtgagcacacagcaatacccaagcgctaatcaagtgctgaaacactgcgaaactactgagccgcttgtgggccttctgtaggcactgaatcatgactctgacaaacggcaaggaaacgtgaactgaagtacccctgaggggcacgggaatggaaaggtccaggccatgcaacaacgaccgctacatgtccgatatgtttctgcgcggctactgagccatggctgacctgtggaacccgttcatcgcccgctcataggcgccaggctggtgtcgacagaacttagtcctatgtcctatgaataccctttgcatagcggttgagaagaatttagcactgatatgttaatagaaattataaag

SEQ ID NO: 683330 - DNA, 984 bp, Homo sapiens
  misc_feature (521)..(521): n is a, c, g, or t
tgcaaaagcccagggttaggaaccgtaggcatgctgcgccccaaggctttgacccatggtgctaagccatagccaacactggaggtcgtccagagtcaccctgctagctgaataacgaggtgatctactgcatggcctactctggttacggggtacatctgacgccctgggtcatccgctgccatagccagtaatcatctgggccgcctacgatccggaacgggaaccaagcgttataatgaacgacaatctcaaacttcatcctcatggactgcattggatgggccgctgtagccatcacccgagtggccaaccttctgctgtgtatgtatgccacaggacgaccgtgggctcttggcaatgctcaatggccaaggcccaggctttgcgtgcagtcacctggcaggagcccctcacccgaatgtggcgagcatcttaacggctattggtcggaagctcggggtcacgagaaagagcaaatgcaccatttgcgaggcggcgtgggcctcctagtaagaacncttcctttagacacattgggagggaagcgatgcgcgacattttgatcccttatccacagaactaatactttccaaccttcctgctacacacaaacaaccacacacacaacaacacctttgttgcggcacgctcttgtggcccctcgcgaaaggcctttccataaaccacacttcgcgttggacgacgcgtcgtgtcgacccccaatatagtcgtaacctcttgaacaccgattgtgctcacattaatctgcgtggtttccccctatgaaggaaacaaattccctcgctggcgtcatactgtcacctataagtcgaggctcatgggagcatttctctgactcgatatgtataaactaaacgcgccactgaggagtgacacaccgcagagcggcttcatgaaacgaataattccccggatatgaacattaccacgaaagtgccactttacctggggcaactatcc

SEQ ID NO: 683331 - DNA, 250 bp, Homo sapiens
cggggccccccccctttttttttaaaatgttttttggggttggccccaggggattgaaaggggggggccccttttttttggtgggtgggccaaggggcccttcgtttggcttttccacagaagcccttgggcggtttggggggttacccccccctttttaatgttttttttttttggggggggggggggggcccctgtttttgggggggcggctttttcccccccctggataaatttctggttcccccca

SEQ ID NO: 683332 - DNA, 308 bp, Homo sapiens
gtaaaagcacacccactggatggtctgggtaatggcgaggttgcccttgatcaattccgagaaaccgacggcaaagatcaggatcgaaatcaggtacgacacactggcgccgacctgcgccgggatcgaactgcgcaggccgtcctccaagcccaggctcaacaacagcaacgtcatggggcccgggctgaaggtcatggtggcgcaaaacaacagaaagtagagaaatgaagacagggttaacgcacttgtcatggccagcaccttgaataaagagaaacagcagcaacagggcgaacgcggccagc

SEQ ID NO: 683333 - DNA, 205 bp, Homo sapiens
ctgtgttgcaatgcacccatctctgcaacaatgagctgactgagcccagaatggcttcaggatgtggaggccaggccgcaacttgcaacacactgtgatggccctaatgtcttccctggatgcagagaaggcccaaggccaaaagaaagtggaggcgcttgagggagagatcattactttaaaccataagcttcaggacgcgtct

SEQ ID NO: 683334 - DNA, 392 bp, Homo sapiens
  misc_feature (269)..(269): n is a, c, g, or t
gcctcctccccatagaatcctaaagggtgggaagaagaagaagaaaaaaaagcaaaagcaaaacaaaacagaaatcaaaagtacactcaagttcttgtcctgtatcaaatatccctaggtcatctgccacccactttccaagacctttctcctactcaaccaggaagtcatggtttctgcagtccagagccatggcaactgagattctaagctctctttgtctcatccaggcaacttttctgtctcccaaccaaggaattcctctgctnaggctccgtgttgcccaggatagctctcttctataagccaggatgtggagcttaaggagactccaatgtttactttctccagtcctagctctgccatataaacactgtctcatggttgtgctt

SEQ ID NO: 683335 - DNA, 380 bp, Homo sapiens
  misc_feature (272)..(272): n is a, c, g, or t
  misc_feature (329)..(329): n is a, c, g, or t
  misc_feature (380)..(380): n is a, c, g, or t
tccttcaaaagctcagcaacttcctgttcttcctcccaggcttccttgtgtgttagctgactgcttccagtactattgcacgtccaaatgcgctcactgtacctttccaagcgagcttcatactcttcccaggtgcggaaggcctcctgagtgtgcgggatggtgaagagcggctcctctccgggcaacggcttcaccagcgggaaaggcttgcggcccaggagcgggcctatcgcggcggcggcggtggggactggcggctgctggggcgngcgcgtcgcgcagcacgtagccccgcggcccggagcgcagcccggcgcccgggttgngggtaggttaagggaggggtgagagggcggcgcgaactccggctccctcan

SEQ ID NO: 683336 - DNA, 614 bp, Homo sapiens
tgtcatagctgttcagaggatcccggtgttcctttgtctggggacgcgaacaagacggacttgacttaccagtattaccgtatgccaacaaggggaaagagtgggttggctatgacaatgcacatcagctatcagttacaaggcatggtttatacggcgagagcattttgggggggccatggtgtggacattggacatggatgacgtcaggagcacgtactgtggcactggccctataccccctagaatacgtatagaatgatatcctgatgcgggttgatttcagtacaacttctttaccacgattttaggctgtcatctgctgtgaattcttcacgcactgaccctgaaaggctggctgtgaccacagaatggacccactgatagtaagattttgcccccaggaggagaggctggggtcactgcgatccacggaacgtgtgaaaatatgactataacccctagaggtacaactgtgcaccctacaaaggaaactgtatcccttggaaagcacactgtcgctctaggagagaagactgagatcactggggcaacgaccatgacttctgtgggtcatcagtccatgacccctggagagaaggccctgacccctg

SEQ ID NO: 683337 - DNA, 106 bp, Homo sapiens
ctctagaggaccctgttcatagcgacgttgttttgtccttcgatgtcggctcttcctctcgtattgagcaggattaccatggcaacaacacatcaggtgggtacgt

SEQ ID NO: 683338 - DNA, 850 bp, Homo sapiens
  misc_feature (704)..(704): n is a, c, g, or t
gggagtctgcgacgcggccggagtcggccttgtggggcaaggtgcggagatcgcgtgcgggcgctgtcttgagcgccggagcgcgtcctgcccttagcggggcttgccccagtcgcaggggcacatccagccgctgtggctgacagcagccgcgcgctctggagtctgcggggtcagcgtgcatgctctgcgatccttgccgcgtgtgccgaccatgccgtcaaggtcccctgcccgtgctgggctggctatgcaaggtgccctggggtaaatggctgcgggttgctagcgcggggggccccaaacatgggccacacttctttgccgccgagccaggacttgcccgttggtgggtagaacgatggttcatcaaggcacgcatgggcccccacaagtttctcaacccaggggccaagagcaggctttgaaaccaaagaaaccaaaaatcttggcgagcaatcgggttggcccccggaaaagacgggtttaaacccgaagaaaaacaccggttgttcctttcgcccaaggttggggtggacccttccctcgggtgcgcgggccccttaatatggggaccttccggttgatttcgattggattggccgttgtgacatttttttttgtggattcccaacaccaaagagaataagcaaccgcgggggggaggtttataaaccctgggttgtttttggcgcctagagggnttgtgggcaaacaaagaaaaaagggccgttcccactccccccaaagggaaaaccccacatttttatcacacaacgcgattccccccaaatttccaaaaattttcttcccaattttttggcccgggaaacaatattacgggaaacaa

SEQ ID NO: 683339 - DNA, 164 bp, Homo sapiens
cggagctgtctctaggcattgctggaactggaggagactgtcagagtggtttgggtattgttgttttgctccgtttactgttgctccctttgctgtccgcttactgatgctccgctccctacctgagctcaatcttcgctcctcgtggttcatatgctagtatc

SEQ ID NO: 683340 - DNA, 426 bp, Homo sapiens
tagcctgttgcctccaaatttgccacttgaatatcattttctttaaatcgctaagaatcagtttatacactagagaaactgctacactctaagactgcctgagaattgacctttacagtgccaagttaaagtttaccttattctcggccgggtgcagtggctcatgcctgtaatcccaggactttgggaggccaatgcgggcggatcacgaggtcagatcaagaccatcctgccaacatgggtgcaacccggtctgttactaaaaaaaataaaaaaattagctgggtgtggcggtgcacgcctgtggtcccagctacttgggaggctgaggcaggagaattgcttgaacccgggaggcggaggctgcagtgagccaagatcacgccactgcactccagcctgggtgacagagcgagactctgtttc

SEQ ID NO: 683341 - DNA, 145 bp, Homo sapiens
agagggcagaagcagaaacaccaagaccctgaagacaataagacactacaatggtacaacaaaaacaacaaatcaaccaacttatctcttaacattatcatttaaataaatatggaactggcttgataacatgaaatcaagtcac

SEQ ID NO: 683342 - DNA, 105 bp, Homo sapiens
atcctgtactaaccggtggctcagtgaaaggaaaatggctggattgcacaggaggcgcctagttctgaggctgggctcttgctaccaggtaggaaggattatggt

SEQ ID NO: 683343 - DNA, 536 bp, Homo sapiens
ccctggggtgtgtctcggtgacgttttctatcagacgtgctccctcccatcctccagccctgcctcacctatctcaagaaggaactaaacgggataacgaaattcatgactgtgaacttcgagtacataggacagacagtaggcacggcccgcagctggcatctgtgcgtgtggggtggcccgtggttggtatctgtgtgcgtggttgtggcccgtgggctgctccatctgtgtgcggtggccgtcgcgccgtggccctgcgcgatctgctgtgtgtggcgctggcgcccgcgggcctgcgccatctgtgcgcgtggcgctggcccgctgggcctggtcgatctgcgtgcgtggctctcaggacgttctatgaactcaggtgcaataccgggaattgacccagactatctgaagccagacagcgaacagaccgccagagggctgaagctgagcgtgtacgttcatgtgaatgtatcatagtcttggcagaggtccaaatgatattcatgatggtcaataagcgcagatgtatgccc

SEQ ID NO: 683344 - DNA, 277 bp, Homo sapiens
ggagagaactagtctcgagtattttgttttttttgggaaagtcaggtcaggggtagtaatataatggtggggacgataagtttaagcatgggagtaggtaaggtaatgtacgtatcaaggccatatgtgttggaaattgaaactatagggctaggcccaccggtgcttcgcaggcggcaaagactagtagggcaactgggccaatatgggctaagagggagtgggtgtggagggtcatgagagtacctataacggaacagcgatagtatcatccctc

SEQ ID NO: 683345 - DNA, 292 bp, Homo sapiens
  misc_feature (259)..(259): n is a, c, g, or t
ggaggtgcagcctttggtccaagtgaaagtacactctctattttcttttcttttttatttttgagacagagtcttgctctgtcacccaggcttgagtgcagtggtgtgatctggactcactgtcgcctccacctcccaggttcaagtgattctcctgcctcagcctcccgagtagctgggattacaggtgcctgccaccacgcccagctaatttttgtatttttagtagagacggggtttcatcatcttggccaggctngtcttgaactcctgacctcatgatccacccgcc

SEQ ID NO: 683346 - DNA, 210 bp, Homo sapiens
cggaacagagtagtgacacaatatattagatagactcactatatgctagcgagcatcgtactctgcagtgcagctgtcagaatacgatgtcattgttactattgtagatcttaaaatgtcctatcttgaaaacgagccttagggaaaaacctccaggggcaaacctctgatgtcttctttgcggccggtagcttgactgcagtactgcat

SEQ ID NO: 683347 - DNA, 367 bp, Homo sapiens
ccttaacttttggccaagtttgttttttaaaaaaaaaaaaaaacaaaaaaccattttatgggtggttgtaaattcaaacccttttcccatgaatgggtttttgtaaacaaaacttttaatgtttttttttcaaaaggtgggttgaaaaattttttgaaacccttttaaaaaatatttttttttaaagtaaatttcgggatgatgataaaaatttttttttttgttttgataaaaaagccagtaaaatgttgccccgggtttttaatttttttttttaaaaggggttgggaaggaaggtttttaaacccctttttcctttgaaattttcagtttttttattttttaaaaatgaatccctcgggcggta

SEQ ID NO: 683348 - DNA, 726 bp, Homo sapiens
  misc_feature (33)..(33): n is a, c, g, or t
  misc_feature (138)..(138): n is a, c, g, or t
  misc_feature (242)..(242): n is a, c, g, or t
  misc_feature (272)..(272): n is a, c, g, or t
  misc_feature (274)..(274): n is a, c, g, or t
  misc_feature (288)..(288): n is a, c, g, or t
  misc_feature (566)..(566): n is a, c, g, or t
  misc_feature (575)..(575): n is a, c, g, or t
  misc_feature (624)..(624): n is a, c, g, or t
  misc_feature (662)..(662): n is a, c, g, or t
  misc_feature (666)..(666): n is a, c, g, or t
  misc_feature (684)..(684): n is a, c, g, or t
  misc_feature (699)..(699): n is a, c, g, or t
  misc_feature (706)..(706): n is a, c, g, or t
  misc_feature (720)..(720): n is a, c, g, or t
attggctttgctggtgccccatgacccctgatncatacatggttgagggtggtggctcaagcacatggctcaggccaagcgctggctctatcaaagacctcaggctagtcaccagctgcttcgcatcctcactgatgntctggtccatatctggtaggacagtggtggctggtgcccaggcaatgcagctgtttgagtcccatgcagggcatcttggcccacagcttttcaacaagtttgcnctgccttacatccgtgtatgtggccaaacnantgaaggccaggttncgggaggcaggcctggcaccagtgcccatgatcatttttgctaaggatgggcattttgccctggaggaactggccccaactggctattaggtggttgggctttactggacagtggccccaaaaaaaacccgggagtgtgtggggaaaacggtgacattgcagggcaacctggacccctgtgccttgtatgcattttaggaggagatcgggcagttggttaaacaaaatgctggatgactttgggccccatcgctacattgccaacctgggccatgggntttatcctnacatggacccaaaacatgtgggggcctttgtggatgctgggcataaacnctcacgtttggtttgacaaaactgagggtatacctttncccncaaggacccctaacccanatgattggttgtttncagggcnataaaagttttggngttgga

SEQ ID NO: 683349 - DNA, 204 bp, Homo sapiens
atatttcattcaaaagttttcatttctattgggtatgtacctaggaatggaattgctgggtcgtaaggtacctatgtataaccgtttcagcaatcccctcacagatttccaaagggggcacgattttactttccccccggcaatgtatgaaagatttaatttttcaatgcactccagcctaggcaacagagtgagactccgtca

SEQ ID NO: 683350 - DNA, 687 bp, Homo sapiens
  misc_feature (589)..(589): n is a, c, g, or t
ccccgggggaaaaatttaatctttttttttttaaaaattttttttgaaaccctttcccccaaaaaaacacgagggcccgcaaaaatttttgcaaaagagaagctttccccgttttttaaagggaaacccgggggaaggggtcccctttagggggcccccttaggtccgggggaaactggtttttttaaaagaaaaccccctttggccccggtttcttttaaaagggcttttttttctttcaaacggctaaggcgggcccccccaaagggggaaaaaagtttttttaaaaaaaaaaacaacccttgggggggtgaaaaaattttccgtcctttttttccaaccgggttttttaaaaccccttaaaaaaaaaaaagggggggggaaacccagtttttttaagtgtttgggcggcccttttaaacggggctcctccggcgggggggggggcctccccccgtttttggctgttttaaaaaatttgggggggggggggttaattttggctacccaggggcgggaaaatagttttttttaaaaacaaaaaaaatctccaaacctcttgtgccttattccccacaagttaatctgnggggggtatttcctggagacacccccgggcgcgtgtttgttcgccaccatatttggtgcccccacccacacagtgtgttatttcccctttggcgcccg

SEQ ID NO: 683351 - DNA, 86 bp, Homo sapiens
gcggccgcctactactactactgctcgaattcaagcttctaacgatgtacggggacatgaaataaatttaataagtctagatcagc

SEQ ID NO: 683352 - DNA, 439 bp, Homo sapiens
taccattgtgccctggatgctgactgtaatcatacaggttaaatacataaacttttttttctttttttgagacaaagtctgctctgtggcccaggctggagtgcagtggcacgatctcagcttcctgcaacctccacctcccgggttgaagcaattctcctgcctcagccaccaagtaaatgggattacaggcacacgccatcgcactcggctaatttttgtatttttagtggagatggggtttcgccatgttggtcaggctggtctcgaactcccaacctcaggtgatccacctgcgtcagcctcccaaagtgctgggattacaggcgtgaccaccatgcctggccctgtttttagttctttgagaaatctccacagactgcttttcacagttgttgaactaatttgcattcccaccagcagtgtctaagtgttccct

SEQ ID NO: 683353 - DNA, 356 bp, Homo sapiens
tcaggtattatccagatcacgggcttccacagcgtagggaacgggaggcttgcaggatggtcacgctgacggggggaactaatcgagcaggcggcgcagtacaccaacgcggtgcgcgaccgggagctggacctgcgggggtataaaatccccgtcattgaaaatctaggtgctacgtaagaccagtttgatgctattgatttttctgacaatgagatcaggaaactggatggtttccctttgttgagaagactgaagacattgttagtgaacaacaacagaatatgccgtataggtgagggacttgatcaggctctgccctgtctgacagaactcattctcaccaataatagtct

SEQ ID NO: 683354 - DNA, 189 bp, Homo sapiens
ggggggggggtcccccgaccccccagggaagatttgggcggcaacccgggggcgctgggaaatccccccgggggaatccctttcaaaggggccccgggtttttcccaaagaaccaggtaggggagggtttatggggagtggtttaatttggtaagaacaagggagaaggggatttttaaaaagccctta

SEQ ID NO: 683355 - DNA, 585 bp, Homo sapiens
  misc_feature (19)..(19): n is a, c, g, or t
  misc_feature (25)..(25): n is a, c, g, or t
  misc_feature (28)..(28): n is a, c, g, or t
  misc_feature (37)..(37): n is a, c, g, or t
  misc_feature (44)..(44): n is a, c, g, or t
  misc_feature (92)..(92): n is a, c, g, or t
  misc_feature (123)..(123): n is a, c, g, or t
  misc_feature (133)..(133): n is a, c, g, or t
  misc_feature (158)..(158): n is a, c, g, or t
  misc_feature (205)..(205): n is a, c, g, or t
  misc_feature (251)..(251): n is a, c, g, or t
ccacggagcttggaggtcncctctntcnaacttcttnaagagtntgctgaagtctgcagagcttctgtcaaccttttcactgtagttttctngagagtctttcccttctcagcaagctccctntgctcttgcncttcttcagctacgtgttcctgtcncagttccaataactcctcattcctttaggagctcctcaatgccatcntcagccaaacccagattagagttgtttgccatctgaaccacagccntgttgacttttgcaacctcctcatccttggcaaatcctttgaaatcatggaaaaacctcttgagtgtcttcctccagatgccattcatacattcctcggtggcatcaccccaagcccaagctcaaagtgcttgacacagtaatagatgttgtaatccttccaaaattacatccatgtcttctcagggtcttcctcagtttcagcaacagcctgggcaaaagtcctccttaggtaatagtcttaaaagctgttataattccttgatgcattggttggatcaaagaggtggtatttggagggagaaacaccactttgatattgagatgaaaatgac

SEQ ID NO: 683356 - DNA, 229 bp, Homo sapiens
ggatccccgttactggcatttcgttacctgcattttgtccagactccttaaaaaccccatcctcaaacctcttgaggaggctaatttgaggtttcctcccatcttctcattcagctaccctgagatgattaaactctttctctgctgaactcctgctgtttcagtgtgttggtctgttactgcacaatgggtttaagagcatcctaagagctccctactcctcacacac

SEQ ID NO: 683357 - DNA, 424 bp, Homo sapiens
ttcggaagatgaaatatttataatgagttatggaaccaatgttttagaaatgtttttcttggggtaatttaatgcagatttttcccccaattttgttaaaaaacttgataatttgatccccccatctatttaatatttaatattttcagattttagaggatttaaaatttaaaccccattataaaattaattataattcccacttatgttagctatgatttagggccaaaactcccctggttttgtcttgcaacttgaaacattgggtattttaaactatataatttgggaacctttttttatagactgtggataacccaaaataagatttgtgatttttaatgcttcatttgggtaaaatcctttgtatattctatttatagtatgccttttttagctcattaaaagtccagaaaacccccca

SEQ ID NO: 683358 - DNA, 153 bp, Homo sapiens
tttttttatatctctagttgtatttttatacctccccagtttattttgaaatattaatgattttgacatatatctcacattcacacagagattacctacacatctgcctatcacatatataaaatgctgatgaggagtactcatcacactatt

SEQ ID NO: 683359 - DNA, 349 bp, Homo sapiens
  misc_feature (55)..(55): n is a, c, g, or t
cttcaggaacaacaagcaattattcctactttccaagttattttgtttccatggnggctcatacctataatctgagtactttgggaggctgaggtggactgatcacttgagcccaggagtttgagaccagcctgggcaacatagcaagactccatctctacaaaaaaagacaaaatttagctgagcgtggtggcgtgttcctgtagtcccagctacttgggaggctgaagtgagtggatcccctgagcccagagaggtcaaggttgtgatgagctgtgatcacaccactgcacttcagcatgggagacagagtgagaccctgtttcagaaaaaataaataaataaaacc

SEQ ID NO: 683360 - DNA, 194 bp, Homo sapiens
aagaagagggtggccatgcagcttaagtagagatcggacaaggaaacaacttgtgagagcagcacgccgtcgtgggcgaacgatcacaattacaatgcagtaaagacagaaaagactgctgctcactcgccggcactgttgtataaatgtatgtatcacctaggggttgggctcctggacccctcctctttcga

SEQ ID NO: 683361 - DNA, 325 bp, Homo sapiens
gagagtcgcgtcctcgatgactcgctggggctggataacgagatggacttgtccttgcgcctcttagactgtgtgaccacgatgttcatggtggcaagaagcacttctgagaggttgtgcctaatttcatcactgaaatttctgaaggcagccactctctcttccacactattacctgactcaggggcaccagctacaagcgctcaatgataatcaaagctctatcaatataaccactataatactacgtaaaaaaaggtaatacaagtccaaaagaaagatagaacgtggagtccaacaaaatttatttagcgcttatacctaa

SEQ ID NO: 683362 - DNA, 145 bp, Homo sapiens
cccaaacccactccaccttaccaccagacaaccttagccaaaccatttacccaaataaagtatagggcgatagaatttgaaaccctggcgcaatagatataggtcccgcaagggaaaggatgaaaaattttaaccaagcttaata

SEQ ID NO: 683363 - DNA, 923 bp, Homo sapiens
gctcaacagcggctgcaaaccctggatctacatgctgtgcacggtccacctcttccacgaactaccgtgcagacgcttcctgtgctgctccgccagactacctggaagggcagacgcctgggagagacgagtgccagcaaaaagagcaaaatcgtcctcctttgtcctgagtccatcgcagttccagccataggcagctgctcgccaggcctagtcctgcgggcgtggaccccaccgagccagggcctagggtgtgcagcctgaggctctaggctgctgcgtggcgatatagtggcgtcgtgctcctagtgctgatgcggggtatgtttcgtgtatcaggtacctatcatgtttgtatccctccactccttggggtggcttcggtgccggtggcgatgtggcctcctagtgcttggacagacttgataggtgggactcaagatcctcgagagcatcatcggcttgggcttccgtacagggtacgtacgtacactacctcgtgtatccacgtgcgtagccctgtggcatggagagtggcttgtgttttctcctggacttgtaaatttcactccagtatatttttacttcttcattctgggatattgtgaaaagcggtaaatataggattggtggaccaattggcgtcaggacagtccaagtgttctggactttgagggtaaagcaggtgggagtaggggaccgtcagacttgggagccgcgttggtggctaagaattcctcctgaacttcacaagggtatttgcctttaaggcggaccaaatgcgggggcctcgggggcccgcctgtagaaggatgcctacagatggggatacctgtaagccatgggccggggggcttattaactggtaaatgtccacccatgtaacgttgcaccccctctcttcctttctcgaggccttctaa

SEQ ID NO: 683364 - DNA, 947 bp, Homo sapiens
ccggggccacttcgtgcaaatggggttcacggggggccaaaacccagagcaatggccctggtgtgttgggagcgccgcgaaccgtgtcaggcgagagtgtccacgggtactctctctgctggggggatgactccgcgtccgtggaaggtgccccgggtaaattctcgggaaagacggtgagctccacggtttcgcctgatttgccccccaagggttcaacatgaagccactcgttgttggaagaaagggccagggaattgtgtcccccccttcaaagtgccagcaggcttacaaaggcatgctgtagacccactgatatcgcgtgttaactccgcgtcataaaactctgtccacactccgaggactgcctttggaaaatttgtaaaggggtgaagatatcccacatgacccatgtgaatacatagaataacatcttatcgcccacataccccaccgtgccacggaaattgtgtttgagggtgcccacacattcgagatttgggcccacccagacaccaacagccttctggggttgaaacggcatggctgatgttcatatgccgagttctcacggacccccacgtataactcggtttctcgggaagatgttcccacttaggaacagtttttcacgcaggacaggtccggggcccgcgtgtggctcaccgacctgtaagtcccagcaccttcgcggaggccccaaggtgggcgcgatcaccacacggtgaacgagatggagacccctgctggcccaccatggtgaaaccccgtctctatcttaaaataccaaaattagtctgggcactggtggtgcaatgcctgtagtcccacgctatttaggacggcacgaggcacgaatagcttgaacccgggaagtggaggttgcagtgacgccgagatcatgccccatgcactccagcctgggagaccgagtgagactcttccca

SEQ ID NO: 683365 - DNA, 105 bp, Homo sapiens
  misc_feature (43)..(43): n is a, c, g, or t
  misc_feature (65)..(65): n is a, c, g, or t
  misc_feature (87)..(87): n is a, c, g, or t
atatggtcactaccctaatagactaaatgaaatcttgcaattncaaattactctttctccatatnagatttacccacagctatattnctgtttaagtactagggt

SEQ ID NO: 683366 - DNA, 127 bp, Homo sapiens
gatttgctggtgcagtacaactaggcttaatagggacatgggcaacagagcgagactccgctcaaaaacaaacaaacaaacaaacaaacaaacaaacaaacaaaaacttaagagactgattcagggt

SEQ ID NO: 683367 - DNA, 184 bp, Homo sapiens
  misc_feature (15)..(15): n is a, c, g, or t
aacgatggtcctcangctgactttgataagggccgggcgcggtggctcatgccttgtaatcccagcactttgggaagctgaggcaggtgaatcacctgaggtcaggagtttgagaccagactgaccaacttggtgagaccctgtctctactaaaaatacaaaaattagctgaggaccatcgttg

SEQ ID NO: 683368 - DNA, 841 bp, Homo sapiens
tccaaataaacgcttaccctttcctttagagtatctttgttctctgtctctctcggcacgtcaaagacgtagatcgcgtagtgtaagtgtgtaaggccattcttctgcgagagtccacaaggctagtgaagagcagcgcatgtgttgcagaatggcagtttccatgagatttctagccgagaccactagaaggagttcctggaagaccctgcggtagctagcactgaagactatttttctattggtagtacgccgaccatctgaatggggaaagggaaagtcaaattaatttttctcgttagacataaggaaatttaaggaaaaacaggtttaagaacagttactcagcgtagatgtgtgttcacatcaaattgctctgcattcagtgttcattgtgaattgggagtgtgagtctttctgtagggtagaaagaagcctcctacccagcaaatccagtagagccaaaagttgaacaaaaactgatgacagacaacaagcatgaagatggcatatttgatgtcactttggttctttttcccagaaggcttatacagtgactcagtcgggaaagctttccagcttccagcccttgaatgtgaaagtgtccattggcatgtctggcagtagtctctcattcactcctcaataaacaacatttgaataccaaagagggttgtgttaaaaactcagtactggtctggcttggattcatttcatgttttcaatattacgcaatgatcctaatatttttaaagtaatagcaatcagtaatagctgaggggttttcccctaatatattcctggtgccattcagaatttagcatcgagttttaccttttca

SEQ ID NO: 683369 - DNA, 225 bp, Homo sapiens
atactgggccggacactgggcatgtagcccttgttggacgaacgaagaaggacattttagaatgtgaccagagggacagatccagccaatagctattatttgataacggaacccaaggccctgggaggctagacaaggctagcccttagattacatggctagctgagagcagattaggagccaacgttgtttgctcatgtaccatcacacctgcagatgtcagac

SEQ ID NO: 683370 - DNA, 172 bp, Homo sapiens
tagcggaccacgccggtatgtcccaagcttatcatcacctttttatgtcgtttcctagaggattcaaaagcttcatcactatcattatcttcatctgaactgatctcagcatatttgggcttttcattaactgtgctacgcttgcgttggttcattttcacacataaccgag

SEQ ID NO: 683371 - DNA, 406 bp, Homo sapiens
acagaggatccgactagtccaacatacctcatgttaagtctctaacactacacaccataaaaatctccccctcaccttgacgccatctagcttgttcactcccttctccagcagccttatagagttatccgtttgaatatcttatttatttttccaaccactgcaaattctttactagcctttccatcaaaattgtgttccctttgattattttattcttcagttatttattttgtttccccttggttactgtatttgtttcacattatagatgtacaagtatatttgttatctacattttactaatctgtaaatgacaactgcacatgaaattcaataaaccggtttgaaataaggaagtacttacagggtaatgtacaacgcgaactaattttcaacgatcttg

SEQ ID NO: 683372 - DNA, 293 bp, Homo sapiens
gcttatgtacgcaagctggaacagcggtgtgtatacgatcagggggtcatgctagccgaggcatgtatcccatgccctgactgaagtacttgaaggcctcagcgagcttgcgctggctggagatctgcgggaggccgccacagtccgccatcttgaggagagtggtctttgttgggtccaattttgagttgcactccaccacggcatccactgcaggcgagctgtccccaaccaccaacagagcagggcactgcagggtgactgtttggggtccgggcattggtccgtcaatc

SEQ ID NO: 683373 - DNA, 824 bp, Homo sapiens
  misc_feature (140)..(140): n is a, c, g, or t
  misc_feature (142)..(142): n is a, c, g, or t
  misc_feature (157)..(157): n is a, c, g, or t
  misc_feature (228)..(228): n is a, c, g, or t
  misc_feature (324)..(324): n is a, c, g, or t
  misc_feature (326)..(326): n is a, c, g, or t
  misc_feature (338)..(338): n is a, c, g, or t
  misc_feature (341)..(341): n is a, c, g, or t
  misc_feature (345)..(345): n is a, c, g, or t
  misc_feature (349)..(349): n is a, c, g, or t
  misc_feature (365)..(365): n is a, c, g, or t
  misc_feature (432)..(432): n is a, c, g, or t
  misc_feature (439)..(439): n is a, c, g, or t
  misc_feature (444)..(444): n is a, c, g, or t
  misc_feature (453)..(453): n is a, c, g, or t
  misc_feature (455)..(455): n is a, c, g, or t
cccagccgaaacggctgctggggcaagaaacttcttgttagaactttccacctccggcttccccctccacctctttaccgtcccaaccttaggagacgctttttctcccccagaggagaatttatcttttttttttttgntntttcctttttctcancccggtgctttgcattggggaagaggtgatttcaagagttggccaggtgggacgcctctctcctccttatncggttataccatatctattggtccgggggtgtttttaaatccctgtattgctcggcccggggagttatcgcccccgtgcccggctccgcggcgcgnanggatgtttgtgnaancggntggngcgcgctggtgatgtnccctctacagatgaccaatctggggggtgaaagcagccgtcggacgggtgctgcccgccaagcttgngggaccntgtcngcgggaaangntcctcatcaccggcggcgggacgaggcatcgggcgtcagctcgcccgacgagtccgcggagcgcggcgccagaaagatggtcctcgggggccgaactgaaaaatgcctgaaggagacaacggacggacatccggacaaatgggcacctgagtgccataactaacatctgtagatgtgggcaaccgcggagaaggttgtaccagaaggccaaggcgcgccgggcaaaagcgtggggggacatcacgcaccctggggtcaaccaagagtccgccgtaggacccaggtggaaaagccgaagggaacagggaacgaggatgcccccctcaatggcccgacacactcacacccgtgggcagaccggcaccacaa

SEQ ID NO: 683374 - DNA, 361 bp, Homo sapiens
tacaagcgtctcaaatatgccatactgtgtcactggtgtagagacagtgtgagatgtacgtaccaacaatgggtatcaccaaacgaagcagcaggtttagagtgtagctccctttgtggggcttcagtttattttggcctgcatttatttcctgtggattcctgccatacagttttaacaaggttgtcactcacaatacttgtcacctcactcgcagggtgagcacctgaccctggcctcctaatcataattcaggctaatgctggagtccaagagaagggccttgtgaccaggcaaggccaattagaatctttccctaggactgatgtataaaagctggggggaaaatgctttctctttc

SEQ ID NO: 683375 - DNA, 762 bp, Homo sapiens
  misc_feature (13)..(13): n is a, c, g, or t
ccattatggccgnggcaactggtattaagtgttaatattggactatgtagaaattttatctacatttaaatcctaggatctacacctcataaagttattgaattattacccccactttacagacggaaaactgaatattaatggcagcgattcaaatctacacaatctagatgaaaagttctagaacaacattgccactgactgattaaaaagtcaactgaaggaaaagccagtgagaaacaaggcaatcaattactgtacagtatttagctttggatatgttaattctgagatccctattagacctccaagatattgggagaaatttgccagagatatggcgactggagatacaaatgcgagagccaggtacttaaagccactggacttaacagaggagaatacacagggagtggctactaataaagacgctgcaggactgactgagccctgcgagccttccaacatttacaggcagggacgacacggaagattggcgctgacggcgaaagccagcgacggaccgcgccccgacatacgtatgaggacactaatggcccagcccccgtgctggccaacatgcgaaaccccgctcttatcaaaccccacataaccgggctggcgcggctccctgccccgtttttgcacccctcccccacaactgtcaacccggccaagcgcctctccgtcgccagatcggcccttgcttgcctggccacacgccacgcttcctctcacaccccccccgtccccggcgccccc

SEQ ID NO: 683376 - DNA, 992 bp, Homo sapiens
gacccacgcgtccgcattatgtagacaaggtttatcttgaactcacagaaagagttctgcctcaccagtgctgggattaaagggatgtgtcaggagctggagagatggcttagcagttaagagcactgactgctcttccagacagaagtcctgagttcaattcccagcaaccacatggtggctcacaaccatctgtaatgggatctgatgccctcttctggtgtgtctgaagagagcaacagtgtactcatatacataaatcttttttaaaaatttaaaaggctaaacaagccatggggagcaagctagtaagcagcaccctccatgtcctctgcatcagctcctgcctccaggttcctgcctagcttccctcaatgggttgtgatgcacagtatgtaaactgaataaaccctttcctctccaaaaaaaaaaaaaaaaaaaaaaaaaacaaaaacaaaaaagacgaaaaacaaaaaaagaaacaaaaaaaaaaggaaggggggggagcatagaaaatacccccggagggggccccggaattgaagtcgcccctttttttgtgaaagagggccccccaacggggactactataaaagaccaggagcgcgagggcagctgaaacaccgggcgggagggaagacaggcagcggggaacttggggaagaaccccacttgcgggcggcggtggcaactagggcggacaccacccacccaagagtaatgagggccccgggtacaaaaaacactggggtcgtaggcgggtggaacccccggacattgtgcggcgagcgagaaactttggttccctgttctctttttaatattgccccgtcgtgcactaaaaaaccatggagaagagaacacgagaccccagcagagacgacgatcggacgaaggacaagcgatcatacaaaacaaaacacaacgcaagagacacagcagaacaagacagcagcgcacgaacacgacacaacacacacattgaagcaaga

SEQ ID NO: 683377 - DNA, 1599 bp, Homo sapiens
  misc_feature (630)..(630): n is a, c, g, or t
  misc_feature (745)..(745): n is a, c, g, or t
  misc_feature (1052)..(1052): n is a, c, g, or t
gggacagtgtcagctcccgccgtatcctgagagggatcggcccgattggccacgctcctttcaataccgacgcacgttacccccgagagacaagggacgaaagcctcaggatccccaaagcagagcgcgtcccgtcgcccagagagcccggcgtggaaatcccgccgtgtacgccgcggctgcgggaggagaggccggtcccctacacaaggatggtgttgtcctgcgccgggatcattgtgctcatatcacgacgggtactcatggccttccggcgcccaaatagcatggcgagtaaggcagcctgcggtccacgggtggtcttccaggggtgttgcacgattggaccacgtacaaatcggagacctcacttgtgctgcttctcttgtgcgtgggctctccgagacggcggacgtcgcctcgctcggggcacgacattacaccgggacccaggtcgcccgactgggcgccttcggctccgtacacaagtcgcgcggtgagagaccaaagagataggagctagaaaggctgctagagggctgggtgtggctcgccgacgagggggcggcattgctcatagtgggggcgctcggctgacacggccagcgggccggggattggcgatagaancgttctcgcggtgacccggggcctctgtacccgcggacgttcgaagcgaattcccccgtggctcgtggtcctttttctggcaaacccactagagggtgttgccattccgtatggngcggaaagcgccaggacaagtgcggttgtacacgccatccagtgtaaaacaaagctttctccgttggatctttcgttgcgcagggggtatatatgtggccatcccattctccatctgtgctttgtgcgccctttctcccacggtggaactgatcgtgacaaaggtcgtgattggggcctagttgcccccttaaaaagctcctgtggcagggaatttgccacaattgcacctaattccttccttccacgcccccccgtgggtggggaacctttggtctgagaaggccattttaatgggcacaaggggncccaagaagggcacagcaaactcctttggcgtgtgggcagttattctcttagctgttggggggggcttcacatccccggggcgtatgatatcccttgagaattgcgacacgaggacaactggggtgcgcgcccaacctttggaatgcgccgttgcgcacagaccggaagcgttcttacaaagtcatttaattcctcccaacaaagttttcaccaagccaccgggcgcttgtgtgggaacagcacagcggagcctgtaatagccctgtggcgtcacataggagggaaacacccccaagagggcgttgtttcccacgacagcagtcttgttgaaccaatctgttttttagaccgtgccagagagagatcttcgcccgcgcagcacttgctggactacacgacaactcgttggtgttaccatgcgcacgatgagtacagtggtgttcctccttgaaaaaacagcgcaagcgttatgtgtaccacctcattgttgcttgtttagtgttcctcacatcggggacaggacaacagttctctgtcatgtagcgt

SEQ ID NO: 683378 - DNA, 149 bp, Homo sapiens
atacagcggtatatataaaagtatcccgagtatacttaaatatttccagacatttgcctaatgcttgagatccagaatgaagagagtgtggtgctttttctaggtcgcgtggactgtgacagagatcactcgctcgctggtgtatactg

SEQ ID NO: 683379 - DNA, 706 bp, Homo sapiens
ccacatccattagttttacatccttggcattaaagatcctaaggagaaattggtattcctgtctggaaaaacttgctgttgcttaatttatttaaaagtaagttatttttaaataaatatgaaaccccatctctactaaaaatacaaaaaattagctgggtctggtgatgggtgcctgtaatcccagctactcgggaggctgaggcaggagaattgcttgaacctgggaggaggaggttgcagtgagctgaaaatggttgcaatggattcaagccggggcaacaaaatgtgaaatctcgtgtctcataaatatatatactcatatgtagtgtatgtatgtatgtatgtatgtatgtatgtatgtatctatctatctatctatctatgtatctccatatatacatatagagagagatatatagagatctatatagagatagatatatagagatctatatagagatatagagatatatatagatatctatatagagagatatctatatatctatatagatatctatatgatatctagtatatatgtatatagatatgtagatatatatgagagagagagactggagaacatatatatcaaacaggtgcatgtataaccttcgggaataggtgggaggatgaagatgatattatgtgatcgtattggtgaatggagttcgataaataaacaaatggagagaacttctaa

SEQ ID NO: 683380 - DNA, 201 bp, Homo sapiens
cctaatcacaaatgtagtcagataggtggtgatcatacatcatgtctgagtatgtcacaggtgaaaggtgaaaaggggagaagagtgctgtacctgtcccagtggcagaaccagcctttaggagtggcgtttatttcatactagtattagttgttctgctgcatcctgaagttttcgtttacggtacgacattgtgattca

SEQ ID NO: 683381 - DNA, 496 bp, Homo sapiens
gcatcaccgcgtccgcggacgattggaactatctcatcgacatctggatcccccaaccccacattggacattgagcctaagaacctggctttcctacacaccagctgtgataggcatgacctccccatctcacgtcaatgctctccttgtgttttggggagtgcactatcgaaagtccccagtggcccacgggtcactgccccagattgtggcttcctcattatacttgcgactcttcccacaggaaagaaacacccctctcacatgctccaatgactccccttgtccatcccttttccctgttttgaacggaccccagggcgaacaggcctgttcatccacaacctcacagctgagggccctcctgcagttcttcacaggagagagaaaggaaggcgcacctgcccagcccggccaagaaaacaaaactctctcccatgggtgcgggaggctgctgcctgcctgctgagcagctcagggcagatgtcgctatggg

SEQ ID NO: 683382 - DNA, 379 bp, Homo sapiens
ccccgactacatacttccgtataaaaggcctgcctatgaaaattacggtggcttttacatcggacccctaagcattcggggaaataaaggtaagaaccctcaatagggagttcctctgagcttaatacatttttataaaatactagatggcgaagggcatgacttcaaatacagcggaaaattaataggggaggtttcccttatgaatgcttaaaagatttgggggaaggggaaggctctatatcctttccttccctagcatgtaagggcaggataaatacttcaggcctggctggtcattaataaagggggggtgaaatccagatttcaaataatcttcgaggcttgatccccagttctgcggagatcatttttttta

SEQ ID NO: 683383 - DNA, 198 bp, Homo sapiens
cccgggggggggggggtttggcccccccccccccccaaaaaggctttttctttttcccgggggaaagtggggggggggggggggccccccccccccccggtttttttttttgggggggggggtttgggggggccccccttttttttttttcccgggccccccggggggtttttggcccccccccccccctggggggga

SEQ ID NO: 683384 - DNA, 345 bp, Homo sapiens
agagaagcctgttggaaatagccttggctgtaaagcttgcaaggacttgggctgagacatataacccactggcgaagactgatttcttccaactctcttagcctggtctactgtacttgactcgggaggtgtctgaagagaagtgggtataaactgcatgtcactaatttgattgtttgccaaatgataaggctcttgagcatttacagtaatgtttaagttagcttcagaaggtgtactcttagccacatccattgttaattgtgggcctgatgaaaaaggctgctcttccaaaccatagttgctttcttggtgcaagacgtgtgtaaagcttacttccggatg

SEQ ID NO: 683385 - DNA, 182 bp, Homo sapiens
gtagtccaacttgctctattgttagtaacctttaaactataagcgagtttagtaacatcccgcgaggcagattttaaactatgatacagtttctatctagtgccactgtgtatacgtgtgtttacaaacatggcctggagtactaggtttcttcatcatcagctgaacacatgatgctgtcc

SEQ ID NO: 683386 - DNA, 1021 bp, Homo sapiens
  misc_feature (169)..(169): n is a, c, g, or t
  misc_feature (204)..(204): n is a, c, g, or t
  misc_feature (209)..(209): n is a, c, g, or t
  misc_feature (213)..(213): n is a, c, g, or t
  misc_feature (225)..(226): n is a, c, g, or t
  misc_feature (228)..(228): n is a, c, g, or t
  misc_feature (230)..(230): n is a, c, g, or t
cggagatctcggccgccaagctccgcctcccgccccgggctgtgccccggggctcgcctgaggccgaccacccgcaccccacctctagcggctttgctcgaggcccaccttcttcccacccccggcaaactccagtaggctcgccctcgctgactccccgccccgcgtnactgcaaggggccgccatagcagtccggggcggtngtcantgancggaactccccnncncncctcccgcggccctggggccgtaggaggccgcatgcgaaggaggtagacggggcgggggtgtcgcactagggtgtcccctagagaacgaggactctgaaggctgggacactagatgggcgacccccgggcaggggccaaggcccattaaaagcaggtcccactatcgtgtgccagaacaacatgaaacatggcgcatcattgaccgggcatcaatctctataatcctcagaagcatcccagggagctccacaggatccccaatatcctggggccatgagatgcagtttgaacagcacctgacccattgtcagattcccacggacatatcaagtatgagagatcacctgcaaaggtctgatccaccagaataaacggcaagctgctgcacaacgctccagaagggacttaatggcaatcgaccattaaagcgcagctggaaacaccactgccaagcttgaacactaggaagaccccctgactggaactaacatagcccaacgccaggacgccaatgaagatgatagcttagaagaaccgaaaaaccccaatgacttacattcaaatccagtaaacttggtgcaaatgggaaattaacggcaaacagaggtttgaactcttcatcgtatattactccatgaaaaagtccgtagagatccagaagaagcccaattaaaactttagataaacatcaccctacacaaaagaacaatatgagaaaacaccctagtaaagcaagacacactgcacaagcgcgcaaggcaatgacaaggaggcacaaaaccatccgcac

SEQ ID NO: 683387 - DNA, 431 bp, Homo sapiens
  misc_feature (57)..(57): n is a, c, g, or t
  misc_feature (428)..(429): n is a, c, g, or t
  misc_feature (431)..(431): n is a, c, g, or t
gcacccgcctttacctttgggaaacccccccgtgaattaaaggttattaaatataancccagtagtaatttaataccataataatacctaaataatccatagaaaattatttataggaataccccaacacctataggatggtgttatggagaggaaaggtgaaatgaaataaagacatttcctcaacattattgttcaatgtagtctaacatgtccaactgcatttttagttgaaaagagtttcatcataagcaaggaaaacccacggcaaatgagtactggagattcctttaaagattcttagaaccaggcagggcgcggtggctcacacctgtgatcccagcactttgggaggccgagatgggtggattgcttgagctcaggagtttaaaaccagcctaggcaacatgatgaaaccctgtttctanngn

SEQ ID NO: 683388 - DNA, 131 bp, Homo sapiens
gctagtgatgatatctgccatcgtgtaccaacttgacaaggttgaatagggcaaaaattgctcctattagcataggcagccagtgcagaacgctgacgtgttgtcgtctacagtgcgaatctaggggatcc

SEQ ID NO: 683389 - DNA, 346 bp, Homo sapiens
cccgaaaccaatgtttaaacccaagccgatctgttgtttgtaataagtaacccggggttttaaaacaaattaattttttagctttattgaagtttgtttttttccttccgaacttggggtttcattttttaaacaccagtttccccccagaatagcagtgccctttctttttgtacatattgattggccctttctttactgttacgtggacactttctatgttagttttgatgcataattctttgaatccttttatccaaactagaatgtttgtgtaagaatacctttccctgcaatgttgtaactacaaacttttttttaaataaatagaaaacttgttttttta

SEQ ID NO: 683390 - DNA, 112 bp, Homo sapiens
gatagtgatatagctgatgccggcactcggacggggagagataggagaaataggactgctgtgattaggacggatcacacgaagaggggcgtcaggtactgggttatggcag

SEQ ID NO: 683391 - DNA, 256 bp, Homo sapiens
ccctcaggctgatctctctatttcaggcgcccaaattcatgggattagagacttaatctaccactccgggacatcgtttcactgatgactcagggttccgctatattagaccggctggaatgcaatggtggagttgtacgtcactgcagactctaagtactgagaacaagcatagcctcttggctcagcctcccaacgtgctagcatctcaggcgtgagccactgcacctggcccgaaaccaagctttctcatccc

SEQ ID NO: 683392 - DNA, 123 bp, Homo sapiens
  misc_feature (17)..(17): n is a, c, g, or t
  misc_feature (51)..(51): n is a, c, g, or t
tctggaaaggggtgccngtggcgaagaagttctggacagcagcttcttggngtctggagaagactggattgttgagcgagatctgacagtcttagcgtggagccagaacgcaggcagctgaga

SEQ ID NO: 683393 - DNA, 633 bp, Homo sapiens
ggcaccaccattttcaattctcatgctgaggtcttttaacatgttctgcggagtgtgcgaacaaaagtttgtgtcctgagaatgtaagtcttttctccgctttaaaattgagtgggttcgtgaggtagctaaaatttagcgcccctggtcttgcatatttttttggagcgcagaacattgtgcttcatgtcataagtgattgggagctttggtaaagggaccccatagaaggagtcccctgcagtcttttgtttttttaaatacttagaacttagcacttgtgttattgatgagtcaggcgccagtgaggcacatccgggtatttggaaacaagtggtcattgttacattcatctgctgcacttagcaaaacggttcatcctggagcaggcacaggtgatgcattttcctggtgctggttctcagtgctctctttccaatattgatgtggttatgtttgggttgtacgggatgttaatcatccggaggatccttgatgttattacatatgggtggttagcgtttgagtgttcccaaagcctatacctttatcacccttctccagggaaaatattcaaagcatgaaatatgttgctttttccagaagacaaacagtaaagtcatgaaaaagaaa

SEQ ID NO: 683394 - DNA, 266 bp, Homo sapiens
  misc_feature (108)..(109): n is a, c, g, or t
gggggcccccccaaaaaaaaatgggggggggatttggggggggggggaaaaaaccggcctcccccccccccccccgtttggggggaaacccccccctttttagaaaannccccccaaggggaggaggggttgggggggccccccccccccccgggggggggggggtttttcaggggggttttttttttttttttttaaaaggttcccccggggggggggggggggttttttttttttgggggggaaaaaagtttttccccccccca

SEQ ID NO: 683395 - DNA, 175 bp, Homo sapiens
tctcattaaaaatatctagcagttagccaggcatggtggcatgtgcatgtagttgcatgtagtgccaccgacttaggaggcacaaccaccttagtctggaaggtcgaggtctcagtgaattgtgctcacaccactgcattggggcttgggtgatggagtgaaaccctgtttcaaa

SEQ ID NO: 683396 - DNA, 859 bp, Homo sapiens
gacagaggcagaggggtgggcgggctggcccatggtgagacctctctcccagagctggggggagaggacaaagccacgcttgcccagatcctggagctggaggagctcctgcgggcaagggaagtcttcttgcagccgtgtggacgaagttgtgcccaaccttttcataggagatgccagggggccaggcacagcctccctcctgtccccatggcttgccggcatcaagtgcccttcctgccctccccaggccacggaaaaaaacgcttttgagctgtggaagcttgggcatcacccacgtgctgaaggccgcccacaagggcttctatgttcaggcggcctgacttctacggcagcagtgttgagctacccgtggggttgccagccaagacctctctgattttgacaattcagtgcctactttctcctctgcggtgactttcatccaccgtgcctcaacaacgcctgggaaaacagcatcagttggtcgggagaaggcggttgaaagccaggagagaacgtgcccgtcaaaaagtgccacacgctggcccagatattccccacagatgcctccggtgcggaaggaggactccggggccccaagtccattgggcagccaggcattccctacagcggcatttggttcgtgagcgttgtgtggtccggcagtgccactgacatatcgttgaggttggcccactctctggggatgggtccggcggaggcactgtccgtgggtacccattgatgcgggggctccgggccaggcaatccggctgcggctgatcggcggacctctccggtttttggggttcgtggtcaccgcgggggccccgctgtttgcccgccattcgtcgtg

SEQ ID NO: 683397 - DNA, 566 bp, Homo sapiens
  misc_feature (94)..(94): n is a, c, g, or t
  misc_feature (141)..(141): n is a, c, g, or t
caaagaccaaccgcccccacacccccacagaccaaaagagagcgcaggccgtgcagcgccaacccaaccttgacatcacctcctgtaagatgcnaagcccctctccagcctcactccactgattgctgcagctaaggaggnaacaaagaacaatcactaaaaccacactcaccccagcctcattgtgccaagccttctgtgagataaatgcacatttcagaaattccaactcctgatgccctcttctccttgccttgcttctcccatttcctgatctagcactcctcaagactctgatccttggaaaccgtgtgtgcagcattgaagagaactgcaactgaatgactactcacatgatggccatttctaaataaggaacttcctcccaattcatggatatcacggcggttcatgactaacggcctatacaactaaatgcccctagccttccgtgtgtcaaaatcctaacctccttcataaccatctcccacaactaactcttgactctataaattcatggcctgatgatattacaacacaaaaaaaaatggcctctatggcctcac

SEQ ID NO: 683398 - DNA, 654 bp, Homo sapiens
aggtcgctgagagctgggaagaggcggcatacagcggggaaattccaaatcgtccgtcccaacagtgcccattgtgattcacggacgatagccttcccgtggggccccctccagcagatccgcatcctcaagaggacccacctagcaatggtgtggtcagtcagccccatactcctagccatgcatggtgccaccgcttccagatcaagtccctaacacagcgagaggccgaggtacgccgaggcccggaagcggatcctgggcagtcgcctaggccccgaggaggagcaggatgaatacccagtcgctcgatcgaggccaaggcagagatctccgcaaccgcgaagacagcaggcagcccaataatgtgactcagacagcctttgggggtcctgcatgggtctcaagggttcaaacagcgcatataaatgcagcgcaagaacacagatgccgccgctctgctgccgtcaccggctcctgggtcgtcctggcaccgggttgcgctgccgtggtagacatgctggcacttgatgcagagggaacgacctgacgttacttgtcgctgtggatccccctttgggtccgaccactgtgtccttgtaactcgcatgacatggtgatcttcgcccctttcttgcccttcctagtgtggtg

SEQ ID NO: 683399 - DNA, 712 bp, Homo sapiens
  misc_feature (10)..(10): n is a, c, g, or t
  misc_feature (12)..(12): n is a, c, g, or t
  misc_feature (29)..(29): n is a, c, g, or t
  misc_feature (49)..(49): n is a, c, g, or t
  misc_feature (170)..(170): n is a, c, g, or t
  misc_feature (205)..(205): n is a, c, g, or t
  misc_feature (226)..(226): n is a, c, g, or t
  misc_feature (239)..(239): n is a, c, g, or t
  misc_feature (241)..(241): n is a, c, g, or t
  misc_feature (253)..(253): n is a, c, g, or t
  misc_feature (265)..(266): n is a, c, g, or t
  misc_feature (317)..(317): n is a, c, g, or t
cttttctaananaaccaagcttttggttncttgaccaggtatgttccantggaaaatttgatgagttgtatctaattccgtgaaaatgccttggcctaatatgaaatttttgaaggaacttaagatatgtttttccaggttccttttgctttaagaatcccgtgccaaanccaaaacttaataaataacacatcgtgaattaagnggtatggaaaagggtttttcngtttacgggaatncnctgttaggttcnttctcttggtgnncaggaatatggattgacctgtcttttcttaagttgtttaggtgaatggttnatgataataatctatctaagataattcacaaatggcaagcaaatacctcatttaatagctgtctacctgtacatttatgggttggacatgtggatttttacaagcaaatagtgaagtagaggtgaggtggaagaagcatggactttggccccccagatttaggttgaagttgccatttcctcactgtgcgacctggaatagttatgtaacctcattagcctgtttccaagtctataaaatgggaatgatagctgggtgtggtggggggcacctgtaataccagctactcgggaggctgagggaggagaatcgcttgaacccaggaggtggaggttgcagtgcgccgagatggcgccactgcactccagcctgggtgacaagagcaaaactccttc

SEQ ID NO: 683400 - DNA, 538 bp, Homo sapiens
  misc_feature (302)..(302): n is a, c, g, or t
  misc_feature (411)..(411): n is a, c, g, or t
  misc_feature (538)..(538): n is a, c, g, or t
agggtattattatgtacccctggctgcttgtaacttgctatgttgactaaatgacctcagactcagagatctacctgcctctgcctcttgagtgttgccattaaaggtgggtaccatcatacctagcttctcggcaggtctctctctttcttaaaggtttgttttgtattttttttacaattttatgtaagtgtatgtgcctatgtgtgggtatgtgcacttgagtgtagataggaactacctgatgtgggtggtgggacctgaatttgggtcttctgtcatctctctagaccttaggctangctataaaatactctcagacacagagcagaacttcaaagagtatcagtcattgggtccttgccaggtgtggtggcacacacctataatctcaggatttgggaaactganggcaggagaacaattgagtttggggcagcacagactatactgggagaccatgtctcaaacacacaaggctggcagaacagctgagagaaggtgcttgcctcaagcacatagtggaaagagaaatagn

SEQ ID NO: 683401 - DNA, 260 bp, Homo sapiens
aaccagccttgattaaccaggcctggcagattcctggcactatccagctgacagctcgatcatgaattcctggggctggcgctggctgatgaacaactgcgggccacgcggctccgaacggacttcggccaggtagccgcgcacgcggtcaccagcgcgcagcacgtcgcgcggaaggcccttgtacttcggtaatgaagccttcggcgtttgcccaccgaggtacgacatagatgttagccgcgctctggcgcgctatg

SEQ ID NO: 683402 - DNA, 697 bp, Homo sapiens
  misc_feature (155)..(155): n is a, c, g, or t
  misc_feature (190)..(190): n is a, c, g, or t
  misc_feature (211)..(211): n is a, c, g, or t
  misc_feature (224)..(224): n is a, c, g, or t
  misc_feature (226)..(226): n is a, c, g, or t
  misc_feature (238)..(238): n is a, c, g, or t
  misc_feature (250)..(251): n is a, c, g, or t
  misc_feature (302)..(302): n is a, c, g, or t
cgctttgggttttgtgccaaaaatatgtccctgtgaaaattaatatgaggggtatcattccctggaaaatcccttgtgctaaaattgaaaattttaaaagaatctgagattttttaattccaggttccttttgctttaagaatcccgtgccaaanccaaaacttaataaataacacatcgtgaattaagnggtatggaaaagggtttttcngtttacgggaatncnctgttaggttcnttctcttggtgnncaggaatatggattgacctgtcttttcttaagttgtttaggtgaatggttnatgataataatctatctaagataattcacaaatggcaagcaaatacctcatttaatagctgtctacctgtacatttatgggttggacatgtggatttttacaagcaaatagtgaagtagaggtgaggtggaagaagcatggactttggccccccagatttaggttgaagttgccatttcctcactgtgcgacctggaatagttatgtaacctcattagcctgtttccaagtctataaaatgggaatgatagctgggtgtggtggggggcacctgtaataccagctactcgggaggctgagggaggagaatcgcttgaacccaggaggtggaggttgcagtgcgccgagatggcgccactgcactccagcctgggtgacaagagcaaaactccttc

SEQ ID NO: 683403 - DNA, 119 bp, Homo sapiens
  misc_feature (37)..(37): n is a, c, g, or t
  misc_feature (80)..(80): n is a, c, g, or t
cactcctgaaaaattttatcaaaagttactggaactngaaaaacacattagggccactattcaaaaaacagataattcangccaggctcactccctcatccctataattccaccacttt

SEQ ID NO: 683404 - DNA, 81 bp, Homo sapiens
gcggccgcctactactactactactgctcgaattcaagcttctaacgatgtacggggacatgctcacttcttaaaagtcat

SEQ ID NO: 683405 - DNA, 262 bp, Homo sapiens
ctgcacaaactcagtgctggcaagggtatgaaaatacttaggatttaatgcctacttttaggatcaaaagcgctactggagcacagtggatatacctgtaatcccaagcctttgggaggccgagggaggaggattgcttgaggccaggagttcaagatcagactaggcaacatagcaacaccctgtctctacaaacaattaagaaataattagctggctgtggtgctgtgcacagtgtatacaggaagctgaggtgggtgga

SEQ ID NO: 683406 - DNA, 1027 bp, Homo sapiens
ctgcgatcctcttacctctctacatctttctcttctgcccttcttttggaagaaggggtttcaaaaccagtttagtttccaaaaagtgtacatttgtggggggggggggtcataatttgaaagcgaaaatgtgtatgtgtgtgtgatggtaaaatgtagtgagattatatcatcatatattttaaaatgccagtacatctttgtatcagtctgtacatgggtcatatagactgttatcagattattacagatgtacttgaggcatctgaaactgcaaaaaagacaactcattaaatgtgatacttcttactacacaggcctgactgctagtagatgtgtaactaaccccattccccaactagtcttcccatccttataccaactttggaggaaaactccccagtaaagcccccatgacctgcaggctgtgtacctggacaggtgtgaagagggaagacaatggccaagtaacagggagggacagagaaagtaaacgagtctacaccatgaggtacagacacacacgggaacctgagagacaacgtaggaacaaccataaagcaaacaacccagaatacacagaccacctaccaggatgaaactgaacagcaggataaggcaaaaaacaaaaataacgtagaacataagaacttgccgcaatatgagtgtgggagacgcaaaaaaaagaagaaaaggataccgcccggggataacacatcaagacaggacacacagacgatgggacggcagaagggaggaaccatgaggcacggagatagaccacgagatcaacaaggagaaacaaagacacaaagaaagaaaaaagcaggaatgaggaagagcaagaaacaaaacagagaggaagaaaagaacataacagagggaaagcgaaacagaagacatcagcaaggcgaaatacacagacaaaacagaaagaaaagaagaagagaaagaagatagagaggaaaaggaacaagagaaaaaagaacaaagaaaagcaaaagaagaacgacacctccagtctcgc

SEQ ID NO: 683407 - DNA, 243 bp, Homo sapiens
agaggacttcctgcatgtaccgggggggagtgggtctcataaggttgtatgatgagaagcgcaaggtacttgttttgttttttttttggagacaatgtcttgctctgtcgatcaggctggagtgcagtggcgtcatctcagctcgctacaacctccacctcctgggtttaagtgattctctggcctcagcctcctgagtagctgagattacaggcacgcgccaccacgcccggtacatgcaag

SEQ ID NO: 683408 - DNA, 305 bp, Homo sapiens
  misc_feature (5)..(5): n is a, c, g, or t
  misc_feature (180)..(180): n is a, c, g, or t
ctagnttttagaagttcaatagcacacacacacgtattcctgtatctttttttttttaagggggctagacaaattctaacagagcggtaacactacacacttctttttctaaggacgggtcatcaggcatggcttggcgggccattccccaagccctcggtccaggggagagctcccggnaattccccaccccccacctcagcctccctcacacaccacggcaccgggctacaaagcttctcgggttatccgggggcagctgagatggagacccaaggccggctatggaaccttctaaaactagg

SEQ ID NO: 683409 - DNA, 444 bp, Homo sapiens
  misc_feature (245)..(245): n is a, c, g, or t
  misc_feature (284)..(284): n is a, c, g, or t
  misc_feature (317)..(317): n is a, c, g, or t
  misc_feature (352)..(352): n is a, c, g, or t
  misc_feature (362)..(362): n is a, c, g, or t
  misc_feature (394)..(394): n is a, c, g, or t
  misc_feature (408)..(408): n is a, c, g, or t
  misc_feature (435)..(435): n is a, c, g, or t
atctagaggatcccggacgagcatcctttacacacggcttacacttcagggtaaaaaggtcaggccggattatctaaaagctattgggaaggtaatcaacggggagaatgtaactgaaagatacagggctggcaaaaagtaaaccacgatcgttatgctgagtatgttaagctctttatgacggttttggtagtggtatagagtactgcagaatacagtaagcggctctatgtgcatttctggangtggcttagtcacttatttcataaacaacttaaggttcngaataatttcttactaaacatttggttatgggncaagtgatggaaaatagtaaatgcttggtgtgatngaatctgatnggacattttcttcagagagctaaattacaatngtcatttataaaancatcaaaaatattccatccatatactngggggactg

SEQ ID NO: 683410 - DNA, 389 bp, Homo sapiens
  misc_feature (50)..(50): n is a, c, g, or t
cccatctggcgaggcagtctcagactccttgccttaagcagtcctcctcnctagcctcctaaagtgctgggattacaggcgtgatgcattacatccaagtgaaactccttgagatggttacataatgtctaaatctgctggtgtagaagttaataaagtgtagaactgaataaatattaaatattagatcaagtttctcatgtttatcttaacgtataacgatttatcttaaagcactgattttcacaaaataacatcagtgtgaaattggaaaagaagccaaatattttatttcacgtatctgggaaatgaggtgctttagtcaactgaatctgcccaaaactaaaaaggattaattaaaaagtacttaactcagaaattataaaaat

SEQ ID NO: 683411 - DNA, 296 bp, Homo sapiens
tactactactaaattggcggccggtcgacggtgtgtgtgtggagtatgcggtgtgtgtggagtgtgtgatgtgtggtgtgtgtggagtgtgtgattggtgtgtgtggagctgtggactgtgtggagtctatggtgtgtggagtgtgtgtggtgtgtggagtgtgtggtgtgtgtggagtatgtggtgtgtgtgtggagtgtgtggtgtgtgtgtggattgtgtggtgtgtgtggagtgtgtggtgtgtggtgtgtgtgtggagtgtgtgtgtgtgtgtgtggtcgacgcggccgca

SEQ ID NO: 683412 - DNA, 114 bp, Homo sapiens
atcgaatgccatcccaaggctcttcagctcgcagagcactctatctacattttttcgcttctcttgcccatatagttatattgcgtctgtataatctaaatgacgggaaaataa

SEQ ID NO: 683413 - DNA, 809 bp, Homo sapiens
  misc_feature (43)..(43): n is a, c, g, or t
  misc_feature (67)..(67): n is a, c, g, or t
  misc_feature (427)..(428): n is a, c, g, or t
  misc_feature (700)..(703): n is a, c, g, or t
tatagatgtacaaagcttaattcatcgcagaagtctgtctgtngacaatacacacggagactaggangtgatccgggaggctgaagagcttgtcaaggtcacagacccacagttttgggcccggtagggtccaagctctttcctggacatctgcaggcaatgtcgacaccccctccattgtctgtggcgggcaaaggatgtttcttcacccccaaacctttccatcctgtgctaaaagtgtccctcaacctgtttcctgagaggcccaagggctttggggttggtactttttctttctctttaaataaaacagaataaaagacagggccttgttggcctcatctgatggaactctgagggcccttccctttaattgaagggtaattcatgatcctaggtcacttgactcggtgggctcgggcgcgcnngtgcggccagcgggatcagcctcacctaaaggccgtaataacgctttttccaaaaataatgtggttatcctcagaaataacatgttgaacaaaaagccctctaagcgcgcaggaaccctaacaaggccgcgctgcttgccattgttccataaggtcccccccctctgacgagcgatacagaaatgggacgcctcaagtcccaggggggggaacaccccgccaggagcttaaaagaaatcaagcgagtttcccccttggaaaagctgcctttnnnnagctcttcatgtttcgtacccttgccggtttacagagaaacgtgtagccactttatgttcctttaaggaaaaagggccgcgcctttgttctattaactaacgcgtg

SEQ ID NO: 683414 - DNA, 1100 bp, Homo sapiens
gggtcaatgtcgcgcctaaccctcatctgctgctctcggcgagccctggtcctgaccgtagactgggcctgctcccactctatgaaggtatttcgacaccgtcgtgtcccggcccggctcgggacgccccgcttcatctcagtgggctacgtggacgacacgcagttcgtgcggttcgtcggcgatccgcctcccacgtccggaagaaggttgagccccgtgcgccgtggctgtgagcagtcagggtgccgtgagatagttgtgtcatcccgtgtggacaccactagagtactaagcgccatcgcacaagtgcattgagccgaagctgtacactgtgcgggacatctgtcacgggatacatagctaccgagagactaagtgacgggtctcacaccctccactggatgttggctgcgacctttggcccgatgggtgcctcttccgcagttatgagcacgtccgcctactagcgggtaaagaatgaccactcggccctgatagggaggagctgtgctcctggacccgtccgtccgtacaccgggggtctcacgattcacccacgcggcagcgtgggagtacgtgccgtaacggcggaaggcaagtggaacgacgctatctgcattggcaacggtgcgtgacctggctccgctctatacctggagagcgtgatggctgacgctcgaggcgcggaactcccatcgacacctggtgacctcaccaatccgtctcttatcatgaaggccgcctagatggttctgcgcctgcggtttctaccctggcgagattggactgatctgacagggcgatgtgaagaaccattcttaagacccgagcttgctgagaccggcctctggagatgatcgttccaccagtgtgccgtgtagggggttcctttggcacatagcaggatcacgtgcatttcggcaggctcggttcaccctcttaagtgagctttcagcaaaacctattgcgtttataacagagacaaacacacgctaagggatgaaaatagaaaactgaacgagtaataaaagccaagaataagaaaaagagaaaaaaaaaacaagaaagaacagcatcatacatatatttaagaaagg

SEQ ID NO: 683415 - DNA, 327 bp, Homo sapiens
  misc_feature (6)..(6): n is a, c, g, or t
cagttntgcttcactttccttctcttccatttataaatggcaaacacaaagtagtaacttgctcagagaatgtcttactgcaacattcaaactgatgggaaggcaggcccagtgtggtagattataaaagcctccttgaatctgggctatgtgagagagcccagccaagatcagcaaagccagccctcagtcaacccacaactaaacataggaacataagtgagcccttgtaaagaatggctaagttcagacaaaaccattaagaactgcccagtcaacatgcagactcagtgagtttgtaaatactgctttatgccactaagtgtt

SEQ ID NO: 683416 - DNA, 271 bp, Homo sapiens
tccggagttcggggatgcgctgccacatggaggtcgagtctccccagtgtctcataggacacattttgtcagtatttgacctagaaaagcttgggaaggaagcgctgttctgtgctcacggactgaggcggccggcgcgaaagccttcccattcctttctgtagggaaaggagcctttatttcactaactttgtattcatatttgatgaataagtatctaaacagagcagtgtaccggaataccaagttacctaccaaacccaaaacacaa

SEQ ID NO: 683417 - DNA, 548 bp, Homo sapiens
  misc_feature (539)..(539): n is a, c, g, or t
cagcggctgccggtgctttaatactttttagaggccctaaaaatcacaaacatatgctcaactcactgtctacagttcttataactgccaaaatctattttcttcctcatacctgacgcatatagccgggtcttggcatcctggaggtggccgcaatggtcctggtgctccaggcgggcccgtggacccctaacgtacattccatagtgggcccgtggggctcctggtgcatcttaataaagtgagagctgtgggctgcacgcccccggcacctggtggaaggcgccgtgctacgagacggtgaaggtgtggcttcaggagaacctgctggctgtgggcatctttgggctgtgcacggcgctggtgcagatcctgggcctgaccttcgccatgaccatgtactgccaagtggtcaaggcagacacctactgcgcgtaggccgcccaccgcccgcttctctgccaaaaggacgcccacggggagatggccgcacccacaagctgcctttcccaccaccaagcctcggtgctctgcccatnagttttttt

SEQ ID NO: 683418 - DNA, 150 bp, Homo sapiens
ccaagatcgccccactgcactccagtatgggcgaccgaacgagactccgtctcaaaaagaaaaacaaagtgtatgtatacatatacacacacacacaaggctcataagtgtactcctttatgactattgattatagttctctcccattgc

SEQ ID NO: 683419 - DNA, 1418 bp, Homo sapiens
  misc_feature (38)..(38): n is a, c, g, or t
gagcaggccgtaaagctgcggcggcggttcgcgtttcncgtgtccgcttgactgacagctgcgcggcgggagcgggcggcgcgagcgggaggcggcggcgcagagcttggggcttccttggtcgcacccaccacctgcctgcccactggtcagccttcagggaccctgagcaccgcctggtctctttcctgtggccagcccagaactgaagcgctgcggcatggcgcgcgcctgcctccaggccgtcaagtacctcatgttcgccttcaacctgctcttctggctgggaggctgtggcgtgctgggtgtcggcatctggctggccgccacacaggggagcttcgccacgctgtcctcttccttcccgtccctgtcggctgccaacctgctcatcatcaccggcgcctttgtcatggccatcggcttcgtgggctgcctgggtgccatcaaggagaacaagtgcctcctgctcactttcttcctgctgctgctgctggtgttcctgctggaggccaccatcgccatcctcttcttcgcctacacggacaagattgacaggtatgcccagcaagacctgaagaaaggcttgcacctgtacggcacgcagggcaacgtgggcctcaccaacgcctggagcatcatccagaccgacttccgctgctgtggcgtctccaactacactgactggttcgaggtgtacaacgccacgcgggtacctgactcctgctgcttggagttcagtgagagctgtgggctgcacgcccccggcacctggtggaaggcgccgtgctacgagacggtgaaggtgtggcttcaggagaacctgctggctgtgggcatctttgggctgtgcacggcgctggtgcagatcctgggcctgaccttcgccatgaccatgtactgccaagtggtcaaggcagacacctactgcgcgtaggccgcccaccgcccgcttctctgccaaaaggacgcccacggggagatggccgcacccacagctgcctttcccaccaccagcctcggtgctctgccccatgctgggaggagggagggagggacaggtgcctggagcccccggaaccctgtttctggaaggccctggctcaggtggcttcagggcctccggaccccccctgggaggggtggccacgtgctggctgcggaacccagggcaggggtgggaggggcctccagcactttttatatttacgtattctccaaagcagtgttcacacgggagccagcctgtggcccccagcctcctggaaaacaggttggcgctggaggagccgggtcttggcatcctggaggtggccccactggtcctggtgctccaggcggggccgtggacccctcacctacattccatagtgggcccgtggggctcctggtgcatcttaataaagtgtgagcagcaa

SEQ ID NO: 683420 - DNA, 1433 bp, Homo sapiens
  misc_feature (18)..(18): n is a, c, g, or t
  misc_feature (20)..(20): n is a, c, g, or t
  misc_feature (22)..(22): n is a, c, g, or t
ggtacggtcggaatttangnanatcctgctctgggcagaagggcaggacagggccctgagtaacggtggcctggggtcagagccaggttcagctgcgaggctgctggtggctgtggagagcttggggcttccttggtcgcacccaccacctgcctgcccactggtcagccttcagggaccctgagcaccgcctggtctctttcctgtggccagcccagaactgaagcgctgcggcatggcgcgcgcctgcctccaggccgtcaagtacctcatgttcgccttcaacctgctcttctggctgggaggctgtggcgtgctgggtgtcggcatctggctggccgccacacaggggagcttcgccacgctgtcctcttccttcccgtccctgtcggctgccaacctgctcatcatcaccggcgcctttgtcatggccatcggcttcgtgggctgcctgggtgccatcaaggagaacaagtgcctcctgctcactttcttcctgctgctgctgctggtgttcctgctggaggccaccatcgccatcctcttcttcgcctacacggacaagattgacaggtatgcccagcaagacctgaagaaaggcttgcacctgtacggcacgcagggcaacgtgggcctcaccaacgcctggagcatcatccagaccgacttccgctgctgtggcgtctccaactacactgactggttcgaggtgtacaacgccacgcgggtacctgactcctgctgcttggagttcagtgagagctgtgggctgcacgcccccggcacctggtggaaggcgccgtgctacgagacggtgaaggtgtggcttcaggagaacctgctggctgtgggcatctttgggctgtgcacggcgctggtgcagatcctgggcctgaccttcgccatgaccatgtactgccaagtggtcaaggcagacacctactgcgcgtaggccgcccaccgcccgcttctctgccaaaaggacgcccacggggagatggccgcacccacagctgcctttcccaccaccagcctcggtgctctgccccatgctgggaggagggagggagggacaggtgcctggagcccccggaaccctgtttctggaaggccctggctcaggtggcttcagggcctccggaccccccctgggaggggtggccacgtgctggctgcggaacccagggcaggggtgggaggggcctccagcactttttatatttacgtattctccaaagcagtgttcacacgggagccagcctgtggcccccagcctcctggaaaacaggttggcgctggaggagccgggtcttggcatcctggaggtggccccactggtcctggtgctccaggcggggccgtggacccctcacctacattccatagtgggcccgtggggctcctggtgcatcttaataaagtgtgagcagcaa

SEQ ID NO: 683421 - DNA, 1456 bp, Homo sapiens
  misc_feature (9)..(9): n is a, c, g, or t
  misc_feature (17)..(17): n is a, c, g, or t
  misc_feature (20)..(20): n is a, c, g, or t
  misc_feature (31)..(31): n is a, c, g, or t
gcggcgganaggtaccnagnggggcttgtgnggggcgtgcggccagggtcccgtggccggaggtgtccgaccgggagcggctggagccggacgcgagcggggcgcgcgagttcgagcccagagccgacacgcagcaacaagagcttggggcttccttggtcgcacccaccacctgcctgcccactggtcagccttcagggaccctgagcaccgcctggtctctttcctgtggccagcccagaactgaagcgctgcggcatggcgcgcgcctgcctccaggccgtcaagtacctcatgttcgccttcaacctgctcttctggctgggaggctgtggcgtgctgggtgtcggcatctggctggccgccacacaggggagcttcgccacgctgtcctcttccttcccgtccctgtcggctgccaacctgctcatcatcaccggcgcctttgtcatggccatcggcttcgtgggctgcctgggtgccatcaaggagaacaagtgcctcctgctcactttcttcctgctgctgctgctggtgttcctgctggaggccaccatcgccatcctcttcttcgcctacacggacaagattgacaggtatgcccagcaagacctgaagaaaggcttgcacctgtacggcacgcagggcaacgtgggcctcaccaacgcctggagcatcatccagaccgacttccgctgctgtggcgtctccaactacactgactggttcgaggtgtacaacgccacgcgggtacctgactcctgctgcttggagttcagtgagagctgtgggctgcacgcccccggcacctggtggaaggcgccgtgctacgagacggtgaaggtgtggcttcaggagaacctgctggctgtgggcatctttgggctgtgcacggcgctggtgcagatcctgggcctgaccttcgccatgaccatgtactgccaagtggtcaaggcagacacctactgcgcgtaggccgcccaccgcccgcttctctgccaaaaggacgcccacggggagatggccgcacccacagctgcctttcccaccaccagcctcggtgctctgccccatgctgggaggagggagggagggacaggtgcctggagcccccggaaccctgtttctggaaggccctggctcaggtggcttcagggcctccggaccccccctgggaggggtggccacgtgctggctgcggaacccagggcaggggtgggaggggcctccagcactttttatatttacgtattctccaaagcagtgttcacacgggagccagcctgtggcccccagcctcctggaaaacaggttggcgctggaggagccgggtcttggcatcctggaggtggccccactggtcctggtgctccaggcggggccgtggacccctcacctacattccatagtgggcccgtggggctcctggtgcatcttaataaagtgtgagcagcaa

SEQ ID NO: 683422 - DNA, 333 bp, Homo sapiens
gaaccggtcgcagaggcttacgcctgtaatcccagcactttgggaggctgaggcccacggatcatgaggtcaggagattgagaccattctggctaacacggtgaaaccccgtctgtactaaaaaatacacaaaaaagtagccgatcgtgacggcaggagcctgtactcccagctactcaggaggcatgagggaggagaatgacctgaacccaggaggcggagcttgcagtgagctgagttcgcaccactgcactccagtctgggcgacagagcaagactctgtcttaaaacaagctacctgagagaaaacatgccatcacgactagtactagg

SEQ ID NO: 683423 - DNA, 963 bp, Homo sapiens
atcttgggttacgaatctcgcgaatagtcatgttctacagtgagtactcccagaatccagcgttgcttcctcttgccctatgtcagcctgatagtgatcgtgtgcaggtgtgccgcgattcaattgttcccgaagaagcccatgacatagtattcgatgaactgtgctcaggccatccaccggtgtatgcattgttcctagtaagccactgaagggatcttaataaggatgttacactcttagcgagaaacaagttggttgtcccactttgcagaacagatggcaaaatgcgatgggagtgttggctgtgttgtgcagtcgtgccagaagacgacctgagaggtctggaacccaccagggtcgtgacggttcccacaaaattgacgacgcaagaagtttgaataagttgcgagcattggcttgtgatatagaagccgcgatggtatcattgtaaaattgcctagcaatttttaaagggtgattcgtcggaattgtccagaagtactcgttgagatccgtggcgaagccatagtcccaagcgattatcaatctgcagccctacgaagtttccaccctggcgggggaccataacgggaagcattcattgagtcaggaattatactccctattggacagtgtaagtctcttcccatgtctcaactgttagtcgtagtgaatcctgtaacgtggagtaggactacctaattgtggttccttgagattgctgtcatgacgagatgctcggcccagaaaagtaaattccgcttggattgatgcctcgaaagcattggtgtaaaactgtgtgggtagcgtttgcgtaggggaccacgggcaattcctgggttacggagccttgggggtcatacgcagcaaaattcccgttggtggccctggttttttatcactcatctggttgggccccccctttacaacatctcggtgagaactgcggcaagaataatg

SEQ ID NO: 683424 - DNA, 1476 bp, Homo sapiens
gagcccctgagatctggagactgccccagcctcaggctctgtgcatctcccccgagcccccaccacatatgtgcggaggcccctgggggcccaggcctgtcctcagtcccgactgggctctacctgaggaccctggggagcctgggcctggccctcctcagagcttggggcttccttggtcgcacccaccacctgcctgcccactggtcagccttcagggaccctgagcaccgcctggtctctttcctgtggccagcccagaactgaagcgctgcggcatggcgcgcgcctgcctccaggccgtcaagtacctcatgttcgccttcaacctgctcttctggctgggaggctgtggcgtgctgggtgtcggcatctggctggccgccacacaggggagcttcgccacgctgtcctcttccttcccgtccctgtcggctgccaacctgctcatcatcaccggcgcctttgtcatggccatcggcttcgtgggctgcctgggtgccatcaaggagaacaagtgcctcctgctcactttcttcctgctgctgctgctggtgttcctgctggaggccaccatcgccatcctcttcttcgcctacacggacaagattgacaggtatgcccagcaagacctgaagaaaggcttgcacctgtacggcacgcagggcaacgtgggcctcaccaacgcctggagcatcatccagaccgacttccgctgctgtggcgtctccaactacactgactggttcgaggtgtacaacgccacgcgggtacctgactcctgctgcttggagttcagtgagagctgtgggctgcacgcccccggcacctggtggaaggcgccgtgctacgagacggtgaaggtgtggcttcaggagaacctgctggctgtgggcatctttgggctgtgcacggcgctggtgcagatcctgggcctgaccttcgccatgaccatgtactgccaagtggtcaaggcagacacctactgcgcgtaggccgcccaccgcccgcttctctgccaaaaggacgcccacggggagatggccgcacccacagctgcctttcccaccaccagcctcggtgctctgccccatgctgggaggagggagggagggacaggtgcctggagcccccggaaccctgtttctggaaggccctggctcaggtggcttcagggcctccggaccccccctgggaggggtggccacgtgctggctgcggaacccagggcaggggtgggaggggcctccagcactttttatatttacgtattctccaaagcagtgttcacacgggagccagcctgtggcccccagcctcctggaaaacaggttggcgctggaggagccgggtcttggcatcctggaggtggccccactggtcctggtgctccaggcggggccgtggacccctcacctacattccatagtgggcccgtggggctcctggtgcatcttaataaagtgtgagcagcaa

SEQ ID NO: 683425 - DNA, 1902 bp, Homo sapiens
  misc_feature (18)..(18): n is a, c, g, or t
  misc_feature (20)..(20): n is a, c, g, or t
  misc_feature (22)..(22): n is a, c, g, or t
ggtacggtcggaatttangnanatcctgctctgggcagaagggcaggacagggccctgagtaacggtggcctggggtcagagccaggttcagctgcgaggctgctggtggctgtggagagcttggggcttccttggtcgcacccaccacctgcctgcccactggtcagccttcagggaccctgagcaccgcctggtctctttcctgtggccagcccagaactgaagcgctgcggcatggcgcgcgcctgcctccaggccgtcaagtacctcatgttcgccttcaacctgctcttctggctgggaggctgtggcgtgctgggtgtcggcatctggctggccgccacacaggggagcttcgccacgctgtcctcttccttcccgtccctgtcggctgccaacctgctcatcatcaccggcgcctttgtcatggccatcggcttcgtgggctgcctgggtgccatcaaggagaacaagtgcctcctgctcactttcttcctgctgctgctgctggtgttcctgctggaggccaccatcgccatcctcttcttcgcctacacggacaagattgacaggtatgcccagcaagacctgaagaaaggcttgcacctgtacggcacgcagggcaacgtgggcctcaccaacgcctggagcatcatccagaccgacttccgctgctgtggcgtctccaactacactgactggttcgaggtgtacaacgccacgcgggtacctgactcctgctgcttggagttcagtgagagctgtgggctgcacgcccccggcacctggtggaaggcgccgtgctacgagacggtgaaggtgtggcttcaggagaacctgctggctgtgggcatctttgggctgtgcacggcgctggtgcagatcctgggcctgaccttcgccatgaccatgtactgccaagtggtcaaggcagacacctactgcgcgtaggccgcccaccgcccgcttctctgccaaaaggacgcccacggggagatggccgcacccacagctgcctttcccaccaccagcctcggtgctctgccccatgctgggaggagggagggagggacaggtgcctggagcccccggaaccctgtttctggaaggccctggctcaggtggcttcagggcctccggaccccccctgggaggggtggccacgtgctggctgcggaacccagggcaggggtgggaggggcctccagcactttttatatttacgtattctccaaagcagtgttcacacgggagccagcctgtggcccccagcctcctggaaaacaggttggcgctggaggagccgggtcttggcatcctggaggtggccccactggtcctggtgctccaggcggggccgtggacccctcacctacattccatagtgggcccgtggggctcctggtgcatcttaataaagtgtgagcagcaaaaaaaagaaacaaaaaaaaaaactttgggagggcatcttatgggcgggtgtcggcggaaaaaggggtgaatggaatggggccacttgggtccattaggtgtgttcccttggacccaagtttttttgtgtcacaaggggggaaaatctgggggggacccccatattagggaagcgagtaataaattgcgagattaacgccggggtttacccgggctttattgactcgggggaaaacaggtgtgaaaaggacagaagaggagaagaagacacgagaagaagaagagtggatgagagaacaatgtggcaccacaaaggagggggcaggcgagacaagaaagcaaacgtgacacagcaacagacaagagccacggcagccgacaagaacaacagggaaagagaaaaagcagaagtcaagagacaccggcgacagaggcccgcagacagagggcagggaggtacagagaggagg

SEQ ID NO: 683426 - DNA, 115 bp, Homo sapiens
gagagacccaccatggtgctgtctctgccgacaggacaacgtcaaggccgcttgggttaaggtcggcgcgcacgtggcgattatgtccggagccctagagagtagtcctttcctt

SEQ ID NO: 683427 - DNA, 796 bp, Homo sapiens
  misc_feature (401)..(401): n is a, c, g, or t
gcttgagagaggcatggaaagctgtccaggaaagtggttgtgctgtgaaatccgtgtgtcattgttaacagggatgaaatgaggagtcttgcactgtgctctttggtatgtatcctgccctggcaggtgactcagactgtgcctgtattgttgtcctgattgtataagggaatccccgttgttattggtatggtggaaatcggccacaagaggcgcattcccacatacagatgaaaagacaacaaagagagggaactgcacgcgtgcctgcgggcgcggttctagggttgtaagacatagaagggggcggcgttgggcgattgtgtgggctggatccagcgatgtttgataacgctcgcatgtcgaatagactcctcatgagcctgatggactcaggtccntgactggcaggtgcaagactgcgatgggaatgacccgtgacatagcatgccaaggtccaaggatgtctgtagtccccgctgttgactaggcatgtggcaagactagtcttgtcaaagtcaccctaggagagcatcgccgagtacacataacatggtgttgttgggcccgctgattggttgcttgcacaggtcgataaacgaatctgaagaggctccttgagacccccaggaatcattatcagggtataacctaccttggttcgagaggtggaaaaagcccataagggtatatagggaataccacttgcagatgcaggttggccggttcgccaacagcgagtccgtccactgtagggggaccttgggagtgcttggctgcgtagactccaccaatt

SEQ ID NO: 683428 - DNA, 563 bp, Homo sapiens
gatctagaggacccttgcgaggtctctacctcttgactgaagctgaatttagttggggtgagtcagggttgggtattggaggggggggggggggtgaaatgttgagtgtgaagccacccacaaacacacacctgttgtttaggaacccggctgtggttgtttctgagctgtttggcttcagttgacagtttcttgattgcctgagcaccaggtctcatcttgcatctcatccggggcgggagaacattcagtttccttccaagccttcccacctttcccccactcccttggaggaacagaagtgggggttgaggcgagccacatggctggagtgtgtatctgaaggtctttctgtcacctgttcagtgtggtctgccccacccttgttgaccaagagggagtgagagtgtaaaataatacagagcatctcacactcagaagggcgggcacattttttgaaagcccatgtgtggttaagtgggtggaacaacgataattcagcgggctttatgagtagaacttgtgagacatattgtggccggccactttgcaccatctctggg

SEQ ID NO: 683429 - DNA, 1669 bp, Homo sapiens
ggccgcagcgcgcgggccgggcagatgtttgggttccgccgccggggtccgagcggatccgcgcgacccgctgccaccgcgggggccagagcgggagcaggagcggggccggagcaggcgccggccggcgggatggggcgttccggggcggcgggtgcggggcgctgagcggcggccccggcacacccgggcgcgatgcgccgctccagcacggacgagtccacgtaccggcgcagcccctctccggagggcaaggagccggacttcgcgcgcggcggccccttccggcgctacagcagcctatacgggcgcgcgggcggcggggacgccgggggcgccttcttcggcctgcacgcgaaccccggccccaaggcggcccaggcgcgctacacgtcgcccaagggcaacaagtacgtggttttctacctggacctctccttcatcttcctcctagaactgaagcgctgcggcatggcgcgcgcctgcctccaggccgtcaagtacctcatgttcgccttcaacctgctcttctggctgggaggctgtggcgtgctgggtgtcggcatctggctggccgccacacaggggagcttcgccacgctgtcctcttccttcccgtccctgtcggctgccaacctgctcatcatcaccggcgcctttgtcatggccatcggcttcgtgggctgcctgggtgccatcaaggagaacaagtgcctcctgctcactttcttcctgctgctgctgctggtgttcctgctggaggccaccatcgccatcctcttcttcgcctacacggacaagattgacaggtatgcccagcaagacctgaagaaaggcttgcacctgtacggcacgcagggcaacgtgggcctcaccaacgcctggagcatcatccagaccgacttccgctgctgtggcgtctccaactacactgactggttcgaggtgtacaacgccacgcgggtacctgactcctgctgcttggagttcagtgagagctgtgggctgcacgcccccggcacctggtggaaggcgccgtgctacgagacggtgaaggtgtggcttcaggagaacctgctggctgtgggcatctttgggctgtgcacggcgctggtgcagatcctgggcctgaccttcgccatgaccatgtactgccaagtggtcaaggcagacacctactgcgcgtaggccgcccaccgcccgcttctctgccaaaaggacgcccacggggagatggccgcacccacagctgcctttcccaccaccagcctcggtgctctgccccatgctgggaggagggagggagggacaggtgcctggagcccccggaaccctgtttctggaaggccctggctcaggtggcttcagggcctccggaccccccctgggaggggtggccacgtgctggctgcggaacccagggcaggggtgggaggggcctccagcactttttatatttacgtattctccaaagcagtgttcacacgggagccagcctgtggcccccagcctcctggaaaacaggttggcgctggaggagccgggtcttggcatcctggaggtggccccactggtcctggtgctccaggcggggccgtggacccctcacctacattccatagtgggcccgtggggctcctggtgcatcttaataaagtgtgagcagcaa

SEQ ID NO: 683430 - DNA, 1163 bp, Homo sapiens
cgctaacggaagcataccttgcgatggctggaaaaaatcgccccttccgcactataaaattggtggcatcgaggcgcgattgaggccctgcatcgccaggtctgtcagcgggtctgaagtgaatgcgcagctaatgctgcgatttcgtcgccgatggcggctcgctgattggtgctggtgaaaaacgcattggtgagatctgggccggttgactaatgccggcgaatggccttacagaatgaatatccctgacaatggtcgtctaaaccttacatagaacaatgttatgacacacccttaagtagaaactgtgaccaccgtcagcaggctattttgcctgcatgtgctttcgctctcttgtcgctagtctagctgaaccgggcactccgcacgtgagggctggacgctgggcacagaaaactggtgagcattgttccactctgatggcactcttatgtcggcttctacacttgatcgtatttgtctggtggttatgcacgtgctgggcgctattggcgtacttatgttgctgcgcttgagtctggcgacgcgggcttctctgctggccggcattaaaccgtcgcatttatcgccgtacttcgacgaccatacttcgacttaatgtctcccttcgcgctcaaaggacacgatctatgcgattaggcgaatcaacaggggctgacaagggcgaaaccggcctgggcctatggaagattaaccccattggcacgaagcgattggttgacctctatctggtaccccaggtagttcacgaacaggactttggcaaacttgggcgggccccagaattatctaaacacatacatgacaacatataaaaacaagttccccattaatcacacactaagtatctcacaacaagaaaatcccgggtgcatactctcacataaccatcaaacacattatcagcggggcatcaatattcggccaccggtcgtcttcgtgtctctccagtgtaaaaaacaccgtaggagaattgaaggcgaaaaccaatagaacagacgatacgtacacataacaatacgaagataacacgcgatagaaaacatgacagagatacgaaagtacatgtcatcatagtactcaatagccacagacaaacgcaacacgacacatcagcaaacacgaagacgatcatacct

SEQ ID NO: 683431 - DNA, 1318 bp, Homo sapiens
  misc_feature (38)..(38): n is a, c, g, or t
gagcaggccgtaaagctgcggcggcggttcgcgtttcncgtgtccgcttgactgacagctgcgcggcgggagcgggcggcgcgagcgggaggcggcggcgcagaactgaagcgctgcggcatggcgcgcgcctgcctccaggccgtcaagtacctcatgttcgccttcaacctgctcttctggctgggaggctgtggcgtgctgggtgtcggcatctggctggccgccacacaggggagcttcgccacgctgtcctcttccttcccgtccctgtcggctgccaacctgctcatcatcaccggcgcctttgtcatggccatcggcttcgtgggctgcctgggtgccatcaaggagaacaagtgcctcctgctcactttcttcctgctgctgctgctggtgttcctgctggaggccaccatcgccatcctcttcttcgcctacacggacaagattgacaggtatgcccagcaagacctgaagaaaggcttgcacctgtacggcacgcagggcaacgtgggcctcaccaacgcctggagcatcatccagaccgacttccgctgctgtggcgtctccaactacactgactggttcgaggtgtacaacgccacgcgggtacctgactcctgctgcttggagttcagtgagagctgtgggctgcacgcccccggcacctggtggaaggcgccgtgctacgagacggtgaaggtgtggcttcaggagaacctgctggctgtgggcatctttgggctgtgcacggcgctggtgcagatcctgggcctgaccttcgccatgaccatgtactgccaagtggtcaaggcagacacctactgcgcgtaggccgcccaccgcccgcttctctgccaaaaggacgcccacggggagatggccgcacccacagctgcctttcccaccaccagcctcggtgctctgccccatgctgggaggagggagggagggacaggtgcctggagcccccggaaccctgtttctggaaggccctggctcaggtggcttcagggcctccggaccccccctgggaggggtggccacgtgctggctgcggaacccagggcaggggtgggaggggcctccagcactttttatatttacgtattctccaaagcagtgttcacacgggagccagcctgtggcccccagcctcctggaaaacaggttggcgctggaggagccgggtcttggcatcctggaggtggccccactggtcctggtgctccaggcggggccgtggacccctcacctacattccatagtgggcccgtggggctcctggtgcatcttaataaagtgtgagcagcaa

SEQ ID NO: 683432 - DNA, 533 bp, Homo sapiens
  misc_feature (87)..(87): n is a, c, g, or t
taatgtcatctttttcacttgaaatgagtattagcaacagttacgaacgtgtagaacgacagcctgacgcaaacacacactacaganagacgtttttaagaacatttgagatcattttggctgtatttattacgatttattgtcaggatgtttcaaaacacttgtattatcatgttttttcattggcttaatatcatggtcgtttcaaaaattaacaataatcttttgtttatggttaatccgtatattgatgtttttaggtgtcagccagattttgctattctttgtgttttttatacatcaaaaacggttttatagagagatgtaccttttggttatacaagctgctgtgcaataaactcttcacgttcaccgagatgaacacctgttactgctgttgttgaaaattggacataattaggctggatttcccattaaattttgaaagaaacaaaatgttgtggaccattgaatgagtgtgaagtcagtcagacaatctggctaaatgaattgaataaatatttaatgaaaca

SEQ ID NO: 683433 - DNA, 184 bp, Homo sapiens
cgagtcgggtactggaggatcctctagatcgacagtgctccaggtaacctgatattatggaggtcagcacggtgctcactgtgtcgacggcactatgtacagggaggcatgcaccgagatgggtgaatacacgtcgaccaggctccaggataacgatatatggaggtcagcatggtgctcacgt

SEQ ID NO: 683434 - DNA, 1374 bp, Homo sapiens
  misc_feature (9)..(9): n is a, c, g, or t
  misc_feature (17)..(17): n is a, c, g, or t
  misc_feature (20)..(20): n is a, c, g, or t
  misc_feature (31)..(31): n is a, c, g, or t
gcggcgganaggtaccnagnggggcttgtgnggggcgtgcggccagggtcccgtggccggaggtgtccgaccgggagcggctggagccggacgcgagcggggcgcgcgagttcgagcccagagccgacacgcagcaacaagagcttggggcttccttggtcgcacccaccacctgcctgcccactggtcagccttcagggaccctgagcaccgcctggtctctttcctgtggccagcccctgggaggctgtggcgtgctgggtgtcggcatctggctggccgccacacaggggagcttcgccacgctgtcctcttccttcccgtccctgtcggctgccaacctgctcatcatcaccggcgcctttgtcatggccatcggcttcgtgggctgcctgggtgccatcaaggagaacaagtgcctcctgctcactttcttcctgctgctgctgctggtgttcctgctggaggccaccatcgccatcctcttcttcgcctacacggacaagattgacaggtatgcccagcaagacctgaagaaaggcttgcacctgtacggcacgcagggcaacgtgggcctcaccaacgcctggagcatcatccagaccgacttccgctgctgtggcgtctccaactacactgactggttcgaggtgtacaacgccacgcgggtacctgactcctgctgcttggagttcagtgagagctgtgggctgcacgcccccggcacctggtggaaggcgccgtgctacgagacggtgaaggtgtggcttcaggagaacctgctggctgtgggcatctttgggctgtgcacggcgctggtgcagatcctgggcctgaccttcgccatgaccatgtactgccaagtggtcaaggcagacacctactgcgcgtaggccgcccaccgcccgcttctctgccaaaaggacgcccacggggagatggccgcacccacagctgcctttcccaccaccagcctcggtgctctgccccatgctgggaggagggagggagggacaggtgcctggagcccccggaaccctgtttctggaaggccctggctcaggtggcttcagggcctccggaccccccctgggaggggtggccacgtgctggctgcggaacccagggcaggggtgggaggggcctccagcactttttatatttacgtattctccaaagcagtgttcacacgggagccagcctgtggcccccagcctcctggaaaacaggttggcgctggaggagccgggtcttggcatcctggaggtggccccactggtcctggtgctccaggcggggccgtggacccctcacctacattccatagtgggcccgtggggctcctggtgcatcttaataaagtgtgagcagcaa

SEQ ID NO: 683435 - DNA, 166 bp, Homo sapiens
ttacgatcctacactgtcgtcatagccatgggagaatatgtcctgctcacactcagtaacgcacgcacgactcaaagttgttgagtggcagcatccgaggtcagaaccgaactgggcaaaagcagcaaccctcacggaataaccttttgagccaattccagcttca

SEQ ID NO: 683436 - DNA, 1351 bp, Homo sapiens
  misc_feature (18)..(18): n is a, c, g, or t
  misc_feature (20)..(20): n is a, c, g, or t
  misc_feature (22)..(22): n is a, c, g, or t
ggtacggtcggaatttangnanatcctgctctgggcagaagggcaggacagggccctgagtaacggtggcctggggtcagagccaggttcagctgcgaggctgctggtggctgtggagagcttggggcttccttggtcgcacccaccacctgcctgcccactggtcagccttcagggaccctgagcaccgcctggtctctttcctgtggccagcccctgggaggctgtggcgtgctgggtgtcggcatctggctggccgccacacaggggagcttcgccacgctgtcctcttccttcccgtccctgtcggctgccaacctgctcatcatcaccggcgcctttgtcatggccatcggcttcgtgggctgcctgggtgccatcaaggagaacaagtgcctcctgctcactttcttcctgctgctgctgctggtgttcctgctggaggccaccatcgccatcctcttcttcgcctacacggacaagattgacaggtatgcccagcaagacctgaagaaaggcttgcacctgtacggcacgcagggcaacgtgggcctcaccaacgcctggagcatcatccagaccgacttccgctgctgtggcgtctccaactacactgactggttcgaggtgtacaacgccacgcgggtacctgactcctgctgcttggagttcagtgagagctgtgggctgcacgcccccggcacctggtggaaggcgccgtgctacgagacggtgaaggtgtggcttcaggagaacctgctggctgtgggcatctttgggctgtgcacggcgctggtgcagatcctgggcctgaccttcgccatgaccatgtactgccaagtggtcaaggcagacacctactgcgcgtaggccgcccaccgcccgcttctctgccaaaaggacgcccacggggagatggccgcacccacagctgcctttcccaccaccagcctcggtgctctgccccatgctgggaggagggagggagggacaggtgcctggagcccccggaaccctgtttctggaaggccctggctcaggtggcttcagggcctccggaccccccctgggaggggtggccacgtgctggctgcggaacccagggcaggggtgggaggggcctccagcactttttatatttacgtattctccaaagcagtgttcacacgggagccagcctgtggcccccagcctcctggaaaacaggttggcgctggaggagccgggtcttggcatcctggaggtggccccactggtcctggtgctccaggcggggccgtggacccctcacctacattccatagtgggcccgtggggctcctggtgcatcttaataaagtgtgagcagcaa

SEQ ID NO: 683437 - DNA, 118 bp, Homo sapiens
gagccttcagtcactggggaaagcaggtgaagcagtgtgagctctttattcactcccagcctgttctgtggcctgttccactgtgtgcacttgtctgtttggccctgctccacatcca

SEQ ID NO: 683438 - DNA, 230 bp, Homo sapiens
tctctagatttacgattgtttctcctaaggcagaggttctctgagacacagtggggaaggtttcagagaaatccaggaacccgcctaaaaatccgtacaaaattgtgtcattgtatgtgcagttttctggtgagtagacccagagctttcatcacatttccaaagggtctgtgcccttcaccctcacctgccaataagatgaagaaattataccagtccctaaggaggca

SEQ ID NO: 683439 - DNA, 904 bp, Homo sapiens
taatgtgccagtgtggccaattgattttccatggggcttcccgcgtgttgtgacgcccgcgttgcgacgcgttttccaccttgtgtagccgccatgtgtcgcttcgcctttgttgaggaggcgtgcccactacggcccccgtggggcggagacgccagagtcactgtttatggcggaggttgtgggtccccgcccggggacccgtatcctggggcccccttgtgtaaggaccttgtttgactggtcccgtgctcattgtgaaagacaccgttggtgtcccgcgcccacggacgtccacgctcttgtccggccctagtcgtcgtccttttattttgtccccgccctggggtaatcctgcgggttttcgccgccacgttagagcttgggggttaacctggttgttaagcagcataattttttaagggcgcccactaggtcccgccagcgtccccaggtgttgtttattgtggttgtttcccacagcgccacccttgctcccgactgtgtgttcacatcgttggtgcgccctctagggggagaaaaggaatgatggccccacccccccccactgtccatttccctcgcttgagaagttggaggcttggacataattttggtatattttttgtagatgagcagaatttttaactgggtgctactctaaaacaataaggatctgtgattgaagttgcccctcaaattggcactagagatgcactgtaatagatatgtacctctctctgtcaattgttttttatagtgtggctgtaataatcccggaaacctttggggtttataaaatttttggctttcaaaagttgggaacaccccctttttgggaaaaggagcccttttatttttttccattccctttggaagttaaaaaaatggaaaggtcccaaca

SEQ ID NO: 683440 - DNA, 119 bp, Homo sapiens
ccaatcccaggtccaatttcttttcattccctggatcacaacacaccacggaagagaggagtccagaatgtctctccctgccagtgctcccctcctacctcgcagctcgcccctgagtt

SEQ ID NO: 683441 - DNA, 390 bp, Homo sapiens
gagtttgatttcccaggggaactgtcggggttttgtagggcttcatatcctatatacagttccatagaagctgcagagctcgcagaaaggattgagcgcagggggccaatccttcaggaaatatggatgaacagtggtttgggcccctcgctcccaaaaaacatgggcccgtttttctgaaaaccccatgcattttgatgcggtcgccctttttgaaaaaggaagggtccccaatgccccccccgttttggttcccctgggccttttatgaaggagaatttgtcatgtccttcaaccctcgtgaggccaggaagctattaaagggatgtttcaagctgtttttagccccttcccaaataaatgaggagggaagagtttttgttttttgta

SEQ ID NO: 683442 - DNA, 124 bp, Homo sapiens
atatattttaattaatgataatgaactagaacacatctagcacaggtagtgaaactatttttaaaaaaagaaagaaaaccttctttggttactgaagagatgtccttacccaggggaatgctgt

SEQ ID NO: 683443 - DNA, 160 bp, Homo sapiens
cgccataccgatagcggaatattccatcgcgttccgaaagtgggtttcgctttcggaaatgtgtttcgcttcccgacgaaaggcatacatcaccatggtcatgatgttggagggcacgaggtatcagcaaaaacggtgaccacggcatatggctcatcag

SEQ ID NO: 683444 - DNA, 142 bp, Homo sapiens
gacccatcataagaagagataggagcgagtcagatgagtgcgctgggggagcgtggtggattagtctgtgtgtggaggtacggagtagagtgaccctcgagtctgatagtctgtcgctcggagtggtgtgttgggttggatc

SEQ ID NO: 683445 - DNA, 1139 bp, Homo sapiens
  misc_feature (1139)..(1139): n is a, c, g, or t
gaggcaacaatatgtatacgtcgatacttcggtttaatttcgtcacaggggctggggtttcattcgacgatagatggccggtggtgccaccagttcacacagacgtctctccgggcactcggacggcccacgaccgccgcaccccgcacaggcccgcgcggctccctcccccgcacggggcccgcgcccggcccgccgctacgccgctacgcgctactctcgctactacgcccggcctaccatactatggatacggacgctatccagacacccacgaagacacggaagacacgacaacaatataccaaaaattaaaaaaacaagaaacaaagaaagaagcacaacaaaagaaaagaaaaacaaaaacagaaaaacgaaacacaagaaaagaaaaaaaccgccacctacagaaaacagaagacaaaaaacgagccgcacacacacaagataaaacgcaggaggatggtagcaaaataaccaaccggagagaaagaagcgagggatacagccaaccgaggcagcagaagtgcagagaacgaagagacataaccggcgaaggaccgagaggaagaacaggaacccgacaccaataaccgagaagacacaagcgacaagagcccacacacaccacggaacaaaatcaagcacaagcaacgaataaagacagccacgaatgcggaggaaaagagacaaggacacgcagaaggacaaccaccaccaatgagagcaatgaggggacaacggagaaccacaaccagacgcatagagacaggacaaccacgcaataacaccgaggccgacgagcgagaggagcgagccaacaagagcacagacgagaacaaagagcccagaagagagagaaaaggacgagattcgagagccgcagaccgaacaactgatagacggtaggcgcagacgagaccaagaagcgtaaagaacgccgaaacacaaaaacagccaccataataccaagaaatcttcagaagatagaggcagcaacaggaccaacaacaaaacgacaagagcgggcaggggtaagaaaaccgacatggaacagacaagcggagtacagcaggagagcctaccaggacccacacaaagagagaacgaagcatcggagcaaactagacgaatagatn

SEQ ID NO: 683446 - DNA, 236 bp, Homo sapiens
cgtcaaggtagtaccaaagtattaggattacaggcatgagccaccacgcctggccaaaatgtatgtatgtatgtatgtatgtatgtatgtatgtatgtatgtatgtatgcatgcatgcatgtatgtatttatttcagacgaagtctcactctgtcaccagcgctggaatacagtggcgcaatctcggctcatctgctgccctccgctctccttgggtactacgcatctggcagggc

SEQ ID NO: 683447 - DNA, 247 bp, Homo sapiens
gggggggggggggtttttttcccccccccaaaacagccccccctttgggggtccccccccgggggaaaccccggggggggtcccctaaaacccccggggggtccccccccggggggccccccgggggggggtgggggggggtttttaaaattttttttttggggggggggggggggggccccccccctttgggggtttttttttttttttttttttccccccgggccccccccttttttttccccca

SEQ ID NO: 683448 - DNA, 659 bp, Homo sapiens
  misc_feature (236)..(236): n is a, c, g, or t
  misc_feature (352)..(352): n is a, c, g, or t
tgccagagcctggagtctgcgaaggccgggacccggttccccggcccacaggtgggggtgtgcaaacccgagagaactgggttgcaaattcgtgaagaatcagcatcatgtttggcagctgagtattggagccaggagcctgccatgaggtttgagaacagagtgctgttttagagctggcagcagcatctcagcccaagagaaggttatattcccagaggatgtcagtcccaagngaccagtagctgccatcagttggattctgaaaactaactggcatcaacactgggtgtagaaacatgcttgccttatgtatcagaggacatgctcagcagatccaagagatatattnggcaactttttctagaaaaggcacattgggtatcattcattacattcttgagttttttgggtttgttttttttggaaacagctgggtgtatggcccaggcgggagtgtgggggaaaatccacagtcaatggaatcctcaatcacccagggcctaagcaatcctcccacctggtagctggggactacagctcacagcacaccgggtaacaatttttaaagggggagagggatctctaggtggccagggggtctcaggatcgggggctcagatggcctccggctcagttcaagggaaaggccaagtggc

SEQ ID NO: 683449 - DNA, 345 bp, Homo sapiens
  misc_feature (202)..(202): n is a, c, g, or t
  misc_feature (289)..(289): n is a, c, g, or t
agactcgatgcatgtgagatggcatgaagatgtagagacgatcgagaagcgcgacagtcagctggcccatagctgaggtacgctggtagtgacactgtaaaaatatctggcggtgcatggtagagtcagacactaggcatacagcgagatgtcctacagtatatttgacaggtgcacgggcaatgtggaaactgtaactggncttttaaggaagggtcagaagagggctgctctgccagcccagagctagcagggaccacgatgcccacttaactgttttttctttttntcggacagagtcttgctctgttgcccagggtggagtgcagtggcaccattcttgtg

SEQ ID NO: 683450 - DNA, 272 bp, Homo sapiens
gcctgcatggcatcagactagccactcctgccaggccgccgacagggttcttctccaggtagactgcaccatgctgacatgctgctactgcacctcgagtgtcctcatggagaacccagggaacagctggtgctaattcagaactgagcgctcgcattgtgggactgccttacaggactctgtggctttcagccaacatgtcaccagaccactgctgtccgatcctgatgctcgctgcaccggactgatagacggattctggttgcgtactc

SEQ ID NO: 683451 - DNA, 1080 bp, Homo sapiens
gaagcagagtgggtgacgtcctggcttctggagcgtggatgtgttctgtctgtgccatgcgcactaacacaatgagaacttacactactgggatgatagttgacgcaacagtgcaacgaagcattctttatatatgcaagtgtatcaccagctgctctatcaccgctctgacacacgcggacggcaacgcacacagactgcgcgccaacactctaccactgcgctacatctatctgcggagcgagacacgcactagcgactcacgctgccaccctgcgcactacctcactctaccaactaggcttgacactaaatcaaggcacatcaacacacgagacaactcactacatgcgtgagcaccgcaccgtgcactactataccactcgacagttgtcgtcacgcactactcactgcgaccgaaaatccccccaaaggcacaccgcatactcatatcaccacattgacgaacaacacgacacagaccactgaactccctcatctggcctcagagacacaccttctacacgcacactgcacacagcgcaccctaaacacagcagcgccaagcacctacacaccttactcaccatctatatccctccacaaaacataacatgccctttaaccataacaacttggaacagctacaaccatacaacatattgtaaccaccactcttgcaccactcttcattcatcctaacatctcaccacacacacacccacccacacacttgaatcatcccaattgcaacctatatcacttcaaacatgtactggtaacaccaatccccctaacaaacactacacactacttcaattaccacaacccacacgcaaacctctccaacgaaatacccattgacaaatatgcatccttcgacccactaaaacataaatcacaggcatcacagcacccaaccctcaccattgaatcttcctacaacacacctctcacaccaccctgcccgctatgtactgtacatcacaacagcaacactaatagccacccaacacctcctcctcccacacctctacctaccatacagcatttcacccttcccaacaatatccaacacta

SEQ ID NO: 683452 - DNA, 313 bp, Homo sapiens
  misc_feature (235)..(235): n is a, c, g, or t
  misc_feature (258)..(258): n is a, c, g, or t
  misc_feature (285)..(285): n is a, c, g, or t
  misc_feature (301)..(301): n is a, c, g, or t
atatttggatagataattcaaaatagccattttgaagaaactcaacaaaatcatgttgataacagagaagaaattcagaatcctatcagataaatttaacaaagaagttgaaataattaaacagaaccaagcagaaactctggagctgaaaaatgcaactgacatactgaagaatgcatcagagtctcctaacagcagaatttgtcaagcagaagaaagaattaatgagcctgangacatgtattttaaaatacagtncaggaggctaaaaaaaaaagagagagngaaggcggccgctgtncgcgcggccgcg

SEQ ID NO: 683453 - DNA, 466 bp, Homo sapiens
gtaaatcgtatgtagtgagtatgtattataatatagtgtgtggggtacgacggaacttgtttacatagtgctagacagcaggcactgaatgatatcgactgggaggaaaagaaatgctattgtgaggagatgaaggttgtatgatgatcactattcaggatttaccttgttcagaaagctgtgggaggcaaccacgtactttagttacggaacagctgtctggagctatacctctatgctgtctgatctcagccgaaggtcggtcgctgatttttacttatgtctaagtgcatatggtatacaactagcatctcataactccaaggtcttctaatatgagcagctggtttctctttagttagccctaagaggcctccgaaataagtcctaaaagtcccccaaataagaacattcctctcctgaaaaaaaaactttgttgacccgaaagtattatatacttctagca

SEQ ID NO: 683454 - DNA, 170 bp, Homo sapiens
gagaggagaaaacttcagctgccacgatcgatctttttcaagtgtcaaggaaaatggagcataggagagcagccccacaagcagcgtgatgggcacatagagccgacgcatgtgccaggtcctagatcagagtaacttcaccatctcaacacaataaaatggtgatatga

SEQ ID NO: 683455 - DNA, 169 bp, Homo sapiens
acgtaccacctgtactccctgcgctgtctgcggaggagaagtgtctggccagcacagctatcccctacggcaccgattacgatgtgcgggtgctactgcgcttcccccagcgcgtgaagaaccaggtcacagcagacttcctccccaaccggccaaggaacaactggga

SEQ ID NO: 683456 - DNA, 95 bp, Homo sapiens
ggggtcgagccacatggaagggggtgcgtacggagcgggcaaagcggggggccttcgacccctacaccctggtcggcagccgacacgacctggat

SEQ ID NO: 683457 - DNA, 639 bp, Homo sapiens
  misc_feature (448)..(448): n is a, c, g, or t
  misc_feature (557)..(557): n is a, c, g, or t
attatcggcacctcttcaacaacgcggggccccatattctttgttgttcgtgaacccgcgcactcttatattaggttccttttctgctcctgctgcgcagtattctacttcatgtgtagggcggctctccgcaacgcactctcctagtctactctctgctggtgccctcgacactgattttctgggctctatttggtggggtgtcacgaccgaccaccggcccccctccgcagagtatagtccctccacagggctctccctcccctgaaggaaacacaacactgaggggtgtatttatcccctctctggtcggaccgtctcatcgaatccgcacacatctgtttctagactctcactctctgatgcccctcccctctcacagcggggggccgacctcgtgcttatcctctcagacatatacaggtcactctcttctggcccacgccgngcgattgatgcccctccaagcagagtgcgagcgcacgccgccgagtgaggcagaaggcaagacaaaccgcgacgcgccccctagggggtaagacacacgacaaacccanggcgcccgcagagggggcattggccccagaataaaaacacgcactcttttttctgccacaacaaaagccaagacgaaacaaa

SEQ ID NO: 683458 - DNA, 178 bp, Homo sapiens
  misc_feature (145)..(145): n is a, c, g, or t
aacacatctcaaaaaggcttttcaaaatcaaaattatggccaggatggtgtaatcccagcactataatcccagcactttgggaagacaatgcaggaggattgtttgagcccagagtttgagaccagccggacaacatagtgaggnttgtctctacaaaagattaaaaaattaaccacc

SEQ ID NO: 683459 - DNA, 456 bp, Homo sapiens
ttctagaggtcccggtgtccctttgtctcaaaatgtgtaataaatgccttccgtgagccaggcaccatggatcagcagtacccatgatagatgaggctctgcttgcatgggagagccagagaataaacagataaatgaataaacaagaaaagaccagatgagagtggctttaaagccaataaaacagggaaatggtgaatggagcaacgggggagaagagtcaccaaagtcagggaatcatggaagccttccccaaagaggtggcatttgaactggggcctgagtggtgaagcagccagccatgggaagggtttggggaacaggatatgcaaaggccctgtggtggaaacaagccagctgtggttgaggaacaacagcaaggcagccagtgtggctggagtggagtgagcagggtgggccaggggtgagggagaacaggccagacaaagggaaaca

SEQ ID NO: 683460 - DNA, 195 bp, Homo sapiens
gctcgtccgcagttatcatggtaccccgatatgatcgggcacacatcgggtgcatgacggcgaagcacgtccggtttcgtgaccgaatcgatggttgggcacacgctctgatagtctccccgaccagtgaccttcaagggtcgcgttaaggacgataagaaggcgcgcatgtgctgacgagagggatctgattca

SEQ ID NO: 683461 - DNA, 423 bp, Homo sapiens
aaatctctgatcagacctcaaattttccgggtcttaaaatggcaattctaaccacaaggttaggtgactagataagcgggtatataatttcctcgtgtgccagcatctgtaaaagatattacatctatccggggcaccgtcactccgatatatattggtaatagatctgattatatgaagtgtgaaagtcaatatgggtaatattcctttaaatgcattttaagaacaaacagcacttaaatgattgggggcacaacagggaaagggactattttaaggtaaaccaatattaaatcagcgtatgatgaggtagagtgctgaaactgtgaaaccggataatttagaaatggtacatgctttaattcaaaacggtaaagaggcaccaattaccctagttggctggaatcacagttcttatgaata

SEQ ID NO: 683462 - DNA, 82 bp, Homo sapiens
ggcccaagaggcggcctccgtgtgcagcgggttgctggggccacgggtgctgtccgtggagccgagagatgccttgcgcttg

SEQ ID NO: 683463 - DNA, 900 bp, Homo sapiens
gcagcgacatgctatttaggtgttgctcgcatccatattttcgtcacgacaccactgtaactcaccccctcctgatactgcctaactgggtcctagacctaaaagtcatggataggcctgaaggacctactttgtccccagtgataccaactgatcatcggaacaaggatgacatacgtaaccatctcatgataattgagatctgtcaccctactagaatcctacactttacgtctaatgacatgatttcagaccgagccgacaagtcaatggtcatttgcgatgatctatatcatcattctttctgtacgaagacaaccaccactgtgatcaccacagcgttgtgaatgaacaaggcctacaccgcatcgaggcctaacctaagcccccgaataagccgtggagagtgaagttaccattaggtcctcattggcacacgcttagtcagggtctgcggggtccccttactccattctgtcatcatgatgttacgacatcacaaccatcctatgtgattgtacttatatagattctgacatcaattcccttctcacttgcccgaagtaattgatccacttaccttgagcccaaccaaccttaataatcgactagccttacgatcgaagtacgcttcttaatcagtaaagatacctccttgtacgggactccaatttatggacgtccctcaacgcccatgtcggacagccccgcgcatcgcctgggtcaactaagtcccttgccgggagtacatctcaaagagctcagggcggcctatcgcgtatacatacgcctccacagctcattctcaacgcccttgacaaaccccacattagggctaaccccttccttgttactagtgcctaatggaaggcagtaattataaccgaagccccacctgcc

SEQ ID NO: 683464 - DNA, 569 bp, Homo sapiens
  misc_feature (39)..(40): n is a, c, g, or t
gagaaaaggagaaaggagagcgagcgataggaaggcaannacaaggagacggacaggatggaaagcgagggacgagggaaaagagagggaggggaggaagaggaggaaaagaggaaaggggaaagagggggaaaaggggagaagagaagggaaaggaagggggaaagggagagaaaaaaggggaagaggaaggggaaaaagaggaaaaaaagaagaggaagaaggaaagagaagagaaaaggaaagaaaagaagagagaaaggaaaaaaggaaaaagagagggaaagggggaaaaggggaaagaaaagagaaaggagaaggggagaaaggaaaggaggaagagagaagagggaggagaggaaggaagggaggagagaggagagagaaagaaggaggggaagagggaaagagcggaaaaggggaaagaaaggagagagaagaggaagagaaaaaggagaggagaagaggagggagagaaaggaaaagaaagagagaaagggggagagggagagggggaagagaagagaggagagagggggaaaggaagcaaaggggggcagggggggagg

SEQ ID NO: 683465 - DNA, 259 bp, Homo sapiens
  misc_feature (193)..(193): n is a, c, g, or t
tagcttttactgcaacctaggaagaattggtgtgatcacaacagagagaggcaccctggatcttttgacgtggttcacgtgaaagatgccaatggcaacagctttgccactcgactttccaagcattttttgttatatggcaacgggcaacaaatccatggtagtttctcttccccgcaggaaatggatatcncgcctcaccatttgcgtgacagagagacgacaaatagacttggcggtacaaagcttgaggtaccga

SEQ ID NO: 683466 - DNA, 1019 bp, Homo sapiens
  misc_feature (1)..(1): n is a, c, g, or t
  misc_feature (82)..(87): n is a, c, g, or t
  misc_feature (135)..(135): n is a, c, g, or t
  misc_feature (176)..(181): n is a, c, g, or t
  misc_feature (200)..(201): n is a, c, g, or t
  misc_feature (205)..(205): n is a, c, g, or t
  misc_feature (210)..(210): n is a, c, g, or t
  misc_feature (304)..(304): n is a, c, g, or t
  misc_feature (319)..(319): n is a, c, g, or t
  misc_feature (326)..(327): n is a, c, g, or t
  misc_feature (344)..(344): n is a, c, g, or t
  misc_feature (349)..(349): n is a, c, g, or t
  misc_feature (353)..(353): n is a, c, g, or t
  misc_feature (357)..(357): n is a, c, g, or t
  misc_feature (409)..(409): n is a, c, g, or t
  misc_feature (411)..(411): n is a, c, g, or t
  misc_feature (423)..(423): n is a, c, g, or t
  misc_feature (447)..(447): n is a, c, g, or t
  misc_feature (457)..(457): n is a, c, g, or t
  misc_feature (459)..(459): n is a, c, g, or t
  misc_feature (463)..(463): n is a, c, g, or t
  misc_feature (899)..(899): n is a, c, g, or t
  misc_feature (904)..(904): n is a, c, g, or t
  misc_feature (948)..(948): n is a, c, g, or t
  misc_feature (1009)..(1009): n is a, c, g, or t
natcttctcctttaattaactcatcaacctctcatggcaagaatttgaaaaagtaaatttatactaaggttctaattttaannnnnncggcagaggttactgctcagtgcaccatgaagttgagacagagttggngacacctcagccccacctctctggaacaggaaagatgattnnnnnnggggcacaggtcagcgtgnnttgngggtnatggtggacatgggggtggggtggtctccccacctcctcacattatgcctacacgaacacagacacatgcaggtgcctttgcagaaacaaagtnagggttcttcaagtnacaattnnttggtttggtacaactnttgcntctnagtnccacacaaggtagctgtttcacactttacaagctgtgagggacacatcagancnctgggcactgtnactgcttgcagcctgagtgttctncctccttttntntctnagctcttcctcctccacatcacggcagcgaccacagctccagtgatcacagctccaaggagaaccaggccagcaatgatgcccacgatggggatggtgggctgggaagacagctcccatctcagggtgaggggcttgggcagaccctcatgctgcacatggcaggtgtatctctgctcctctccagaaggcaccaccacagccgcccacttctggaaggttccatcccctgcaggcctggtctccacgagctccgtgtcctgggtctggtcctccccatcccgctgccaggtcagtgtgatctccgcagggtatgaagcccagggcccagcacctcagggtggcctcatggtcagagatggggtggtgggtcatatgtgtcttgggggggtccgtgcgctgcacgtctccttcccgttctccaggtatctgcggancactncacgcacgtgccaaccaggtaggctctcaactgctccgcctcangggccgcctcccacttgcgcttggtgatctgagcggcatgtcggcgcggtccaagagcgcngtctcgttca

SEQ ID NO: 683467 - DNA, 963 bp, Homo sapiens
gtccctctcgctcggggttcgtcgggtgggttaactcgcggttacaccctgcgtgtcgataccctgtcgcaccggcgtcgatggcccatctatcctgggacagagcgctggtgatgtccaggatcttagctatccgtattagcatcgagtcgtaacatgaattagtgtgtgatattcttcgatgatcggttatcatttgttgggggaagcagacgcagcgaagtccctccgccaagacgatttatgctggcaccatcacggattgctgcgcattttcgccagctgggtggcattgagctgcatggtgggtaatacctccgtgttgcggcaagggctatcacagtgaggcctcatgaaataccagcgagatctgtggaataatgctgacttgatgtcgcggggggagagtggagctaaagtctatcccacaagcggcgaacgcttacattttattcatgggaccagtcgttcgcctggagccaattaaaggagctcacggagcatggtcaggatatcatacagaagtccacgcctgaagcatcccatctgtagtccagagccccatctatgcgggctcggggccaacggtggctccatgaaaatggtagctgcagtgtactccgacggatgtggtctctgcgaaggctgctccttaaatcctctcgtggactccagtttcttgttctgtacctgtgaacaatgcccgttgtgcatacgtggacactggttgatgtactctgctccctccactcccggtccctctatagtgggcggggcgtccagcagggttttttgcctggttggcatctacctacttttcaggatgtttcgggtgccgaactgggtctcaggtggtcagcctctcgggggggtcggccttggtggacctggaggttgccttggcgcccgacgggttgtgggccgcccggttctgcccgggcaaggggccgcgcgtttttgacc

SEQ ID NO: 683468 - DNA, 858 bp, Homo sapiens
gcaaaactaacccccgtaataaaatgaacttaacctcacttcattcatcgatgctccccacccgatgcaacatctcctgcattgattgaccccttcggttcactcctcggttgcctgcctgatcctgccaaatcaccactaggaatatacctagccatgcaacttacttcatccatgatcgcctcaagagccgccatatttcattcatactcagcccagctatcatcttctgagagacgagtataataaaatggcctgatactcattccgttagccttcacgccacaatgactgcctcataatattggtcgttgaatcttcgccttgcttgtctctatcaacactcggtgcgacggcgcattctaatttaactggactcatttgtctctttactctagaaaccctgaaaactatctggacattatctctcctgccttgctacatattgcaaccaagcacttcaaataggcgtgacgtcctacccgatgaggtctaagatatcatttcatagcaggggtccacaagtgaatgaacaaagactttactattcgatgatccctattaccattgatgacgacgcaaccttaattccatctgaactctggacgagtacagtctacctgcgagttaagacatgcttccaaccgtcacaacgatatctttacctttcacttcatctgtgccctatcattgcattgcgaggccctagcagtgactccagcctccgtattcttgcgcgaaaacgggggatcaagacaaccccgtaggaatcagctcccattccgatgaaatcacttacaccgcttactacggaaacaaagaagccctcggttaacttcgtctgcttcctctccttag

SEQ ID NO: 683469 - DNA, 404 bp, Homo sapiens
atcacactcacgatctcacagactcactatctcactcactcataatctcacaatatcattcactcacgatctcactcaaaatctcacagactcaaacgatctcactcacgatctcattcactcacgatctcactcacagtctctcacgatttcactcatgatctaactcacgatctcactcattcacatacgatctcactcacgatctcagtcacagactcactaactcacgatctcactcatgatctcacaatctcatgatctcactcacagactcactcacgatttcactcacagactcactaactcacgatctcatgatctcactcactgactcactcacgatctcactcactcggacacaatcagttaaatttacaaggggatttagagggttctgtggg

SEQ ID NO: 683470 - DNA, 720 bp, Homo sapiens
gcagcgcagcttcgtggagcatgagtgctgcatgtgactgcatgtgcaatgctggcactggtgcacctggcctgaccctgggaaatgcctggggtccccggttgtttgcatgctccctggagctccgtgccggctggctccaccttgcgaaatgagatcccgtgaggtcctagtggacccacgcatgcctggctgtgctgctcatgtgctgtgtggcctgctatttttgtggcaatggtgcgtgcgttttgccaaagttgcttcgatgatctctggactgcggacaccaatggatggtgttctgctgggcaagatttgtgcctaagtctctgctgctcaatgcctgcaaccatgatgtggatgaagatgtccatggaaatatccattcacctgcagcctctgcccaccagcactgtcagtagtgattccactggctttttctgatggacaactgacttctgtgttcgtggtgttggatgctctgcctgccggaggtctctcctgtgatgctgcacaatgagtgatgtgaaatgccctgactgatgcctgaggccctgatactacctactggcaaattgtgcttgtgctgccagtacctgcaccgaaacctgagttattcatcgagacctcaagcttgggcaaccttttcctgaatgacgatctggcaggtgaaaataggggacttttggacttgtcaacaaagtcgaatctacggggagg

SEQ ID NO: 683471 - DNA, 286 bp, Homo sapiens
aatgcccagttcagctatgcctggcttcaaaggagagggccccagcttcccgaggtggagctgtcagtttccacaaagaatagagtatcaggcctttgtatgttgtcatatttattatacaaaacatcagccttggcgtgtgtgttcctatattaactccaaagggaaacacaccgactgcctcagcaatctatgcaaagaccttgcctggcccggtggcaagcgctgaaaataccgaccgcctgtaggctcctggaactatacagattggttaagagttccaagt

SEQ ID NO: 683472 - DNA, 391 bp, Homo sapiens
ccatggtttgaccaaaaaaaggggaaatggggaggggaaaagggtgggattgtccagcatgcttgtatgtatatttcagaaccttttttaaatgtaaaagctggacatttctgggaagttctgaatttcttttgtttccttttttccttcaagcattttgcagtgagctttttttatatatagccacccatttggaaggaccccaaaatatgggggagttcctttaaaaaaataactccagtatagcgctgggccaggaccctaaaagactttgataaaaagaaaccataataaaaggccccccttttaaatgtcattcatatatcccttgtggatgagggctaaaaacttttccccccttttttagagggattaattattgaattactga

SEQ ID NO: 683473 - DNA, 233 bp, Homo sapiens
gacctggggctttccagggcccctgggttgaggctgggagagaagggcgaacgtggacccccaaggccctagcgggatcccggggtgtgctgccaaggggttgctggacgtcctggagccgaagggtcctgaagggccaccaggacccaactggtgccggccaaaggagagaagggggagcctggtcgccctggggacccttgcaagtggtgggacctgctgttgctggaccc

SEQ ID NO: 683474 - DNA, 151 bp, Homo sapiens
  misc_feature (43)..(43): n is a, c, g, or t
  misc_feature (109)..(109): n is a, c, g, or t
agaacacccgatgattcagaatcgttccgaagtgctatatttnttcgactgctcagactgtacccctcaagtgatctgccctcctcagcctcgtaaagtgctgggattncaggggtgagccgctgtgcctggctggccctgtgatatttct

SEQ ID NO: 683475 - DNA, 104 bp, Homo sapiens
aatgcagttaatacagactcagactctggaaaaaatttttaaaaccaggaatagtaggcttgacctaccagtacccagctactcaggaggccgaggaaggaaga

SEQ ID NO: 683476 - DNA, 753 bp, Homo sapiens
  misc_feature (573)..(573): n is a, c, g, or t
aggccggggagcagccgaccgtggagccccagaaaatcatgccaccctcaaagcctcatccacctgtcgtgggcaaagtgactcatcacagcattgaattatactgggatctggaaaagaaagccaaacgccaaggacctcaagagcagtggttcaggttctcgattgaagaagaagaccccaaaatgcacacttatggtatcatttatacgtaggtgcagtgttgaattgcttgccactttgccttacttcctgattagctggaatgatttctgttgtctctaaaaagccactgcttgtttcaaattaaagaatgagtcagcatcatttgtattcatgctcttttatgaattacaatttttggaaaataggcattagcagtaactttgaaattaaacctctgtacctttgagagcttctttgacttctgaaatattttaatgatatgtatttaaaatccagaatgtagagacagactcaaacaatagcttgatgcaattaggggaggcttccatcaagctggttggttcactgaccgggaatgggcccccatgggctacccctgctagcttntttgatctcatggataccaatgtcccctgggaactcttttatccacgctgggtggctttaacctgacaggggcaagtggttccatcgcaagatcttgtcgttggtgggggttgaaaacaatccttctgttttttcaaaggggtcttacacaaggccatttagatgaaaaccccccccccc

SEQ ID NO: 683477 - DNA, 150 bp, Homo sapiens
ggagctcggtacctccttctggccacgctcaggttgatctggcggaaactcattatggcttgaactgctgggtgcctagtgatgacgtgtgcgtgaggagtctttcatcggtggtaccgagacacataacgctagacgcttgagcgtact

SEQ ID NO: 683478 - DNA, 93 bp, Homo sapiens
  misc_feature (23)..(23): n is a, c, g, or t
ctagaggatccggcacattgtgngttggaggctgtggctgctggctgagggttctggtgtctgtgccagcccattaaagtgcagttccctcgg

SEQ ID NO: 683479 - DNA, 558 bp, Homo sapiens
acaaggtctcactctgtctcccaggctggagtgcagtggtgcattcatagctcgctgcaaccttggactcctgggctcaggtgattccccaatctcagccacctgagtagctgggactataggtgttagccaccacacctggctatttttattttatttctgtagagacagggtcttactatgttgccaaggctggtcttgaattcccaatgttctcttttagtagtttcatagtttcaggtgtcagatttaagtctttaagccactttgatttgatttttttatatggtgagagataggggtctagttcattattctgcatatagacatctagttttcccagcaccatttattgaaaagactgttctttccccaatgtatgttcttggcagctttgtcaaaaatgagttcattgcagatgtgtggattcatttctgaattctctactgttacattggtctatgtgtctgtttttataccagtaccatgctgattcgggtctctagttctacaataaacttcaaagtccaggcaatgtaacaacaacatacacaacag

SEQ ID NO: 683480 - DNA, 325 bp, Homo sapiens
tgggatggagtcttgctctgttacccaggctggagtgcagtggcgcaatctcggctcactgcaacctctgcctcccaggttcaagcgagtctcctgcctcagcctcccaagtagctgggattacaggcacataccaccatatccagctaatttttgtatttctagtagagacgaggtttcgccacgttggtcaggctggtcttgatctcttgacctcgtgatctgcctacctcggccttccaaagtgctgggattacaggcgtgagccaccacgcccagcctaaacttgtacttaaattatatattgatagcttattcattttta

SEQ ID NO: 683481 - DNA, 1090 bp, Homo sapiens
  misc_feature (608)..(608): n is a, c, g, or t
  misc_feature (610)..(611): n is a, c, g, or t
agcgggaccgcgagccaagggcagcggcgggccgggccgtgactcagtgaaagccgcaacggccgggcctcggaaaacggcgggcgcgaagccgccggggccggggcgagaacggcggcgggggctcaccatgtccttggacgagcccagcttcttgaggccgtccaggggcagcaggtcggcggagtccttgtggatgaactgcaccgcctgcttcatccggcgctgctgtcgcagtgacgccgcctcccgcatgtcggtctccttgcggccgccctcagtgaggagccctgagtaaaacatcgctgaggcgcctggcggccctggtagcccacagccccccggcagcctcagcctcgagctcctccagcgccgcaagggccccgagccgcgccttttatagccgagcgtgacgtcgcggggagcagccagtgcgcgctgcggggggcggggccggcacagagtccacgccccgcgcggctccctcgcgtcccgcgtcccgcgtcccgcgtcccctgctcacccggtggcaaagccggcgaggaggcggcggcgctggtggggactgacccggcagtccgagaatccaccgcggcttttcacccaancnncccctcctgcgtgggggccccgcatcccctggactggcgtgggctctggggcccgatgccctggcagccccggccatctctgccgctggccgcgggtacctgctcacctgtccacgccgtggccgacccggggatcaccgacagccgggccatgcctcgagtcccgccgcccgcgccgctgctcggcttctcagaaacgcacctccacgccgccagccggggctccaggtcaaccgcccgggcccggaggactggcgactccctccgaggttgggagcgctccggatttctccaacttcaggcagtgtggatggggctcatgaaatagagaaatatagaggaacaagatatgtgtgtatctccaaagagtttatggttcatgcagagtcaggcatcaatgatcacaactccagtcttcatgcagagcacgtctcttcaacagtattgcctgctctatacactaggaaacattatgtgga

SEQ ID NO: 683482 - DNA, 492 bp, Homo sapiens
acaatgccacaggaggacggtgttcgcctaccccaagaggaggaggacggtgccgggggctggggatgagagttcctgtgggactggtggatggcacccaccggcgcagtaaaaatggcaaagccactgagaggcctggggactcgtgtcagtgagcgtcttctgtggagcccgggctgagactcaaggggcaaaccacactcctgtaatatccggcgcatcaaactcttttgaaccaccacaacagcccgctgaagtcctgcccatggagcgagttcccaggccagaacctaggactcgacccactccagcttacagctccgggtgcaaattcctgcccttgatcctgtcccagtttctgccccagtacccatttcagccacaaatccactaacattctccctgtccatatcttgcctatactactacccctccttcagagattcctccttgtacttctcctggcagattgctcaggcgggtacgagatcg

SEQ ID NO: 683483 - DNA, 165 bp, Homo sapiens
cttacttactagcaactactaactccggtttgatcaatccccaaacagttacatttttctttacaaatccttgccctcccattatatataacaaactccggtttctcatgaacgtttagtacggttagctcttacagtgatcacattggccatcgaaggactaaa

SEQ ID NO: 683484 - DNA, 725 bp, Homo sapiens
  misc_feature (85)..(85): n is a, c, g, or t
ccaggctggaatgcaattgcttgaacccaggaggcagacgttgcagtgagccgagatcgcaccagtacactccagcctgggtganagagccagactctgtctctccaaaaaaaaaaaaaaaaaagaaagaaacttgtgtgtatgcacaaggagatatgtttaacactattttgcagcattgtttgtaccagttgagtatcctttatccaaaatgcttgggaccagaactgtttcagatttcaattattttcagattttggaatatttgcattatacttaccactttaacatccctaatccaaaaatctaaaatcctccaaagaacatttccttgagggtcatgcatattatacactcaaaaacgttcagattttgaagcatttttggtttggggattaggatgttcaacctgtattagtaaaacagtggaaacaattgaaatgtcagtaggacagtagttaactatcatattcatacaatagaatattacatagtagtgaaaatgaatgttatgactttcaaatattttacctacagtgagaaatatatttcataccatgactcaatatatatatgcttatatataatcacatacatatatgtatataggcattaaattgagtacttatgatacattttatttactgttctgttttttctaaagcagttcatgacctgctatattgattttctgtgctactaatgatttgaaacctacagtttga

SEQ ID NO: 683485 - DNA, 338 bp, Homo sapiens
tatttacaactatctataactattagaaatccagtctgtcctattcaaacagatcttagccacacacttcttcaaggagtatctcccaaggttccttgtaagtggatatataatttttctccattggttagtatagtattatattttcatctgtcttatagctctagtttcctatctagtacacagtagtaacatttatgtatatatcttatccctcctagattattttacctttgccttacttaaattttcactacctgtggaacttccacatactagacttctggatcaatctagtgatgtgtaaaaatatacattagtaattaccttattaatgg

SEQ ID NO: 683486 - DNA, 1280 bp, Homo sapiens
ctttaatttattaatgcaaacagtacctaacaaacccacaggtcctaaactaaaaaaaaaaaaaaaaaaaaaaaaaaaaaggggggaggcccttcctttgcccggggacgccgaactctctcaatggtatcaacaggctccttcgccctctggctcctggtcatgttccattattggggagccccagcagaagaatggagaggaggaggaggctgagtttggggtattgaatcccccggctcccaccctgcagcatcaaggttgctatggactctcctgccgggcaactcttgcgtaatcatgactatctctaggattctggcaccacttccttccctggccccttaagcctagctgtgtatcggcacccccaccccactagagtactccctctcacttgcggtttccttatactccacccctttctcaacggtccttttttaaagcacatctcagattaacaagagagaagaacaagaagacacaaaaacagagaaaagaaaaagaaacacataagacaaagaacaagagagaacaaagaaacaataataacaagacagaaaaagagacaacaagagacgaaagagaaacgaaaaacgtgcgcgggggcgccgtgcagagtcatggacggccccgtgaggggactccgaagccgtcagcatcccgggaccaccgcaagacactgcatgtgtgcaacaccaacagtgggggggccctccaacgtgccagagagagacgagtgacccaatagggaacgagtaggaggacgagcggagtcccgtagcagtccgcggtcatacataggccagagcaaggggaggaatgcatagagaagcggaacaaacaacggacccggtaagggaccgaacgcgaagagaacgagcgggaacaggaacgggcacaatcgctaagatagctcacttaacgaggtgaggaggagagagagtaatacaaatcgagggagcggagacaccaaacagagccacgcaatcaccatagaggtaaacctaaggcacacgcggtctccgacagccgacacctgagagaggagagaagccaaattgacaaggtcaccaagagccggagaccgactctcgtgggggagcagttcgatcgaccgaacccaaattgcaccgaggggctagactcgataatgggcaaaccgaaggggacgtcgcaagaaaaagcgcagatagcgataggcacagcgaaacaggatgcaaaaaacccacaatagagcaaagagggacgacacacaagaagatttaaccccgaaggag

SEQ ID NO: 683487 - DNA, 605 bp, Homo sapiens
  misc_feature (12)..(12): n is a, c, g, or t
  misc_feature (21)..(21): n is a, c, g, or t
  misc_feature (66)..(66): n is a, c, g, or t
  misc_feature (86)..(87): n is a, c, g, or t
  misc_feature (103)..(103): n is a, c, g, or t
  misc_feature (109)..(109): n is a, c, g, or t
  misc_feature (114)..(114): n is a, c, g, or t
  misc_feature (141)..(141): n is a, c, g, or t
  misc_feature (163)..(163): n is a, c, g, or t
  misc_feature (170)..(170): n is a, c, g, or t
  misc_feature (178)..(178): n is a, c, g, or t
  misc_feature (190)..(190): n is a, c, g, or t
  misc_feature (193)..(193): n is a, c, g, or t
  misc_feature (212)..(212): n is a, c, g, or t
  misc_feature (227)..(227): n is a, c, g, or t
  misc_feature (229)..(229): n is a, c, g, or t
  misc_feature (238)..(238): n is a, c, g, or t
  misc_feature (247)..(247): n is a, c, g, or t
  misc_feature (255)..(255): n is a, c, g, or t
  misc_feature (275)..(275): n is a, c, g, or t
  misc_feature (279)..(279): n is a, c, g, or t
  misc_feature (286)..(286): n is a, c, g, or t
  misc_feature (291)..(291): n is a, c, g, or t
  misc_feature (294)..(294): n is a, c, g, or t
  misc_feature (300)..(300): n is a, c, g, or t
  misc_feature (303)..(303): n is a, c, g, or t
  misc_feature (312)..(312): n is a, c, g, or t
  misc_feature (364)..(364): n is a, c, g, or t
  misc_feature (373)..(373): n is a, c, g, or t
  misc_feature (390)..(390): n is a, c, g, or t
  misc_feature (403)..(403): n is a, c, g, or t
  misc_feature (407)..(407): n is a, c, g, or t
  misc_feature (412)..(412): n is a, c, g, or t
  misc_feature (420)..(420): n is a, c, g, or t
  misc_feature (437)..(437): n is a, c, g, or t
  misc_feature (440)..(440): n is a, c, g, or t
  misc_feature (446)..(446): n is a, c, g, or t
  misc_feature (453)..(453): n is a, c, g, or t
  misc_feature (461)..(461): n is a, c, g, or t
  misc_feature (470)..(470): n is a, c, g, or t
  misc_feature (473)..(473): n is a, c, g, or t
  misc_feature (504)..(504): n is a, c, g, or t
  misc_feature (530)..(530): n is a, c, g, or t
  misc_feature (556)..(556): n is a, c, g, or t
tatggggccaantttaaaaanttttatttaaaaaattgcattttccacttacaaaacagtgtttanaaagggcaatgttatttccnncccccgtgcatatgtnccaaantcaantattgagaatgcccagtaacttactanagcagcctaactttttaaaacngccacanaatttgcnacgaatttaggnccntcaaatgttttaaatgtgnggaacaatgccacancnacacttggntggcttaancaaccccntcaatggggggccccgaggnagcnccaccanagggnggngccccnccnccaggaaancccccaggcattccccccggcatgcctgtgagttcaaacttgccaagcaggntgttatccnttgtcatggcacgcccnccttcaaaaaccngaanaagcncaccaggntggttgtcagaataggnagngaaggnctgtgtntgcttggnaggaatggnggnattacgcttgaagaggacagtaatgactccnccagcagtttcaaaaccaagggaaanaggagtgacaaccaagagcagcaaancttgaacattctcagacttgtctccagacaagaaggctgcctggacagc

SEQ ID NO: 683488 - DNA, 935 bp, Homo sapiens
tataaaaatagctctgttaccggaaataactgttcatttttcactcctccctcctaggtcacacttttcagaaaaagaatctgcatcctggaaaccagaagaaaaatatgagacggggaatcatcgtgtgatgtgtgtgctgcctttggctgagtgtgtggagtcctgctcaggtgttaggtacagtgtgtttgatcgtggtggcttgaggggaacccgctgttcagagctgtgactgcggctgcactcagagaagctgcccttggctgctcgtagcgccgggccttctctcctcgtcatcatccagagcagccagtgtccgggaggcagaagatgccccactccagcctgcatccatccatcccgtgtcccagggtcacggggcccagaaggcagccttggttctgctgagtgcctgcctggtgaccctttgggggctaggagagccaccagagcacactctccggtacctggtcctccacctagcctccctgcagctgggactgctgttaaacggggtctgcagcctggctgaggagctgcgccacatccactccaggtaccggggcagctactggaggactgtgcgggcctgcctgggctgccccctccgccgtggggccctgttgctgctgtccatctatttctactactccctcccaaatgcggtcggcccgcccttcacttggatgcttgccctcctgggcctctcgcaggcactgaacatcctcctgggcctcaagggcctggcccccagctgagaatctcctgccaggtgtgttgaaaacagcgggcactttgcaaccgtgggcccatgcgccctggcactgggacaatattaacactcgtgaatatctgcagggctgaatcctggcccaagagcctaccaagagcagcgggagttctgacacctcaccagtccagcgagttacaac

SEQ ID NO: 683489 - DNA, 808 bp, Homo sapiens
tataaaaatagctctgttaccggaaataactgttcatttttcactcctccctcctaggtcacacttttcagaaaaagaatctgcatcctggaaaccagaagaaaaatatgagacggggaatcatcgtgtgatgtgtgtgctgcctttggctgagtgtgtggagtcctgctcaggtgttaggtacagtgtgtttgatcgtggtggcttgaggggaacccgctgttcagagctgtgactgcggctgcactcagagaagctgcccttggctgctcgtagcgccgggccttctctcctcgtcatcatccagagcagccagtgtccgggaggcagaagatgccccactccagcctgcatccatccatcccgtgtcccagggtcacggggcccagaaggcagccttggttctgctgagtgcctgcctggtgaccctttgggggctaggagagccaccagagcacactctccggtacctggtcctccacctagcctccctgcagctgggactgctgttaaacggggtctgcagcctggctgaggagctgcgccacatccactccaggtgactcactgcagtacccagggacggggtatccaacgtgtgtcactcccttgatgcctagccctgcccctccttgaacctctctggctgagctgggctgggggctggggtctggggtctggctgtcactcacatcttctcgggcaattaaagtatgtatgttctgttcatgcttgggcatgtacgtatttctctggctggtcccttgcaactttctgacctttatattttttagttctatcttctcta

SEQ ID NO: 683490 - DNA, 2089 bp, Homo sapiens
aacgtacaggcagggggaatgtctcttccaaggttgctaaaagtaaacatcagaacatatgataattccattccaatcagtgaatcaagcagaaaatcatggaatcaaaaacactttgctttgacatttcccaaaccactccagagaggtacaaatgataaatcaagacctttgaaatcacaaataacagttactagacatgacaaaagaaaactagaagaaggccagaaaccagctcataaatggataaggcattctttcagaaaaattttgcaatggccacccatttacacagctgccagggaacagactccattcagacatctttatacttccaaaacccatcttaaaaaagcagaatataaaaagtccaaagatgaaaaaggaggaacacctttgaagaaagattccaagaaaaaaggaggttcatatgcaacaaatccagaatccaagcaaatagtagaagagaaaactaaaagacaaaatgaggcagataaaactcccttaaaatcatcacatgaaaatgaacaatccaagaagtcaaaatccagttcagaaactaatccagaatcccaaaattctaagacagtctcaaaaaattgttcacaaaaagataagaaagattcaaagaattccaagaagacaaacactgaattcctacatacaaagaacaatccaaagaaagatttgaagaggtcaaagactagtaatgatcccatatcagagatttgctcagaaaatagtttaaatgttgatttcctcatgttagtgggacagtctgatgatgaatccataaattttgatgcatggttaaggaattactcacagaataattcaaagaattattctttgaagtatacaaagtatacaaagaaggacacaaaaaagaatgcaaagaaaagctctgatgctgaatctgaagactcaaaggatgctaagaaagattcaaagaaagttaagaaaaatgtcaagaaagatgacaagaaaaaggatgtaaagaaggacacagagtctactgatgctgaatctggagactcaaaggatgaaaggaaagatacaaagaaggataagaaaaaattaaagaaagatgacaagaaaaaggacacaaagaagtacccagagtctactgatactgaatcaggagatgcaaaggatgcaagaaatgattcaagaaatttgaagaaagcttcaaagaatgatgacaagaaaaaggatgcaaagaaaattacattctctactgattctgaatctgaactggagtcaaaggagagtcagaaagatgaaaaaaaggataaaaaagattcaaagacagataataaaaagtctgtcaagaatgatgaagagtctactgatgctgactctgaaccgaagggagattcaaaaaagggtaaaaaggatgaaaagaaggggaagaaagattcaaagaaagatgacaaaaagaaggatgcaaagaaaaatgcagaatctactgaaatggaatctgatttggagttaaagaaggacaagaaacactcaaaggaaaagaaaggttcaaagaaagatatcaagaaggatgcaagaaaggacacagagtctactgatgctgaatttgatgaatcttccaagacaggctttaaaacatctacaaaaatcaaaggttcagatactgaatctgaagagtcactatataaacctggggctaagaagaaaattgatgaatcagatggcacatctgcaaattcaaagatggaaggactggaatcaaagagaggattcagaatgtcatccaaaaagactacattcaatgaaaaaggggaaaaagcaagtacaggtagagttcctccatcaagagaaaaaccaccactccctgcttgtgagccttctctaccatcaccaaaggtcagacgtctttgttggtgcaagatgcctcctccacctccaaaaccaagatatgctcctttgcctgaagcaccgtggattcataagctgctttaaagaacaactgagcacttggtttcacagaatggccttaccacagtaagcaccacctactctcaaatgagcatttctacctctgtggaactgaaataaaaacaagtcttccatgaaa

SEQ ID NO: 683491 - DNA, 629 bp, Homo sapiens
cacggtgactcacgcctgtaatcccagcactttgggaggccgatgcgggtgtgatcacgaggtcatggagttcgagaccagccgtgtccatcatactgataaccccatctctgctgggaaacaatgatatcagaaaattagctggttgcgtggtggcaggtgcctgtaatcccagctactgagagaggctgggtcgatgagaatcgcttgaacccgggaggtggtaggttgcaatgagccgagtattgcagccattgcaggccggatgactagatgatgagactctgtctcacaataaaaagataccatcactgagataatggcttgtggggcacatcaaaatcatcaaaatagactgctccatcaatttggtctggacacgtggcgtccacatatttatattctatggtagcgatatgtgtcacgaatgtgaacccgcggacatcaagatataggtcgagagttgtcagcccttataaaatatacgccgggggaaaacccaaggtttctggaacaaatcccggggggggtccgagggcccaaaaaggggtttttatcaccggggttccaggggaggccccaaataaatttgcccctgggggattcccagaacaccgcgcaacagcgga

SEQ ID NO: 683492 - DNA, 1060 bp, Homo sapiens
gatgcgacccggatctctcctacggtcctcatcagctccatgtaagcttcttcacagtggtccgtgtgatttgtctgcatcctatgcgttgcctcgcagatgctcagatagactctgaaccattcttttcctctgattcgcgtttgcccggtagggcattactgtattgtgagtgcatcgcgaggacagtgatgagagtagccccttactttccctgtgacaatgcacgaggacatccctgatgttcaccatcaggcagtcggatcaaaatacttccatctgtctccgtcggcgacacgtgatgagtgcgtgccaatcaaggggacctgtgggggtgtgccctgcgacccgtatgatcgctgatcgaactgaattgtctgtagagcaaattgtccgacagtacgtcatcatgagcgccactgggttgcgagtagtgcacctcgcatggactcgaatcatgtgtctgtgcctaaataacatgtgggtgtcagagtagttgaggctggaggacctcgcacatacttgaccttacgcgtgaccccctggcaggggacagtgcccatgtgcgaagactaccgtgagctttcctccttcggtgtctgcctctcagtgagaacctgcgcactcatgtaccgtccccttgaggggtcatggggaactaacatatcgcttatgtagaagggtctcatgctccatgaggaagctgagcactttcgtgtctagtaactacgggcatcttatattgaatgcttttagaccagcgtacaatggcgaatagtttcttgcgaaaattgataacaaaattaaccttgttcttcggagcgccacttgtggaacacttcgtgacctaaagagttatcccagaaatcgccagcggaatgttagacgagttgccgccactctccccaatccagagaaccgaggaacaaaggtgggactttgtgaacctacatccatggaaaaaaacgcggacaccttttaacttacggagggagtaatcgcccccccattttggggatgcccctcggtgggggtactccctcctgggatttgggccccg

SEQ ID NO: 683493 - DNA, 343 bp, Homo sapiens
aacgtacaggcagggggaatgtctcttccaaggttgctaaaagtaaacatcagaacatatgataattccattccaatcagtgaatcaagcagaaaatcatggaatcaaaaacactttgctttgacatttcccaaaccactccagagaggtacaaatgataaatcaagacctttgaaatcacaaataacagttactcctgaagcaccgtggattcataagctgctttaaagaacaactgagcacttggtttcacagaatggccttaccacagtaagcaccacctactctcaaatgagcatttctacctctgtggaactgaaataaaaacaagtcttccatgaaa

SEQ ID NO: 683494 - DNA, 388 bp, Homo sapiens
tctttatcaatttgctcctaaagctcagaggagttattagtcaccttcggaagcttacttctgtcaattcgtcaatctcattctcgatccagttttgtgcccttgctggagaagagttatgatcatttggaggagaggaggcattctggtttatggaattttcagcatttatgtgctggtttttcctcaccttcgtggatttatctacctttgatctttgaggctgatgacccttggatgggatttttgtgtgtgggccttttgtttatgttgttgctttctgttagtgtttcttctaaaagtcaggcccctcttctgcaagttgctgcattttgctggtggtctactccagaccctcttcacctgggtatttccagtggtggctacg

SEQ ID NO: 683495 - DNA, 1424 bp, Homo sapiens
ggaactagtctcgagttttttttttatgtttatttgggcaaaaaaaaccttttaataatgagggggaaggggcaaaagggtgcaacccaggcaggcaggttgagggcaggacaatgccgccttcatagggctcctccagaaaaagcgtgtgttcaagcggaggacgttgggccggggaagggcccaagggctgcagcaacattctacacgaggggctcagcaaaattctccaggcggtttccacactcgttggcagacaacaagagggtggctcattgggcctcactcaagagctgtgggggtctctgccccgtggtgtttgttagggtgcaagtcttattttcccgtgccactttggcgcgcaggtgtgacccagggtcgtgctctgcgtgtgcgcgcacagtgtggcggggccactctgtgggggcctcctgcgagatgtgggccctccctgtgtggggactcatggggccctatatacgggagatatctctcctttgacaaggctctcaatctacaagtgtggggcaaatatctctccctctctgaggagggggcgtccatctcgaacaaggcgaggatcatctgtgccagtgaggggcgtcttgttatatgtggggccccccacagacacacaaagggccacaatattttctcacggggcggcggggacaaacggcggtcaccaggggaggggcgaccaccctgtggaggcggcacaagcatccacctctacacaaagggggttaggggggaggagaaacattacacgaggacctcctcccgcggaacacccagggagaggtgacacctataaaagatacacgcatcaacaaggggtgtcgtggtgggtgtttcccccaaaaagtgtggcgtccccccgggggaaaaaaagacgttgccagtgattcacccccgatcgaggagaacttcttttgagtagccgccggcggaaaacagattgggggcgccctcttccggtgaagatgtctcgcgcgaacaccccgagatgtggggccccccacctgttgtggggtcctcaccatgtggtggcccccgccggattcttgtggaccagcggggccgccagatcgcggtgtcatcacaacgacatcttccctgcggcgggggggacactcttgttgtcgtgtcaggcccgcaccacagcggggcaattctcaccaccgtggctgtgtgccacccggaggtggtccgcccccgtgggagcgaggcacacacttctggctggggggtagaaactccccttcccggggaaagctctccagcacgcgggtgttgccccccgtgttgggcgcaagaccttccccgggggcccctctttgttggcggcaggctgtggggggaacacctccgggggggagccccttcatgttgagaggggacaatcttccccctcttgggag

SEQ ID NO: 683496 - DNA, 792 bp, Homo sapiens
tctgagggtgaactgtgtcgctttgagaagttgtcgctgcgtgtagtccacccttcaccaagggtggtgccttgtacacttctggagtgggcttaaaaccagagctaaaaacggggagggcgaaatagtttatacttgggggatattctctccttcggtgatccgacacccgagtgtaccccgtctgttgtgtcaaggtacgacgacgcctgtgtacgacgcaactggttgtaggatcattaatagtgccacaacgcttagtactattgtggcccccagcttatcgcccatgtgaggatgaaggtcccgcgcggtgacagggtcttcttttcatcttgtgttgacaacgcacataatcatggtgggggtaagcaggggaatatatcgacgagtgtgtttgcacccccctgcccacatccgacacgaatctatgtacaggtcaggaactgactgctgtttatgaatagagtatgccgcacggtatggagctacaccacctatgggatggtgtcatccacacactgttagtgcccacacaaggtatgatccattggagggtttgtgctttagtccgcccctctctgtagtaccaagacacgctcgtcgagaagtcgcggctagctgtgatacagggggacagtaggtgcctgtttgcgccacccccaaagagcgcagttattacagcccggcggagaaaaatcccccacctgttgtacgattaagctcgggcgtaacaccccccgctaagagaagttcgtacagtagaacaccccccgccccccaaacaaaaca

SEQ ID NO: 683497 - DNA, 92 bp, Homo sapiens
ctaacacagagtttgtaatagttgttgtggacagtacagacagagagaggatttctgttaactagagaagaactctataaaaatgtttagcc

SEQ ID NO: 683498 - DNA, 210 bp, Homo sapiens
  misc_feature (27)..(27): n is a, c, g, or t
  misc_feature (54)..(54): n is a, c, g, or t
gctcctacccggatcacaaaagcgggncaaagaggagaacatttcttgtgacantctcgtcctggaaatcaactctctcaagtatgcctataacataagtctaaaggaggtgatgcaggtcactgagccacgtgtgtcctggagttcccccgtgcaacagtatggattcccctgcttgactccaagccgctttgtgtgtttccgggtacc

SEQ ID NO: 683499 - DNA, 903 bp, Homo sapiens
tataaaaatggagtttcgccatgttgcccaggtggtctgtgaactcctgagcttcagtgatccgcccgcctcggccttccgaagtgccgatcacaggtgtgagtcactgcccccgggtctccagggctttctaattccaagggatgcgatctggtttagagcctcatctgggtgactctaatccttatgaccagaatggtgcagggattctggactggcatccacactgggggaaatgtaacagctttagcctggggcacagaaggctttctcttcctggtgcttcctgaaccagaaacttcaggaccctgagggactcccgctggagggaatggaagcccagctcctaggacttattaacaaaaaaaatatggactttcagcatttatgggaggcgctcgacgcggacaagatctcttgaatacaaaacatcttatctggaaaagagactaaacaggccaaattgggcgacagggcacaacgacctcattatccaacttgggtcggccatgggaccacgtagaatcgggcaagtcccccattacttggccattctgatctataaaaggcgcggggccttcgacaaacgaccccatgaaacaacttcgccgagacggacgctgccgagcaagtgggaaaggggctcctcacagtagtgcctggacttgggataaactggacgctgcgcgtaaacaggtggatttcaccagttgaatcttccccttggggggaaattggcacacccggacgctacattggtaaatctctggggccccaggaccggaacttatcaacaccatgtcgcccggcacattgggcgacgggcgaccgaattgcacgatgtgcaaatcacgtagtccaaaaggcacggacatccttggtaagggtcacacatggcggacg

SEQ ID NO: 683500 - DNA, 346 bp, Homo sapiens
taggtggaactccagagccctaacggctagaggagtgataatgccacacagtagtctttcacatcttctgacaggattccttaagggatggatggaccctcacacctggtcagatccaggaatggtgtacaggcccctcgctggcccatcaagagtacttggtgtgggagatcttcttccagagcatagtcttgacgtggctgagcaccagcgagtgatgggcctccacctggctggccagcccgctcagcgtggtacaggtgcgcagctgtgtgcccagctcctcgcggaggtcggcgggcgcgccaggcagcaggttgccccgtagcagtgcgcacaccttggc

SEQ ID NO: 683501 - DNA, 250 bp, Homo sapiens
cagggggcagagtaacaggcagctgcgctcagcaaagcctttaaagtgaagccatattgtcgtccgagtatgcagtggtcataccccactcctggtggagattcacgagggcaggtggagagaggagactggagattcacagacctgcaagcacaaataaacggagtactcattactctcggatgagggccctacctctcaacgacaaagatcatctgccttataaaccgactacagaccatgactttca

SEQ ID NO: 683502 - DNA, 301 bp, Homo sapiens
gccgggtggggttggcccccgggggggccgggggccctcttttttttcccccctttttccttccccccacctccccccccccctccaatttttttttgggaaggtgaggcccccccttttgggttaaaattttttgagccggggtttccctttcctttgggtttttttttaaggaagggtggtttggggggtggggtttgaccccctatgattatttccttccgttgggggtgggttttaagatttgttttggggggggggttttttccttttgtgttattaaattttaaatgggaattga

SEQ ID NO: 683503 - DNA, 542 bp, Homo sapiens
actctaagcatctactagtgggtcagagcacacattgcttctgagtatggtgcccggccggcaagtatgtaactagttgacgttgtaatcgcgactcaaaagggcgtcccaccattctatcatccagctgcttcaggaagatggggaatatggtaagaccagtgaattccgtgagcatgagcccactgcctcacttctttacctgtaaagtgagtgcttggtcagaggtaatgctgtgtggaataccgtgatagtggataaggcattccttgagtccataaatggtagtcttggcagaagcattgcatgcaggtgggcaagcccatatactgagtaagtgcctgttccaatgaggacaaacctctctcctttccatggtggaagagttccaatataatcaacttgctaccgggtagctggtcgatcaccccaggaaatgatgccatacaaagggttcactgttagtctctgctgctgctgctggcaaattgggcactcagcagtggccacagacagttcagccttggtgagtggaattcacc

SEQ ID NO: 683504 - DNA, 318 bp, Homo sapiens
  misc_feature (247)..(247): n is a, c, g, or t
caaaaaaaaagtgcctttagaaatttaaaataaggcctagtgtggtggctcgggcctgtaaccccagcactttgggaggctgaagtaggaggatctcttgagcccaggagttgagaccagcctaggcaacatagtgagatactgtctctacagaaaatttaaaaatgatccaggtatggtggtatccacctctagtcccagctactctagaggataaggtgggaggattgcttgagccaggcagtanaggctgcagtgagtcttgatagattgtgccaccactctccaccgtgggtgacagagcaataccttgtctta

SEQ ID NO: 683505 - DNA, 242 bp, Homo sapiens
  misc_feature (20)..(20): n is a, c, g, or t
gagctcgtacccctaattgnttcttcgatgacgggcatggtggttatcctcgcgagggcataaaaaacccccttgcgggggcggtctttcctgcggcccgggtcagcgggtcacaaggaactcggcatcgaacgacatgacgagccggccggaggtcgggtcgtagtcgtccgggttgaagctgatgatgttccctagccgttccaccgcattgcggacggcgtcatcgaagaaccaattag

SEQ ID NO: 683506 - DNA, 431 bp, Homo sapiens
  misc_feature (9)..(9): n is a, c, g, or t
gcacccagnttgccatctccaaacccacctggggctgagggaaatcaataccctgaagggaaggacacaaacctggctgaattttccacctgctgattgtagatcccttggctttgagtgaacataggcagtagccaaggcagtggtcactgggtcttgggagagacacagtgctgtgctagctttggatctggcccagtgcagtcccagtggttgtagccacaggggttcttgtgtcaccctttccccagctctaggcagctcagcacagagagggagactctatttgtttaggggaagtaataaaagagaagaaggttctctgctggtaatccaagggaattcttccagatcttacctaagacatcaagatagtatctctatgagtttgcaagagcattgcattattaagacttgggatgcccccaaag

SEQ ID NO: 683507 - DNA, 172 bp, Homo sapiens
cccccgcccccccccccccaaaaggggtttgggttaaaaaaaaagaaagggggggcttttttttcggggtttttcccaaaaaatttttggggtttttttgggggtttttttccccccccccccaaaggggggggtttccctttaaaaaaaaaggggggggttttttttggga

SEQ ID NO: 683508 - DNA, 496 bp, Homo sapiens
ggaccggtcccatgcacagttggtggatacccacgtgatataaaaacaaatgctacacaaaaactgtgcacagatgttctttgcagcattatttataatagcccaaaattgaaacagccctaatttctatcaactaacaagtgaataaacaaaacgtggcatatccatacaaggaatattattcagcaataaaaaaagagatgaagtactgatatgcaccacaacatggaaaaaccttgaaaacatatcaagtgaagaatgccagacatgaaaggccacatattatatgatttcatttatatgaaatgtccagaacaggcgaatatatatagagagaaggcagattagtggttgcttaggctgaagggttggggaggacaaaggggtgactgctaattagtatggggtttcttttttggggtgatgtaaacgttgtaaagttgattgtggtaatggtggcacaactctgaatatactaaaaaccactgaattgtat

SEQ ID NO: 683509 - DNA, 703 bp, Homo sapiens
  misc_feature (194)..(194): n is a, c, g, or t
  misc_feature (223)..(223): n is a, c, g, or t
  misc_feature (272)..(272): n is a, c, g, or t
  misc_feature (450)..(451): n is a, c, g, or t
  misc_feature (474)..(474): n is a, c, g, or t
  misc_feature (487)..(487): n is a, c, g, or t
  misc_feature (495)..(496): n is a, c, g, or t
  misc_feature (499)..(499): n is a, c, g, or t
  misc_feature (536)..(536): n is a, c, g, or t
  misc_feature (539)..(539): n is a, c, g, or t
  misc_feature (543)..(543): n is a, c, g, or t
tggtctcgaactcccgacctcaggtgatccacccgcttcggcctcttgaagtgctgggattacaggtgtgagccaccatgcccagccagaaagttttaaggctatgattattagaccatcacacacacacaaagtacttaaaaagtctcaggaatgctgtccctcatggcctggtatgacaaagataagaagtnggtcgtgaaaatttctgaatgtggtttangacaaggaaccccagtaagattcagagacaacctagaaaattgaaaganaattttactactgaaatcatccttctataaaaaataatagaagatgtcaaatatgaaaataaaactgtcctctgggccctcaattttctgtgttatgggagaaggcagacagctactcagcagttatatcccataagaatggataatactaaaacaactgacagcatcaagtatggtnngaaagtggaactgattctctcantttcatgtagttnaagatggnntanccacttaggaaaatgtctccccatttcatacaatgcnaantatntacttattttataaccagaaaatccactcttatgtacttaaactcaagaaaagtgaaaatattattacagaaaaaaatatgtatatttgatttgttcgtagcaggtttattcatgataacctccaatccgaaactgcttttgggtctatccataattgga

SEQ ID NO: 683510 - DNA, 900 bp, Homo sapiens
gagcctctccactccacagtcatggtgaacctattggtcaatgacgctgtcagtgaatgagagtgacattgagagtctttctacgaagaagaaccagagattaatatagaggagaaagaactataaatctcagtagaatccgaatcataggaaggtagaatctgtgtcttgtatgcccactcattagtagatctgtctgtaataagttgggttccatcacactggtcgcaagggatgggcatttacatgtgtttaaggaatggggaaggagcgatcccagggcaagatgaatgttgggaagtacggattccactgaaaggagaaaatagagttgtcatataggagagagtaaagccacatggatatgtgctaatatttgatatttcatgggtgggatactacagagaaatgtttgttaactgacttggatgttcatcgacctaaaaaagagggtgtgatggtagttccagtgatggacaccgtagttgtataacttgtctagtattgtaatgtagctgtttacaggtgtgtaaatttaaacttcagaggttgataaaatgtgtacggcattgttaaagtgaaagattagtagtaagaggtattgggacttgtatttggaacacatacagcggtgggggtgattggagttgaattacgcaagcgggtgattgtaaccgggtattcgggttggaaaggttgacactcttttttaaaattcggtccacaaagggattagggtcctggagaacaggggatgcacggggggtcaggaatagggaagattttacttgtgttgcctaaaatgaatagtgatgatccccttatatttaaaaagctggagggattgtgatcaataggagagagggagcattagaagtgttagaggaacatcgatgtgaa

SEQ ID NO: 683511 - DNA, 722 bp, Homo sapiens
  misc_feature (148)..(148): n is a, c, g, or t
  misc_feature (189)..(189): n is a, c, g, or t
  misc_feature (197)..(197): n is a, c, g, or t
  misc_feature (203)..(203): n is a, c, g, or t
  misc_feature (211)..(211): n is a, c, g, or t
  misc_feature (213)..(213): n is a, c, g, or t
  misc_feature (215)..(215): n is a, c, g, or t
  misc_feature (218)..(219): n is a, c, g, or t
  misc_feature (241)..(241): n is a, c, g, or t
  misc_feature (243)..(243): n is a, c, g, or t
  misc_feature (245)..(246): n is a, c, g, or t
  misc_feature (248)..(248): n is a, c, g, or t
  misc_feature (285)..(285): n is a, c, g, or t
  misc_feature (292)..(292): n is a, c, g, or t
  misc_feature (301)..(301): n is a, c, g, or t
  misc_feature (322)..(322): n is a, c, g, or t
  misc_feature (328)..(328): n is a, c, g, or t
  misc_feature (337)..(337): n is a, c, g, or t
  misc_feature (340)..(340): n is a, c, g, or t
  misc_feature (346)..(346): n is a, c, g, or t
  misc_feature (373)..(373): n is a, c, g, or t
aggctcctcgcgtcactcgctgtcccctcgatgcgggctccagccgcatgccttagcttcggctcccggcttgggtggcgcggccgtgccctcgtttggcctccgaacgcggctcgtaatggcaagccaaaattccttccggatagantatgatacctttggtgaactaaaggtgccaaatgataagtnttatggcncccagnccgtgagntntncgnntgaactttaagattggaggttntnannanacgcatgccaaccccagttattaaagcttttggaatnttgaagngagcggccnctgaagtaaaccaggattatngtcttnatccaaagnttnctaatncaataatgaaggcagcagatgaggtanctgaaggtaaattaaatgatcattttcctctcgtggtatggcagactggatcaggaactcagacaaatatgaatgtaatgaagtcattagcagtagagcaattgaaatgttaggaggtgaacttggcagcaagatacctgtgcatcccaagcgatcatgttaataaaagccagagctcaaatgatacttttcccacagaatgcacattgctgctgcaatagaagtcatgaagtactgttaccggacgcccgaagttctgatgctctgatgccaatccaagagttgcccgatctcagatgggcgactctttcgggggcggccctttctggcgaatgggttgtcccctatg

SEQ ID NO: 683512 - DNA, 707 bp, Homo sapiens
  misc_feature (417)..(417): n is a, c, g, or t
ttggacgagcggcgcacaccagaacatgcctatcgcaaaggatcatcttcattcctcttgagaagaggacaagaggcaatcacatgatgaaacgcctggggcacagccccaattcctacttcatggctgggaaatgcccagaatgctataaattcaccacgtttgtgagccatgcacaaacggtaattctgggtgtaggctgctccactggactcagccagcctacaggaggaaaagcatggcttacagaacgatgttccttcaggacgaagcagcactaagagcactctgagtcagtatgagtgggaaaccatgtcaatacacacattttgcgttaatctaaaaggtaatttatgttgctcacttgtgcccgcctctgccaattcaaagatagagtccatcctgttaatgcatggngccaagattagatcttcctggcccgattcgccctgttggggggcagtttagatctatttggccggtcctttacaaccgatgcgattgggaaaaccctggcatctcccaattgaatggccctgaggcaaattcccctttggccagtggttataaaccaaaaaggcccgacccttcaaccttctaaaattgtcaacttaaaggcggggggaataaaagcctatcttttgttaaaatcccgtaaattttggtccactccaatttcaacaataggcggaagggggcccttattt

SEQ ID NO: 683513 - DNA, 160 bp, Homo sapiens
tacctaaatggctgtgcacctcatcaattactactcagtagtctatggaaatataaatagatgagcatttactcttaagaagcactttatatcacctggtctacactacagctctatgaccaaagttgtagagtgagtatgctaagaccatattgaacac

SEQ ID NO: 683514 - DNA, 1848 bp, Homo sapiens
cacgcctgtaatcccagcactttgggaggccaaggtgggcggatcacctgatgtcaggggttcgagaccagcctggccaacatggtgaaaccctgttgctactaaaaatacaaaaattggctgggtgtggtgtcacatgccagtaaccccagctactagggaggctgaggcaggagaatcacttgaacccgggaggcagaggttgcagtgagctgagattgcaccactacactccagcctggatgacagagtgagacttcatctcaaaaaaaaaaaaaaaaaccaaaaaaaaacaacccggttagcatgtgtccctttccccacgtgacaaacttattcaaattccagaagcttagaactttcgtctctaatttatttttctccgtgaacaaaatttacccaagttcaagaacaaaagtgtagtttttagaattatacggcagcattacgacctgaatttggtgagtatacggggcttatatcttaaatcaccattcccctaaaaatgggtttctttctccttagaaatgctggtgggcaacttgatgaagcagccaaatgcaccaggtcaggtcactttcccattacattgattcccgattaacaaaaccagaacgaaacctctttggcgagaacgccacgggccctatgggggtaacttaaaaggcccccctgtagcataccactttttggaaggcgcacattcctttacacacttttcattacccggtgcaagaacgttgacgaccatagccaccgggtgcggccgcgaatgtggcgggcgttatccccgagcgtaacgaggagcgagatgtaattactaccctaggtgtacgtcgcaacaagcagggcgagggcgccggcgaatcaatcgtacagcccgcaccaatctgtggtggcgctccgcagacatccacgcctcagggttcttgatccatgttcacatgtatactcacgcgacgcgcctgacccacgcacatcacccacactcccgccagcacaccacgagactagcgctcgccgtgacaccccgctcactgccctccccgccatcagcaccgcaccaccagccacaccgaccaccccgcagcacacggggcggacccgcgacaccgagagacggccccgagaggacgcgcgggcggagcgcgcgcagcggggcgggcacagcgacggcagctgggagcagacgaggggcgtcgacaggtcagcgaactcagggcggcggacgcgtggcggaaggggaggcacgcgcggcgcggccacgcggcagcgagcggcggcggcgaggggggcgcggcggagcgcaagtcggcgagagcaggtgggatcaaggacgacagaaccgagcccgacacaagcagccaagcaccgggaagaacggcaagagcgggcgagagcaacaagcgcgacgagagggacagcaaggacaagtagggaacgaggaagccagggacagccaacagagaaagcgagacgagagacacaggacagaactgcaacgtgacagaagacgcgacacggaaaggacacagtcgacagggcaggcacatagggcagaagggggacaggccaggagaggccggagagcgctcggaggagaaaccgatcaagccacagcacccaagcgcggcgaggcaagcagacagcggtacgccgccagagaccgcggggaccaggcgcgtacgagagcgaagagacggagcggaggcgcgagacgagagcgaacaggcgaggatggagagatcggcacacgagctcaggggcggagaggacgaagcagacgagaggcgagagcaacgaacgaaaacagggaggccagagccgcggagcgagacagcgacgaca

SEQ ID NO: 683515 - DNA, 130 bp, Homo sapiens
tggggaggtgatgtgaagttgattctggatgtatgtggaaggtgggacttgcaggatttgtgaaagaattggatgtggagtgagagaagaaagggaggaatccaggatggtttcaggatttttgacttga

SEQ ID NO: 683516 - DNA, 132 bp, Homo sapiens
agaaggcttttgtccaacatgatgcatttttggggttacattcagagggcccagacagagcggaaaagttgggaggaggcagatctgtagcgggaaagaagaagagtattctgtcgtagaggaggaggtgtc

SEQ ID NO: 683517 - DNA, 151 bp, Homo sapiens
actaccgatcttaacaccgcatctctagggggaaactagtttttgtttgtttgtttgtttgttttgagatggagacatttaagagctcaatattggtctattcagggtttcaatctcttcctgaatctatcttgggagattgcggtgtttg

SEQ ID NO: 683518 - DNA, 154 bp, Homo sapiens
gcggctgtaatgggcaataatgtgttttattttccttgatgcttacccttactaccaattgcaaaaataatactgaggagccctcctttgccttgtttgtagttggagttttggaaactgatcataaatcatgaatctggcgtattaatgctta

SEQ ID NO: 683519 - DNA, 234 bp, Homo sapiens
tgaagatcttgatgacttctgaaggtcctttgctcaaagcgggcggtatgctgtgtggaggccccgtgacgaaggcttgcttccagaatgtccatgctccgtttactgtcctccgccaacttttcaaacttgtgtggtatcagctgatgttgcccagcctgtgtgaatttgtgtttgagctggttcagtgcacattctcgtgcttgctgcctgtatgacgctatggtgatgttc

SEQ ID NO: 683520 - DNA, 322 bp, Homo sapiens
gtctgcggcgactctagaggaccccatctctaattgttgcacaattatgatcccacgcgggtcaggagagccatctgcattgatcagcttaactctcctgcactagagacatagctttagcatgttgaaaatgtatctcggttgaggaaaagcagtcctacgatagaactatattgcatgtacttgaagtttcccacctatgaaaggctcccgacgcagtagcgcctacactcagtctcatcgcattctgactcgcggcctggcgctacctcatttatttcacaagagtctcgttcatatgtcagacctccccgggatacag

SEQ ID NO: 683521 - DNA, 1361 bp, Homo sapiens
  misc_feature (1361)..(1361): n is a, c, g, or t
gagaagaagagattcagagattccaaactactttcaccctggaggatgctgatctgacgagtctcccttcgttgacatcgggtgtcctcttcttgcaaggtgccgggctgacttggcagtcggtggacgtgggcgcacttctttgtcaggcttgtttccgtcacagggtgacggcaccgtgctacagtggagatagctgtgttgctgattggtcgcatatgaggttctgcttcttgtttctgatgagtgcttacccggcctccggcctgttggagcccctgtgtcttccgtgctttcgtgtgctccccgcgacgctgatcattgccggcgcacggcgttttctctccatatgcctgtggcatctcgtcgtgtactctgatagcctctggttcgcagagtctctgcaggcgcatcgtgggcatcccaacttggttcgccggcatgcttgcctctggcttcagcacggtgactagtgtaccatcgcaaaggataacaatcatctgcaccatgtgtaccatatctgccagttgctatctaaggcgtctcaactgcactgtgtgtgtacatgcatgtccagtggctctctgtcgtgggaggaaatttccgcctgcttttcaaaggatgggcccaacccacttcgatctgagcgaagtgatcgcctagttctttcccaagtcccctccaggggcccgcaatgggaacttgcccctaacccgcattgagctttggcattcgcaaccgctttggtgacatggcggggtggcggttggtgtgcaacttccaaggaccatgcttggagtggggtttgccaaaggctgaggggccacctcgaaaagcgtgcacgctttggagccctcggggtttgtccctggtgggccctctcccacatagattgggcaccttccgctgaccccccaaggccttagctatcccttgcgcaagccttccaaaggggggccttgccgacaaagtgcaacgtggaataaccccgcgggaaacacgaaagaagaaccgcgtaggttccaccaagtccccccttggcaaagggggatgcggtttgtttccccgagaccgttccctttgggcgccccaaacattcgacccggacagaagtctttcccctaatgggcctttaggttgggccccaagtggccccagagacaagggttcccccaaagaggaagtacctttccgccggtgggctttaagcaagggccaacaaggaaaagaccaatctttccgggcctgtgacttccacttttcccaaagggtcgcgttctccttacaaggaaacccctttggacacgggacaaaccgcgggctccggccaaaacccatccggtttcgcaataccccaatgn

SEQ ID NO: 683522 - DNA, 196 bp, Homo sapiens
  misc_feature (107)..(107): n is a, c, g, or t
agttcgacggagactctcactcaaaaaaaaaagaaaaaaaaaagaaaattaaaagggcaagggcatagactagggggaaatattggagaaacatatgggctggacanaaaaagaacttggattctaaagtatatacaaaggaaatcttaacaattccaataaataagggcaaatggatccaattaaaaatggggcc

SEQ ID NO: 683523 - DNA, 135 bp, Homo sapiens
gatagcacattgacttcacacccggctcggagctgctcatcaccaaggccaagaacgggcacctggctgtggccgccccacggctgaattctcggtgataaaggcgcccactggaccctccacaacctctacaag

SEQ ID NO: 683524 - DNA, 758 bp, Homo sapiens
ggccggatcgagcgggtgctgctagcggaggcgccataattggaggggaacaaaactccggcgaccagcggagtgacaccaaattaaaccctgtggaccccttttgttccccttcagcttctaagggccgcgatgttgtaccctagaaagactatctggaaattgatgagagcaggcttcctagtggcactcttgcggagacccgctcaccaggggaaaaattgcgcgaggattgggacccttgccagtgtggcagcacatggcaacgggtgaattcactttaggaaaccaaacatgaagtacaggtggaaaatctccttttaatgaaatgttgcaagcggaacacaaaattaaacgcgtggagttggtatgggtgcacaggacggcaaaatgtggggcattacctatttaaaaaaacagaggaactttactttattaacaggacgctttggggggaaatgatttgcaggtatttggacagcaaggggggctcccacggtgtggctacaacacgacccccaacgaatttatttgtttgcacgttgtggaccaggccaaccttctacctaaacaaacaggcattcggaacaaacgcgcgacccaagagagaggcaagtcagatgtcgagacaatttattccccacataattagtcctccattaaattgtgcactggccaaagtggggagtgggatgccctccatacaccacacttgtggacacaaggcattccttgcttcccttaaagattattacgcc

SEQ ID NO: 683525 - DNA, 916 bp, Homo sapiens
ttgcgcagccgacttcttctgcgtcgaccagcctccgtgggtgcggtcaccgttgagtggctacctggatgcttcgcctggcgcgcgccgcagggtcgttagctgtgtcgtgtcgcgccgtcttctccgctgcgggctccgggcgttgcgcccgccgctgtcgtccgcttctcggtgggtcgctgtgcgcgccccatgtggcgctgttcctggcggccgggccgacgccgggcggtgcgtggacctggtcgcgtgcctggcccgcggccgtctgcgccggccgcggtggcgggggtgtgcggtgggcggcgctggctcgcgccggcgcgagtgtggagtggctgtcgtgctgttgtcggtgtgttcggtgcggtcgaggctctatgatctgcgatcgtcggctggctgcgtcgtcacgtctagcggtcctcgtctctttttcttgtgtctggtgggcggtctgggtggtggatggtgactgcggtcggctgggtcttgcagcacaggtaggtggtgtgtagcgcgagcggtggtaccgcctcgttgtgtcgtgtgtgaagcgacctggttgcgggtcgctcgctgttggctggggtttgatgaagcttctcggccgcgcggtggtagtggtgtgagagtgcgctgcgatatggtgggcgtcatatgtggtcctggcgcgcgtagtgtggcgtggctcgtcggcgtgtatagctgtgacgagtcacgcgtgccgccgcggctcttcgtgtcgtgccacgcctctggctgatcgtagcttccgcgattcgcgccggtgctcctgaagatagtatcggcgcgaggatgtcccccttcttccgcgcgggtttttatgagccgggtgccacagttgctttctgctatttttgttcttttgaggacccccttccccaaaaca

SEQ ID NO: 683526 - DNA, 848 bp, Homo sapiens
  misc_feature (149)..(149): n is a, c, g, or t
aataaatgatattcttctcgcctccaaaaagcgtctcgcctaattgtctcccgcgccggtgacaaaaaaaaggtttgggttcacacccccaacggcgccaaatgtgctggcctaattcccaacttccgctgctacctgatccgcgaagncttatccaacagggggcgttaattaactaccgaacaaccatgtgaggataaacacattattcgcggtctctaaagtcccgagtaaacaacccttctgcctcgcccgcaaagggtcaccagcaacaattgggcacatatagttaattcgcagcacgagttacccactccaaatttcccggataatgcccccaaaagtgaagtttcacctctgcgtgatcgaatacaataatgaggattctcgcgcccccgctgtcttcaacagcaagatatgccgcctgtgaatttctatcaaaatgagtgcgttcttgcccaccacaatgcagttaccccgcgcgtttcctcgacaagagggaaggagggcatatgcggttccaacaaaaccaaccgaggtttttctcgtgcggaaacaatccgccccaaaggtgttatgggctaacacaatgcccgtccccaaaaaattcgtctctcgtcaacaccacgttgagggaccctcacggttcttattgaccactcgagatcaccgcactcgggctcgctcgagaggcgcccctccgcgccacacaaggggtgagtaatactcccataacctttctcccactgggtgcagaggccccccacgaattacaaccctcgcgcccgcttgtcgtttgaaaaaccggcccttgggataacagccgcccctaaaaaccacccccaaaa

SEQ ID NO: 683527 - DNA, 1547 bp, Homo sapiens
cttctacctggtgtaattttttaaattccatatttaggatgctctgtaaatatgaaaatgtgtcacattggatacatttttcttttaggtttagtttttactactgagacttatttatagtcttaggctctatgccatttagaatatgataatcctcatgcctttaatctcagcacttgggaggccaaggcgggcggatcacctgcggtcaggagtttgagaccagcctggccaacacggtgaaaccctgtctctactaaaaatacgaaaattagctgggactacaggcgcctgccaccaggcccggctaatttttttgtatttttagtagagacggggtttcaccgtgttacccaggatggtctccatctcctgacctcgtgatgagcccgcttcggtctcccaaagtgtggggattacaggcgtgagccaccgcacccggcgatttagtatttttttctaatagactatgttcaacaaataagtaattctcgaatagttcagattaaaacatacaggaaccaagtacatacccagcatagaagaactttactaaaggcttcttggaaagcccttttttgaaacgacagtatcgtaagtaacatatcatttataatagaaatctgtgacccagtgcagaaaaataaatatagtaaaatttatttatctttggccagttttccaacacccaggtattagccttgaagttgaagagataaggtttcttgtatattatttttcatttgtgttctacaattaaaggttctgctttgatttgtcagataatttatagaaattttgttctcaaaacaaatgtttgataaaacagattattaaatttggggttgagatgtctaaattgaatgctagaagtaaagtagaagtgaccactattaaagatgtatagggagaagagtacagcacaaagtgataaaatagtgacacttttgtaggggtgtttattgtttggttaagtctgctaaattacggtatgcattatctggtgactatttgtgcctgaaaattcgttttgtattaaaattctggagaaggaattcaggactagaataaagagaaattttgtaaccttttttatcatgacagttttagaataatttttttagctgagattaaatgttcaaggctccaatattatttttaggaacttatttaaggagtgctactttacagaaattactaacacaccaaaacattattaattaaataaaatataagtttacaataataaaacatgtttcttttaatttttctgattatattttatgagttcagaaaggaaatggtaaaagaactatacattttcatgttttaacattttatgtacgtacttgattctgtctgtgtcataattacacatttacttgaacacagctatcctttatcttgtgctttctttaatagaaaaatgaacagaaactgaatgcagttaaatttttatttttagtaggttgtgaagttacttttactggagaaataaaaatatgttaaacttgattgactttttaagataaattgttaacactttt

SEQ ID NO: 683528 - DNA, 884 bp, Homo sapiens
  misc_feature (10)..(10): n is a, c, g, or t
  misc_feature (302)..(303): n is a, c, g, or t
  misc_feature (311)..(311): n is a, c, g, or t
  misc_feature (340)..(340): n is a, c, g, or t
  misc_feature (535)..(535): n is a, c, g, or t
  misc_feature (617)..(617): n is a, c, g, or t
  misc_feature (684)..(684): n is a, c, g, or t
  misc_feature (742)..(742): n is a, c, g, or t
  misc_feature (749)..(749): n is a, c, g, or t
  misc_feature (792)..(792): n is a, c, g, or t
  misc_feature (817)..(817): n is a, c, g, or t
  misc_feature (854)..(854): n is a, c, g, or t
  misc_feature (858)..(858): n is a, c, g, or t
  misc_feature (875)..(875): n is a, c, g, or t
  misc_feature (879)..(879): n is a, c, g, or t
aattcttcanattctatattttaaaataaattttacaaataccaatcacatcttcataacacttttcactatccacatcaactttattatttacatacttcaatacacaactctaacacaaatactttcttatcaccaataattaaaccacacgcataattttttcaaataatttttacttacacaataaattctaactttttaaactctaaagctacataaaactcaaatcaatctatttttctacctcacttcaaaattactttcctttttcctaactaaacataattcttaccattttnntaaatctnaattcattttttattctttttcaaacttntccaaaaaattttaacccctgctttatatacaaattctcatcttacacatatatatttacatattttttcttcaaatactaattacaatgtatgatgttaataggcctgtaatggaaccatgatactactaataatattaaataaaaatccactcatttatataaagtgttccttaattgtgcaataagaaatgngatcacagatttatgtacatatatgaatcactaagagttcagaaattaagctcactttaagaaaactcagccaggcacagtnggctcacgcctggttatcccagtactttggggaggccaaggcggggtggatcacgacgtcaggagtncaagaccagcttgacatggtgaaaccctgtctctactaaaaatacaaaaattagccgngcgtggnggcacacgcctgtgatcccagctactcaggaggcaaggcaggngaattgcttgaaccagggaggcggnggttgcagtgagcccagatcgcgctattgcactccancctnggacaagagagcgagantctnactcc

SEQ ID NO: 683529 - DNA, 1544 bp, Homo sapiens
gcaggtttgaaaactcactgaagaattcccacttcctctgcattaaaaataccttgttcaaggcagtaaatattaacctatgctggtttattcagaaactcatgttaaacaaggtagagaagacctaaaattatgtgttttgtttgtttatttgtttttgagacagagtctagctttgtcacccaggctggagtgcagtggcacgatctcagtttactgcaacctctgcctcctgggttcaagcgattctcctgtctcagcctcccgagtagctgggactacaggcgcctgccaccaggcccggctaatttttttgtatttttagtagagacggggtttcaccgtgttacccaggatggtctccatctcctgacctcgtgatgagcccgcttcggtctcccaaagtgtggggattacaggcgtgagccaccgcacccggcgatttagtatttttttctaatagactatgttcaacaaataagtaattctcgaatagttcagattaaaacatacaggaaccaagtacatacccagcatagaagaactttactaaaggcttcttggaaagcccttttttgaaacgacagtatcgtaagtaacatatcatttataatagaaatctgtgacccagtgcagaaaaataaatatagtaaaatttatttatctttggccagttttccaacacccaggtattagccttgaagttgaagagataaggtttcttgtatattatttttcatttgtgttctacaattaaaggttctgctttgatttgtcagataatttatagaaattttgttctcaaaacaaatgtttgataaaacagattattaaatttggggttgagatgtctaaattgaatgctagaagtaaagtagaagtgaccactattaaagatgtatagggagaagagtacagcacaaagtgataaaatagtgacacttttgtaggggtgtttattgtttggttaagtctgctaaattacggtatgcattatctggtgactatttgtgcctgaaaattcgttttgtattaaaattctggagaaggaattcaggactagaataaagagaaattttgtaaccttttttatcatgacagttttagaataatttttttagctgagattaaatgttcaaggctccaatattatttttaggaacttatttaaggagtgctactttacagaaattactaacacaccaaaacattattaattaaataaaatataagtttacaataataaaacatgtttcttttaatttttctgattatattttatgagttcagaaaggaaatggtaaaagaactatacattttcatgttttaacattttatgtacgtacttgattctgtctgtgtcataattacacatttacttgaacacagctatcctttatcttgtgctttctttaatagaaaaatgaacagaaactgaatgcagttaaatttttatttttagtaggttgtgaagttacttttactggagaaataaaaatatgttaaacttgattgactttttaagataaattgttaacactttt

SEQ ID NO: 683530 - DNA, 646 bp, Homo sapiens
  misc_feature (325)..(325): n is a, c, g, or t
  misc_feature (376)..(376): n is a, c, g, or t
ccggggagggaccgttgaaaagagggggggagcggttccttgtaaaatataagaatcccccagacatgtctcaagatccatctctcgataggcttgaggtgaagacaaagggattcaggctcaaactgcttactttgaaaacactggcaatccagcaattttgccagaagcttctttttttatggggggggagagaaacatctgccccagactgaatacagagctgtatgaatacatgcgtggtgagcttaaatgaagaagaaataagggcaaatgaggtcgtggtttctggggcaccactttagggggaaatcacaagaccttncacaataaacaaaaaagtggctaatgataactggaatgatgtgtgcgttcngagggtagacatccaccccgagcatcactccgtttattataggtaagagtcgatacaggaaaattggcattatccttttaccacacggtaaaaagactcggcgggcagtaaccccagggcaattgtaaaagataattattttggcccccgcttcacgcccaaacttcaaaatttcctgatcctgctattcccgactcttcccctcctccttcctatccccccctagctgtctctagacagatatacccaatcctccatcacaagaaaaac

SEQ ID NO: 683531 - DNA, 199 bp, Homo sapiens
gattagaaccgagctcggtaccctcgataagggccaagcttgttaggcatttgaagttgggggaaatgggagatgctcagtgagactatcagtacctgtctctgagggttattaagaaggaagagccaaaggctcacattcttctatggtaagtgcttgttgtggtactttccatgctttatgcattggccttatcgag

SEQ ID NO: 683532 - DNA, 204 bp, Homo sapiens
gtccaagagtaagcgcctgtgagccatcttacacacatctagtgctccactaatgcacttggaccatcgctgagctggaggtgcagcaggaagctctaggtgggctctatctagtgctctaggcccctatctggagaccgtcccctacaaacaagcacctactcagcctttcctatctgtttcccacggttaacaccacagtta

SEQ ID NO: 683533 - DNA, 329 bp, Homo sapiens
tttgatacttgggcacatgccattattgatattcagaaaaatatcgcttggctcaatacagagcgagaacaagcctttacagattctggttttgattatgacattgctagcaccagtaacttcatgaaagtctcacgtaagcaaccccatatacttagcgactggctatggcagtttttttgggattcacccatatttttgaaagaaattgcacctgaagatgggcattttaagatccatatgtggcctaagccagcaagcaatgtggacaggaaaactatttttcaactttccagctgctttattcaaggtggtaaagtttcaaaaat

SEQ ID NO: 683534 - DNA, 381 bp, Homo sapiens
gtggcctaggaaaaccagtactggctccatggagggcagctgtggccgccagggatatgggttcaagtcgcagaccacttggtctatgtcacggctgttttcccattaggggtaggaattccggcgaggtctagtcagagctaatgtttggcgtaatggattgctagaccctatataacaaaaccgccgtgttcaggtagaggcgcaagacgcttgttagacataagagagtaccatgtattggcactgtggcccttgtggtgtccaattcaatctcggacgcactttcgtttaggttccaacttcggacgggcacgtttccccaaattgggctgatgccctccgccttagttcaatagtgatctgcctcgcccgagcctg

SEQ ID NO: 683535 - DNA, 188 bp, Homo sapiens
atgtccctacgtggtagcggtgtgaactccacgtagttgcaggttgcctttcttatcagtgggtgcctcccggtacattctcgtccacttcctcatctgtgaaggcggccacccatggtggtgagcagctcccgtgttggtggccctctatggatgaaacctgtaggcttcctcagtcgaagcaggca

SEQ ID NO: 683536 - DNA, 690 bp, Homo sapiens
ggtggcacacacctgtaatcccaggtactcaggagactgaggcagtagaatcacttgaacctggaagatggaggtgcagtgagccaagatcacaccactgcactccagcatgggtgacagagtgagactccgtctcaaaaataataataataatagagttgtagctgggtgcagtggctcaagcctgtaatgccagcacttcagagcctgaggtgggaggattgcttgagccctggagtttgagaccagcctggaccacatggtagaccccatccctacaaaaaaaaaaaagtcgggtggtgggtgggcacacggcctggtaagtcccagctaactcaaagaggctgaagtggcggaggatccctaagcccaaggaggtcaacggctgcagtggacgccatggattggccacccactggcaatcttcggcggtcgacaaaagactctggtgctcacacaaaaaacacacaaacggggcacatgggggtaaacacagctgcacccctctcaacaggaaggtgctctcatattgccccccaggcacgaacaggaaaccccaagtctatggttatctaaacgtacagggggaccacaacatggggcgcaagaataacaaacccacaggcgtcctagcgcagacggcacgaaccccaaccaggggcgcggaagccacccccgggaacaccaagg

SEQ ID NO: 683537 - DNA, 989 bp, Homo sapiens
  misc_feature (12)..(12): n is a, c, g, or t
  misc_feature (131)..(131): n is a, c, g, or t
  misc_feature (139)..(139): n is a, c, g, or t
  misc_feature (151)..(151): n is a, c, g, or t
  misc_feature (170)..(170): n is a, c, g, or t
  misc_feature (189)..(189): n is a, c, g, or t
  misc_feature (214)..(214): n is a, c, g, or t
  misc_feature (225)..(225): n is a, c, g, or t
  misc_feature (250)..(250): n is a, c, g, or t
  misc_feature (325)..(325): n is a, c, g, or t
  misc_feature (359)..(359): n is a, c, g, or t
  misc_feature (361)..(361): n is a, c, g, or t
  misc_feature (381)..(381): n is a, c, g, or t
  misc_feature (392)..(392): n is a, c, g, or t
  misc_feature (471)..(471): n is a, c, g, or t
  misc_feature (512)..(512): n is a, c, g, or t
  misc_feature (514)..(514): n is a, c, g, or t
  misc_feature (772)..(772): n is a, c, g, or t
  misc_feature (883)..(883): n is a, c, g, or t
  misc_feature (892)..(892): n is a, c, g, or t
  misc_feature (978)..(978): n is a, c, g, or t
gcctggctggcngaagcctcaggaaacttacaatcatgatggaaggtgaagaggacacaggtgcatcttcacatggtggagcaggagaaaaaaaaaaaagtgggaagtgctacacacttaaacaggcaganctcatganaactcacttatnatgaaaagaacagcaaggnggaagtatgcccccatgantaaataacctcccaccgggcccctnctccaacattnaggattacaattccacatgaaaatngggtagggacacagagccaaatcgtatcaggtgctggtatctctattttgcagatgagaaaaccaggctcaaganattaggtgactggcccaaggtcatatagccagananttacaaatctggagtttganccctgacagtntggtcccagacaccccatgcttgacccctgcatggggctttgcacaggagtccccagggctgcatagcaaacctacgangtggaaggtgttattgtgtccatggtcaacactagtccctnanattcagagaggttgagtaactttgctcaaggtcacagagctagccagggattccacaaaggtcacgtcatgctgatgtaaaacctgagctcttggtactgggcaggggcctggcagtcaacactaactgctggccattattgttaggaaatattatccacgttgctttttcatcagctttaaggaaatagttatcaaactgcttggccttttggcttcccagctattctctaagatttcaccttcaccaaggcctctntggctggggtgcagcaggacagcgagttaaggtgcttaatgcgcagagaaccctcagctaagcaacctggggtggaattatcccactctggcctggcacgcttgagctgtncacagcaanagttagctgccgcctcgcgcctccgccctcagcagattgtaaagcaccgcttgggcattaaagcgtttcttaatatctggctttanctcgcagcaca

SEQ ID NO: 683538 - DNA, 1028 bp, Homo sapiens
ttctttttacatttcagctccagcagccagctatttaaaaaatatttttaaatatcttccccaaagtttaagatgtgggaccatctacttgtaagaaacagtggcttatttcttcatttctcagtaatcattgtaaacctttttttttttcttctccactctaacaaaagtaaaagaacaaaactttggctgaggtcttggactccactactaggttagttatgtggggctgggaacagatggcaggtctgtgccgagagaagccccacaacttgtggcaaagatggaaacattttataatctttggcctctccctttggtcacagtgttgtcgtgaagatcagatatgtatgaatgccaggtccaaataaacttaaaacattaggcaacgtgtcaactatcgttgccccaccggaatcttgaagggttagcaaaaaaaaaaaaaaacaagaatgtcctggtacatgaaacagactgagaaggcctttgcgacatccccctgaagcatagctcatccgttgtttagactaaaaatttccttgcaacggaaatagctacgcaaaacaggttttgcacgacacctccgtgtggtgcaaagtccctctcgttgttcaagtttacccccctcacagacgtccatacggggtaaagtcactttatggagctttattcttaaaaaatacgaacaactggcggcagggcaagaattcaccgtacttgggcccattttgacaagcagtggaagtaacaaattggtaacaccccgtagtagggcgataatttgtacctttggcccgtccacatatgctggacgattctacccaataaagtacctcccggaaaattccccctgggaagttgcgcactccatgaaacactcagattagtcattagtttcagcacaaatgtcttaacaggcttatcgtgggagcaacgataccactccaccttttgttttacacacatagtattgtgtctgcacacatcgggtcagggaacacacacgacgggtacatctcccgactaat

SEQ ID NO: 683539 - DNA, 421 bp, Homo sapiens
ctagtgtagaagttcatagcaggatctgtattcttagtttcattattttcttgggatggctatggaaacttctaaaactagggcttttctgctatggaaacttctaaaactaggaccacctttctgttactcaaactcgcttttcaccctccggctgggatgaatgagcagagtcatggctggtagtgtcccctttggctatggaaacttctaaaactaggtatcacagtattcattatataagctaaaagattgggcttctctttagggtagtccctagtttgagaagtttcaatagcatctgtaaggagtgttctaagtccttgtcatctgaagtggggtatttggggtttatatgccctcaagtaaaagaagagccgaaagggttaatcatatgggaaaaccatattgtatggtattg

SEQ ID NO: 683540 - DNA, 297 bp, Homo sapiens
ccaagtacacagacgttggggtatgtggcccattcgggtcggaaactgattgtctcagaaagtcggtctcttttacctactcgttatttgaacgaagagagagcctgtgcgggatcgccttatcttgtgtccacaggcactgaagtgaagtcacttggagaaggggagacagaggatgagcggcgtctgtgtagggacccccacccgggcctgcagaagggtggagtgctacccaggactggcatgacaggtagtatcctcctcaccacaggctgtgcccataagtctctagtgcag

SEQ ID NO: 683541 - DNA, 949 bp, Homo sapiens
gcctttgccgatccgccgcccgtccacacccgccgccatgctcaccatggatgatgatatcgccgcgctcgtcgtcgcacaacggctcctggcatgctgcaaggccggcttcgcgggcagacgatgccccccgcggccagtcttcccctccatacgtggcggcgccccagcgcaccagcggccgctgatgcgtggcgcatggcgctcagaagcgacttccctaatgtggcccgacgagcgcccagcagcaagcagacggccatccctcacccctgcacgctaccctcatcgcaggctcggccatcgctcacctaacctggagacgcacatggcacgcaaaatctgcgcacccactaccttcctaccaatgcagcctgccgctgctggcctcccgcagcgacgcaccaccgctgcctgcctgcacccgcaggccacgcccctgcaacccccctaacggccccaacccgccgaccaccgcactgcacctcaaccactcactgctcccgcacgaccctctccacacccacccccaagcccactgctcacgctcagccctcatccaagcgacctgctgcatcaatccccgtgcctaccgcccatctgcgcacgataccccactgcgccactcccgccgcacctcgagaccttctctcggctgcaccgcgacgctcacaacccaccacccgcgtagcccacctcctaacccacgcgcggtaattagccgcctcctccacacttgctaatcccgtggaccgatcacttgcgacacccctggtcccatagtccccccgcgcggcaacccatggcaacatagagaccgaagccccgcccacttgcacacggtatctccgcgtccacgcccgatagcccccgcccgcgcccctaccgcacgccctacttccaacaatgccaacaccgtgtacccactgaacgtcctcgtaacgtatct

SEQ ID NO: 683542 - DNA, 398 bp, Homo sapiens
tggtttcaagccaaccccatggcctccatgactttttctaaaaaaaaaaaaaaaaaaaaaaaaaaaaaattttgggggggcccggggcccctggaaaagagctttttagaaacacaatcgcgggtggggcgcgcgcgggggcccaggatgggtacaagtggacacacgggggcaaaagcggggtccctaagggaaacccggggccaaggaacaaagggcggggaggttctcccacccaatataaaaaacgccccggggggacacccaggaggggtcttgggaacaaaatcccaggagggagggtccacgagggggacctcacgggggagcctaattacaacgggggggtccaagggagggcccgaaattccaaatataagcccccggccagggggggc

SEQ ID NO: 683543 - DNA, 1075 bp, Homo sapiens
atccgggccaagtcacctagattcaccgcatgcggcggactcaccgactcgtcctgggaacaacctttccgtcggtcctccaattaaccgcgcgctcccgccgagtctcagggaccacggtgttttaacaccctggagaagtctcgcctactttccagagggaccaacagggtcatcatcgtccgcccccctttgcctgatgccccccatgagtcattcatcgcgcctgaaccgagatcgttatgaccaccgcgcgccacgagtcatcagcaaacgccctcctgcaccaccagccgccttagcaccctggcacaaggtccatccaagacaactgttggttctcactggaaagacgtcaactgagccacacgtccacgccactcactgccacccagaagcctgtggactggccccctccgggaatattgctcccggcgctgatggtccgcggggctctccagaacattctataccctgcctctacctaggcgcgtgccaaggctgctgcgcaaggtcatccctgagctgatacgggaagctcacatggcattggcctttcccgtgtccccaactgccaatggctcgtcacgtggtggaccatgacctgcccgtcatagaaaaacctgccaaaatactggaatgacactcaacgaaggttgcgtgaaagcaggacgtcggagggccccctaaagggcagtcctgggctacaactgaagcaccaggtggtctccctctcgactttcaacacagcgaaccacccacatcctccacatttgaacggctcggggcctcgtgcaattgccctccacacgaccagctttgtccaagctcatttccttcggtatgtacaacgaatattggcttacagcaacagggtggtggacctcatggcgcgcacatggcctccaaggagtaagacccctggaccaccagccccagcaagagcacaagaggaagagacgagaaccctcaactgctggggagtcctgccacactcagtcccccaccacactgaatctccactcctcacagttgccatgtagaccccttttaaccggggaggcgcacttatagg

SEQ ID NO: 683544 - DNA, 508 bp, Homo sapiens
gcctggccatgttgagctgttccttctaccagagcgttggggagctgccactgccgatggcaaactggacaaattgcagggcatacctctcaacgcggaagtccaggaccccgaaccagaacacgaggtcatgacgcaggatgctctgtgcgcccggcccttggaactgctggaggctgaggatggactgtaagatggctttgcgctgctccgccttgtccatatgcgcaggcaagtggcacgatcaggaagcagagcatgtgcccgaaggccgccaggcgcacgctcacgccacccttgataccccagtagccgcccaggccagtgcgcgtgcagtcggtctgcacgtctcgcaggaagggcaggtggtagtacttgccgaacagcagcaggatgacaccccgcatcctcaccgaacccaccagcacgaagttgaagggccctagcgcatccatggacagctcactccactggtccgcgaagagggcgtccttgagtcgcttgatga

SEQ ID NO: 683545 - DNA, 765 bp, Homo sapiens
gtgcctagtaccttactattccgcgtccccttcaccatcggggacactccaaggctggacacatgtgagaacggggttgaggagtgacacagaaggtcgaacggggcccaaagaaggtacccctgggagcccatcggagaccccaggcccccgcccagcaggacctacaagggatgtagccagccgagagcccatcggaagaccccgaggccccacgcccggaaggaccgtgcaggggactggagccagccgagagcaccatcggagacccacaggcccaagcccggaaggaacataacaagggatgagaccaagccggagaagccagtcgggaagaagacagaggccccggactcggaaaggaacttaaagagagaacgagcccaaggcccagtaggagcgctcaaatcggtgagacaccctcacgggaccctcggagccggtggagggactcgatacatggagagaaaccaaagaggccaatgccacagtactcgcaccatacggacaagagaccatgaagtgggcacacacggaccctaagaagtgagtacacgacattccaggaaagatacgaagacaggcaagaagagacacgcagataggggggatgaaccgatctgttgcgtgagccgcaaacggtcggaccatgattatgtgacgacggaccaggggagagaaacacggcagggagcagagagctcacaggcaccacacatagcggtcctcagtggagtaggtctgagggggcgatagggaacactg

SEQ ID NO: 683546 - DNA, 452 bp, Homo sapiens
gaagccatttctactaaaaatacaaaattagcgtgggcgtcatggcacatgcctctaatcccagctactcaggaggctggggcgggagaatcgcttgaacctgggaggtggaggttgcagtgagccaagatcgtgccattgcactccagcctgggtgataagagcaaaactctgtctcaaaaaaaaaaaagtctgcagggatccaaaggggcagcatggaaagtagatattggggggtgactggatggggtcgtttggaaagctgagagtaagaatctagggacccatttccggcaaattcagggaacgagttcactggaagggatttgggtataatggtcagggctctggtacatagacatttatttggggatacaaaaggtaaataaggtcaagaggtttgggtccttcaagggacactaaccattccaggaacgtacaattagaatttt

SEQ ID NO: 683547 - DNA, 230 bp, Homo sapiens
gactttcttcgagtctttgacggtatataaccaatcagaatttgtgcactaggtatttataagcatttcacttgcactaagaggtcatgggtgatatagctatgggctctatttttcttaacacacactccagatgtagtgcataaggaaaaaagggaacctttatggaattctctatagtgagacacttctggtcagagagttgtcatagagtaatcctcggagtagag

SEQ ID NO: 683548 - DNA, 94 bp, Homo sapiens
tccggcttcctacggaaagtccatggcttaaaaaatgtctaaaaactacggatttaccagtatgggaaataaccctacttaggactatggtaaa

SEQ ID NO: 683549 - DNA, 136 bp, Homo sapiens
aggtcactctagaggaccccagcggggaacactcactttggcagcaacctagcaaaagtgaacaaataggattacatgaagtgaaacagcttatgtacagcaaaggaaacaatcaacaaagtgattgttccccgct

SEQ ID NO: 683550 - DNA, 243 bp, Homo sapiens
actccagaggatgaagtcggttctaccatacttcagagctggtattttgacgtcaactcgacaactatgacccctatctctaagaggaaaaacaagagatatgataagaaatacgctgagattggccgggcacggtggcgtatgcctgtaatcctaccactttgggaggccgagaggggtggatcacctgaggtcaggagtttgagaccagcctggccaacatggtggaaccccatctctact

SEQ ID NO: 683551 - DNA, 286 bp, Homo sapiens
ggatctagacgatctatggagccttacctcgggagccttagtactccgggagccttaacctcacggagcaaagccatgaggtccaaccaggagtacaccccctcctcttcccaaggagcaaagccatgaggccaacattcaaattcaggaaatacagagaacaccacaaatatactcctcaagaagagcaactccaagacacataattgtcagattcaccaaggttgaaatgaaggaaaaaaatgttaagggcagccagagagaaaggtcgggttacccacaaagg

SEQ ID NO: 683552 - DNA, 174 bp, Homo sapiens
agccttacctcggaccttacctcggagccttacctcggagccttactctcattgcattatgtggctggtgacatcgcggctctcctctcccggccccccctcggagaacagtaaggaccctacttccatggtgtgctcctcttcgctgcagaacttgccgccgaagcccgtagt

SEQ ID NO: 683553 - DNA, 383 bp, Homo sapiens
  misc_feature (89)..(90): n is a, c, g, or t
ggccgagaagccagtggaatcttcaagggttttgaccccctcctcacctttgtggtggggggccccattgggaaaatgggagcccctgnngcccagtacaggttccggggggacccccggcagttgggccttgtggggggccggggcaggtccggggggttaatttgcccgcaggagggaatgggggccatccccaccccttttatccagaagggggacccctagcttggccggggggggggggggtccagggcaggcccaaaaagttgggtttcccggggatttggggggggctccccccccaggcccccctctgggaagggaagcattttcctttttgaaaggggggaatttttgtttttttaaaaaaatggcaaccccca

SEQ ID NO: 683554 - DNA, 292 bp, Homo sapiens
cgtaggatcattgtagccatcgagctcccaaaatcaggtgatcctcccacgatagaccacattgaaatagcaggcataacaagatgtgcaccaccatacccagactaatatatattgtagttaattatagagatggggtctctccatgatgcccaggctgattacgaattcctgagctcacgtggtccacccacctcagcctctcaaagtgctgggattatagagtgtgagccaatgcacctaaccagccttttgtttgacaggaaagagtgatagaggcccagagaaccaa

SEQ ID NO: 683555 - DNA, 171 bp, Homo sapiens
ttttttttttggggggaaggtcaaattaaaaaaaaaacattaaaattgttttaagcaaagataaggatttttatacggcagggctttcctaaatttcaaatagggggtatttttaaaaatgctaagggggtttgaagaaaggacaaaaggggggggttttccttcctttta

SEQ ID NO: 683556 - DNA, 846 bp, Homo sapiens
gagtgcagtggcatgatcacagctcactgcagccagtaatcctcttgcctcagcctcccaagtagttgagactacaggttgtaccactatgccctgctagtttcttcattttttgtagagagacgggtcttttttttttttgagacggagtctcgctctgtcgcccaagctggagtgcagtagcacggtctcagctcattgcaagctccgcctcccaggttcacgccattctcctgcctcagactcctgtgtagctgggagtacaggcgtgagccaccgcgcccagcaaggcgggtcttgctgtgtttcccagatctagactggtcttgaattccagggctcaagagatctcccacctcagcctcccacagtgctgggattacaggcgtgagccgccacacccagcctattcaaaattttcttccttagagaccgggtcttggtggcccaggctggactgcacgtgatacaatcatagctgactgaagcctcaatttcccaggctagggtgatcttctcacctcaggccttccaagtagctgggtccgcagatgcatgccagtacacccagctcatttacaaaacaaattttaccttttcggagagtctgtgcttaggttgcccaggctggattgcactggtgtgatctcggctcactgcaaagttccacctcccgggttcacgccaattctcctgcctcagcctcccgagtacgctgggactaacgggtgcccgacaccaaaccggctaacttaaggcattataagtaggagacgggggttacaccgtgttagccacggatggtcttgatctcctgacctcatgatccgcctgtttggcctccaa

SEQ ID NO: 683557 - DNA, 135 bp, Homo sapiens
tcgacacaacagtgaaaccaatacgccggttcacaactgttccctggtgttggcgcaatatccgctcaccccggcttaagtcggggatcattttttctttcaagcgttctctacccaagccccgcactacctggc

SEQ ID NO: 683558 - DNA, 742 bp, Homo sapiens
accttggcatccggtggattcgtccgggctaaatctaccgacaccacattggagcttctgcaaatgtcagcgtgcattgaggacattcacctgtacctggcgtcccaaacttgtgcaattgccgagacactaacccagctttgcccatttagaagtcactccgtatgcgactatcgccctgtctgggaattgtaaaaccaacctgaacaatgttattgaagggaacctggacatggtaagcctgccaaacttgctaagccactgaggcagaggagacttgctaaccccaaggcgtgcaatgaatctggctgctctttgacgatcgggcgactgcacatggacttgacagtatcgatgagttaccgtgcgtcaactgataactgccaagatcatgaagtccagacctgattctactgcttgcagaggcatatgtcgagcttgacaactagcagtgcatacctggtactgggacacactatgatgtactgctgatgtcaggagctgaccacatagtctagccctataagcttccaaggcagtggctagcttcgttcctatgcaacagtaacttgttgaggagacttgctgcctctcgatggatgtgcacgtaaaccattgattgcagggcttgaattctggccttcataggccaccgagacttttggacgctccatggcctaaattcagactccggggaccggccgccttaatcgccgaccgcgatgacttcaatttgtgcctt

SEQ ID NO: 683559 - DNA, 865 bp, Homo sapiens
aagcgttacctgtgcagcattgctaaagatctataatgcagactatctgaagatgtgaatgaagaggcagtacatgcacgtacttcagcacagtctccacaaaagccaggtgtcctcactcatcacagaagccgccttagctcccgttactcacagaagaacagcattacccttgcactacatggcgacactcaactggagagagagggcactcggggtcttctgatcatcgcagcgtgctatctgcagcctgaaatgctcatacagcattcccttctggcggccagtgacaaacaacgaagggataaccaagcgttggatatgtcgtctatagacaacaagatgtaagtcactgacgattggttagaagaccaaggaaactgttcatgcaaacagtgtcttcagcatgattctgaatcacacatgagtgaagaaaaaacggaagaacgatttactaaataatttcatgcaatcaatgtcaattgcagaacagggagaacatctgatgttaacttgacagtcttgtctcgtgtacttgaattcgtgccaaaggtgagggtaacggggtggtgagtagcgtcctgtatgttccaggatggcatcgttaagtttatctaagatcattaaggtaatcagggttcgtgtcacaaaacttaaaacaaatgtaactcggtctgatgtagttccagtgtacccaatgatagttactgtcacgcacacctcgacctgtaaacatatacttgtacccttctagcgagattacccatcaaaactttcttgcttccaacacgacccgacgacacccccaccaccaaccgggggccgcccaaaagccccccgggccccactccccaccggtttcaca

SEQ ID NO: 683560 - DNA, 1717 bp, Homo sapiens
tactatcttcgcgcgctccgtgctcttgtcgttccgtgtgtggcccgggggtctgtttggttgtatcctgtgttcgtctgtcgtgtggaggttgtccagctgctgggtgtgttgagttctattcgcgagatttcttgctttgggggggagcccccacgcagagtggggggcaccacccacacgcacggtggcgcccgctgatgatcccgtcagtcttttcctttccgcgggatgtgccctgttggggtgtccttggattggggcgcacatgcagaccccctccgcttgtggtgtgcgtcatacggtgcccattttgcccgggggggcccaccccgcttgggtgatgctaagtctccccccgcctgtctttgtgggagtatgacatctgcggctgtgcgcccttcaaatttatctcctcccggcgggggaataattggttgggcgcttctttttgttggtgtttctaccgccaccacaggggaggtgctgctcctctcctcctggtggtgatccgcaggggggaccaacatgttgtgggcttggcgccccctaaaatagaaggggggcgccccaaagccattgtgcgttgggctgccccagaggtgcctattgtggtgcgtacccccgcatttgtgcgcccccacgactgatggtttggaagagggttgctacactgttggtgtgtgctccacaaggccgcccctccagggtgaacactagccatgtggggttactttgcttggtggggccctccctggtagggtagaatgtgacccctgccccccctgcgtgtgttgtggtcccacagggcctctttttaatagggtgtatgttccaccgcccccgcgtgtgtagaaagttgtctcccacaccaggggggggcacacacccacgtcgtggagaaagttctcccctcgtagagttagtatattggggccaccacagtccttggatgttctcacaagagcacctcgtggaagggaacccccacaaattttgtgggagagtcacacgggcgagatagcccccacgcgcgtgtctctgagacacacagtgcgcctcacacacacgttcgtttcccccgcgtgtgcttccgctttggtggccctgtggtcacatctcacgcacacaggggtgtgtttctgaccacacatggggcacagcacatctttatcacacccccctgagaaggtgtcccttgaatatatcaccacagagaggagaaaacgtctgtgcacatgtcttctgctctccctgtgagagggggtgttcccgccacacatgtgtttgcacacaggtgttctctggtctctgcacagagaattgtgcaaacccacacacctgtgtgtgcactccacgtataccccactttctatcactccaccgggtacccaaccgaggtcctcggcctctgttctcgtggaagaccggagttacaccctttccccacttgctgaaaaaggttccaggcctcttcttggctgaatccactctgcctttgtggctgctgcccctgtggctgctgccacccaccacagctgctcctgctgctgctgcacgccccacgctataaggttgaaaccccaaggaaagaagttcggaaggaagtccgaccgaggatatgggatttggtctctttgactaatccacccaaaagccacccacttagcccgttttatttgccaaacaccaggaaataaaggcttacttcctttta

SEQ ID NO: 683561 - DNA, 677 bp, Homo sapiens
tcctgtgggacgtctggcgagcaggggtcatcaggtctgtgctctgaactccaggcaagggagcctggggagtcaggacaggaaaggacatgcgtgagggcctgtggctcatcaccaccctctgcgtcctagtttacgttctggtggcatctggtgccagggaaagccactcgtcaacacaagctgcgggaggagaggggagctatttggagcaggagacagactaagaaatagacattgcggtccgtggatttcagcccttttgggtttcagctgtgccctaattcttccctgtacggggacagctggatctttgcaggcagtgcaacagagctgcaactccagatgtagtgattccactttggacagaggtgccaggtgggggccccagacttgtgtccaggagggcattgtctgtgtgccacagtccaccggcctcctggaggtgaaatccccatgccagccaagaggggtacgcaatgacgacttagagttcagcatcactccacttctccactcgccatcactcctcaccttctcctgggccctgccctgattttctgaatctcctccagccctctgcggtggaaatgaggaggtcgatggctccgaaaccagcaggtctggggtgttaaggaagatggccctaggtatatcaattaggaagggttcagaag

SEQ ID NO: 683562 - DNA, 541 bp, Homo sapiens
tcggttttctaggaaattgggaattagttgcctagagaggatactgaactatgcagaaggagttaagagctgggatgaggctggatggggtgactgacagtccagatcattgaaacagattgggtcgtcggaaactggtccagatgaggctggatggggtgactgacagtctggatcattgacactgattaggtcgtcgagaaacgggtccagacgaggatgaggcctgaggctggatggggtgactgacagtctggtatcattgaacactgattgggtggttggtcagaaacgggtccagagaggatgaggtgaggtggatggggtgactgacagtccgtggatcattgaaactgattgggtggttggctcagaaacgggtccagatgaggatgcggctggatggggtgactgacagactggatcattgacactgattgggtcgtcacgaaactggtccagatgtaggctgggtggcggtgactgacagcttggatcattgaaatgattgcgtggtcagaacactggtccctatgaggct

SEQ ID NO: 683563 - DNA, 408 bp, Homo sapiens
aatgatcctctacttcctccccatcctgacaaaaatgagtccctatgtatcacagggagatgggagagtgagatggattagaaaaaaatgtattgtgtccatactaaaattttgggatataggcataatctaagttaggtagcctcaatgtccttggcccatcatgacactggtgtagcattaactgtaagtgttgtgcttccaaatcacttttgggtttccaagaatctcttgatactcttatagcctgtcttcactcttgatccttgattctattctattagtcaggtgcacaaagattaccttcctgttatagccttctgtctcgtcaccaaccattcttactgtggtggacatgtacttggaaaaaggccgcatgatctttctgggtccactcagtgtctaagg

SEQ ID NO: 683564 - DNA, 248 bp, Homo sapiens
ggggggttttttgggggctttttttgggggggggggtgtccccaacaccttgggggcctttttgttttttgggcccccttgctggggaaaagggggtttttttttagggggcccttttgggggggggggtttttcccctttcggggtttggggggggccccaattttagggttttttggcccgggcccccccccttttgggggctttttttttttttgggggtttaaattaaaaaggtttttccccca

SEQ ID NO: 683565 - DNA, 515 bp, Homo sapiens
  misc_feature (41)..(41): n is a, c, g, or t
  misc_feature (45)..(45): n is a, c, g, or t
ggagaggagaagagagaggagagaggaggtcgaaagccatngaanaggcggtgagattggggaaaagaacgggaagatgaggaaaaagggaggaggggaggaaaaggggagggtgggaaggggaggagggagggagaggaagagaggggaagaaggaggagggaagagaggaaagagggggagggaagggggaaagggaggggggagaggaaggggggagggaggggtaggaggaagagggggggagaagggggaaggaggagagaggagggggaaagagagaggaggagggggagaaagagagggagagagaggaggaagaaggaaagagagaggagagggagagaagaagagggaggaggaggaaggagagagggaaaggaggaaggaggagggagggagaggagaggaagggaaagagggaggaagggagggagagaggagaaagagagggaggaggagagagaggaagaagggaggaggagggagaagggaggggggaggagggggggggg

SEQ ID NO: 683566 - DNA, 189 bp, Homo sapiens
ttttttttacatttgaattggaaaacattttttgttgtttcttcaaatgacctgactcccacctttaataatactcaagcagcactgctagaaagtgtaaacttattttcagtagggtgatgatagaatgtcaatgaaagccattgacattctcatagtgagtacaatatatcactgcctgcgtcgacg

SEQ ID NO: 683567 - DNA, 311 bp, Homo sapiens
aatcgagccagtccccaaattatgacatgaggagttgggaacaggaatgctaagtccctgaacaatacaaatctctatgcaactcaaggctgccttatagagccagctccaggactctgccaacagaattacagctctgctgaaacctaatccattcccaggcctggataaaagtaggtagcctgttggtttgcagagacatcttataataatctagggtttggccatccagaaggcctctttctgctcagggttactgcagagtctttaggtgacttgttagcagccagtggctggactgttctcatggg

SEQ ID NO: 683568 - DNA, 832 bp, Homo sapiens
taatctactgtcagcaattttcaaatataaaatatattattaactgtagtcaccatgatatacagtagatctcttgaacttattcctcttttgtctgaaattttgtatgctttggccaacatctccccaatccccctgcctttcagctcttgagcatcatttaactctttttatgagtttgactttttcagattccacatataattaagatcatgaggtattcttctgtgcgtgatttacttcacttaatgttttctaggttcatccatgttgttgcaaatgacaggatgtccgtcttttaagactgaatagtatttcattgtgtatatatcacattttctttatccattcatccatggacacttaggctgattgtgtatagtggctattgtgaatagtgctgcgatgaatacaagtgcaggtatttcttcaacatactgatttcatttcctgtggatatatacccagtggtgggaatgccagataagttctatatttaagttttcgagaaaccaccatactgttttccataatggttgtactaattcacaatcccaccggtagtgtacaaggggttcccttttctccacatcctttgccaaaaactttgaaatctttcatctttggtcagcgtttcagagatggggtctcattatgtcgctcacgctggtcttgaactcctggacccaggtgatcctcctggctcggccttctgagtagttggactaagcgcatgtgcatcgtgctcagatctacttagatatggatacaggccttctaaaggtgtgcaggggaaatccaagggggccaattcgattcaccgatagggcat

SEQ ID NO: 683569 - DNA, 369 bp, Homo sapiens
  misc_feature (36)..(36): n is a, c, g, or t
  misc_feature (45)..(45): n is a, c, g, or t
  misc_feature (357)..(357): n is a, c, g, or t
  misc_feature (361)..(361): n is a, c, g, or t
ctcgtttcctttcccattcgagtccatttcctctcnagtccattnccgttcaatcccattccattcgagtcccattccattcgagtccgttccattccagtccattccattcgagtcaattccattccattcgatgtctttccataacgatccattccattctattcctttcgattccattccattctatttcattccattcgattcccttccattggactcctttccattcgagtgcattccattccgttccatttctttccgttctgtacgattcctaccgttcgatttcattttgttccagtccattcctttcgcgtccattccattccatttcactccattcgattccattcnccancactcgaa

SEQ ID NO: 683570 - DNA, 445 bp, Homo sapiens
tgctttccgcctctttgagaccaagatcaccaagtcctgccctcaccaaggatgtcaaggccgctgctaatcagatgcgcaacttcctggttcgagcctcctgcccccttcgcttggaacctgggaaaaaatatttgatcatgggtttggatggggccccctatgacctcgagggacccccccagtacctgctggactcgaatagctggatcaaggaaatgccctttgaacgcctgtgccggagcacccgccagggggcagcctgggcccagctcaacgacttcccccaggagtatggccctcaggggggccaggtgtgagggctgccctcccccctcccctgggaggaacctgaacctgggaaccataaagctggaagccctgctgggtcccctttcatgaacccagcctgggcccagggcatattaaaggcttttggccccca

SEQ ID NO: 683571 - DNA, 310 bp, Homo sapiens
tacccgatggcgtacagcacggtggtaactggtggtgcgtgaatcgcagatggccctgtcgtcaacgagggcaaggtggcgatctgttcgggcccggcacgtacaagctgaccacgcaaaccctaccgctgctgaccaacctcaagaactgggacaagctgttcgcctcgcccttcaagagtgacgtgtactttttcagcacacgccagcagctcgatttgcgctggggcaccagccagcccatcacgctgcgcgacaaggatttcggcgccgtgcgcctgcgcgcctttggcaattacgccgatgcggg

SEQ ID NO: 683572 - DNA, 280 bp, Homo sapiens
aactatatggtattatttcacgctgtacccagtccattgcttgaacttacgggtacctaatgaaacgtggaggtccggatgtatgaaaatctcctcttttcccctttacttacagcctctgtaggcaataattatagagtagtatagatgatttttcttttttataaatctgcctatctccaggaggatggggcgcgcacttttagaaatgcatataaatgctctacgctccttttttctgttacttaatcggcgccaaggcctttacatgaatactcag

SEQ ID NO: 683573 - DNA, 905 bp, Homo sapiens
tggcagacgggacgagctgttccagcacggagcccccggcccaagggcgacttctccagccgggcccgcgaagtgatttctcacattggcaaactgagagattctcttctggcaacacaggcaacagcattatattaatgctccatagccatacccatgtctgcacatcatgggcaggcatgcacagacaccagcacacgcagccacccagcatcagcacctaggcatgccccagcatcattccatgcaggcaccgtgcttcaagcacagccacattccagcaaacgtcacgcaaccagcacagcgtccaccacaggcagcatcacaattaacaccagaccaaagtgcacagcgcagcccaccagtgcacacagcctgctctctctgcgattctcacaatctcagcacagccatctcactatgcacacacagccaggtcattgttacacacgctgtatcacactccaagacaaccagccagccaggccacaatcacagcagacttcctacacagccagcttggctcgcgcactcacaggccacacacagccactacactcctaaaacaactcttgaacacacctcagccacacccccaacacattaaccccaaccagcaaccataagacacgcacaatcacccaacaactccctccaccttcgccacccaccacgctggtctcattccccgctccgacgagcaacgtcttcaccatgtatcccaacacgacacagacgcaaaccgtcccattaggacaacaactgtcaaactaagcaacctcccccatctggatccgccagccttcgggaccaccggcacaactcacggttatcaccctcatgtcaccagacatcacaagcaattacacaccatctggaggcctctcgcaaaagacgcccttacc

SEQ ID NO: 683574 - DNA, 428 bp, Homo sapiens
cacagggaggccctcagtaactgttattcgcaagctggttttctagacctgatagctggaagcatggtgagcaccgggctctggacgctcaggcgcgtgtcgacttcagtcatctccaccacacaggtacagcagcgctttctggtagtcgcccttagtgtcttgctggatataatagtacagggacttgccgtactttctcttgaattcagacctaattttcaacatgtccacttcactgcgggagaccatgactctgatcaggaccttatctcgcgtccccttgcccttcatggagtcatacagccgatcagcaaaatacaggggcttgttctgaatgcactgaaccaggttcaggaaagcattttccaggtctcctttaatctctttcctgatgctgtccaacatgtcataagggctgtaactct

SEQ ID NO: 683575 - DNA, 491 bp, Homo sapiens
  misc_feature (374)..(374): n is a, c, g, or t
  misc_feature (491)..(491): n is a, c, g, or t
cgaacaggacacgcaaggagcaggtgctgagtgagcaggagggggagctgcaggcacttagggagcagatcagcaggcgacaggaagagagagccgagctgcacacacagctgacgcagaagcaacaggaggctgagaggagggatgccatgtaccaggaggagcttggagggcagcgggacttggtccaggccatgaagaggcgggtgttggaactgatcaagagaaggacgcctgtggcagaggctccagcatctctcttccatggctcccgagtgctgtgtggcctgtagcaagatctttggccgattttctcggcggtatccatgcaggctctgtggaggcctgctctgccatgcttgctccatggattncaagaagagagaccgctgctgcccaccctgcgcccagggaagagaagcccaggtcacctgaccaagaccaagaccagcccatgactggcctcccacctgcctgcccatcccactcan

SEQ ID NO: 683576 - DNA, 828 bp, Homo sapiens
  misc_feature (25)..(25): n is a, c, g, or t
  misc_feature (306)..(306): n is a, c, g, or t
  misc_feature (310)..(310): n is a, c, g, or t
  misc_feature (328)..(328): n is a, c, g, or t
  misc_feature (330)..(330): n is a, c, g, or t
  misc_feature (536)..(536): n is a, c, g, or t
  misc_feature (544)..(544): n is a, c, g, or t
  misc_feature (560)..(561): n is a, c, g, or t
  misc_feature (567)..(567): n is a, c, g, or t
  misc_feature (604)..(604): n is a, c, g, or t
  misc_feature (732)..(732): n is a, c, g, or t
acgggcgctcgatcagcaagcgggncgtgagctgtcagtttgggcctgacgtcaccaaggccttcttggaagagaacaacctggactatatcatccgcagccacgaagtcaaggccgagggctacgaggtggctcacggaggccgctgtgtcaccgtcttctctgcccccaactactgcgaccacatttcaacaaaccctcctacatccacctccagggctctgactacggcctcagttccaccagttcacagcagtgcctcatcccaacgtcaatcccatgtcctattccaacacccttctccanctanaaatcatctcacctaacngncggggcttcctgcatcccaggtcccctccaatcccaccggacccaggccctgggctaggggcagagcaggcccccccccagggcaatgttggacccccttttactttgtaaagtttgtatttattcccctttaggtttgcagagggggtaggggcagagtcaggggctggccagagggtctgctccctggacagagaggaaggagntggagcanctggtgctggagcacnncctggncattctgtggggaggccgtcctcggggtggggtgggnccgagtggctgccctgcccccctcatttgcatggctcctcccccactcaagcaatagggccccgccataggaagacccccagagagagggtcagcagggggccccgcctgcgcctcccctcctatacnccatggtggggctaggctgggctcacccccctccccagctattttatgtctgtaattaaatatgttaaaataaagtcattatcgggaagtcaaaaa

SEQ ID NO: 683577 - DNA, 150 bp, Homo sapiens
  misc_feature (1)..(1): n is a, c, g, or t
  misc_feature (11)..(11): n is a, c, g, or t
  misc_feature (24)..(24): n is a, c, g, or t
naagtttaatncactgaaaactgnaaactatttttgagaagttttagaagtcaattcctagtgaaaaattaatgattgagacagatgcaccttggtgtggagtcaaaagtacacatgcgtggatcaaaatatataagaactgcatttcct

SEQ ID NO: 683578 - DNA, 572 bp, Homo sapiens
tcggaccgcagtcttctcccatcagcccaattatgtttcctctcccttcctttcacaggtgctgattcgtaaaaaaacattgagctgggcgcggtggctcacgcctgtaataccagcactttgggaggcctaggagggcggatcacaaggtcaagagatcgagaccatcctagccaacatgatgaaaccctgtctctactaaaaacacaaaaattagctgggtgtggtggtgcacacctgcagtcccagccactcaggaggctgaggcaggagaaccgcttgaacccgggaggtggaggttacttgagctgagactgcgccattttactccaggctgggcaacaagagtgaaactccgtcccaaaaaaaaaaaaaagatctgtccctagaggcttgtgttctggggggagtaactcagatacccatgaggcagatgtggggggcagggaggtatgacgggaaagaggtgggaaagcatagcttggtccagccgggggaaccaattgctcaaaatcccctaagtaggaaagcgctgagcttggtccagatagggataagttaaactccacaaa

SEQ ID NO: 683579 - DNA, 271 bp, Homo sapiens
tcgactcttaggatcccctgatcttccgtgcccctgggatgcacagttggttccttggagtcattatagatagcagatgccaagacctattagaaatggcttacagtggagtgcagtggcagagacctttgtatttattaccatgagcaaaggttacattctaaagaaagaaattacagttacattccttggtattgttgttgttggtgtagctcaatcacatttattgtttgtatgtgttaaggggacggaagatcagggacgaagatca

SEQ ID NO: 683580 - DNA, 719 bp, Homo sapiens
  misc_feature (107)..(107): n is a, c, g, or t
gtaagaagactgttagaatgccctcggtaacatagaggctgacgagatccttgacagtaatagtccttgttgtgggtctggaatctgatgcttccatcgcaggtaantgtcatgggagtcgatcaaattataccttatttggagcgaggcggcacaatgcgttggttcctcgagcattaacgtgtcatttgaatggggttaccgatacacaggacccttaggccgcagttggaaggggcaaattttcgccgttttggggcttaacctttgccttattctggtcgaattgcctgcacgaatagttacacatgaaacagagcatgttgaacagcccaattttcagtcgcctcacctgcgcagcccaggtataaggacgagtgcacaatctctgtaagcacggcgaagatggggccgaagacattgagtgcccccgtaaagtttgtacacttggtttgtgggccaattttatacaaatggcttggtttttaattagtgacaacctttaagggtaaagggcaacgtacgttgaccactattttttcctaataatcaccaaagttcggaatttaggggccttggttagaggttaagtaacaaaacacaccttaatatataggaactcagaccgaacctcgacacacgacaaggacggtttggagaaacgcatagtggttccaggggcgcagggaacacgggcggccccccagggcctaaaaaag

SEQ ID NO: 683581 - DNA, 267 bp, Homo sapiens
  misc_feature (89)..(90): n is a, c, g, or t
  misc_feature (109)..(110): n is a, c, g, or t
gtccaagcgaggtgggtgagggctagggatatcgggaggctttttgcgcgcggagggccgcgatatccggatcccgaaggatatccggnnggaactttgcggacggcgnntacccgcttggaactaaacacgcgggcttcgatttcggcgccgccccgggatatgcggaggggaaggattatgcgcatccaacttatatgcgggatgagagcgttatgcctctgccctcgcggagtgaaattaccaaacaaaatgaccttcttggcc

SEQ ID NO: 683582 - DNA, 155 bp, Homo sapiens
atctcctagtgagcattgaacaggagatggggagtctgaacttggaagccaatgtgacagcagatgtgagccttgtgccatggaaaagggactggcctctctgcacgagtgagatgagtggacgctggaatgtgcgcagctggcaaaggcacagg

SEQ ID NO: 683583 - DNA, 913 bp, Homo sapiens
aaggtgaaccataagcaagtactaccaatcaagtactgcaatcgattaataatcataatgggtatagctaggtaaaactaggaatagcccccgcttgtcacgttctgagtcccagaggttacccaaggcgcccctctgacatccggcctgcttcttctcacatgacgaaaactagcccccagtctcaatgcatataccaaagtctctccctcactaaacgtaagcctgctcctcactcgtctcaatcttatccatgatagcaggcaggtgtgaggtggattaaatgcaaaagcccaatctacggcagaaactcttaggcatactcctcaaattgacccagcgataggatgtaataagtaggcagttctaccgtatcaagcgctaaccataaaccaattcgtttaatttgaaagctatgtatagttatcctaaggtaactaccgcattcctactgaactcaagcttaaagctccagcaacacgaccctgactactatctcgcacctgaaacaagctagcatgactaagacccttaattccatgcaccctcctctccctaggaggctggcccgcatagccggctgtttgcccaaagggggcagttatcgaagaattcacaaaaaacgatagcgcctcatgatcccgcacatcattagtccagcatgcacctgccttaagctctagttctactacgcctgatctactccactcgaatcagactactcccgatatctaacgaacgtaaaataaaacgacagttgacattgaaaagccagcccattgctccccagattcattggcctaacaggtatctactattttccctttatattaataatcttttaaaaaacacacaaaaagaaaaggggggggaaaaaaccgggggcccgaaagcacccctttgaaaggggcca

SEQ ID NO: 683584 - DNA, 105 bp, Homo sapiens
ccctaactcctccctgactagtctccagccctaactcctccctgaccagtcctcctgcctaactcctccctgtaccgatcctcctgccctaactcctcccttttt

SEQ ID NO: 683585 - DNA, 182 bp, Homo sapiens
gatgccacccaaatctctccaaaacacaagggaggattggggggggccaaagtgtacaattttcatcccacaatggaaatttttaaatcatttcaggtagtctaccgaataggtaccaagatcacaaatagtgtggatcagatcttacaagtttatgggggcatcgataaacacggggtacc

SEQ ID NO: 683586 - DNA, 303 bp, Homo sapiens
gaaggccaagacatagtcttacgcttataggtagatacgtagccaggtagtcctaggacggcccacaaacatcatccaagacttctacaatccgctaggtggcctccgggcagaagcgggagatagggtgcctcgctctacgtcggctgggccgcctccggcctgctagtccttggcggggggctagtttgctgcaactagttcaacccgcacaaaacaagccttactccggccagtattctagtggccggtccggtggtggccagcaaataacgtttaagtgtaccacgggcaacccctgct

SEQ ID NO: 683587 - DNA, 201 bp, Homo sapiens
  misc_feature (38)..(38): n is a, c, g, or t
ccccccccccccccccccccgagtgcttagtgggcccnaaactcaaatttcctgtgaaatacgtattgataatccaattttgatttttccccccagaatataaatttcaggtaataaggctttagaactgctgataaaggggatcgttttcaggccctccccccggagtatttcagaatgcaataaatcaaaataatggca

SEQ ID NO: 683588 - DNA, 995 bp, Homo sapiens
  misc_feature (796)..(797): n is a, c, g, or t
  misc_feature (804)..(804): n is a, c, g, or t
  misc_feature (826)..(826): n is a, c, g, or t
  misc_feature (906)..(906): n is a, c, g, or t
  misc_feature (908)..(908): n is a, c, g, or t
  misc_feature (985)..(985): n is a, c, g, or t
agcgggccgcgctcgtggctcgagctccgcgcactccctccgcggccgctgagccgagcggacgcccccgggggccgcgtcgcagccctccgtgctcccccctatcatgcccggtgcccaggctggggccgcccaagcagccaggacaccatgcccgaggacggcgctggcgacggcggggaggtgcccgcgctcatcccggacggcgagccgctgcgggaagagcagcggcccctgaaacagtccctgggaagctccctgtgccgcgagtcgcactggaagtgcctgctcctcacgctgctcatccacgcctgcggggccgtggtggcctggtgtcgcctggccacagtgccgcggctggtcctggggcccgaggccgccttggcccggggagccgggggcccgccaccgacctacccggccagcccctgctccgatggctacctgtacatcccgctggccttcgtctccctcctctacctcctctacctggctgagtgctggcactgtcacgtgcggtcctgccaggcgccacgcaccgacgcccacacggtgctggcgctgatccgccggctgcagcaggcgccgccgtgcgtctggtggaaggccaccagctatcactacgtgcggcgcacacgccagatcacgcgctaccgcaacggcgacgcctacaccaccacgcaggtgtaccatgagcgcgctgacagccgcacggcccgcggcgagtttgactactcggcgcacggcgtccgcgacgtctccaaggagctggtggggctggcggacacgcggccannggctgcncttcaacaagtgcttcacttcngcagcgcggaggccgaggcctcgtacctcacgcagcgggcgcgcttcttcagcgccaacgaaggcctggacgactatctngnatgcgcgcgagggcatgcacctgaaggacgtagacttccgcgagtcgctcatggtcttcgccgaccccgcagccgcnctgcgtacgc

SEQ ID NO: 683589 - DNA, 1251 bp, Homo sapiens
tgggttaaaaggttataaaaatatccttgtgtgtctctcttatatatcccctctttatttacggtgtgctctcagatatatattctcctatattttattatctaccaggtgtgcaatatctccaaattgtggaaccattaagttttaaaaagggagaaagtttgggcccgtgatattattgtgtgggtacccttttatacacagaaataatacagagaatatatcctatttgtgaaaaacacctcctcttaaacacctgtgggcgccctcgagagagtgcgtgagagtgtgtggcagagagagagggcgccgcgtggagtgtgggacaactgtgtggacacctgatgacagcgtgagcagcgcagaaccacacagtgtgtgtatacacacaacagaggggatatatatattatactaagaaggtggatcataaaatagtacactagtgtgtataaagagagagaacatatatatcacacacacactgattatcatagtatagtgtagtggctccagaatatatcatcacacacatagtgtcgcccacactatgctgtgaacagcctatttatcagaagacactctcacagcagtgtgtggtgtgacagacgaaaactactctctgtgtgtgtagggctgatgtgagtagtatgtgaagtgtagtgtagattgtgcgccgactctcttctctctctctgtgtgccacaagagtgcgccctttgatggacagcgcgacgcagtcgcgccgggaaaagagcgacaacaataatgtgagaagagagaggcgccccgggtgtgagagatatcccacgcgcaccccacaatcataaatactcgcctatcatcaactgaggagagcacaacgtgggggtattatcacacatcacagtataacacaaagaagtccaaaagaacatagcgacccaagaagtggagagtcacccagaggggcgagggagagcaatctaccaccaaaaggagcgccccaggcaaaaagacacaccgactagtagcacgaaaccaaacaacaacaccgacgcgctgttgtatgacggaccaaaaaggggcggcgacccaacaaaacaaacaaaacaacaacaacacccaccaaccaccaacacaatcacaccaaaaccaacaaacacaaccaccgaacacaaccgacagaagcaaccacagagcactcacacgacaacacaacaaacgaaaaaaacacaaaagacgcggcagcgacgagaacagcgcacgaac

SEQ ID NO: 683590 - DNA, 1705 bp, Homo sapiens
  misc_feature (87)..(87): n is a, c, g, or t
  misc_feature (117)..(117): n is a, c, g, or t
  misc_feature (120)..(120): n is a, c, g, or t
  misc_feature (149)..(150): n is a, c, g, or t
  misc_feature (162)..(163): n is a, c, g, or t
  misc_feature (180)..(180): n is a, c, g, or t
  misc_feature (1143)..(1143): n is a, c, g, or t
tcaggggtcacggaggcttttaatttggagcacaaaaccacgggggatctagccgggggccaccccggaaatgacacgaggctcacntgactctagacactggggggaaagtgaggnganaaaaacaaggactggggccaattacacgnntggcaaagctannagctggccaacgagggnctctccgagggaagcttgggctttcgtggtagaaagtttcatagaggaaggcggtacaaactctccaggggcgggtggggcgctataacttaggcgagggacacccctgggcagagtgtgtgtgtggctcgggtggcctctcgagagcgtgcctgtggagctgtgaccacgggaggggagaggggctcgtggtgtgtacgccaaacgaggtgtgcacctgaaaaggggtcttgtggcgctgtgtgcccccaacagagggcttatactgtggggccaccagaagggcgtgtctctctgtgaaaagattctcgctgtggcgcgcggccaaacaccttttagccccttttttgctgtgtccccgaagagctctctctctcctttaccaaatttccgtgagaagagaaagccgtggtgtgtgtgatcactttgtgggcacaaagacgcgcgcctccagaagatcttcgcgcgccacagtgtgtgcgcccacctacggttctgtgtgaactctttgggcgcccagttgtgtgcgaacagtgcgccccaaacaacccccaggggtgtcagagcgagaaatagaacgggtatatctcctctcagaggtctcttcccccggagacagcgaattggagaaacccaacctagtgagaagcggcccccacaaagctctagttgtggcgctcgtgtggggccccaagatcttgtgggacagccgtctcgtggagaaaggagaagaaatcttgcgggctcccagcgggagaagcacccaaatcccgggtgcttgcgcacttttgagaaagcccacgtggaagggccacacttgtgggacagaggagacacatttccctcgagataacccacgggggcgcattgtagcggacagaactcccctactatgtggcgggtgtgggcgcgcgacgtggggaggaaagcattccatatccccccccacaatatcaaccgctnggggaattctcctgtgggacacgttgcggccgtggtgtgacaaccttccgtggcgccacaaaagggtttcccccccagaaggtgacaactccctcgtggggtcacaccagacggggggcagatcttcttgcgagatatgagaacaccccccacgtgggggcggaagcaccccactgagcgacagaaacggagcctcttgtatacacagcggccaccgccacagcgtgtgggccaccgcgagcaaaaaatggacccccggcggggtcggacacagcacgggcgaagaaccatcggagaaccccacggggcacctaatctcccgcggaacaccgcggagaaacaccccggcgggccgccaacacaccactgcccgcagcaaccacatacatcaggtggtgcacgcgtccacaaaaaaacatactcaaagcaacaggagcagcttaaatccaagaacgtgagggggaaaaaccacgcagtccccacaacgggggagggcacccaacacctcgcgcaatcacgcggggagccagccacaccaaggagcacaagcagaccaaggcca

SEQ ID NO: 683591 - DNA, 621 bp, Homo sapiens
  misc_feature (87)..(87): n is a, c, g, or t
  misc_feature (117)..(117): n is a, c, g, or t
  misc_feature (120)..(120): n is a, c, g, or t
  misc_feature (149)..(150): n is a, c, g, or t
  misc_feature (162)..(163): n is a, c, g, or t
tcaggggtcacggaggcttttaatttggagcacaaaaccacgggggatctagccgggggccaccccggaaatgacacgaggctcacntgactctagacactggggggaaagtgaggnganaaaaacaaggactggggccaattacacgnntggcaaagctannagctggccaacggggctccagggagctgggctccggtgagaagtcctaaggaagcggtcacgaactccacggggggggggcgctaactagcagggaccccgtgcaagttgtgggctcgggggcctcgagctgcctgagctgacacgaggggaggggtctggtgtagccaacgggtgaccgaagggcttgccggcccacagctatcactgggccagggggttccggaagtccggcccggcaaacttagcctggctggcccagctcctctacaatctggaggacgcgggtggcactgggccaagcgctcagatcggcagggggcccccagtctggatctggccagggcacagccccacaaccgggtccagcgatgaaggtatctccagtctcccccgaacgatgagacccatggaggcccaaccatgggcctgggccagcttgcacgctgaagagaccga

SEQ ID NO: 683592 - DNA, 354 bp, Homo sapiens
agaagggacacagtaacaacagaagggctgagaatagagtaggcttgagtagagtaggtggagtgagaggagtatgaggcaggtagatgggaagtgggtgatgtaggataatggaggccattatgagaaattcaaatattcagtgaacatgtgacactactgaaaaagtcaagagaagggggcagtgtagcctgattcaagttacaccagattgctagtggtcgccatatggagactagttcaggcggaaacaggagtggaagcaggacaagcaacgaggacaggctgctgctctaggccagacgagagtccccgatggtcaaaccacacaatgcatcaaagaggactgagtgg

SEQ ID NO: 683593 - DNA, 224 bp, Homo sapiens
aacgcagagcatgcattacatgccgtcaagatgcggcaggagacagactccgtcatccccatggcagatagctttaaatcaggatcgatttgaaagaatcctggttatcaccaactttaaacgacgatttggatcgctacataggatacgcgacaagcaaaagattctacgatatagttcgagaagcagttccaaacatagtcatatcagaaaacaaatttaca

SEQ ID NO: 683594 - DNA, 400 bp, Homo sapiens
ggggaccactggactgctgggaggaagattgcaaaaagatgaaggagccaacgctttcttcaaaggtgcttggtccaatgtactgagaggcatgggtggtgcttttgtattggtattgtatgatgagatcaaaaaatatgtgtaatacccaagctcacaagttcacagatccattgtgtggtttaacagactattcttgaggaaataaaacaaaaaaaagagacagatcttggataaaaccagaccgtaaggaatacctcagaaaaaaatgcttcattgagtattcattaaaccacagaagtattttgtatttattttacatttagattcccacagaaaacaggctagcttatcatacttgttcacctgattaactgaagaactgatgctgaaaagtaac

SEQ ID NO: 683595 - DNA, 534 bp, Homo sapiens
ttgaattgcggtctcatcagctgtagtcagtgtctttctagggcagtaacgccacaacatgatgttcatcagtattatagattgttctggcgtcacattttcataagcaatgacctggcaacttgtcaatgaatttctgtactgcttcatgatcagcagatgctttatcaccataaacctttaaaaatgcaatgctgtgccttttcataaatttgtgcaacccacctattgagtatttatagttcccttcagtttttcagctcatccggatggatatttgcttgtgtcatgatcagaataccattaagtggcatttgttcactgtgacactgttggattcattcttttaatacacagttgaaatcttcatttttagctttgtacagcatttctcactaacttctgtttatgaatttcagcatgtaactaactgtctttggtttcttctactttttttttaagatggagtcttgctcttttcgcctaggctggagtgcagtggcgcgatttcaactcactgcaacctccgcctcc

SEQ ID NO: 683596 - DNA, 425 bp, Homo sapiens
gtggcgccgccgacttaaggatccccgtgtcctccccctttttgtgaggcacggtgagggaggaagtgatgattggggggactggaacgccaacgctatggctgggagtttgtcaggagcaggtgagagtgttgtatctagcacagagcccaaataggtgtgtcaaagttatgcaggcaggacactcagacgtgtcacatgtaagcctataggacacagcaacagagacagaataaaagtttaaaacacctgggttcaaggctcaccccccacagctcgtttaccatatggactcaagcaagtccttttgtgtgtcataaacctcaatttccttgaaaagaaatacaaagggatatcggtatctctgcttcttatcatgaagatggtctcaaaatctgaagaaagaatgccatccacacttgttt

SEQ ID NO: 683597 - DNA, 250 bp, Homo sapiens
ctgtctagtttttatgggaagatatttcctttttcaccttaggcctcaatgcgctccaaatgtgcacttccagatactacaaaaagagtgtttcaaacctgctctatgaaagggaatgttcaactctgtgacttgaatgcaaacatcacagagatgtttctgagaatgcttctgtctagattttatatgaagatattcctgtttccaatgaaatcctcaaagctatccaaatatccacttgcagtgagcc

SEQ ID NO: 683598 - DNA, 140 bp, Homo sapiens
cgctctagaggatctctccagagctgaaaagcataatgaaaataaaaaagactctgccctccctcctcttaccactttggtttattgagtcatcattttatactctccacattccctctatggtactactctggaaaggg

SEQ ID NO: 683599 - DNA, 149 bp, Homo sapiens
cgagtcttaggactcccccgtgacgccacagctgctccaagctgctgggattacaggcgtgagtcctaccggtggtccggccttttatgccatttctttgttgtaggaatccagctccatttttatggcaatctatgagccttcttgag

SEQ ID NO: 683600 - DNA, 152 bp, Homo sapiens
tcggtacctgtatcagcgggagcttaaaagctcactacaagaagcttatcggttgggaatgaaaggtgacgtttggaggttggaagggtgagcagttgttggtgataggctatggaatgaacggcctagatgtaccaaactagtatcaaacg

SEQ ID NO: 683601 - DNA, 560 bp, Homo sapiens
  misc_feature (553)..(553): n is a, c, g, or t
gggaggcagaatgatgatatgagagcctgctgcatggtcagggtgtgtatggtgttgatggtcagcagattaatggtcggtactgtcgttgtggggcgaaaggataagggaataggctgggggaaaatataagtattaagaagagtagtttaagtaggccccattgtatgtggtgtctccagcatggagattggtgttgtaggaatggacatcggtggcacctgggagggtgatgaacccagcattgggtgggatgtcagaacttccagaaccagcaccggccacctcatatgctgtagcgggctggtgatggtgtgtgggtggattgtgactgttgcaatagaagaaatagcggggtttcgcctatacgggggctccgtaataatggggttcatgactgaagcctttgccaccgtaatagtagggataatcatagttgttgtaataatctttagctagggcagagtcgtattcgaagatgtagaggacgaatccatgttggaagccaggcaggtcctcccaccacaaacgtgggatccgtgcacgttaacgnatactag

SEQ ID NO: 683602 - DNA, 242 bp, Homo sapiens
  misc_feature (227)..(227): n is a, c, g, or t
atccaactagttgcaccctccatattcagctgcttggtgctgaatctcgatcgaacgttggaaaatggtgtcttttttttttccctttaaattatgtttccttcttttggtgatccctttgtataatcttacttttgttggagaggattacccttttgtttctcttttatttttggagttcaatgaactttatctgaacgttaaatatgtgattaaataaaattgcnttctttgtttttgga

SEQ ID NO: 683603 - DNA, 416 bp, Homo sapiens
acaggaagagtgactctgtctcatataaaataaaaaataaaataaataaaatgtatcacactaagtatatggttttgaatctttcccttttttatttaaagaacaccttggagtactttctcattctctgttgcagccacatagtattttattgtatggatgtatcaagatttattttttctgtttcctattgatagaaatatgggttatttctaatcttttgctgttacagaaaagctgcaatgaatagccttatacatacgtttctcgtgagtgcaaatatatctgtagaatcactcccattagtgggaatggtatgtttgcaagtttgatggatattgccaaattaaccttataggatttgtaccaattttcacccccatcaccaacaaattagaatgcctgcttatccacag

SEQ ID NO: 683604 - DNA, 127 bp, Homo sapiens
cacgaggagtatatcggcctgcatatcatgccccaggctcttccaaaattcctaacgcactccacgttgagcctagccggcgaccagaaatttgatagcagccacctgcccaatttcaaactcggtg

SEQ ID NO: 683605 - DNA, 197 bp, Homo sapiens
atctcccactccggatcggatgcggggaagaggacaggcttcacggggcgcacatgcgggagatccgcggggctgaccatggagcgaagtgtaccaacgaacgccactgctcgcatcacgcgcccccctccgcatgcgacgtgccacctggcgcgtcgcatgacctccgcgtgttgcgcgtcgtggccctgaccatg

SEQ ID NO: 683606 - DNA, 680 bp, Homo sapiens
cctacagccaattgtcaggtgtggccagagagggtccctagggcccctagatggttctaaccccaaaccccttaaccatgagcttccctgtcaactgccacccacagggagctgggagtgagggctgggaatcagggttgcccaatggaagagccaggaattctggagcccaggttcaaatctagactttgtcataaatgatggttatgccctggccagtgggggacagagtcaaagcactgcctggttcaagccccagctctgtcacttactagttgtatgagcttgagtgagttattaagcctggctttgggaaattgatagtccctctctaggtgtcaatattttcatctgtgaaatgggtttaatagtactctaagaattaaatgatatgggaggatcgcttgagcccaggaatttgaggctgcttagagctatgattgtgatgtgaatcagattcaaccattaaactgatgtagatgattcagatgtgaatcaaatattaaagtctctacttttcaaagaggcagggtggttgtgccagagagcaggaatggtctcagtccagactgctatggaatgctgggcaaatcatatttcatatttggacctcaacttctttccttctctgtgaatgaaaggaatttgattaaagaggattttaaaaattaaaaaaaaaa

SEQ ID NO: 683607 - DNA, 758 bp, Homo sapiens
agcggaagatatatttaacggtaggaggctagaacgtatctcctttagtatatagcttcatatacaacctttcaaatattcagtcaaaaagtatgtgggccttcatttacacttatgacggggctcacaaataggggtggtcgtgccccgtttccttacgtccactctttcttcaaattaaacttgctacagcaggaaattactgaactgtggatcttctcctacgtccgccttccctatgtcaattccgcatttccacttggtattctacaaatagtataggactgtaaattctaacctataagtataatttcgacgcgcaaggttgggacatgaagaagggattagtgggaaggtaaaaagaacaagagaggatgtgtacacaaaaaggggagtcgaaacacatagtggagcaacaggcgctaacaagacgatgcacgcaaacaaaccagcagaagacggaccaacccagctgggccatctatgggagaaacacatgcattaggatccaataagtgggaaaggggggaggaaagagaaggaccaacccgacaaccaaacgggtagctagacaatccaacacaaacgaaaacaggacaatagaaagattagacagggaacgacatccaaaacaaacagacacggtattgaaaagcggatatgcagattgaacaatacacaaagatactatcacgtgaggaaaacacagatacacatagaaaaaatattatgcagcaaagtactgagtgaaaaaagga

SEQ ID NO: 683608 - DNA, 231 bp, Homo sapiens
agagatggactctctaagtcacgggggttcgactagaatcgatctgcgggggtcggacggtggctcaggtgtctgatggaactagtacaggcggcgtgcaccgcagtggtgaatacacgtcgaccaggctccatgtttgcgatatttggaggtgagcacggtgctcacgtgttgacggaacttgtccagggaggtatgcaccggcacgtggtgaactacacgtcgacgctg

SEQ ID NO: 683609 - DNA, 1357 bp, Homo sapiens
  misc_feature (1038)..(1038): n is a, c, g, or t
ccacccaccacacagaaattggaagggggaagccgccctcgtcttttgggggggcgttgtccccgacacacaaagagtggcttcggtcctccacagcccgccacaatgaaatgatgccgcccgcgccgtgtgtgtaaccaaaaagggccgccctcctcatggtgtacctatgggggaacacccccgcttggggaagaatggaacccccacaagcgttttcctgaggccaatagggcctcgaaaaattgcctccgcctttgtaaaaaggggctggacatccgcgtcggttggtctcatcgccgctcctcggggtggtgagcaccaatgtgtcctcccctcttctcggcggggacactaataccgcggtgctttctctttgggggcgaccacacctcggggctcaaacaactttgcatcaatggggagtacctgctcaccaccacgtctcttttgtgggggagatctttcctgtcccccttcggggtgattatattgtctcttggagagagccccccccctcgctgcttatcaacactggtgcacacgagtggtacggcgggcctcctcgcgaagaggggttttttctcggcaagcgcccaccaccccacgggggggtgttgtcccccgcacaaccttctggcgggtcctctcctttcgtctcctcggggagggggcccacacgacggcttcgggtgttatcacacggcgccaagagtggattcctcgctgcactcttctcgctcacggacccacacttgcccccggttttctcgggggtcccaccgcgccacaggccacacatcgcggggggtttgcccgcgagaaacttctggtggaaactctcacaagaaggcttctcacagggtggcccgctgaaaccccacagctctgtgacacactggcacagctctctcacacccaccctcggggtctccgaggcgcctggggtggtctcgtgggaaacacgtggctcttggggccctggctggagacccccacgcgggagacacaccaagagagcggtgctccaagcacagnccacaggtggtggtggtgaacacaaacgcggggtgcttcttcttccacaccgcccccacaagccacgcccgggcggccgaacccctggggcacaggccacaggccacaggtcctccctgagatggaacgcctgccgccccccacacccccacatctccacaccccaatcacatgtttaaacagggttcggcggcacagcggttgtttccacagaacgccgcctccccccccagatcccggtataatagagatatagcctatttatatttacttgggtaaaaataatcggacgacctgggattaagagctctttttttta

SEQ ID NO: 683610 - DNA, 758 bp, Homo sapiens
  misc_feature (28)..(28): n is a, c, g, or t
  misc_feature (32)..(33): n is a, c, g, or t
  misc_feature (39)..(40): n is a, c, g, or t
  misc_feature (43)..(43): n is a, c, g, or t
  misc_feature (48)..(50): n is a, c, g, or t
cggctggtcgcgttgcaggtgaggttgngacnngcgggnnggncgcgnnncaggcaacatgtcggaaggaaacgccgccggcgagcccagcacgccgggagggccccgacctctcctgactggggcccgggggctcatcgggcggcggccggcgcctcccctcacccccggccgccttccctccatccgttccagggacctcaccctcgggggagtcaagaagaaaaccttcaccccaaatatcatcagtcggaagatcaaggaagagcccaaggaagaagtaactgtcaagaaggagaagcgtggagatggcacatccttgctgctggggacttggccctgctatttatttttgtatttatgtcttaatctcttccactgatgcatcctccaagggtagatggggagggtctgtgtgaaggggccggcttctcttggtgcctgctgggttgcaggggcaggaagcgtgtggactgcagcttctgctggtgctccccccgtcctcctggaggcagtataggagagagagcaaggattgagtctgagacttaagcactcggtcccagcttgccagttcctggttctgtgtccttggacaaactacctaacctttctgagcctcctatacctcatccgacacaaatggggatgatacctacctccagggttggcgtgaggattcatgggctattatagatgaaaactgcacaaggccagaaccagcaggcactcaataaacgttcatgtcctttttctct

SEQ ID NO: 683611 - DNA, 164 bp, Homo sapiens
atgacctcaagctaatccattaccacttggacctccctaaagtgctgggcttacaggtgtgagccaccatgcctggagacgtagacaaatcttcactgagcattttcacacaaccttttacaaatgtacacactcgaggagcgcggccgaactcaggcagcgcg

SEQ ID NO: 683612 - DNA, 1073 bp, Homo sapiens
ggttgccgccgccgccgccgcccgccgcccctctgccagcagctccggcgccacctcgtggccggcgtctccggcgggcgggagccagtgcgctgacgtggccgcaggcgtggggccgagacgaactgctcctgcggctgcgacatcagagctccgagagtctagcgacttccccatgtgggctaggcctgcaggctgcctgaggagcatctgagatttgtcacctgatagttccaatggtgcaaacaggcagaggggatattggaatatccttgggagaagattggccatattgatgaaagaagagcatgggaaaaactagttatcatataacaaaatacacaaatcatcctaaaggattataaccaagtaggggagacacagtacaaaggaacaatccagtgaaacacaaggttaggggtaaatggacaagaaggatatgaacatggccaacttacccatacggaactgaaagaggctataataactatgcaccaaggggaacacactaccgtagggaacgcaagaaaaaacattgaactagcaaaagacacaaacatgagcataacgtggcaatgaacagagaggggaatgccccatatcttaatgctggcggcaggaaaccatggaggacacacgaaatgcctacaaagaaaaaaccaatcataggacgaagttggcatataaaaaagcctacgttcgcacaatcagatgatagaaagaccaacatataaacatagccaggattcaaaaagtagtacaaatagaataataccacaaagcacaatccgaagaaaggaagccacaaaggcaatagaacaccacagagaacaagaggaataatggaaacacgaagcgaaacaaaaccacaaaaacatggaaaacatacaaaggaaaggaggaagccacaaaaaaacaaaagaaagacgaaagaccaaccacacgcaaacaaagcggcaaaacaactccataaatcacacagagacagtaccaaaaagaaaaaaaaacacacagacaaaatcaatagaacaaaactgaaaccaataactagccgcagacaaaaactataacag

SEQ ID NO: 683613 - DNA, 465 bp, Homo sapiens
cagctccaccaagatcaaagaagtcttacagtgccagtcacagtggctcatgcctataatcctagcactttgggaggttgaggtgggaggattgctctgatggacaggaatttgagagcagcctgggcaacatagtgatgactccatcactacaaagaaaaaaagaaaaaaaaaatagctgtgtgtggtggtatgtgcttgtagtcccagctacttgggaggaggctgaggcaggaagatggcttgagcccaggggtttgaggctgcagggggctgtgatcatgtcccactgcactccagtctgtgtgacagagtgagaccctgtctcaaaaaaaaaaaggagggagggagggagagagagaaagaacgaggggaaagaaagaaagacgacagggacggaaggacagcagaggacgaggagaccgacgtgacacggaaggaaggaaacgagacagacggagaaag

SEQ ID NO: 683614 - DNA, 466 bp, Homo sapiens
  misc_feature (225)..(225): n is a, c, g, or t
tgcgcgtaacaaacttaaaaacaaatggctgaacacgcaggaacaaggaaaacctgactgaagaatgagacgttaaaacttaagggccttaggtcctggcacggtggctcacgcctggaatcccagcattttgggaggctgagccgggtagatcatttgaggtcaggagttcgcgacaagcctggcctatgtggtgaaactccgtctctactaaagaatacaaanaatccgccgggcgcggtggtacgtctgtaatcccagctacacaggaggctgaggcaggagaatcgcttgaacccgggaggtggaggttgcagtgagccgagatcacgtcagtgcactccagcatgggtgacagagcaagactccatctccaaaaaaaaaagggagataaaaatttagttactatcacgggatggtggtgaagattaaaggaggtaagatatggtatgtgctgagaacggtt

SEQ ID NO: 683615 - DNA, 1988 bp, Homo sapiens
caattgttattattatgtcctacaagcattaaaaaaaaaaaaaaaaaaaaaaaaaaaaaaaagatggcggcgcccaggccctgccacgcagacttccgcccggcgcgagaccgaagctggcggctggtcgcgttgcaggcaacatgtcggaaggaaacgccgccggcgagcccagcacgccgggagggccccgacctctcctgactggggcccgggggctcatcgggcggcggccggcgcctcccctcacccccggccgccttccctccatccgttccagggacctcaccctcgggggagtcaagaagaaaaccttcaccccaaatatcatcagtcggaagatcaaggaagagcccaaggaagaagtaactgtcaagaaggagaagcgtgaaagggacagagaccgacaacgagaggggcatggacgagggcgaggccgtccagaagtgatccagtctcactccatctttgagcagggcccagccgaaatgatgaagaaaaaagggaactgggataagacagtggatgtgtcagacatgggaccttctcatatcatcaacatcaaaaaagagaagagagagacagacgaagaaactaaacagatcttgcgtatgctggagaaggacgatttcctcgatgaccccggcctgaggaacgacactcgaaatatgcctgtgcagctgccgctggctcactcaggatggctttttaaggaagaaaatgacgaaccagatgttaaaccttggctggctggccccaaggaagaggacatggaggtggacatacctgctgtgaaagtgaaagaggagccacgagatgaggaggaagaggccaagatgaaggctcctcccaaagcagccaggaagactccaggcctcccgaaggatgtatctgtggcagagctgctgagggagctgagcctcaccaaggaagaggaactgctgtttctgcagctgccagacaccctccctggccagccacccacccaggacatcaagcctatcaagacagaggtgcagggcgaggacggacaggtggtgctcatcaagcaggagaaagaccgagaagccaaattggcagagaatgcttgtaccctggctgacctgacagagggtcaggttggcaagctactcatccgcaagtctggaagggtgcaactcctcttgggcaaggtgactctggacgtgaccatgggaactgcctgctccttcctgcaggagctggtgtccgtgggccttggagacagtaggacaggggagatgacagtcctgggacacgtgaagcacaaacttgtatgttcccctgattttgaatccctcttggatcacaaacaccggtaaaatgagcaggtggaggaggacggcgcctgtgcccacggctgctgcctgctccagacattttgttcttgaatctgtgagacccagaaggggcccactgagcccactcactccagcctttggcaaccattgttccaggtcccccagggcttcctcccacagcagctgtgaatggcacagtgaccttcctgcagcgtggagatggcacatccttgctgctggggacttggccctgctatttatttttgtatttatgtcttaatctcttccactgatgcatcctccaagggtagatggggagggtctgtgtgaaggggccggcttctcttggtgcctgctgggttgcaggggcaggaagcgtgtggactgcagcttctgctggtgctccccccgtcctcctggaggcagtataggagagagagcaaggattgagtctgagacttaagcactcggtcccagcttgccagttcctggttctgtgtccttggacaaactacctaacctttctgagcctcctatacctcatccgacacaaatggggatgatacctacctccagggttggcgtgaggattcatgggctattatagatgaaaactgcacaaggccagaaccagcaggcactcaataaacgttcatgtcctttttctct

SEQ ID NO: 683616 - DNA, 877 bp, Homo sapiens
ctgatacagaatcctctgtcgtgctcggggaagctggtggccgcggtgcaggctgtggcaggctgggaggctgtgggcgcctggcgagcatcagctggtgtcccacgtcaaggtgatcgagcccccaggggcatttacacgggaggggaccacccaaaggaagctcttctgtgcgccagcaattatgcacagtgcaacagcagtcaccgtgctcacagccactgaccctcaagaccggagatggaccaacccagacgggaccacgctccaagatcttggtatcgtggccaagaagccgggaagcccgtgggagaatgtgtgtcacctgctgttgtcagagcttgacccagatcagacctgctggcgccatggtcaccttcatcaccagagttctacgtgggccagagaaaatgaaggaaggagcacaagctcagagcccacatcggagcactgccccgcgctcccagcaccccacagccctcacatcccagtggccgggacgcaggagacccaggagaaagcaccctcccttagtgaatgaggagtgggcatcaggccgtgggacacggcttactcctggtaccgccgcacgcccagccatgctcagttaagtggacaggcccacaagatcgaccttgcatgctgagcagatggcagagatgggatgtgtgaggggatgaggaggcatcagcagatgagaccccgaaggagatcaggcagccccacctgcaggagaacgatcagccctcacaggggatcagcccactgccagttaccacccagctgcaggtgccagccacggcagggatgggagaggggtggggagcgagtcactgcctcctctggtgcagagattcagagtaacatcacatgaata

SEQ ID NO: 683617 - DNA, 1925 bp, Homo sapiens
ttaggtacgaggcctggtgttaatcggccgaggtgtcagtcccctctggtgatctcgtcgccccttctctcccaggcaacatgtcggaaggaaacgccgccggcgagcccagcacgccgggagggccccgacctctcctgactggggcccgggggctcatcgggcggcggccggcgcctcccctcacccccggccgccttccctccatccgttccagggacctcaccctcgggggagtcaagaagaaaaccttcaccccaaatatcatcagtcggaagatcaaggaagagcccaaggaagaagtaactgtcaagaaggagaagcgtgaaagggacagagaccgacaacgagaggggcatggacgagggcgaggccgtccagaagtgatccagtctcactccatctttgagcagggcccagccgaaatgatgaagaaaaaagggaactgggataagacagtggatgtgtcagacatgggaccttctcatatcatcaacatcaaaaaagagaagagagagacagacgaagaaactaaacagatcttgcgtatgctggagaaggacgatttcctcgatgaccccggcctgaggaacgacactcgaaatatgcctgtgcagctgccgctggctcactcaggatggctttttaaggaagaaaatgacgaaccagatgttaaaccttggctggctggccccaaggaagaggacatggaggtggacatacctgctgtgaaagtgaaagaggagccacgagatgaggaggaagaggccaagatgaaggctcctcccaaagcagccaggaagactccaggcctcccgaaggatgtatctgtggcagagctgctgagggagctgagcctcaccaaggaagaggaactgctgtttctgcagctgccagacaccctccctggccagccacccacccaggacatcaagcctatcaagacagaggtgcagggcgaggacggacaggtggtgctcatcaagcaggagaaagaccgagaagccaaattggcagagaatgcttgtaccctggctgacctgacagagggtcaggttggcaagctactcatccgcaagtctggaagggtgcaactcctcttgggcaaggtgactctggacgtgaccatgggaactgcctgctccttcctgcaggagctggtgtccgtgggccttggagacagtaggacaggggagatgacagtcctgggacacgtgaagcacaaacttgtatgttcccctgattttgaatccctcttggatcacaaacaccggtaaaatgagcaggtggaggaggacggcgcctgtgcccacggctgctgcctgctccagacattttgttcttgaatctgtgagacccagaaggggcccactgagcccactcactccagcctttggcaaccattgttccaggtcccccagggcttcctcccacagcagctgtgaatggcacagtgaccttcctgcagcgtggagatggcacatccttgctgctggggacttggccctgctatttatttttgtatttatgtcttaatctcttccactgatgcatcctccaagggtagatggggagggtctgtgtgaaggggccggcttctcttggtgcctgctgggttgcaggggcaggaagcgtgtggactgcagcttctgctggtgctccccccgtcctcctggaggcagtataggagagagagcaaggattgagtctgagacttaagcactcggtcccagcttgccagttcctggttctgtgtccttggacaaactacctaacctttctgagcctcctatacctcatccgacacaaatggggatgatacctacctccagggttggcgtgaggattcatgggctattatagatgaaaactgcacaaggccagaaccagcaggcactcaataaacgttcatgtcctttttctct

SEQ ID NO: 683618 - DNA, 299 bp, Homo sapiens
caccatcctactttctgactactctgggaacctcatacaaaaggaatcatacaatatttgtcctttcgtgactggcctgtttcagcgcaacgtattcaaagttcaaccatgttgtaacctgtcaggattcccttcagcatcttaaaaatataatttgaatatagttttttttttttttccaagaacccacttatttacaccctttacaaagtcctacattctgccacatcagtttaacacaggggaagggaattagaagaggggaatccacgtcattcacagacttcctgtcagcccct

SEQ ID NO: 683619 - DNA, 450 bp, Homo sapiens
ggatattcaggtagtgggtgtagagcttacgctatgttacttggtggctgctataagagcctactatgggtgtaaattattactctctctacaaggtttttcctagtgtccaaagagctgttcctctttggactaacagttaaatttacaaggggatttagagggttctgtgggcaaatttaaagttgaactaagattctatcttggacacccagctatcaccaggctcggtaggtttgtcgcctctacctaacaatcttcccactattttgctacatagacgggtgtgctcttttagctgttcttaggtagctcgtctggttacgggggtcttagctttggctgtccttgcaaagttatttctagttaattcattatgcagaaggtataggggttagtccttgctatattatgctcggttataatttttcatctttcccttgcggtact

SEQ ID NO: 683620 - DNA, 846 bp, Homo sapiens
taaagtcttgcaatgaatgcaagcgcgtcacggggttagacctggccgttgtcgctagctagcagagagaagttcgctggccccgtgtgagctgtgaagtttgtcgggccctgaagtgtgacgctttgcctgttgttgtcgaggagttgcggagtgtccggcgacgccactttaaagtgcgctgtcctgtcgggttaagacgtgtatgatgctaatggtctctattgtgtcgctttctaattctcgctgagtattagcctccgctcgccgttcgtaaaagggtgctgttgcgagcactctggggacggtcaatggttgccaagtgtgcgttctactgagtatgccgtccctcaatcttggtagctgtagacaagtgcgcgtgcgagtgtgagccttattgtcgtgtcgctaaggctagatagcgtgcgatatagcgtgagcggatacggcgaccatgcagcagggtcggcacgtcagtaatccctgctgcgtcaagggaccgttcataatcgtcgtatcgtccgcagcgtaagtaggcgttgttgtgaatggagctgtgctaggcagagccgtcggcgtaagcctgcagccgttagcccgcccgcacgtattaacctagctgggagaactgctcgtgtgctagtgaacgcacgttctctctgatcagaatatctactctccgtacgttagcaggagctgcaacatactagtcacagccctatactccctctacatagttgtagccacaacagcaactggggctcactcacccaccacagttgacaagcataaaccctcattcacacgagaaaacaccctcataaatcacacagggtatggcccgca

SEQ ID NO: 683621 - DNA, 1903 bp, Homo sapiens
  misc_feature (28)..(28): n is a, c, g, or t
  misc_feature (32)..(33): n is a, c, g, or t
  misc_feature (39)..(40): n is a, c, g, or t
  misc_feature (43)..(43): n is a, c, g, or t
  misc_feature (48)..(50): n is a, c, g, or t
cggctggtcgcgttgcaggtgaggttgngacnngcgggnnggncgcgnnncaggcaacatgtcggaaggaaacgccgccggcgagcccagcacgccgggagggccccgacctctcctgactggggcccgggggctcatcgggcggcggccggcgcctcccctcacccccggccgccttccctccatccgttccagggacctcaccctcgggggagtcaagaagaaaaccttcaccccaaatatcatcagtcggaagatcaaggaagagcccaaggaagaagtaactgtcaagaaggagaagcgtgaaagggacagagaccgacaacgagaggggcatggacgagggcgaggccgtccagaagtgatccagtctcactccatctttgagcagggcccagccgaaatgatgaagaaaaaagggaactgggataagacagtggatgtgtcagacatgggaccttctcatatcatcaacatcaaaaaagagaagagagagacagacgaagaaactaaacagatcttgcgtatgctggagaaggacgatttcctcgatgaccccggcctgaggaacgacactcgaaatatgcctgtgcagctgccgctggctcactcaggatggctttttaaggaagaaaatgacgaaccagatgttaaaccttggctggctggccccaaggaagaggacatggaggtggacatacctgctgtgaaagtgaaagaggagccacgagatgaggaggaagaggccaagatgaaggctcctcccaaagcagccaggaagactccaggcctcccgaaggatgtatctgtggcagagctgctgagggagctgagcctcaccaaggaagaggaactgctgtttctgcagctgccagacaccctccctggccagccacccacccaggacatcaagcctatcaagacagaggtgcagggcgaggacggacaggtggtgctcatcaagcaggagaaagaccgagaagccaaattggcagagaatgcttgtaccctggctgacctgacagagggtcaggttggcaagctactcatccgcaagtctggaagggtgcaactcctcttgggcaaggtgactctggacgtgaccatgggaactgcctgctccttcctgcaggagctggtgtccgtgggccttggagacagtaggacaggggagatgacagtcctgggacacgtgaagcacaaacttgtatgttcccctgattttgaatccctcttggatcacaaacaccggtaaaatgagcaggtggaggaggacggcgcctgtgcccacggctgctgcctgctccagacattttgttcttgaatctgtgagacccagaaggggcccactgagcccactcactccagcctttggcaaccattgttccaggtcccccagggcttcctcccacagcagctgtgaatggcacagtgaccttcctgcagcgtggagatggcacatccttgctgctggggacttggccctgctatttatttttgtatttatgtcttaatctcttccactgatgcatcctccaagggtagatggggagggtctgtgtgaaggggccggcttctcttggtgcctgctgggttgcaggggcaggaagcgtgtggactgcagcttctgctggtgctccccccgtcctcctggaggcagtataggagagagagcaaggattgagtctgagacttaagcactcggtcccagcttgccagttcctggttctgtgtccttggacaaactacctaacctttctgagcctcctatacctcatccgacacaaatggggatgatacctacctccagggttggcgtgaggattcatgggctattatagatgaaaactgcacaaggccagaaccagcaggcactcaataaacgttcatgtcctttttctct

SEQ ID NO: 683622 - DNA, 2827 bp, Homo sapiens
  misc_feature (1940)..(1940): n is a, c, g, or t
  misc_feature (2275)..(2275): n is a, c, g, or t
  misc_feature (2373)..(2373): n is a, c, g, or t
  misc_feature (2484)..(2484): n is a, c, g, or t
ttaggtacgaggcctggtgttaatcggccgaggtgtcagtcccctctggtgatctcgtcgccccttctctcccaggcaacatgtcggaaggaaacgccgccggcgagcccagcacgccgggagggccccgacctctcctgactggggcccgggggctcatcgggcggcggccggcgcctcccctcacccccggccgccttccctccatccgttccagggacctcaccctcgggggagtcaagaagaaaaccttcaccccaaatatcatcagtcggaagatcaaggaagagcccaaggaagaagtaactgtcaagaaggagaagcgtgaaagggacagagaccgacaacgagaggggcatggacgagggcgaggccgtccagaagtgatccagtctcactccatctttgagcagggcccagccgaaatgatgaagaaaaaagggaactgggataagacagtggatgtgtcagacatgggaccttctcatatcatcaacatcaaaaaagagaagagagagacagacgaagaaactaaacagatcttgcgtatgctggagaaggacgatttcctcgatgaccccggcctgaggaacgacactcgaaatatgcctgtgcagctgccgctggctcactcaggatggctttttaaggaagaaaatgacgaaccagatgttaaaccttggctggctggccccaaggaagaggacatggaggtggacatacctgctgtgaaagtgaaagaggagccacgagatgaggaggaagaggccaagatgaaggctcctcccaaagcagccaggaagactccaggcctcccgaaggatgtatctgtggcagagctgctgagggagctgagcctcaccaaggaagaggaactgctgtttctgcagctgccagacaccctccctggccagccacccacccaggacatcaagcctatcaagacagaggtgcagggcgaggacggacaggtggtgctcatcaagcaggagaaagaccgagaagccaaattggcagagaatgcttgtaccctggctgacctgacagagggtcaggttggcaagctactcatccgcaagtctggaagggtgcaactcctcttgggcaaggtgactctggacgtgaccatgggaactgcctgctccttcctgcaggagctggtgtccgtgggccttggagacagtaggacaggggagatgacagtcctgggacacgtgaagcacaaacttgtatgttcccctgattttgaatccctcttggatcacaaacaccggtaaaatgagcaggtggaggaggacggcgcctgtgcccacggctgctgcctgctccagacattttgttcttgaatctgtgagacccagaaggggcccactgagcccactcactccagcctttggcaaccattgttccaggtcccccagggcttcctcccacagcagctgtgaatggcacagtgaccttcctgcagcgtggagatggcacatccttgctgctggggacttggccctgctatttatttttgtatttatgtcttaatctcttccactgatgcatcctccaagggtagatggggagggtctgtgtgaaggggccggcttctcttggtgcctgctgggttgcaggggcaggaagcgtgtggactgcagcttctgctggtgctccccccgtcctcctggaggcagtataggagagagagcaaggattgagtctgagacttaagcactcggtcccagcttgccagttcctggttctgtgtccttggacaaactacctaacctttctgagcctcctatacctcatccgacacaaatggggatgatacctacctccagggttggcgtgaggattcatgggctattatagatgaaaactgcacaaggccagaaccagcaggcactcaataaacgttcatgtcctttttctctacctgagtctatttncaaacaaaatagagattctaaatctcccagaagcagcgactagagctgctcccgtccccactcttgccccttcctgctttatatcccgtcctcaccctgggcctgatgccctaaatttatggtgtcagatgttctatgcctttttctcctggctcctgttagccaggtgcctcctgtgtgagttactgtaatagctgcaggtaatagaaaggaagaagtcagagacccctcccagcaccctacaaaagccttgggggacatgttgggcccaggacatgttccctgcactctttcctttgcagttagtactcatgtatgagccgaagtcatatatngctaacaaaaaaactaaatccttcataagagaagttagggatgtattgaataatggcctctttgacacttggccgatgatgcccacttcaaaaacttngggtttcagaggcctgcccgtctcctgtcctagcactgccagagccacctactcagtgttactttttgggtctgtgatcctgttccctttaccaggtcattgtactgtgtngtccctggaggaacagcttctcctcttgtcttgacagtagggctgggggtcttcgcaccctggttcagctggagggagacgtgttgcagggttaacgaaaaggtctccctggcggcagcgtgtgtggcgggtcagaccgctgatgggcacaaccttccctttggtggggtcgggggatgctggctctgggaagtttgaacccataggggtccgggaaaacgctaccatcaccaccaatcctgaatcctagggccctgatatgggacacgcatacgagaactttcttaaagcacacgggaacatgagagggggccaaaacacaagcgaaaaggggggagtagaa

SEQ ID NO: 683623 - DNA, 254 bp, Homo sapiens
aaattttcccccccacccttgtgatttgtttttttatgcaaattagttaaaattccctgccaggttttttttgccccccaaaatgatcccgtttggaataaccttttgtaaaaaaaaaatttttttttttttttttatagctggctggaaaaaatttatttttttcccccactttttgcatgtttaaaatattttagcttttttttttttaaaaaagtaaggtttttggcccttttttgggaacccccggggga

SEQ ID NO: 683624 - DNA, 2773 bp, Homo sapiens
  misc_feature (1886)..(1886): n is a, c, g, or t
  misc_feature (2221)..(2221): n is a, c, g, or t
  misc_feature (2319)..(2319): n is a, c, g, or t
  misc_feature (2430)..(2430): n is a, c, g, or t
ttaggtacgaggcctggtgttaatcggccgaggtgtcagtcccctctggtgatctcgtcgccccttctctcccaggcaacatgtcggaaggaaacgccgccggcgagcccagcacgccgggagggccccgacctctcctgactggggcccgggggctcatcgggcggcggccggcgcctcccctcacccccggccgccttccctccatccgttccagggacctcaccctcgggggagtcaagaagaaaaccttcaccccaaatatcatcagtcggaagatcaaggaagagcccaaggaagaagtaactgtcaagaaggagaagcgtgaaagggacagagaccgacaacgagaggggcatggacgagggcgaggccgtccagaagtgatccagtctcactccatctttgagcagggcccagccgaaatgatgaagaaaaaagggaactgggataagacagtggatgtgtcagacatgggaccttctcatatcatcaacatcaaaaaagagaagagagagacagacgaagaaactaaacagatcttgcgtatgctggagaaggacgatttcctcgatgaccccggcctgaggaacgacactcgaaatatgcctgtgcagctgccgctggctcactcaggatggctttttaaggaagaaaatgacgaaccagatgttaaaccttggctggctggccccaaggaagaggacatggaggtggacatacctgctgtgaaagtgaaagaggagccacgagatgaggaggaagaggccaagatgaaggctcctcccaaagcagccaggaagactccaggcctcccgaaggatgtatctgtggcagagctgctgagggagctgagcctcaccaaggaagaggaactgctgtttctgcagctgccagacaccctccctggccagccacccacccaggacatcaagcctatcaagacagaggtgcagggcgaggacggacaggtggtgctcatcaagcaggagaaagaccgagaagccaaattggcagagaatgcttgtaccctggctgacctgacagagggtcaggttggcaagctactcatccgcaagtctggaagggtgcaactcctcttgggcaaggtgactctggacgtgaccatgggaactgcctgctccttcctgcaggagctggtgtccgtgggccttggagacagtaggacaggggagatgacagtcctgggacacgtgaagcacaaacttgtatgttcccctgattttgaatccctcttggatcacaaacaccggtagacattttgttcttgaatctgtgagacccagaaggggcccactgagcccactcactccagcctttggcaaccattgttccaggtcccccagggcttcctcccacagcagctgtgaatggcacagtgaccttcctgcagcgtggagatggcacatccttgctgctggggacttggccctgctatttatttttgtatttatgtcttaatctcttccactgatgcatcctccaagggtagatggggagggtctgtgtgaaggggccggcttctcttggtgcctgctgggttgcaggggcaggaagcgtgtggactgcagcttctgctggtgctccccccgtcctcctggaggcagtataggagagagagcaaggattgagtctgagacttaagcactcggtcccagcttgccagttcctggttctgtgtccttggacaaactacctaacctttctgagcctcctatacctcatccgacacaaatggggatgatacctacctccagggttggcgtgaggattcatgggctattatagatgaaaactgcacaaggccagaaccagcaggcactcaataaacgttcatgtcctttttctctacctgagtctatttncaaacaaaatagagattctaaatctcccagaagcagcgactagagctgctcccgtccccactcttgccccttcctgctttatatcccgtcctcaccctgggcctgatgccctaaatttatggtgtcagatgttctatgcctttttctcctggctcctgttagccaggtgcctcctgtgtgagttactgtaatagctgcaggtaatagaaaggaagaagtcagagacccctcccagcaccctacaaaagccttgggggacatgttgggcccaggacatgttccctgcactctttcctttgcagttagtactcatgtatgagccgaagtcatatatngctaacaaaaaaactaaatccttcataagagaagttagggatgtattgaataatggcctctttgacacttggccgatgatgcccacttcaaaaacttngggtttcagaggcctgcccgtctcctgtcctagcactgccagagccacctactcagtgttactttttgggtctgtgatcctgttccctttaccaggtcattgtactgtgtngtccctggaggaacagcttctcctcttgtcttgacagtagggctgggggtcttcgcaccctggttcagctggagggagacgtgttgcagggttaacgaaaaggtctccctggcggcagcgtgtgtggcgggtcagaccgctgatgggcacaaccttccctttggtggggtcgggggatgctggctctgggaagtttgaacccataggggtccgggaaaacgctaccatcaccaccaatcctgaatcctagggccctgatatgggacacgcatacgagaactttcttaaagcacacgggaacatgagagggggccaaaacacaagcgaaaaggggggagtagaa

SEQ ID NO: 683625 - DNA, 2063 bp, Homo sapiens
  misc_feature (1884)..(1884): n is a, c, g, or t
ttaggtacgaggcctggtgttaatcggccgaggtgtcagtcccctctggtgatctcgtcgccccttctctcccaggcaacatgtcggaaggaaacgccgccggcgagcccagcacgccgggagggccccgacctctcctgactggggcccgggggctcatcgggcggcggccggcgcctcccctcacccccggccgccttccctccatccgttccagggacctcaccctcgggggagtcaagaagaaaaccttcaccccaaatatcatcagtcggaagatcaaggaagagcccaaggaagaagtaactgtcaagaaggagaagcgtgaaagggacagagaccgacaacgagaggggcatggacgagggcgaggccgtccagaagtgatccagtctcactccatctttgagcagggcccagccgaaatgatgaagaaaaaagggaactgggataagacagtggatgtgtcagacatgggaccttctcatatcatcaacatcaaaaaagagaagagagagacagacgaagaaactaaacagatcttgcgtatgctggagaaggacgatttcctcgatgaccccggcctgaggaacgacactcgaaatatgcctgtgcagctgccgctggctcactcaggatggctttttaaggaagaaaatgacgaaccagatgttaaaccttggctggctggccccaaggaagaggacatggaggtggacatacctgctgtgaaagtgaaagaggagccacgagatgaggaggaagaggccaagatgaaggctcctcccaaagcagccaggaagactccaggcctcccgaaggatgtatctgtggcagagctgctgagggagctgagcctcaccaaggaagaggaactgctgtttctgcagctgccagacaccctccctggccagccacccacccaggacatcaagcctatcaagacagaggtgcagggcgaggacggacaggtggtgctcatcaagcaggagaaagaccgagaagccaaattggcagagaatgcttgtaccctggctgacctgacagagggtcaggttggcaagctactcatccgcaagtctggaagggtgcaactcctcttgggcaaggtgactctggacgtgaccatgggaactgcctgctccttcctgcaggagctggtgtccgtgggccttggagacagtaggacaggggagatgacagtcctgggacacgtgaagcacaaacttgtatgttcccctgattttgaatccctcttggatcacaaacaccggtaaaatgagcaggtggaggaggacggcgcctgtgcccacggctgctgcctgctccagacattttgttcttgaatctgtgagacccagaaggggcccactgagcccactcactccagcctttggcaaccattgttccaggtcccccagggcttcctcccacagcagctgtgaatggcacagtgaccttcctgcagcgtggagatggcacatccttgctgctggggacttggccctgctatttaactttggctataagcgctaaactcttcacatggcgcatctcctccaggcttatcgtgctgggcctcttataaaggcctgctcttctcttcgggcacttctcacttttcaagatccatcctcgcattctctctcttaccatctcatcgtgctatcccacatcttcatctgagatcttccgctcactacctcatcttcactcattatctctctaccacctccatcccctcttcttaccggctactcctcgtctgcatctacactctcaatcctcctcccctctcatctctcgccacacctcccctctactcttctctctcaactatactatacgcgctcactacatctcatccggctcttctctaccttnctgcctcatgtcattactccgctctctacactctcttgtctcacgcactcactaactcctcctactagccctctctctcacctcactaccatctccgttactatctctacacatctctctctgccgacccttcgcgctactctcacaccgctcgtagatcctctatcttctctttcccg

SEQ ID NO: 683626 - DNA, 1877 bp, Homo sapiens
ttaggtacgaggcctggtgttaatcggccgaggtgtcagtcccctctggtgatctcgtcgccccttctctcccaggcaacatgtcggaaggaaacgccgccggcgagcccagcacgccgggagggccccgacctctcctgactggggcccgggggctcatcgggcggcggccggcgcctcccctcacccccggccgccttccctccatccgttccagggacctcaccctcgggggagtcaagaagaaaaccttcaccccaaatatcatcagtcggaagatcaaggaagagcccaaggaagaagtaactgtcaagaaggagaagcgtgaaagggacagagaccgacaacgagaggggcatggacgagggcgaggccgtccagaagtgatccagtctcactccatctttgagcagggcccagccgaaatgatgaagaaaaaagggaactgggataagacagtggatgtgtcagacatgggaccttctcatatcatcaacatcaaaaaagagaagagagagacagacgaagaaactaaacagatcttgcgtatgctggagaaggacgatttcctcgatgaccccggcctgaggaacgacactcgaaatatgcctgtgcagctgccgctggctcactcaggatggctttttaaggaagaaaatgacgaaccagatgttaaaccttggctggctggccccaaggaagaggacatggaggtggacatacctgctgtgaaagtgaaagaggagccacgagatgaggaggaagaggccaagatgaaggctcctcccaaagcagccaggaagactccaggcctcccgaaggatgtatctgtggcagagctgctgagggagctgagcctcaccaaggaagaggaactgctgtttctgcagctgccagacaccctccctggccagccacccacccaggacatcaagcctatcaagacagaggtgcagggcgaggacggacaggtggtgctcatcaagcaggagaaagaccgagaagccaaattggcagagaatgcttgtaccctggctgacctgacagagggtcaggttggcaagctactcatccgcaagtctggaagggtgcaactcctcttgggcaaggtgactctggacgtgaccatgggaactgcctgctccttcctgcaggagctggtgtccgtgggccttggagacagtaggacaggggagatgacagtcctgggacacgtgaagcacaaacttgtatgttcccctgattttgaatccctcttggatcacaaacaccggtttgagcccaggagttcaagaccagcctgggcaacatggtgaaaccttgtctctgaaaaataaataatacacacccacatgcacacacatccagttcttccatgttaatgagtatgttgtgtttcacatacttctgaattagccgaaggaatttaaaggtagcatcttttaatcctcagactgccctgcgtggtccgattgaattgggcagtcagcactaggctcttcaaagggaaacaggcttctttcttaggacggtgcacagtgaaagagtggcacacacgctgttcatccagtgctccaacccccagtcctggtgtcagatacttctacatttggggcatttccccttgagatggctgtggctagcgacacatgatgtgaacacctctcttggattgtggttcggccgcacaaggccccatcagagttctacaggtggagtgtggggcccagaaggggctcaggtcttaggggtgtcatcgtttctttttcaccacctgtatcgctaatcctcttaactggcaggaatggggcaagtcaatttcaacacgcgagtcttaggctaaatctgtttataggagttgcccccagaaagggagt

SEQ ID NO: 683627 - DNA, 156 bp, Homo sapiens
ctgaggggctcaaatacgaattcaagatccgtggccgttcacatggtttcaaggcacaatgagactcacttgcccttggaaacttttgcttttgatgtcaatatttcttctttctgctttcactttcgttacccttagggacaagacaggagaggt

SEQ ID NO: 683628 - DNA, 1946 bp, Homo sapiens
  misc_feature (1703)..(1703): n is a, c, g, or t
ttaggtacgaggcctggtgttaatcggccgaggtgtcagtcccctctggtgatctcgtcgccccttctctcccaggcaacatgtcggaaggaaacgccgccggcgagcccagcacgccgggagggccccgacctctcctgactggggcccgggggctcatcgggcggcggccggcgcctcccctcacccccggccgccttccctccatccgttccagggacctcaccctcgggggagtcaagaagaaaaccttcaccccaaatatcatcagtcggaagatcaaggaagagcccaaggaagaagtaactgtcaagaaggagaagcgtgaaagggacagagaccgacaacgagaggggcatggacgagggcgaggccgtccagaagtgatccagtctcactccatctttgagcagggcccagccgaaatgatgaagaaaaaagggaactgggataagacagtggatgtgtcagacatgggaccttctcatatcatcaacatcaaaaaagagaagagagagacagacgaagaaactaaacagatcttgcgtatgctggagaaggacgatttcctcgatgaccccggcctgaggaacgacactcgaaatatgcctgtgcagctgccgctggctcactcaggatggctttttaaggaagaaaatgacgaaccagatgttaaaccttggctggctggccccaaggaagaggacatggaggtggacatacctgctgtgaaagtgaaagaggagccacgagatgaggaggaagaggccaagatgaaggctcctcccaaagcagccaggaagactccaggcctcccgaaggatgtatctgtggcagagctgctgagggagctgagcctcaccaaggaagaggaactgctgtttctgcagctgccagacaccctccctggccagccacccacccaggacatcaagcctatcaagacagaggtgcagggcgaggacggacaggtggtgctcatcaagcaggagaaagaccgagaagccaaattggcagagaatgcttgtaccctggctgacctgacagagggtcaggttggcaagctactcatccgcaagtctggaagggtgcaactcctcttgggcaaggtgactctggacgtgaccatgggaactgcctgctccttcctgcaggagctggtgtccgtgggccttggagacagtaggacaggggagatgacagtcctgggacacgtgaagcacaaacttgtatgttcccctgattttgaatccctcttggatcacaaacaccggtaaaatgagcaggtggaggaggacggcgcctgtgcccacggctgctgcctgctccagacattttgttcttgaatctgtgagacccagaaggggcccactgagcccactcactccagcctttggcaaccattgttccgagctccacaagtttttctccaaacaatttggaaggccaaggggcctttctgcaacgggaaatgcccatccttgtttcggggacttgccctcgtattaattttggtttagggcaaaactttccccgaagaactcccagggacatatgtggtcttttgttaaagctttccttctttcggcctccttctcttctgctataaacgctttctcggacttttcttggcctccccccgcttctgggtgcctcctgacagtatcctggctgcctctctccaccctcctccccttgctgtnctcctctgcttccgctccttttgaggtttactatcactcaccatggggtgtcccctctccgccgtcgggttatcttcccttcatccatctctgctcttccactcgctcgctttcctccgtctgcctctttcctcatcacctgcttctatctacatgctcccgtctgctctcttctctgccttatttcccctcatctctctctgctccctctgcgtacctgtcttcgcggctctctctctcccg

SEQ ID NO: 683629 - DNA, 1143 bp, Homo sapiens
agcgggtgaattctccaacttgtacttctttttctttatctacttgggaccccttgaaattccatatgaattttgaggatcaacttttccatttctgcaacaaaggctgttggaaatttcatagtaatgcattgaatctgctgatcacttttggtagtattgacatcttgaagatattaagtcctcttatccatgaacacaaggtgtttttccacatacttagatcttttatggtttttcttcacactctttaggagaatactaatttagtcaaaaccacccagttcctaccaaagttaccaaggatcacattggcaagaagtcttcaatgttgaatgattccattaaaatgcatttcactgcaattcacaaagcattactttatttttatttaaattttaataatcactgatgaaggaaaaacaaaattatgacaatcaatatttacttgggaaaccattttcataggtcactgatgaaggaatgtggtacacagcttcagagtggcaagggacatagggacaagcacacaagattgaaagcgtaaaagcatattctcataaggaccaaacaatccttattgttggaggaccaaatggaatcatcgttaactgtatgtagaatcaaaagttcacgatctgtaagtcctttttaagatatgcatgattcagcttatttacagttcgagcaaaggcatatttagaagcacgggtatatgcttcccaaacttgtacacttttcttgaaggtccagatcaccaatggattgtcctggaacgaggacatgaggcacacctgatttaagtgggacgcccagaaaagtaagtaggttcccgggatcctctccatatctccttgggcatgctcactggatgggacggcctcaggaccagccgactgtttccaaaacctcaacagggggcttccaaaacgcacctcagtcacaggcaagggcgctaacaaccaaccactacgaaaggggactcggaagccgcccagggtgtcccctgaaacgatacaagggcgcccaccagcagaggcacaacagcacctcaaagactacagcaccgacgaaccgacgtcagacgtagtcaccgacacaggcaacgcgcaacacagtggaacaaccagcaccccccaccag

SEQ ID NO: 683630 - DNA, 2196 bp, Homo sapiens
ttaggtacgaggcctggtgttaatcggccgaggtgtcagtcccctctggtgatctcgtcgccccttctctcccaggcaacatgtcggaaggaaacgccgccggcgagcccagcacgccgggagggccccgacctctcctgactggggcccgggggctcatcgggcggcggccggcgcctcccctcacccccggccgccttccctccatccgttccagggacctcaccctcgggggagtcaagaagaaaaccttcaccccaaatatcatcagtcggaagatcaaggaagagcccaaggaagaagtaactgtcaagaaggagaagcgtgaaagggacagagaccgacaacgagaggggcatggacgagggcgaggccgtccagaagtgatccagtctcactccatctttgagcagggcccagccgaaatgatgaagaaaaaagggaactgggataagacagtggatgtgtcagacatgggaccttctcatatcatcaacatcaaaaaagagaagagagagacagacgaagaaactaaacagatcttgcgtatgctggagaaggacgatttcctcgatgaccccggcctgaggaacgacactcgaaatatgcctgtgcagctgccgctggctcactcaggatggctttttaaggaagaaaatgacgaaccagatgttaaaccttggctggctggccccaaggaagaggacatggaggtggacatacctgctgtgaaagtgaaagaggagccacgagatgaggaggaagaggccaagatgaaggctcctcccaaagcagccaggaagactccaggcctcccgaaggatgtatctgtggcagagctgctgagggagctgagcctcaccaaggaagaggaactgctgtttctgcagctgccagacaccctccctggccagccacccacccaggacatcaagcctatcaagacagaggtgcagggcgaggacggacaggtggtgctcatcaagcaggagaaagaccgagaagccaaattggcagagaatgcttgtaccctggctgacctgacagagggtcaggttggcaagctactcatccgcaagtctggaagggtgcaactcctcttgggcaaggtgactctggacgtgaccatgggaactgcctgctccttcctgcaggagctggtgtccgtgggccttggagacagtaggacaggggagatgacagtcctgggacacgtgaagcacaaacttgtatgttcccctgattttgaatccctcttggatcacaaacaccggtttgagcccaggagttcaagaccagcctgggcaacatggtgaaaccttgtctctgaaaaataaataatacacacccacatgcacacacatccagttcttccatgttaatgagtatgttgtgtttcacatacttctgaattagccgaaggaatttaaaggtagcatcttttaatcctcagactgccctgcgtggtccgattgaattgggcagtcagcactaggctcttcaaagggaaacaggcttctttcttaggacggtgcacagtgaaagagtggcacacacgctgttcatccagtgctccaacccccagtcctggtgtcagatacttctacatttggggcatttccccttgagatggctgtggctagcgacacatgatgtgaacacctctcttggattgtggttcggccgcacaaggccccatcagagttctacaggtggagtgtggggcccagaaggggctcaggtcttaggggtgtcatctgacaaaaccagagatggtgatgggacaccagttctaggagccctctgcatggccaatttctgcctcagctcttctaaagcatttcttctgttcccttccatgggtaaccagtgatctgtcttccaaaaactgagtcagaagctgcactttgcttaacttggttcatcttaattctaacgatactccgtccgaacacccacatgccgcctcacttgtctaagaaagccttacatgggcccagcaccatggatccaaaccgtaatcgccaaccggccgaattccgccgtgaacaacaacacagccggctcttcctcaacgaccgtaccaccggtctgcatacccgccacgcctagaatccgcccggcttaacgctgccagcccaccgcccgcacatgttcctacggccctaccatagtcactcaccgaggcacaccacc

SEQ ID NO: 683631 - DNA, 303 bp, Homo sapiens
tgagtgaaaggaaaaggtcaggggaaacaggtggctgccgctttgttcaacttctagtcatactaatctgtgtacagcctatcccttgaggcatcaagctcttccttgaaattctctgcttcagtttcattcattttcagtaaaagaatattttctgaaactcttaagatatattgaaggtcagaggcagagctaaacaggtgatgccactgggtcttttgcaataataaatacaaacttactattggcattgggattttctcatatattttttctttctttttaatatcattagtataaaga

SEQ ID NO: 683632 - DNA, 211 bp, Homo sapiens
tgtgacagaaattctactgaaactagctcagaaaaaaagacaaaatgtattgacttgtggaatcacaggaaatgttgaatagttaaaccacagtatacacaagaaacaagctagctctcaacaacaactgaaccagggaatgttcacatggcagagttacctcagttcctctccctaattctcttctactgtttgtttcacatggccactc

SEQ ID NO: 683633 - DNA, 1550 bp, Homo sapiens
ccccatgacggcctggcatgtacacgttgaccatgaagtatggtggcgaactcgtgccacacattccccgacccgtggtcaatggctgtgagccctgcctgtggacaccatgcagtgatcaaatgtcttttgtgaccatgtgaatatgaatgtgtgaaatgatgtgttcctgtgtgaatgctaccacctgactttacatgtttgactctctgtgcctgctgacccagtgtttgtgtggtgttgaccactatacaatggtcccacatattgccaaaccccatacagtggggcctaccaacctgatgtgctatattgtcacatgaacaattgctgtgatgtgtgaccctaccatgtgatgtgacatacaacatccctatattgaatgcaaatgtgtactaccattgtaagttgtgatgtgttgaccataattgattgactgttagcctaatacccaacaacatgtccctatacaatggttgtgctttgtacaacttgaaatgtgcttggccagacccaatactaaggtggtagcaaatgccctaaatgtggaccttggactttgaaatgatgtgcctatatacgcaaacaaaagcaccaaattgtacattcaacctgttgggtataacccaagatgtgctgcatgtgacacttatggttggggctttgtgaccataacctttgattcgcaggtgaccccattacaagaaagtctgacacgaatacaacatatgcatacaatgaacagaacagatggacttgagacaagacctggcaagcatgcctagacgtaacaatatccctaataacagctgccctggtggagacttaccgaattgataaacataatccaaccaattactttgaaggtgacggcctcaaaaaatccgcctatgagacaatacccacattatcagcggggattacccattgttaagcactgtcgattgcttcggctggacacccaccccaggccaaacgtggagcagacagaattatgcacatggtcacaccgagtgggcttgggaacaactcagagggcagagtaccgagaagccccactgattatattctatagcaagataccacgttacaacaagggatgagcaaccaagcaaaacaccacatgggaccgtgggccgatggacactaccgaacgcagaccacagagatgaaccgtcgaaacaacgagcaccacaccgaaatggcaattggcgcagggcagcaccacaggaggacagcacaattggcgggcacaccaacacaggaaagacacggccaacagcgacccagaccgacagtgaagcgcacaaacacccacacatccaaggcgacagagagcacccctaacacaagtgaaacaaaaagcgataaccacgagcatgaatgaagacggaacaaagctgccgagaagacgcccacagaggatgcaggaacaatgcaccacacagcgatgaccacagaagacagaacgaacacagtgacaccgtgacgaacgacacccacagccaggtgtcgacacacactcgctgacacagtagactaacaccaca

SEQ ID NO: 683634 - DNA, 807 bp, Homo sapiens
gctactggggccgtggtgctgatcccgtggtgatgctacgcggctccctgggctccaggctgtgcggggtgtaggtggcagtcacagacggtcggggcccgaggtgtccggaagtggcgcacatggtgtggcaggggagagcatggctcacgctggatggtctgggtgggacctggagatgacaggattggacattgagaaggacagattattgagatggcctgtctgataactgactctgatctcaacattttggctgaaggtcctaacctgattataaaacaaccagatgacgttgctggacagcagtgtcagattggtgtaaaggagcatcacggggaagtctggacttacccaaaggcagctgcaggagagtacaacttacattgcacgcaggcagagtatgaattcctgtcctttggtacgacagcagactcctccaggggctctgtacaccttgcggggcaacaatctcagctccactgtacatcgataagaaagctttcttggagcaaatagcattgcccccaggttcatggaaaccatctttccatttgtcacgaatacactccgcacgctgagccactgttaacatgaacctgtgcagacgctggttatcccaggagagacatattgacattttgcagcccaaaggaaggggtgcttctcatatgggacacttggaatgacattaagtggaaaggctcaagagagcttcgagtataccgagataacatcttagtgaacaaaattggattgaacagagagaggaaacgcttcatgacacaatggggaaaaggggaaaga

SEQ ID NO: 683635 - DNA, 141 bp, Homo sapiens
aaaaagccatttttatggtttttgaaaatttgcttcattctgccaggattcaaactagactattctgaggccctaaaggttctaaagcagttccagggcaacattttaaattaattaagtagtaaaacaaggagaaaccag

SEQ ID NO: 683636 - DNA, 691 bp, Homo sapiens
  misc_feature (616)..(616): n is a, c, g, or t
tggaaggaaaattggtattatttcaattattttatatgtacaaaaaactcaacagggtacattaaacccagttaaggggcaagttcttaagcccttgtgccttttcgagcctgtggggatacgacccaaaaacttaaggacccaggacatggccaccccagtgaggggggatctcatcgtatctggtcatggtaatgggcccgagatagctacccaccagctaagccaaagcgcctatggtctcccgagtcaccggtgtgaaggcgacagtggtgcaggtctctccgggggactagacgtcccagtctggccttccccttgaataatgcagtaggggacccccatttaacgacacagggcaggcaagaagacaaccagctcgaggggacccacgtcgttgtgcaatcaccaccagcgtgagctatctgtgtctccaccagggtggtgacggtgtaaactccggctcgaaggacagggggtctctcacgtgggagacgtccccttggccagaagcctatcaactcggcccggggccaacaagtctcggatatctctctggctaaggcctcgggtctagtcactggggggccagctaaagcagtgagtagctgttggncgggccaggccctggggtgaccgcggtaatcgagaggaggcatttacaggcggtaaaagagaaggcccaagcaga

SEQ ID NO: 683637 - DNA, 188 bp, Homo sapiens
gaggctcccccttcatctactaaacaaaacagtagtaatatatagcttcatactaagtgatgcatgatataccagtatggtacggcaatggtgcagtcaaggatgcatgatataccagtatggtacggcactggtgcagtcaagatatggactacaaaagaagttagagaaggtagagagccgggcaa

SEQ ID NO: 683638 - DNA, 109 bp, Homo sapiens
  misc_feature (13)..(13): n is a, c, g, or t
catccccaacctntgccccttgggaccctctcccagggccaccacctgttttgccccactccccacattcccacctttaagaataaataagttttccttttgttttcca

SEQ ID NO: 683639 - DNA, 462 bp, Homo sapiens
ttgcgtctcaccttgacttttgttttttgttgtgctgtggtcttgttttgttttgtttgagacagagtccgctctgtcacccagacggagtgtaatggtgtgatcttggttcactgcaacctgtgcctcctggcttcaagcaattctctcctgccttggcctcccaagtagctgggattacaggtgtccaccatcatgtccggctaatttttgtatttttagtagagacggtgtttcaccatgttggccaggatggtctcaatctcctgacctcgtgatccactgtcctcggcctcccaaagtgctgggattatagtcgtgagccaccgcactcggccaatacctcaattttaataagagctgtgtcctcgctttggttctggaggccccacttacagctagcaaaaaatggccttggactacagccttccaaatgtatcgtatttatcttattattatttt

SEQ ID NO: 683640 - DNA, 294 bp, Homo sapiens
cagaggcacatggaggtagaagccacgtcagagctcagatggaaaaagacagaaaggcatgaagaggcaacgttgccgaaaatcacagcagaacagagaacggtcacgaaaattaaaaggtttaagaagacctttcggagggggtacacatatctgtatatagagttcgaaatttgagcacaccagccaagacgttccagacttgaaggccaagtgctggggcaaactgtacctgacagggggttggtggtacttgcacaagggatgtcacacgtggttagtacgtggacaggg

SEQ ID NO: 683641 - DNA, 1566 bp, Homo sapiens
  misc_feature (485)..(485): n is a, c, g, or t
  misc_feature (1443)..(1443): n is a, c, g, or t
  misc_feature (1566)..(1566): n is a, c, g, or t
gggggtggcgtcaggggatgcggtgcgagagtttgccctgaatttgctggtcatgcctgagaacaccgcacaggtgcgctgtgcgtaccaaccgctacagaattgcagtcatgggactacgggggtcgtgacgtcttcgaaaatgctgtcgtgtggtgcagctggacgagtgctcgaattacgtatcgttcgtgtggagacgacgactcattggtgtgaggtcagcctgtcaggtggccaagtggtgaccataaacatcctcggtatgatagcctcaactgggtcatgtgcagcgcagtttgagaatacctcccggtgaaggccaagtatacgctaacgtgcttagcgtgtgcgttggcttaacgcatgcgaagagtacaagtcttttagagaccttggggtgcttcccattggatagcatagtacacgtgcgcgataggtaagcccctaacttggtacagaaagcccactcctaggtcttgaanacgcgcgaacagttttgcgaaaatcactcctgaagtggtcagcgccgatgcaccttgaacgcgtacgtgggaccccctcattgggtggctttcttcaccacaacagaccgcggcagcggtattaaaagaacctttgttccttagtgaggcacctcgaccttcgacaatccggggaaggggaaagccccgggtggaaaaaccgcagggccgtgaggctgtgtaaacgttgcctgatagatagttgcaccctgtgcgcgctttggggtcctggtgtcccttggcgcctgttctgcgggtccgggcaaaaccgccacggggctgtagatgatcttccccattccccacacgttgcgggcacgtgctcccctatttcaacccagttggcgccattgaacggtttgccattgagcgccccctgttaaggggttgttgggcattggtggcatgtgccatccggtggcgacccctttgagggcaccccataggggtgcacatgtggcggcctttggcgcaagggtgacgccgaaagagatggtccctgcgtgacaggagagcacacctcgaggaaaaagcaagctgttaccccgttggtcgaattcccccaattaagattcccatgagaggcgtatgaagcacggaccaagtgccggtgccaatgatgcgacaaaagacccatttgcgagagtgaatccacccgtgagccattgttaacgactgccctttctccacattttgtgagcctgtgtctgctaacggtcattacgagcacatgggttgtgccgactacccaaaagcgttgggagttcacattttccactaaaaaacgcagcatgtttcgggcgagcaattggcacccgggggaggtcgcccctggtagggagaggacccccacaccaattggtgtgtccccccaatttggcccttgtgatgggcagacggcaatgaacgcgttttggtnccaacacccactgtcgttgcttatcccgccactatgtcttgggttctccccgccacatatgtcgtacgcaacatagcgccccgtctaaccacatgagcgtgttggtctaacaccaccaaccan

SEQ ID NO: 683642 - DNA, 211 bp, Homo sapiens
tcctgaggagaaaactccgtgagcccagaggaatctaaattactctattataaagatatggccaggtacggtggctcatgcctgtaatcctagcactttgggaggccgaggtgggtggattgtctgagttcaggagatcaagaccagcctaggcaacatggtgaaaccccgtttctactaaaatacaaaaaattagccaggcatggcagcg

SEQ ID NO: 683643 - DNA, 582 bp, Homo sapiens
  misc_feature (213)..(213): n is a, c, g, or t
gcctggtgggccgcggtgcggggttcccaaaaatgcaaaggcgcccattgcccctttcaaaaccaggggcagcatccagtttggggattggcgcccccctggttctaaggtgggcctcaccaccagcccccccttggggggcttgggggaaacctggccaaggtacaaaaagttgggggcatgttgagcacccccccacccattttttagggntgggttcgcctggcccccaagttttcccttttgtatccccagggggcctttgttccttggtacgtggggggggggatggaggaaggcgatttttcaagggcccgtgaaaatatggctgccccttaaaaggattttaagggggttgggggggtttttttttaaggaggggggggggaaaaagggggggaaaattaattatcccttccttttggccccccagcaagtcagggtcccagaattttgggttcgggtttactgccagaggttaaagcttttggggtagattgttttccctggggggtcatgttttttcccgggggcccgggaatttttttccctcatttttcaagggaaggtcttttcccccca

SEQ ID NO: 683644 - DNA, 803 bp, Homo sapiens
  misc_feature (398)..(398): n is a, c, g, or t
gagggaggcgccgcccccaaccaaactgtctgggggacccccggggggggaacaacgcgggccaaacggccagactccctggggacacacccagttgtccagacctctcgcggagaggagaaatttttacgcccccaactgggggcccccccgggggccccgggaaccgcgcctgggtggggcgcgggaacagttttttcagcccccacaacctggggaggcggcccccctcccacacacgcggctgtttttatcccccccagaagagagcgcgctttttctcccacagagaaaaagttctggggcgcaagggagacttccggaagaccccctgggatacacatcctccgcgagccagagtattactcccctggaatttttttcccccttccccaganccccggtggcctgtgacattttgtaacaaaacatctccccgtctcaagtataagagggccccgatatttctacatggcacaatgggccgtcggtacattggcgttcttctcacacccggagatgggccagctttgctagccagactggggtccacatcccccattctatcctggctgtaaaaccagtagctgtgctttgaaatagcaccccccatggattaccccctctgattaccccgaatttgggcgagcacccacccagtgctctccccagagatggtttggccctctatgggggaaaccagggggtgttaaaagagccaatttaatttttggggggttttaacccccccaaacaaccttcagtagagccctgatttaaagggaaccccccgagattttcca

SEQ ID NO: 683645 - DNA, 381 bp, Homo sapiens
ataagaaaatttgatggcagggacaaaggggtagcatttattgttatttaataaagaccttggggcaaatgggccacttatgaggggatcagttgttgcatgtaatttttgcctttgtttaagcctgggacttgtaagaaaaagaaaatttaatttttttttttagggcgagctatagaaaagctattgagaggatttagttaatcagggcagtagttggaaaccctgctgggggatgtgaagggcttttgggcttttgaaagactttatcatttagtttttgtctatttttcctttgatgttcaagtcctagtttataggattggcagtttaaaagctttactcccccttttaaaataaaagattaaaatggggtttgga

SEQ ID NO: 683646 - DNA, 168 bp, Homo sapiens
ctaactacaaagctgcattaaataattacggttggggcgacctcggagcagaacccaactccgagcagtacatgctaagacttcaccagtcaaagcgaattactatactcaatagatccaataacttgaccaacggaacaagttacccttgggtactacgctttggca

SEQ ID NO: 683647 - DNA, 120 bp, Homo sapiens
tatggaatgaatcgaatggaatgggatcgaatggattggaacgaaatctgaatggaacggaatatgaatatgactcgaatgtaatggattgctatgtaattgattcgaatggaatggaat

SEQ ID NO: 683648 - DNA, 663 bp, Homo sapiens
ggggtcttatcactaggcgtctcgtctctagaaagcacaacactaatgtacgtggccttagatctcagcttcaaatgccccgtatcaatatcaatgatagacgctacatatcccagactgtatgctgttgtcaactctatgtagtggttacctgcttatgtatcgtacttcttggtacagccacttgtgctatctcactaacaccttgaagtgagttaggactaccagatcttactccacgtatacttgaggtttgtgaaggcatcggttaagggcacaaagacagccatggggacatttatgtaaatacgtctctaattgccacactgcagctgaacagtgtgtagtattttcccagtcagctttgccatactgacgtcaatcatttgagagaaattattcagattttattttgtatctgtggtaacaaaacattaaccaaaagattttctgtccagaagcctccccgaccccccaagctatttgctcacattaacaaattaaagtgcctgaagcataattcattctttacctgtatactaaaaaccctgtgtatcgatttttttataataagcctttttacctctggtgtcacacatatatatacaagtgttgatgtacattttagttcttacttttttatggttctaatatgtatgacaa

SEQ ID NO: 683649 - DNA, 260 bp, Homo sapiens
actcaagaggatcccctcttctccgaaagcaacatctctgtggtgcagtccaccgtctccaggggctatggcggggccagtggtgtccgcacgtggctctacggcctggttggatggaatgcagcctagcctcctagtagcagtgtggtcttgtgctgttggagagtggcgttcaggtctccccgccacgtggacagacgccagttgcgggcgctggcctgcagtctctcgtatggacggcgagcatgttcccaccactc

SEQ ID NO: 683650 - DNA, 144 bp, Homo sapiens
cccgtttctgtcgatcgctgccagtacccggcagcttgctctggctactgtgagaactttggcacatgccagatggctgctgatggctcccgacaatagccgatgcactgcctactttgacgggactcgaggatgtgagagtga

SEQ ID NO: 683651 - DNA, 953 bp, Homo sapiens
aaaagtgaattaaaaaaaaaaaactttaaacatataaatacgaatccatcttcctgccttgggataaggggtcaaggccttttcttggagtgtgggtatgtgatgggagttctgtgtatctttctggcttaaaccacacttgtaatgcagcatttatcacttggagtttgggtgggagtgagaatttagacagtggagaagcagtatgaatatagactctcttcagattggttacagttttggctccaatatttggtggttaccatgcccatacctaatttaaaacataattttaagggtctttttagttttccaaagtattcaattaagttatagaaacaatggtttctatattcctatttcaccatttgcagtgagccaagatacacaccagtgcacttcagcctgggtgacagagcaaggtctccaagaaaaaaaacacagggttgcatgtcggaatgggacatgggcgtgagtcgacccacacaaaacaaaaaaaacggaggcactgagaaaggagaggaaagcgaaagagcaaaaacgaaaaaaagagaacgggaaaaacaggacacagggcaaaaagaggaaaaagacccagccggaggaggcacaacagcaaggggacgacggacacacatggacaacaacacaagacgacatgtgcgagaagcatcatagaaacgaaggagacgaacaggaaaacacacacacagactgacgaagtcacagaacaagacacgaacgcgaccaccacacaaacgaaagtgcacgcgcagcacaaacagactggaggacagactcacaccgaaccaccggatacaaagacacaaccacacccccaagacagcaacagaaacaacacacacaaaaagagccacccacaaagaagaacaacaaacaaaacaaacacaccaaacaaaaaacgatacaacacaacaagcaacaacaccaag

SEQ ID NO: 683652 - DNA, 416 bp, Homo sapiens
aagaattatatataaagaagggtgtttaataatgatagttataataataaataattgaacccatctgaatcccctgcaattggaggtaaattatgttttagttataattagattgtgaatcagccccctgaaaatcctttttgcatatttcaatgtcctaaaaagacccggttgctctatatatgaagtgaaaaaaggatatgggagccttttatagtactagttttgctttaaaatgctatgtcaatacccacaaaccctagaaagaaatatatatccccctgttattgtatttgggggagggaaactgggataatttttattttctttgaatctttctgggtcttcccctttttttcccgtgaatttaatccaatagtaaagttgttgtaaaaataaaagtgggtttagaaaga

SEQ ID NO: 683653 - DNA, 936 bp, Homo sapiens
gaactctttttgacccaatggttgtactctcagatgcatctctgatgctgtgtaacttctatcctatccaatgtaaaggctacccccacctatcactgtaggattcaagtcatgaaatgccgatggtcctagtcagtgaatcttgaagatactgatatgtgacataaggagttgaaaatgtatgtgtaatcgaaaaatgcaatgtatagggctaatatggcagtggcatgaagattggtaaactgttagagtcaagaatatggttcataatgagtgtgtgtcattcattggtcttatattagtttttcttggatatagaggtagtagttggtatttgtctgattctgttttcaattcagtacgagtttggtataataattaagttgtcagtctctgtgctcgacatactgatccatttgtctaccctatgagctggtgttgagcatcttctgtttgtccctgagataccttcaaagggtcagaaagggcatatgtctatcagtgatgactgtgaatcctttgctaatatgcaaaggccgagatgctactactcggaaaatctacctcggtactgacttaaatatatttcctttaccatctctttcacagtgcaaggggctgtttttgtgaaacctaagtgtcatgctcatggaagaggcccatctttatacaatagttctctagatacatcgtctgtctagaaacttgagttcatggatgtcttagtgtttaccgtgtttgcgaggtggtaacaaaaatgaaggcttgcaagggctccaccctgtttcatatggaccctgaaatagcatttacggacagaacgattggttcttacaggttcttaatgtatttccacaataataaatctaaaattggtttcccctttttaaagaaagtccgtactttctcctcccactgatctctgcattcttaatg

SEQ ID NO: 683654 - DNA, 172 bp, Homo sapiens
ggacctgattgatgacagtaagctcaaggacatcgagatgaggcctggaacatgagctgatggtggctgaccggcgccagaaagcgagagaattcggcagctggaacaggaactgcattagtggcaggtgctagtggacaggcatcacatggcatgagctctccggacttcg

SEQ ID NO: 683655 - DNA, 392 bp, Homo sapiens
ccaaactcgctgagagtagctatcgctcccattttgggagggcggcgcactcatgcacgccgtggccctagttcttgtcccattccctttgttttaattgttttcccgtaatgaagtgtgtttccgaaatggtaggccttggggttggggaagacctgggttcggctctgtcttactctgctttgtgctcacaggctgggtaatttacgactaacacaaatgtattggctcatagttcttggggctgggcagttggacagcaggggccgttgcacagcaggggccggtatctgtcaagggccttttgctgtgtcagtccatggcagaagaacaaagagaaggtgagagaagaagaggggctgggcttgtccttttattgggaagctgctcat

SEQ ID NO: 683656 - DNA, 113 bp, Homo sapiens
cactgtacccatatcgaacaagggggttgtgtttctcaaccatcagatgttcctgggaaattgtcaaccctcgtgatgcagtagaaacacctggtgtatttagatttggaacg

SEQ ID NO: 683657 - DNA, 151 bp, Homo sapiens
ggatccggatacccaggtgtcttttcccctcaacaggctacattccatccagtcttcacatttagctgattatcttgcctgtgttgatctggtatatccgaaaaagaatccttcagggattaagcctacctacctatccagctgcgtttca

SEQ ID NO: 683658 - DNA, 86 bp, Homo sapiens
atttaatgtagaatattgcttttttaaaataatgtttttattttgctgtagaaaaataaaaaaaaatttgattataaaaaaaaaaa

SEQ ID NO: 683659 - DNA, 147 bp, Homo sapiens
tacctactaatgtgaaatgacagaactattttacctcacaggctgtacaaaaacagggacaggctggtttggcctctggacccctcaatgcattaataataatccagattgaaagtctgcataggtggggtccagaggccaaaccag

SEQ ID NO: 683660 - DNA, 853 bp, Homo sapiens
gatgacgtgcagccggtctctgtgttccaaggatatgggtctctcggttgatgactggcgtgcgtgtactgatcataatagctcaggaagatgagccgtgcgtagtgctcgtccccactggatacacgttaacgcagtccaattaagcgctattgtaaccgaagaatccgcgcaccaggtgaaatgtcatagctaatccgcaatttgcgtatccatcttgtgggccatggtacctagaagtgagttgacggcatcagatgaggccctaattttggcttagcattttggtggagttctgcactttcgttgccgaaaaaattaggtttttcgcgaaagaaaaagtctcattattggaggactaattctagaaagagctcttgggtctctctattggacccggaattggaacattatggagcctagatgatgggttttctactaacggtgtttgaacttttcaagaggtagctagctggagtgggtgcttgaagaacaataacatttcgaatctaacgattcttgggaatgctatcgaattgaggggtaaaaactttcggttatggcagatataggcttttggagaaagaattttcaacaaatcattaggttggaaaaggaagaacaaaagcttgtataagatgttttaaatgatcgtcttgatatgtcttaagaggaagtgggggactataacttctggtcttgatgtgtggggtaaggaaaatgagtttcttaaggacgcgtgtttgaccttgtttttttgaaccatagtatgttttaggcactttccaaatagggaattacaagggggtgtaaatttggaaatttaatgggtaccctgaaggtttcctgaaaa

SEQ ID NO: 683661 - DNA, 1197 bp, Homo sapiens
gagagaactgacgaggcgaagatgtccttcctggtgactctgaacaacgtggaagtctgcagtgaaaacatctccactctgaagaagacactggagagtgactgcaccaagctcttcagccagggcattggaggggagcaggcccaggccaagtttgacagctgcctttctgacttggccgccgtgtccaacaaattccgagacctcttgcaggaagggctgacggagctcaacagcacagccatcaagccacaggtgcagccttggatcaacagctttttctccgtctcccacaacatcgaggaggaagaattcaatgactatgaggccaacgacccttgggtacaacagttcatccttaacctggagcagcaaatggcagagttcaaggccagcctgtccccggtcatctacgacagcctaaccggcctcatgactagccttgttgccgtcgagttggagaaagtggtgctgaaatccacctttaaccggctgggtggtctgcagtttgacaaggagctgaggtcactcattgcctaccttaccacggtgaccacctggaccatccgagacaagtttgcccggctctcccagatggccaccatcctcaatctggagcgggtgaccgagatcctcgattactggggacccaattccggcccattgacgtggcgcctcacccctgctgaagtgcgccaggtgctggccctgcggatagacttccgcagtgaagatatcaagaggctgcgcctgtagctgcctggatgagcacacctggctcatcacacttgcaggcctgttccctaaggggccccagccaaggagctgagcgaggctgtcgggcttgggggagatctgacagcccagacctttctacggctggcagcagagaaacaaagtctggacccactccatgctctgccctcagacctggccaggtgatgctctgggggcagcatctccccaccgagagaagcgggctcctaatgaggtgggaaagccacggcaggcagcgagcagcccaggccagctttctgcatggatggtcagtctcttgccctcaaacactacagcaaacaagctacccctgccagtcctagacaacttgggtacatctggggacctagcagttaggcttgactttgaggagaggctgtgatgtttatgatccctgaataaagctactccttggagaga

SEQ ID NO: 683662 - DNA, 1113 bp, Homo sapiens
gagagaactgacgaggcgaagatgtccttcctggtgactctgaacaacgtggaagtctgcagtgaaaacatctccactctgaagaagacactggagagtgactgcaccaagctcttcagccagggcattggaggggagcaggcccaggccaagtttgacagctgcctttctgacttggccgccgtgtccaacaaattccgagacctcttgcaggaagggctgacggagctcaacagcacagccatcaagccacaggtgcagccttggatcaacagctttttctccgtctcccacaacatcgaggaggccagcctgtccccggtcatctacgacagcctaaccggcctcatgactagccttgttgccgtcgagttggagaaagtggtgctgaaatccacctttaaccggctgggtggtctgcagtttgacaaggagctgaggtcactcattgcctaccttaccacggtgaccacctggaccatccgagacaagtttgcccggctctcccagatggccaccatcctcaatctggagcgggtgaccgagatcctcgattactggggacccaattccggcccattgacgtggcgcctcacccctgctgaagtgcgccaggtgctggccctgcggatagacttccgcagtgaagatatcaagaggctgcgcctgtagctgcctggatgagcacacctggctcatcacacttgcaggcctgttccctaaggggccccagccaaggagctgagcgaggctgtcgggcttgggggagatctgacagcccagacctttctacggctggcagcagagaaacaaagtctggacccactccatgctctgccctcagacctggccaggtgatgctctgggggcagcatctccccaccgagagaagcgggctcctaatgaggtgggaaagccacggcaggcagcgagcagcccaggccagctttctgcatggatggtcagtctcttgccctcaaacactacagcaaacaagctacccctgccagtcctagacaacttgggtacatctggggacctagcagttaggcttgactttgaggagaggctgtgatgtttatgatccctgaataaagctactccttggagaga

SEQ ID NO: 683663 - DNA, 106 bp, Homo sapiens
tgccgaagtgaccacaggtcttagattccctgtgcagatgaaaagatttgtgcctttaatgatgaaagtgatctgcaaggaaccgacgctctgcaaggaacccacg

SEQ ID NO: 683664 - DNA, 1442 bp, Homo sapiens
gagagaactgacgaggcgaagatgtccttcctggtgactctgaacaacgtggaagtctgcagtgaaaacatctccactctgaagaagacactggagagtgactgcaccaagctcttcagccagggcattggaggggagcaggcccaggccaagtttgacagctgcctttctgacttggccgccgtgtccaacaaattccgagacctcttgcaggaagggctgacggagctcaacagcacagccatcaagccacaggtgcagccttggatcaacagctttttctccgtctcccacaacatcgaggaggaagaattcaatgactatgaggccaacgacccttgggtacaacagttcatccttaacctggagcagcaaatggcagagttcaaggccagcctgtccccggtcatctacgacagcctaaccggcctcatgactagccttgttgccgtcgagttggagaaagtggtgctgaaatccacctttaaccggctgggtggtctgcagtttgacaaggagctgaggtcactcattgcctaccttaccacggtgaccacctggaccatccgagacaagtttgcccggctctcccagatggccaccatcctcaatctggagcgggtgaccgagatcctcgattactggggacccaattccggcccattgacgtggcgcctcacccctgctgaagtgcgccaggtgctggccctgcggatagacttccgcagtgaagatatcaagaggctgcgcctgtagctgcctggatgagcacacctggctcatcacacttgcaggcctgttccctaaggggccccagccaaggagctgagcgaggctgtcgggcttgggggagatctgacagcccagacctttctacggctggcagcagagaaacaaagtctggacccactccatgctctgccctcagacctggccaggtgatgctctgggggcagcatctccccaccgagagaagcgggctcctaatgaggtgggaaagccacggcaggcagcgagcagcccaggccagctttctgcatggatggtcagtctcttgccctcaaacactacagcaaacaagctacccctgccagtcctagacaacttgggtacatctggggacctagcagttaggcttgactttgaggagaggctgtgatgtttatgatccctgaataaagctactccttggagagatgccagtgttgctgttcacctggtagggccagatgctatggggccgagccggctctccgtgctcgacttggagtgtaaacccagatcgctggtcccaccgggcgcccgctgtttcgggccctgttgggcggccctctcttcctcttcgctctgtccctgccagtgggtccgggtccgggtgaggcgcccggcgtttgcgcccgggggttccaacgacccgcgcggctttgggcaagtcggccccg

SEQ ID NO: 683665 - DNA, 732 bp, Homo sapiens
  misc_feature (190)..(190): n is a, c, g, or t
  misc_feature (212)..(212): n is a, c, g, or t
  misc_feature (238)..(239): n is a, c, g, or t
  misc_feature (602)..(602): n is a, c, g, or t
gactccatgattgaaatcacaattgggataaagttggtagagatgcttcttaatttacagtggggttatatcctcataaacccctcataagttaaaaatattgtaagtggaaaatgcatttaatacacctactgacatcatagctcagccttgtctgccttaactgtgcccagaaatgcgcattagcctncaatgggggcaaaatcatgtancaaaaagcctattttgtattaaagcnncaaatatctcatgtagtttattgaatactgtattgaaagtgaaaaacagattggttgtataggcactcaaagagatctcagttctcttgcaagctccttaaagatgactggatgaggctttacaccattgtgtgtttgccaccgtgtttgtacacaggaagggctcaataaacaaatcattggtgactctttgacaacacagaaaacgattttgacttacagtgatttaaaggaattttagacccttttagcttgaagtcttaaaggaagttaagaagatagaaacttatttttaagagcttcccctacttgcattaataatgattaaatgttgaatcaaattagaatgaccaggctgcagtncgtataccaatgtttgggaggtgaatgttctcaatgagggtcatgattctaacaaaattagttgttactcaaagcctgtttttcaacttccatttgcctcctactttgcccacaaaaaaaaaacaacaaa

SEQ ID NO: 683666 - DNA, 362 bp, Homo sapiens
tagtggtctctccacattggacgtgacctccattgtcacacaaagacctccacagccacgtggacgagacctccatagtcacacaggagctccacaggcacatgggaccatgggacgtgagcaccatagtcacccaaagagctccactgccacgtagactagacctccatagtcagacagagaccgccatagggacatggactagacctccattgtcacacacgcgacctccataggcacattggactagactctccattgtcacacagcgacctccacaggcacatttggatgcgaactccatagtcacacagcgacctccatagagacatggactagacctccatagtcagactgcgaac

SEQ ID NO: 683667 - DNA, 577 bp, Homo sapiens
  misc_feature (269)..(269): n is a, c, g, or t
ggactggaatgggtagccagcggccaggataccaaagccttacaggacttctcctcaagtgtcaagatgtgccaaggtaatcgagacacttactttcacctgcttcagactctgaagaggctagatcggagggatgaggccactgcactctggtggaggctggaggcccaaactaaggggtcacatgaagatgctctgtggtctctccccctgtacctagaaagctatttgagctggatccgtccctctgatcgtgacgccttccttgnagaatcttgcatattttcgctaaagttttggagcatgtaggtgccacgttttgaagagcctgagctgggtccccagtgggctgtctctatgaggggagggctttctggttcaccaacattaggaatgtggccattcctaaataattcatgaagtggtgagatgggtggtaggcctgtggtatttgcccaagtaacaaccattgtcgtttcggaggaaacaatcttggccaccaccgagtcattgagtttgtccgaggcgccttttttccggcttttcatattgggttgtggagtgaaatttcagattt

SEQ ID NO: 683668 - DNA, 322 bp, Homo sapiens
  misc_feature (240)..(240): n is a, c, g, or t
cgcagtggccgagagatagggagtagaatcgtgttatggccgagggataccttcggattaagaccagtctggcgcatccatcccgacacatctccttctccatcatccgttctccaccctcgcttgcgtccccgctgctaggtctgtcctatgacctcctctccgtgccgaatcggtggcctccaggatcccacaggactccctgagagcccccggggtcctgcctctacccggacctgngctagaggcctcctaggctgggcctgtcttgagcacacaggacgccattcgctgtgaattcctcgaattcttatgactattc

SEQ ID NO: 683669 - DNA, 355 bp, Homo sapiens
atgcttgttggtcgtctctagacgatcccctttcgccatgtttcccccacatttgaaaactcaattaatgtatgtccactatatcaacagactagtagaggtaacaatcagcgtggtcacgattgtatagatgcagaaatatgcttttgacaaaattcaacacggattcaggatgaaaaatcctcagcaaactaagaataggggtcacttccttgtagtaaagaacatgtttaataaatacttgttgtttacatcattactttatagtgagacattagaggctttctcactatatcagaaacaaggtaatgatgttccctctcccaatttcttttcatcactgcagttgacgtca

SEQ ID NO: 683670 - DNA, 665 bp, Homo sapiens
  misc_feature (192)..(192): n is a, c, g, or t
ccctcaatagaatgttttcaagcataacttaatataaagttcgcaaagaacctgtcatgtaaaataagtgaaatttcaaaagtttatgtcaagtacatccatatccgttacccaaattaagacgcatgtggtcctaaaattctatatcaaattcatatcttgaaaatctacacgtgtaataatctaaatgtncatttctattggtgacaaagtcacaggtactctgatcctactgtgacttgtttccatattcgtaattaaaggaatgttatatttcaagtagaagtttggtaaaaagaaagatttaaatttttccccatccaagttcaccagacccctggtttagaggttgtcttaattttacttttgtcattttaagagtaaattattttgttttcttgttcaattctcaattatttgggcttattttactgcctcttgcatgcttttttatgcttgaatggtttttgcagtgttagaacagtaataattgaagacttgggtggaaaaaaatcagcacctgattgaaaatgaaaggtttcaacaaaagctcttgataatgttacctccaggtgtaccatcatgccaccattattggtgctacaaatctgttaatttatttatgcttaagtatgtaaactttaaaaaacttggatcatctgcat

SEQ ID NO: 683671 - DNA, 208 bp, Homo sapiens
gggagctcacactacattaggtgagatactatctctaaggatagacggcccgtgaaggggccccgccttttctgggccctccagcaaagctgagaaacagaggcggcaacatctccttgtactatctcctatgtctgctgtgtcaatatggactctctgggccagggaattcagtgtggagaccgccaggcctgtctctgtttctagt

SEQ ID NO: 683672 - DNA, 327 bp, Homo sapiens
  misc_feature (281)..(281): n is a, c, g, or t
gaagaggtcctgcccctccaccagctccacgcccatctgctgggccaggaaggcatgctcgaagtaggccgagttgtacatgcccggcgtcatgacgacgacggtcgggtcggccacgcccgagggcgcgacgctgcgcagcgtgtccagcagcaggtccgggtagtgggccaccggggcgatgcggtggttgacgaacaactcggggaagagccgcatcatcatcttgcggttctcgagcatgtagctcacgccgctgggcacgcgcaggttgtcttccngcacgtagtagtggccgctgccatcggcgtggccggcgcgcacgat

SEQ ID NO: 683673 - DNA, 449 bp, Homo sapiens
ttcctctttctcctcctgttttttttccttttctttcctcaaagagaaaactaggaagagaataatgaggattgattaatggtcaggggaatacaattcacacagaagaaagaaatggagactaaatggttattggcagcataggaatctgatagaggaaaaagaatatatgttttttggccgggcccagtgtctcatccctgtaatcttagcactttgggaggccaaggcaagtgaatcacctgaggtcaggagttcgagaccagcttggccaactggtgagaccttgtctctactgaaaacaaactaaaaaaaaaattggccaaccatggtggtgcatgcctgtagtcctagctactcgggaagctgaggcaggaggatagcctgagcccaggggagttggggctgaagcctgggtgacagaggaagaccttgccttcaaaaaaaca

SEQ ID NO: 683674 - DNA, 893 bp, Homo sapiens
cctcctgttttttttttctcttacattcttttttttttcccggtttatcctttaaaacaagataagattggaaatattctcttgtgcaattattggtggcactccccagggtgaactctcaattagaaaagtgtccttctctctggggtaaaagggatgggttccctggtatatggactatagagtaagatgtggcgcaggcaatcttcccatggccttttccaagcagaaggggcacagaacaggtagcgggagactggccatctctgggcaagattccgagtgtaaagaatctcttctaaatttctacctccctggttctctgaatcagcccatagtttgtgtgcatgaggggccactcttaaagagtcacctcagtactcgggggatcttacggtcttggtccaagggtcaattaaaaccctagtctcctttaatcctacttcctatcctcagctagatttgaaccctcagcttttttaccttttcgggaccttattactagtggacttagtattcactttacctagatgacacgaattcttcttaacaacatttaatatctttgtaagacttcacaaattcagattcctgtacctggtgcctgggtcgggcccaagggtggattctccctagaagaacaaaacacatcaaggctttctgtcgggcccttagcagatggcaggggcggtctcaaacgaacgttttcaccattgggaaatccctaagggcggaaagtccaccggtacacttgatctctatccaacttcaactacaggcttattagatggtttcccatgtcgcagtctggtctccaagtttcaccacaacctgtaaggcttagtgctcgtcaactttttaaccgtacttgactggaagcaaagttcaaagga

SEQ ID NO: 683675 - DNA, 238 bp, Homo sapiens
caataataatgtggcatattgggatgtattgaaggcatgtaaaagttgaagatctgggcaaaagtggattttgaaagaatgaaaattaaagaaaaagaatttaaaaatgtgtgtaatgtgccaaaattggttctcagtagacttaaaacagggatgttaactattactttggatgaaagtgattgttttgctgcctgggtttctgcaaaagatgctggtttcagcagccctgatgggt

SEQ ID NO: 683676 - DNA, 388 bp, Homo sapiens
gcattactttcatatattatctcacttatttttatattttaatggaaatatctactcagcatgataaaacagttttgtttttctcatattgccagaaggaatacacagtttctttaatatgaaaggcaattttatacatccgcacaaagagtaacacttcattcatagtatgctacacgtataggaaggttggtgaatatctgcagtttgtactttcgagttgagtgctttcactataccttactgcctttttttagaatttatatattaaaaatatattttaatcttgttatttgattaaaacccaatttgtacaattcatgatactggaaaaattacaaggtttgataaatttattctgaataaaattaagatatgtaatttgaaa

SEQ ID NO: 683677 - DNA, 379 bp, Homo sapiens
ccagatggtgtcaagagcctggacaccacagctggggtcgagatcccaccagtgtctggggaccttccccaggccaccagtatcagattctattccattgctcaaatcacaaaacattgaatggagaggtctcctctggaagcataaagtaaagattctgtggcatggtggccagttaggcatggaaggcatggcaaaatattgaaaatgagggattaggtgacggtatagtaactgctgaatactaaatacttgatccaggccccattccctggagactgacagagagacacatcgtccaggtagtagtggagaaatactttctgggtatctgaccagccttcgtggaaagaactggcaccatcctgcaggtgcaact

SEQ ID NO: 683678 - DNA, 496 bp, Homo sapiens
cctcgccagtgcacataggagttagaaagagctgggcatgatgactcatacctgtaatcccagcactttgggaggctggggcagaagatcacttgagatcaggagttctagaccagtctagccaacatggtgcaaccctatctctactaaaaatacaaaaattgggctgggtgcgatggttcatgcctgtaatcccagcactttgggaggccatgatcctcatggatcatgagttcaggagctcaagaccagcctggccaagatggtgaagcatggtctctactaaaaatacaaaaattagccaggcatggtggcaggtgcctgtaatcccagctacctgggaggctgaggcagagaattgcttgaacttcggcggtggaggttgcagtgagccgagatcgtgccactctactctagcctgggcaacagagcaagactctctcaaaaaaaatacaaaaattagttgggagtagtggtgggtgcctataatcccggc

SEQ ID NO: 683679 - DNA, 259 bp, Homo sapiens
  misc_feature (33)..(33): n is a, c, g, or t
tggcctggggagggggccgtggcccttaggccnaaagtgccttccaaacggcccggtttgggggcgggtgttccctgttagcccgagtccgcttcaggaggggagccttcaggtgccggctggttaggggattaccccctgtgggtgggaggaggcagcgcccctttcaacagccccagggctgcctggggctccctggcaacccagccccggggaaaccgtcagcttctgtggcaataaaacctgccccgggtttgga

SEQ ID NO: 683680 - DNA, 128 bp, Homo sapiens
ataacgacaccgtacccacatttcccgcctgtttgattttatctaattgaaatagtatcagaaaggattttctctgtgcggcacattcttatttgttattgggaagactttctgacttttaatctctt

SEQ ID NO: 683681 - DNA, 165 bp, Homo sapiens
  misc_feature (49)..(49): n is a, c, g, or t
  misc_feature (61)..(61): n is a, c, g, or t
gatccacagtcagcaaatcacatgaacagttcactgctgactatatatnggaaaggaaatnctgattctgtttcaaatactcctgaggttggagccaagaggaaccacctcttcaacaccacgaataagatcaaaacaggctacattcccttgaagaccctgcca

SEQ ID NO: 683682 - DNA, 239 bp, Homo sapiens
gcccgaggaaccaactgttttgagcctactttggggataaaggattatttggttttctggatttggaggcaatcagcggacaacaaggaaaatgtgtgctttggctcggataaaaaatgggacatcattcagtccctagttggatggcccaaggcttttcccaaacgcatttgtagcagagtggaacttgtactaacttatgatagaatgtatgggatattaatgtttttaccagtcca

SEQ ID NO: 683683 - DNA, 337 bp, Homo sapiens
cctttttttttgttgaaaagcccccccatggggggttttcctttattgggggttttaatgggaaatttcccttttttcaaaccaattgaaagccctttttttggatttttcccttgccgtggggtccggaaacccacattttggttcttccccccccttaccccgttttttttttgtttttgaaacaaaattgtttggttttggtttcggttttaaatttttttgcccccggttgttttcccccccccccccccggggggaaggattttttttccctttttaaaaatttaaaggggatttttttccaaattttttccaataaaattttttgttttta

SEQ ID NO: 683684 - DNA, 397 bp, Homo sapiens
cacagagcaagatccatgtaatgtcttgtggtaggaaacagctgggtgggtgctggcccacccaaggttgctcattcactaccccagcctctctgcaggcttgctacaccgatccgccccagcccagcctcagcgggaaggcctctcttcctccaccattaccaacaataccgactcctacagccactcggcttactgtcccgggcttaccagataaccagctaatgttttaagtgaatggataagttaaagggaggaatgaaggggtggagtgagctcacaagaagagtttagcgccaaacctagagaaaagtccaaaaggagcactgccacctggaaaataacgcgttggtcaatgttgtccccaacacccgagcagcgtgcctcgcagtccccg

SEQ ID NO: 683685 - DNA, 158 bp, Homo sapiens
ctatcttaccccttacaggtacattggctgttgggatgagaaaatacgaggaaacaagaatcatttgttcgtttggggcatgcaatatggtgggcaattatatatatggcacaccaggaggggaagtgatgtaatacatggcaagtggaaatcaagca

SEQ ID NO: 683686 - DNA, 370 bp, Homo sapiens
attctacacggatcccccacgaattttggttcaatacttcgggttacaaaacaaagtatcatttcagacatcagctgctacaattattattcattactttttcggagacagagtctcactctgttcgcccatgctgaagtgcagtgccatcatcttcgttcactacaatcctccatctcctgggttcaagtaattctcctgcctcagcctcccgagttgctaggactacaggcacgcactaatatgcccggctcatttttgtatctatagtgtacaacgcgtttacagtgtttgccaggctgttcttgtactcctgacctcgggtgatccacctgcctctgcctcccatagtgctgggattacaggcgtg

SEQ ID NO: 683687 - DNA, 469 bp, Homo sapiens
ccaggtaagactttattatattaacaaaaaaaatgtaactggaaataaaggtaagtcattttaaaagattgacagtttttaaacccctataattctttaatggcagcattagggaccactgcccaagccactttcaacccaaccaagatgctggaaagcagagcacacagttgtgcccaccaagcccaagagggcgacggaccccaaagctcctagactacacttggtgggatctcccgtgtaatagccataagcataaagaactcgtccaacaatccaagccaagcccagaccagaagctatacgcggttggacaacacctccagccgctagacaaacatagaagggaggatacactgccaacgtgttctgacgggctcgctgaatgcagttgatgacgcgcccatcttcaagggccgtgctgaacatgatacgatactccactttgcacttagtgacagccttgaaa

SEQ ID NO: 683688 - DNA, 685 bp, Homo sapiens
aatgtccttaatcctttccctaagttcatgggttactgcatgctaggagggctttttggttacctgcactggctgctttgccagcgaggccaccattcattggtcatcttggtatctgtgtggacatctcactttcctcaatgtataaaggaaccaagtatggatttcagaggtgctcttagattccccatacacccaagggtaataaacgtgtacaagtacagtgttcatgatacgtgccttggtgggagtccgtggtgcctcagggaaggggctcacgctgcttctggtctccagggacagtgctgctggaaaggctagtgatgagcttcaccctggagctcctcccgggaccttgcaagcctctccatccagcatcttctctatcttagttgaatgccttctttctgaacatctgttgtaagaagtatgttatggaggcaccaatacttcgctggatttctttcttaatctcgatctttttgttataaaaatgtatagtgattccatgggacatgtgaagaatgcagtcaagtaaccactttaatgcaatctctgttatcataatattgtatttcgtggtagtcctttccggtagatatttttaaggccctttaatgccattgtcgccttggatttatgagttccaagtgtttcttaaaatatagaaataatgtcagaaaaa

SEQ ID NO: 683689 - DNA, 545 bp, Homo sapiens
ttaaagcaagcaagcaggacatgttgatggccaacagtaaaaccttccaggctgggaaggcgaggggaactctgggagtggatatcccagtttccttgcttgaggaagtccatctggctccatgaaatgagtagacactggagaactacagcagtgcagagataggctgaatctattctacatgttcctcttgaaccctgtgaagcactatcaacaactgttctttctgaacaagagagtgcggatggctatggagcagattccccagcagtaaggctctgcacttggctggcaagttggacttactctggtagtcccaggaggctgtgacagtgcctgacatgagcagacacttacttactacagactggattttgcatacctgctggtagatgcaaatgcccaaaatactatgaaaggactaaaacaaggctgggcgcgatgggtcacacctgtaatcccagcactttgggaggctgaggcagggagatcacttgaggtcaggagtctgagaccaggttggtcaacatggtgaaatcccatct

SEQ ID NO: 683690 - DNA, 181 bp, Homo sapiens
  misc_feature (3)..(3): n is a, c, g, or t
  misc_feature (21)..(21): n is a, c, g, or t
ctnagcaatatactccctacnaaagggggccacttcaccctggggattaacaacataaaaccctcattaacaggagccatcaccctcaggttaaaacacctttccgccattatcctcataccccattaccctgaaatccttcaggggtgttcttattacagggttttcctattaaaaaaaa

SEQ ID NO: 683691 - DNA, 970 bp, Homo sapiens
  misc_feature (3)..(3): n is a, c, g, or t
  misc_feature (112)..(112): n is a, c, g, or t
  misc_feature (114)..(115): n is a, c, g, or t
  misc_feature (122)..(122): n is a, c, g, or t
  misc_feature (154)..(155): n is a, c, g, or t
  misc_feature (158)..(158): n is a, c, g, or t
  misc_feature (204)..(204): n is a, c, g, or t
  misc_feature (232)..(232): n is a, c, g, or t
  misc_feature (241)..(241): n is a, c, g, or t
  misc_feature (245)..(245): n is a, c, g, or t
  misc_feature (251)..(251): n is a, c, g, or t
  misc_feature (270)..(270): n is a, c, g, or t
  misc_feature (287)..(287): n is a, c, g, or t
  misc_feature (300)..(302): n is a, c, g, or t
  misc_feature (308)..(308): n is a, c, g, or t
  misc_feature (315)..(315): n is a, c, g, or t
  misc_feature (317)..(317): n is a, c, g, or t
  misc_feature (347)..(347): n is a, c, g, or t
  misc_feature (354)..(354): n is a, c, g, or t
  misc_feature (379)..(379): n is a, c, g, or t
  misc_feature (381)..(381): n is a, c, g, or t
  misc_feature (396)..(396): n is a, c, g, or t
  misc_feature (436)..(436): n is a, c, g, or t
  misc_feature (440)..(440): n is a, c, g, or t
  misc_feature (451)..(451): n is a, c, g, or t
  misc_feature (507)..(507): n is a, c, g, or t
  misc_feature (517)..(517): n is a, c, g, or t
  misc_feature (526)..(526): n is a, c, g, or t
  misc_feature (561)..(561): n is a, c, g, or t
  misc_feature (563)..(563): n is a, c, g, or t
  misc_feature (727)..(729): n is a, c, g, or t
  misc_feature (747)..(747): n is a, c, g, or t
  misc_feature (809)..(809): n is a, c, g, or t
  misc_feature (811)..(811): n is a, c, g, or t
  misc_feature (966)..(966): n is a, c, g, or t
ttntttcctcatattattagaaacagtatttcctcatttcatggagtttcttagaaagttctaagtattaacagaagagaaaaatgaaaccgtgggggagattaaataacangnngtttacnccacagcaagggtgctcacccatcccaatttnnggngttacacaagtgactattgggtgatatagtcccgatcatgcaaatnatcgtatgatcacttggtatcctttggnagttctganattnattgtnactagcacagatatttaantgagtcagatggctgcngtgagtggggggnnntttttnggttttngnggtggggggggggggggggggggggggggngggcgtnggctcatttccttacatcggacganantgttcgcagctgacnatccgttgctctgagccccagagggcgcacctggtgtctncgcnacacgtctganaggggtggtcgcagtatcctctgccttccatctaatggcactggtttatctgtggncagcagaacnccacaaatnagcatcgagagcacgttttcacaaaataggcagtnanaaaattaaatcactagaacctggcaatgttaaatttgtgttttcatgagccaaaggtcatagcacaaatgaggtctaaatgtcatcacagcggaccatgggccacagaaagacacattttcaagttatgttgaccttccaggaagaaaaacagagatacagagnnnagcaaacacgtgccgggnacgcacggcggagatgcacggcgtccctgtgaaatatgaacggcgccatttacatggaaatncngccagcaggggcattgagtttcctgccggctcgtcggagctgctgtcatggaaagaagctcagggcaatgtgaccggggtgggcagaggggcaggcaggctgggaaatgtcaccatctcaacatgtgttctaaagtgacttcgaggtgatcatcnttta

SEQ ID NO: 683692 - DNA, 318 bp, Homo sapiens
tattaccaggcttgcttctgctttaccagggttgcggcttgttgatttaacatgtacggcatggtcaacaagtatcaactccacttggtctgcatttaagaatctcttaccgccgggcaccgtagctcacacctgtaatcccagcacggtgggaggccaaggggggcggatcacttgaggccaggggttcaagactagtatggccaacatggtaaaaccgcatctctacgaaagatacaaaaattagccaggcgtggtggcacatgcctgtggtcccagctattcactgaggtgggagaatcgcttgaactcaggagg

SEQ ID NO: 683693 - DNA, 366 bp, Homo sapiens
ggagacagagtctcgctctgtcgcccaggctggagtgcagtggtgcgatctcggctcactacaagctccgccttccggggttcacgccattctcccgcctcagcctcctgagtagctgggactacaggagcccaccaccacacccggctaattttttttttgtatttttcgtagagacggggtttcaccatgttagccaggatggtctcgatctgatggtctcgatctcctgacctcgtgatccacccgccttggcctcccaacgtgctgggattacaggcgtgagccaccgcgcccggctactattatttcttttaaggtggtggtttggtttcagggtcccccagcactgcaatggcagcctat

SEQ ID NO: 683694 - DNA, 594 bp, Homo sapiens
tagggggtctgcgcggggccggataagtcctaaagtgctcttgtaggctgcgcggcctcgcgtccttgttctcccccttctagagtgttactgtgtgactctgtgggtcccgaagtggtgacgtgatgtcctctccacgtaccagtttagaacgaacactggagcaaagagccacaaagtgggatgaaccatgctgaaacttaacgatcatctagagaagcgatataacgaagggcctatagaaaaatttgttaaacaagaggtctagaataccacgatgacattacggtcacgaatggacagaatgcgcacagaatctacgtataacgcaacggcaataaggacaccctgtctccagacggagatccagcgattgtccatccaacaatgcagttcttgacacaccatcatgtgtccatgcggatgtggcaagttcgtgctaagaacagcactgcacacatgacaacactgacacatgaaagctcctactagattgtgtccgtcacgcaggcttgggaacattcttagaagcaagcggtcctgtgcccacagttcttcttggcagacattgactctccagcggagggtgcccaa

SEQ ID NO: 683695 - DNA, 1539 bp, Homo sapiens
  misc_feature (1539)..(1539): n is a, c, g, or t
ctgatcgcgtacggcgacccgacagtcgttcctgtcagaccgctcgctacgtccgtacgatgtatccgcatgtactaaatcgctgagtggacagtgtcgctaagagtgctgtaactccgaaaggaataaatttctgaggtctgatgatgaccataggttacgcaagaggctcgcctaacgattcgtcatgggcccctgatcgggtcttacgtacgaacaccttacggcagcacgtccattaagaactctaacatcaatggagtccccttagtacgccgtcaaggaatcttcaaacactcaatgcgctactaattactgcatgcgccaccccggtacacatggacgtcgtactacaacgcgagtacgggttctgttcctatctaatggagaacacactccccctatcccagctaatcctctacacacgcgaagtgggatgcatcgcccttccaagacataatccgaacttcggtggagtcggaatgcctggagccgcatgcatgctaacgctctgatgggcaggttccaaccttggatgctctttctgaacccaagcgagtggaagcaaatggctgggtgggccatccataatctggccacggggagctgggagccccaaaataggggttccaatcgataatcgtccttgagatccaacttccttcgcttagtagcgagccgctccacaatcggttatccgtacaattgggtgcttgatgaaatccaattgagggaaaacgtaattggacagcacggaggtccctcatatagattcatttctaggcaaaaactgtacattcccaattggaaatcaaaacgaaacctggccttcttatgacaatcgaccctttggggtgccaaatgtgatctagatccccaagtgcacgaaaccctttgtgtggttcgacccggtggtaccattccgcgagcttccagatgaccccacgaagtcccaactggcgcaatccaaccatggccgatccccgtagaccgaacgtggtgggaaattggaacaccgataccggggtcaaacactttggtggggcgatgactagaggcaggggggggcttctcccatgaaaggattcctttgtcccttgccctacttcctgggtggctcgcccacagtgtctgtaggggcacaaaggaccctccccctggaggttcgaaagtcgggccagtcgtcacctggggcatatgtgccttgccaggttgtcccccacgtggccaatacggcgcccgttgttgggccctcgaaactagcgcgtcttggaaaaaccgcggggacaaatgaagaacgaaaaagaaaggggggcgaaaagcgggcagggaagacccacaagagcacgatgagaaaacttggaacagcggtgacaccatgaagagggcaccctccatcacaaacggtcaagcacacaacaaggggcacaaatcgagacgaaagcaccagaggagagtcaagagagaaaaaagagcaaacacagaaagacggagctcagaagaacacacaacagagaggtgagagtgaacaaacaagan

SEQ ID NO: 683696 - DNA, 462 bp, Homo sapiens
agacggtgccccaaaaaactgtcatcccgtactatcttcggtctagtcatactcctattcaccgttctcaactactcgtacatgccctgctcttgtgtacactgccggtttacactgattttccaagccatcacagctgatatctccgggtgctgtccccaaactgccactcttaactctggaagtaaataaataatcttggctggcaggactatgctgaatctccttaggcactctctaatcagatatcctgagtcatcccaattattagaccttttatacttgtttttctccttctgttattccatttagtttttcaattcatacaaaaccgtatccaggccatcaccaatcattctatatgacaaatgtttcttctaacatccccacaatctcaccccttaccacaagacctcccttcagcttaatctctcccactctaggttcccacgccgcccctaa

SEQ ID NO: 683697 - DNA, 530 bp, Homo sapiens
cttccggttttcgtgagcgtgaggtgtgggtgttcgttggggaggtagggcatggctaaaagcttacgcagtaagcgcaaaagaaagatgcgtgctgaaaagagaaaaaagaatgccccaaaggaggccagcaggcttaaaagtattctcaaactagacggtgatgttttaatgaaagatgttcaagagatagcaactgtggtggtacccaaacccaaacattgccaagagaaaatgcaatgtgaggtaaaagatgaaaagatgacatggaaatggagactgattttaagagaaacaaaaggactttttagaccagcatggacagtacccaatatggatgaacccaagggcaaagaaaaggcctgaggccaaagcgagagaaaagaaaggcgaaaggcaaaccaaaagcagtgaaagtggccaaagggttggccctgtaagactcttaaaaactttgtaaaaaggcccatgggaatagatgacggattaagattggttccccctgtttactttggatttcaaccggcacc

SEQ ID NO: 683698 - DNA, 1271 bp, Homo sapiens
  misc_feature (1271)..(1271): n is a, c, g, or t
ccataattattgactatacccctcccggtgtcaaggatatttacgcttgatatcggtccatgcttccacggattgacactatgaattgatctgcctgcgaagggactctgagctccctaaggacttcgatccttcacgtattgacactcagtatggtgagccatgatatggagatcgtattacgcaaaattcatcactagagctgtcgatagattaatgaggatagtaaggtaaagtatagatcgtcatccagatgtcctgggttagtagttcgcctagtgctaagtacggagcatagtgatatcgctcaatccataagtgaggcttccatgcccacatgggatttccctcgtatatctccaggccggtacaacccttaagatgtaaaagcctcacgccaggaatccgattctcactgtaatcactttatttgcattcggggacgtaaagattcgtaagacgtatcgtctttccccaatctataacacagttctccattacgggtaccgtgacttctcgggaaagttgcgcccacggaacagttataactcacgggactgaatcccaccgggcattcgacaagttaccgccaccataattggaaaaaaattctctacttacaatcttgttagaggctgtcaattttcccatttatcttcctacaacatggggaggtcaaatactttaagtctacactcctttactcagtgaatgtaatatcgtagaaaggtccatgtcaggtcattcgtaaacggctgggaaaaaggtaccgtataactattgctggggaaatgaaagcccctgccgatttaaggaatcgtggggaaggtggacgctaactttgtgggaatggcgccccccggaacgccacattaattcataacaatttccgaaaacgaaaacccgcggtgaattttcaatttaaccgcgttccaaggtgcaacaaaaacccccgaggacaagggcaagtccgatgatcgccccctcaaagaggagagcatgggtttttcaccacggaccggtaaacccccgagaggagggtccgtgccaaatggaactcgttttagttcccacggacacatggatgtaaaccaacgaaaaacgcaaattcaacaacttacattaagcatagtttgcagcgagagctacactctacgaagtgcacaccctgtgacaagagcgccctgttttcaaagaccacaactatacaatattgatcaagcaacagaggatgcgcacaatgaggtagtgatcgagacattgacacagan

SEQ ID NO: 683699 - DNA, 1516 bp, Homo sapiens
ccacgcgtcggtccgccggagacagccgtgacagagaggacgtgcggacgggccaccaccccagccctccaacgtaggtcaggctgctgccttggcgcctcccctctcgcaggtccatcctggctctgttggcccgctgtggctgcctcggtgtcatctgactggcccctgagccagtgccctgtctcttggagcatggagaggcctgcgtgggcacgtcagtcctggagcgatgggtccacttcagtgagtgaaccgactgcacgtgaaagctatcggtgcgcgtgagagccgtcggggcgtccatggaaccacggacctctggtcacaacgcgcagcctaacagacggccatggtgttgccttaacgcgctagctcacactgcacaaccagagacggcgggtggctctccaaggtagacatgcctggaagcgcattggggtgggtacctggacgacggtgtccttaggtttgcgcaccaccgaataaggaagggaaaacgggaaacacttccatattacaccgggcaccactattgggacaaacccctaagggcacaccctgataaggcacggggccccagattagaggaaccgaagattacggggggggagaagggcccccccaggcttaggcaggcccacacacctgagatcagaaagaagaagccacaactaatagacagcggggcccgcgggagggaaacaaacccccagaaaggacttattttgtcccacatagatttatacacacggaccccaccacctgggggcgaagaaacaaaaggggggcagacccccccccatttatttaccacacgcccccacaggggagggagacgcaaacacaagaaaacaccacccgacataggcggggggcggggggggcgggcgagaaaaacacaagccgcactcacgtggtagtacggcggcgcgagagaagacaaacacacagaatccacacaccgcgcagacattaactatctacacaccacctacccattgccccgcccgctatgaaaagaaaataaagaatgaaaaacacacaaccgcgcggggggggcacacagacgggggggggcgagagtacaaaagggggggggggggagggaatagaatattctaatatcacgaccaccaacgacagtactgtagtttaatattcacaccacgcaagacacccctgctgtgacacaaagggggccacacacccacccccaccccacaaaaaacaacaaatacataactatcttcaccatccaactacacatccaccaacccaccccctctacatgacaacaacttatatatatcatatattattatcccaccacaccacacggcgaccgacaagcacattcttttctttggatgacaaaaacaaaacagaccaaccaacgccaccgcggggggggagagataggaaagagccagacgagcacgaactcgcaaacacacaaaaacaaagaacatgacacggaccccaaccacacagcgacaacgaaccaccattcaca

SEQ ID NO: 683700 - DNA, 327 bp, Homo sapiens
ggaattttttggggggttttcccccctgattttcaaaaaaaacccccgggggcctgtgtttgtggccgctcccatcccggaagcccggggtggtgttcccccccccctcgtttttttgtaaattcaaaacaatgtttttttttgggtttttaaaagaagggggttcaccagtaccacccaggtgaagggaccccgcggggtgttttttttgggcttttttttatggggcattcccgcaaaaggggtcagtttttgtgtgaaaaccacccccagtttttgggtcccaaagtaaaaaccccattcccaaaaaaataaaaacatgtttca

SEQ ID NO: 683701 - DNA, 101 bp, Homo sapiens
agcaggctggtaccggtcccaagcgtatgatctctgtgcgcgctccgctcggcagcctgtgggacgcgaccgcggcgctagtctcgttcctttgtgctgcg

SEQ ID NO: 683702 - DNA, 142 bp, Homo sapiens
gccacaggatcgtgacgatcccgaagtcggtgtgctcacccatgcccgtgagtcgccgtcgagctcgacctcggtgccctcgggaagggcgtagcttgttcatgcgaagctggtcgatcgagtggtccgtgaacgcgtcgaa

SEQ ID NO: 683703 - DNA, 1401 bp, Homo sapiens
ggcgcagccgcgcctccctccctcgccgacctcccgtggcgcctggggttggcgatgtggagacgtgagtgggacccgtcggatgctccggcttctccaggactccgccagtgcgcccgcagcgtccctccatcaccctggaggaggagacggctcctgcgcggggctccgaggacgggcgaggcgctggtagcctggattcccatgcctcgcacaatgggacatacctgtggagctgcatctctccaaagtgccagccggacgccgcacacacgcgtccggcgcccgaggctcgccgcctgtgaacccgccccgcccgctcgcagggcagatcacggcagacgcgcgccacctagtcccgccaagcacacccacacccgcgcaggccgctcatcctctcactacccgcctcagcatgctccgcagccacctctcactgagacgtcactggatcaacccttgccagaccaacccgacagctccaaacaccacgtccccccacccacgcgctccacataacaaacccctggcacctgcctcaggcgcatacagccgacaacgccctgaactctagagactgcccccataccgacaatccaataccacaagccaccagcacacccactgacggctggcatgcgcacccaccccacgccccctccctgcacaggcacgccgacacctccccgcacacaacagctcacccatgcccgcgtcagaacgaatcccgtgcagcctccacccttgctagtcgccttctggcacccaggatactctccaccactcgccatcactcccccttgcgagcaggcaacagtattcttgactggccgacgatccccgggtcaccggcagcacgcacccatcctgtgcgcccgtacgacgtgggatggcaagaggccccacgagtgaaggccgacagcgaccacgtggcacaccctctcatgccactgtgccccgtgcacacggacaacctggcagcaaccccttagggcccaattgctgtcagccctagggcgaaaccacaccccacggcaacaggccagcacgaacgccgatccccatcactgaccagaccacgaggcactcgccccacccacgacaaggcctaccccactcctgcccaccatcggccattctcacacctaccacgacgtccctcaccaccctactcacgacctacatcactccccaccgacaccaaaagaatacctaccacacaccccagcaccacagtccccctataatcaccgcactctacccctcactcccccactcgtacccaccgtcaagcaaccaaccaaacccaccaaccacccacccccccacacccccaccacacaacacctcaaccctaactcctccatcacccccaccccccccactctccccccacccacc

SEQ ID NO: 683704 - DNA, 643 bp, Homo sapiens
tgccttgtagtcattgtttgatgggaccaacttgtaaagtatgagccttaaataaatctccatgctgaaaaatgtgttctaatgcaacacaaaaacatgaagtgactgcccagaggtagagttagtgtttaggtggaaagggagatgacagctttccaaagaaggacctaaaacacaccaagattgtcttctacaggaattgctgggcaggtctccgactaaaggtcttatgatgaaaaggaagaaacaagcccccaacacaaggctctgatactactggtaaatgtaggagagaattaagaatctgttaattaaaatccaaacagagcttatttcaatagtcaagttacctgacatgaaaattatttctgcaggataaaagaggttttatggtcttttttggaacttatcttcttggaaaaaattctaccaaaaatggtttcttcaatcctgtggggcctaattaaatgaagccggcttcacagaccccaaggcctctggtttttggtatacttttgggacaaaaagggttttggcttttggtttgccttaaagaggtccctagggaggaaccagggctttttggttttgggggagcctttggcagacaggatcaaacatagggtttaacggggcaaaggtg

SEQ ID NO: 683705 - DNA, 754 bp, Homo sapiens
gtcccctggcgcctacacacacacaaaccctcacgcacacaccacacacacacacacacacacacacacacacaccccacaccctgctcgagtgtgtggtggtggtgggtgtttcaacactggggagggatgtggtgtgtctggtcgtcagtggtagttgccatactctgaatacttcttcctagtcatcgttgtcgtagtcgttgtttttttgttttttatttttatccccccccccgcgcccccgcccccggggttgtgatgcatgtgtaggcttccagagtgccctccctacaggatagtgagtattcttcaacagagtgggataacaacagagattaggaacctaccccatgctgcgaaacgccgcgtgctagttgtatgcacatactattttttttctgttatcttttctactccatcttagaagattacaacgaatagggagtggttctcatttgcggcggtggatggtggtggtgtgttgttgatgaattgtgagtggagagtatctttgttctatgttcttctagcttataatagatctattaagtacgatggtgagtgtggggagtgctgacagcccctctttgtccctcgcaaacctcccacagcacctccctcaagttctcatgtcactaagagcacaagcattgttactgcgcacggtgactgaaaaacaagaagaatacagaagacatcaagttcttgtgttctaaatcattggactggagagaagactaatactgcgtgg

SEQ ID NO: 683706 - DNA, 186 bp, Homo sapiens
tgcaattctttcaggctgtaggtggccgtggctcttctccctgtgacaggtgacgaagcgctgtgccaggggctggtcctggacgtggcgttcttcctctgtgatcctctccagcagcctgtccttcatccgtgtgtagtcagcgatggagtcttcccactcacagcccaacacttcacagaagca

SEQ ID NO: 683707 - DNA, 616 bp, Homo sapiens
tggctgagctccatagcagaatggaaatgacagaggaaagagtcactgaacttgaagataaatcaatagaaattatccaattgaacaagagagaaaaacgttaaaagaagaaggaaacttaaaagaaaaaaaaaaaaggaacagagcctcaggtactggtaggacaataccaaagggtctaacactggatgtcatcagagtctcagaatgaggataaagaatggcaaaactgagtgaagatttcaaaaacttaatggattggaaaacctcccaaatttagtggaaaccacaaaggcctatagcttcaagaaactccatgaaccccaagcaagataacacaaaagattactgtccagacactaaatattcaaactgctgtgaaacctaaagacgaaaaaatttttcaaagcaaaacagagacaaaaaagggtggttacctgtggggaaattaactcccagggatggtggattctaattcaacaccaggagggcagaaggagtggtacacttctagatggtccatgaaaagaactctcaatccaaatttttggtctagcaaagatatccttccagagtgaaagagtatctaaaagagtctcagatgaagcaaagctgt

SEQ ID NO: 683708 - DNA, 384 bp, Homo sapiens
cgttatagcaccgtggtagcttgctaatggcaaataactctcagcatttgtttgtctgaaaatgtctatctttccttcataagtgatgcttagtttcactggatacaaaattcttggctggtaattgttttgcttgaggaggctgaagataggtccccagtcccttctagcttttagggtttctgctgagaaatatgcttttaatctgataggttttcctttataggttagctggtgctctgtctcagttcttaagactctttccttcatcttaactttggataatctgatgacaatgtgcctaggtgaggatctgcttgtgatgaatttcccaggtgttctttgtgcttcttgtgtttggctatctaggtctctcacaaggcc

SEQ ID NO: 683709 - DNA, 708 bp, Homo sapiens
  misc_feature (137)..(137): n is a, c, g, or t
  misc_feature (284)..(284): n is a, c, g, or t
  misc_feature (354)..(354): n is a, c, g, or t
caacaaagagtatcaatctttttccaaacaccttcccaaagaagcccttcaaattgtccccagaaagaaatgagtcccttaaaataaagaacccaaccctcctcccacttttatctccgtgtcttaatttcatagancctaagaaatatgaaggccgagtagcgccccattaaagaacgctctcctgggggttaactgtgaagaatgaagcacaccattgcccatgttgcggagggttactattcatactccactctatgaccggttgttctatctaaactatnccattctctccgaacaatataatactgtttcattctacactatataaactgtactatctgtctattctanactatttcttctaaactgaaaggagttagccagcttgctttaggcagacagtaagcgaagggtcccagacagcctccagcccatgttttgtgcagataggggaacttgctcagggggcttgcctaaacatgctcacagtagactgagggtccccatacacatgggggaatggggtggagccaccagaaattcgctccttatgcaaacagggagcccagccccatcagcttctatgtaaaagcccttgtagtcaactgggaagggggcaaccagcaacctgctctcaggacccctctttttgctgagacctttccttttcgcttaataaattctactgcactcagaaaaaaaaaa

SEQ ID NO: 683710 - DNA, 409 bp, Homo sapiens
ctcctgtgtaaagtagggataataaaagtatccatctcactgggatattttgataattaactgagttaacccatgtcaaacatttagaacagtacctgacacacagtaaatgctcaataaaaattacatattgttatattgctgttctagtttataagaacaggtgtcagaatccagttttgaaatgaaagcccagaactgtgagaaatgatgtttttctctattagatgttctaggaaataaggaaacatcaagaataatacagccatgcttagaacaagttaaatatatgtccctcttggctttggactttctctgtcacttccgtgctgttcttcctcttccagtctctccatactctaatctctgttctcagcttctacttgaactaccatagaaggaatagaaa

SEQ ID NO: 683711 - DNA, 221 bp, Homo sapiens
tctggatctgtagccatgggctctcgcttggaatgacccccagaccagcccgtccagctggatagagcgcacacacggcctccagctgaggcatgtctgtctcatcatcccaaggcttgacatccagcaggatggaggacttgcgccaccatgtgcaggcttcttggcgcttcttctccgcgtacttgcctgcagccgagagcggtgggggaatccaccta

SEQ ID NO: 683712 - DNA, 288 bp, Homo sapiens
ttctattagttttttggcctcgcgtcttctccttgattttaaaattccttctatagctagagctttgctttctttcattctctcttcctgcagagtttcgcatacatcagaagctaggtacataaggtaaatgattgagagttggctgcatttagatttatcactttttaatagggtgagcttgagagcttactttctttctggttttcagttttaatcttgggacaattgtagagtgctagaaaatcttaaaagggggattttttttttccgggaacctccaggccc

SEQ ID NO: 683713 - DNA, 944 bp, Homo sapiens
aatctgaacgactacaatgcatctgaaggatgctttcattctgtaagacctagaataactctactgatgggacgacttaacacacgtctcatacagagaagacaggagggctagaacccaccaagcttgcggactcaagttcagtcagtcaccttgctcgggtttacatggacgcatccctcgtctcctggtatctacacgattcacggtgcacttggtagtgcccctcatggagctggatgtgtcagtgttcatgacccaacatggacatagcctaggtcttccctgtgtcctagtggttcacgccgcactgcgggtgcctccttcttgtaacccgagcgttggtgcagatccgggtggcgacagctcctagagccttccacgtgtaaatcttccacccttgtcactgtggaacggggtgtttggactgcgtcccacgcgtgggtgcctgcccgagtgcactgcctcggggtggcggcctagtcgtgcacatttttggcgttacagtaaccacttcgcgtgcgctttcaactcgcgcttccaccagaaaaccaggtctcgggggccccctgttgcgaatgtggtccggacgtaccctcggtgggagcgccgggggccgatttccctcaacgtaggaattaccgggtgtctggggaacattgtcttgtgcgcgaagggcggacccactatatgtgtggggggcacccccatcattactttctcgttctgtggccgccaggtctattattggctcctgttgtggacctccgattagacgaagagaccactcttgagggagagtggcccctcggcctccacccagcgtgcggactcctggcggcgcgctttatatcccccccgtggggccctctcatagaacggcgcggtgcgcgcccttacgggtgtatagcgacccctctagaggggggcgcgcccctcagact

SEQ ID NO: 683714 - DNA, 724 bp, Homo sapiens
tagaaaggagaggccccagtacagtgcccaagccaaacgccaggcctacctggacacgctcgatggccaatcggaagactacgaacaagcacggcaacacctgatgaccatcgccgtcttcacctcggagcctgaattccaagtaaaagccattggctatctacaggcccaactggcgctcaatgaagcaggggtaaacgaagaactcgtcccctttacttcaaaactttcgcccgttctggaacagctcccaatccatgcaccgccacctcataccagcgatatcgcggactaccaacagatcgtcgagatgagcgacagcatgatcaagcgcctggattacgctcagtcacgcttcaccgaactacgcaaattcggcccggccggattcgacgtgatcagggagagcaaacgcaaactgccccgctatatgagcgacgatctcagggccctgcaggtgacgttggcgcgtcacttgtgcctggcccctgaatccctcgcaaccgaaccccatgcctgggagatgctcaacgacacgctcgacagtgccgacgtcgcggtacagaccctgcgtgacaccctggatgagcgaagcgaatatcgcctggacgagcgcattgatgccttgagcaatctagtggagcagtcaagttcatcgatgagcgctgaaggactttctcagagtctcgaaagaccaggcacccggacaccaggggggggacct

SEQ ID NO: 683715 - DNA, 354 bp, Homo sapiens
cggtgcgaggacagtgcccagcgcagaccttggcactcagtagacactcccacaaatgccggttcccttctacaggcccagtcgccagctcagaggacactcgatctcctgccccctgggactgacaccatcatcccaaggtgatccccagccccagccctggcaggctcagcgctggcgcagtgggccaggactgagctagaaactggcagctcccagggcacacagccaggccaacttcccacacagggctccgccccctcacttcggggcaggggtccaggcagaatcagggatgttgagtcattcttccttttatgcccagagttcctgacccacccccactctgcacaa

SEQ ID NO: 683716 - DNA, 365 bp, Homo sapiens
  misc_feature (343)..(344): n is a, c, g, or t
  misc_feature (349)..(349): n is a, c, g, or t
tctccaggatcccctgtagcacgaatgtcctggacacgctcgatggccaatcggaagactacgaacaagcacggcaacacctgatgaccatcgccgtcttcacctcggagcctgaattccaagtaaaagccattggctatctacaggcccaactggcgctcaatgaagcaggggtaaacgaagaactcgtcccctttacttcaaaactttcgcccgttctggaacagctcccaatccatgcaccgccacctcataccagcgatatcgcggactaccaacagatcgtcgagatgagcgacagcatgatcaagcgcctggattacgctcagtcacgcttcacatnnggtgntccagggtaacggact

SEQ ID NO: 683717 - DNA, 331 bp, Homo sapiens
caaacattcctagatacaggtatgatgaaagtcagtcaggcatttattgttttcgttttatagaaaaggggtcttgatatgttgcccaggcctggtctcaaactcgtgggctcaagagatcctcctgcctcagcctcactagactagctaggattgcaggtgggatccactgcactcaagacagtcagccaatggtgtgacataaatctcggacacaaactgcaggaaaaagattctcattaaatattcctaattgtcatttgcagttgtatctattctgttcaatatgaatattgcctcaatacattttttacacaagtgacagattcag

SEQ ID NO: 683718 - DNA, 213 bp, Homo sapiens
tggtgctctgaggatcccactcgatccgctgatccagcaagccctgctgcaggtcctgcaaccgatgatcgccgacgttctctgaatcgagctacggcttccggccgggccgacgtgcgcacgacgcggtgctgcaaggcgcagcgtcacgtgcaggaaggctttggcgtggtcgtggatgtcgatctggagaagttcttcgacccgggtcaa

SEQ ID NO: 683719 - DNA, 146 bp, Homo sapiens
gacgtataggacatgggacatggacgacactaaagatgcaagacctggtccataaacgtcagggcagattgaggacacgatatatggaggacaggggagatggaatacaggggaaatggacgacatgagagatagaggacagggga

SEQ ID NO: 683720 - DNA, 137 bp, Homo sapiens
  misc_feature (32)..(32): n is a, c, g, or t
gagcacgtacactaggagcagctggagatggncaacaagagtgagctcaggactactggatcacatgcccaggtgtacagcagacctcaaggcagaaggggtcactaaaccaggaggtcacagactgatgtgaactc

SEQ ID NO: 683721 - DNA, 434 bp, Homo sapiens
gatcactagcagtacttctgagattactgattctcccacagatatttgtgagtggactcagacaaatcgtgcatgttctacatagaggtgcatcaagtggcagtactctgtcacatggttagacgctggtcactagtggctcaatactttctacaatcattgcagcgtcatggccatcgatcactgggaaagctagggcctctcatgtagaatcgatatcagtggcatcagtatggcacagtgaggtagccatgatctgaatgcgaaggtcatgagcctaggagggagctacttcaacctattcaatgcagaggagcatgcctgcttctcaggcgatggttgatatgcattcaataactttgccggtggtgcccattattcattgggaaaatgtgttggaagtttctttctgagttaagaaagcttcaaactcc

SEQ ID NO: 683722 - DNA, 154 bp, Homo sapiens
agacatcgctatttaagcgcagggctggaaactcaagtaagattctcgccatctggctgttggacagctggaggagctggtctttgcctgggcccggcttccatctgtcagagacatatttggattgtgcttggatcaaacccttcctttttct

SEQ ID NO: 683723 - DNA, 638 bp, Homo sapiens
  misc_feature (498)..(498): n is a, c, g, or t
  misc_feature (516)..(516): n is a, c, g, or t
  misc_feature (536)..(536): n is a, c, g, or t
  misc_feature (595)..(595): n is a, c, g, or t
  misc_feature (621)..(621): n is a, c, g, or t
aagagcttattccacctcctgcaacatcctggataaccagaggtcctgagtctgcccatgtgacaacttcactgctagaataaccagcctctgagaaagtcagcacagtaaacctatcggccgccgaggacctccacagagtccacttcggtcccctgtcacctccaccggagcaggtgctcgcatccacagctgggagacctgaggacggatcacatcacaggactctgtgcagacattccccagcaccagcctggtagccctgctgggtggagagacccagaagaacaatagcaatcactgctgtctggtttgcaggaagctccatctctaggggaaggggcagtgcacaaatcagggaccaccccatgggactaaagaatctgaccagcagccttgagttccagattttcccactgaaataatctacacacatgagaaggaatcagacgagtaatcctggtaatatcatgaaacagggctctattccaccctcanaagaccacactagctccncagtgagagatccaaccaangagaaatcagaatgctggaaagaatcagaaggtgattattaactactcaagagatacanagacagtgattacaactttgaattanaatcataccagtagatg

SEQ ID NO: 683724 - DNA, 331 bp, Homo sapiens
  misc_feature (97)..(97): n is a, c, g, or t
  misc_feature (153)..(153): n is a, c, g, or t
  misc_feature (188)..(188): n is a, c, g, or t
  misc_feature (299)..(299): n is a, c, g, or t
cagcagctggttcacgcattaaggccctttgcaggtgaaagaaaacggcactggagggccgactgcagaagcagacgcagtgcacggtggacatctnccccttttgggggcctgccacggtgcttcctgaaaactcaggttaagctgactctnctgtcaggctgatgaggcgcctgcacccacctttnctcagcacgccagcccaaatggaagagcaggtgctatgacaaaaatcagttcttgtagcaactatttttgatactgaaactgaaaagcgagagcagcaaagctatccacgngagctcctggacagttaggcccggctttggct

SEQ ID NO: 683725 - DNA, 419 bp, Homo sapiens
  misc_feature (5)..(5): n is a, c, g, or t
  misc_feature (7)..(7): n is a, c, g, or t
ggatngncactagaaactgctgctggaaacgggcggcggctccacttagggattcctgaagcagtgtttgtggaagatgtagattctttcatgaagcagcctgggaatgagactgcagatacagtgttaaagaagctggatgaacaataccagaagtataagtttatggaactcaaccttgctcagaaaaaaaggaggctgaaaggtcagattcctgaaattaaacagactttggaaattctgaaatacatgcagaagaaaaaagagtctaccaattcaatggagacgagattcttactggcccgataacctgtactgcaaacttcagtccctcctactgataaagtatgcctatggttgggggctaatgtaatgcttgaatatgatattgatgaagctcaggccttgttgggaaaaga

SEQ ID NO: 683726 - DNA, 465 bp, Homo sapiens
  misc_feature (462)..(462): n is a, c, g, or t
ctgcatggttcccttcactcggactttgccccaatttgattacactctgggccatatatacttgcacattatgcaaaaaaatgttgatagtatctccttgccacacaatatgcagagttgacaacctgtgaaaaccaaggtaactaatatgtatgtcctagttgtgtggcgcttggtaacaaagtctgtacatattatgtataaaatgtgtattggttagcatttagtactaagaaattctgagtttaaaataagtgatttttttcaaagtagcgatatctatatctgtgtttatctaaaaatactggcttgaatagaaaacattctcagatgattcaagattgagtaaaaatgagaatcccatacattccattattaaattctgccctattcccaattgttagcatctggctgatattaaggtctttgattgtcacaatattctcaataaatgagacattntga

SEQ ID NO: 683727 - DNA, 100 bp, Homo sapiens
tcgcagactgtacaggatttggatttgtatgtcatcatctaccaaggataactgagaaattaatagaccaagattattccatgtcatagtgaacgcggga

SEQ ID NO: 683728 - DNA, 388 bp, Homo sapiens
actcccagatgcgaatggatgaattggtttaaaaccagtaagcaaattaataataaaagtagtatatgtatatatttaaaaagtcagccaggtgcagtggctcatacccagaatcccagcactttgggaggccgaggcaggtggatcacttgaggtcaggaattcgagaccaacctggccaacatgatgaaatcctgtctctactaaaaaaaacaaaaagaaaaaaaaattagctaggcatggtggcaggtgcctgtaataccagctacttgggaggctgaggcacgataatcacttgaaccaggaaggtaaaggtagcagtgagccaagattgtaccactgaattctagcctgggtgacagggtaagactccatctcaaaaaaaaaa

SEQ ID NO: 683729 - DNA, 283 bp, Homo sapiens
  misc_feature (279)..(279): n is a, c, g, or t
ttgcgaacatagaggatccctacatgtattcgggctacaagccaagtgcagtgtttgtggccctttatttaaggttgttttcttatattattctgcatataacagtgacgtttaacatgaaaaaacaacaacaacgaaaacctccattgagtggagccacactttaaatgataatttcccttttactatactcagaaaaaaaaatagaattttgaatatctttagcacttgttgtctatttttaactaacaccatatgctgccagtatcgacatacatngtta

SEQ ID NO: 683730 - DNA, 584 bp, Homo sapiens
  misc_feature (381)..(381): n is a, c, g, or t
cggctccaggacgggtcgtgctcatcccttaactttttaactttttgttgtttctatttatattttattgtgctatgtcttgaaatgttgtagctattacttttgattggatattacttagtattcctactttaaataagagtagtttgcacaccacacagctatagtgttataatattctgttttgttttgtatcctattagcagtgaggatttttttttacctttaggtgatcatttattactcattaatgtccttttcttcctgattgaagtactccctttagcattcctttaggacaggatttgtccccagtgccttatttagttcacttggtgaggtcatgttttcctggatggtgttgatgctagtagatgttcnttcaagtgtctggacattaaaatcttgggcatgcagcaccaatatgaagaagtttaaaaaataaaatttaaagagagaaaaggctctggtatcaggatgacttatttggcggcacttattttcacaatagcaaagactgggaaccaacacaaatgtccgacaatgatagactggattaagaaaaatgtgcgcacaattattaa

SEQ ID NO: 683731 - DNA, 212 bp, Homo sapiens
ttaatcgcaagcttatgatccgcaattactgggaattctctcgtgcatggggcatacttgcatccccgatccccatcatgacatggcgttcaccggggttacccgcgtcctgccggcgtaacggtttgcgtcacgctgatccagtctgtgtatcgcgcgtgctgacccggacattctccgggcattacagacctattattgctcgttctcgg

SEQ ID NO: 683732 - DNA, 173 bp, Homo sapiens
  misc_feature (17)..(17): n is a, c, g, or t
  misc_feature (25)..(25): n is a, c, g, or t
  misc_feature (110)..(110): n is a, c, g, or t
aaatagcttccattttntaatcgtngctgttgtatactagccagaggactgcagctctgagagaaaagcatattgaagatcctgccaaaataacagaaaagaaaattgtntccatttaatatatttccaaacctgcctaccttgaaagagtgtgatgccactagtaattctat

SEQ ID NO: 683733 - DNA, 1622 bp, Homo sapiens
  misc_feature (843)..(843): n is a, c, g, or t
  misc_feature (909)..(909): n is a, c, g, or t
  misc_feature (1085)..(1085): n is a, c, g, or t
  misc_feature (1410)..(1410): n is a, c, g, or t
cccccgggcctgtggaactctcctggggctgacaccgagtcccaccccgctgctccgtgcctgtcctcagcagctacgatgccctccatccagcccagcagtgctccctgcagctgtcatggcctgctggtctgtcgtgcatgactgaacatgtggcttgaacctgctggctagacctatagccgtttgtccgctcgtgccatagttcctgcatgcttgcctgtctgatgtgcctgccatgcacaccatcaccgccaatgcattgtatcttggcgctaaatgctctgccctcacatatatcctggccttgctgctattgtgacgatcgacgacgtgttacccatgaattgtgaacttgaaagatgcgaacatatgtcggcgtgcatcttgcatctctcaattgtgcccacaccgttgcaacagtgacacatgaacgtggttgcggctctacatacaaactcccattactgccacaagccacatcacacttgatagcgctgacaacgtgaggtggcgcgcacaccccttcggcggtggaatgccacctggtgtcgaacacctgtaagcgaaccgcctcttggcggccccacttctatcgctggcccacatgcgcgatcagaaccggtcccttggcgcactgtcactccccataattatccctttggctggtcggctttgcaagttttggcccaaacttttagggcgcgagggacgacgccgcagttaagcgcgaccaccggtggcactattctacgctggtcggccctttctggacctccatgggccagcttgatcgatgacgagcatctggcccagacctttgcacgcaaacaatcgccttancgcgcaactggactgtcacagggcggccaccaatgatttatatgctggccaacaccaggcggcacncgcaactcggccttaccgtttggccggcaattggactcgctccccagattctagtttaccactttggcggtgcgccttggtaagcgtaggcccgaaatgacttccatggactgcactgctgtctgggacccacgaaacgattaaagcgctaaacaacaggggggacaccttatccntggcggcgcccgctttgggccacgcctggagcctcataattactggcgagcaaatagtccccccatcttgggccgcgacaagcatttatcaccacactgcacactagatagcaacataccaagcagactggtccccgacgcttccacatgatcgccccctattattacaaccgctagcccgaattagtatctgtctagggcgcgacacaggccaactgggccacaaacgcgtcaaccagcgttcgttggggcggcttccgtacacctgactctccaccaacggtcgacaaccatctttggtaagtgacaaatcccccgcttagtngaaaccaccgcccacatttattcacgcgtagatagacgggccatacttttgccggccgccccaaaaccctataatccgcgaacatactgcttggccccattgggaccactcggaatgcgtcgcactcggcgccaatcagctcgtcatctttcccccgcgaattctcccccgcgggggcacgatccattggagacaccactatcacatgcgga

SEQ ID NO: 683734 - DNA, 413 bp, Homo sapiens
  misc_feature (11)..(11): n is a, c, g, or t
  misc_feature (23)..(23): n is a, c, g, or t
gggagggacgntgttgagctganagatgttttaaattaaaaaattgtgaaagctacatctgcgacggatatatgtaggtattatgcttcgcgtgtatgttaatggctacgtggtaatgctggcgggcattgaactgcgggttttttctgaagacgggggcgataataatctcgttgaatttattatgctgcggcttggggcgaagattggccctggaagaagtataagatgggttggaggcgtgtcctgtcccgggaccaccgcagtctatagactcttcttcgaggccgggtttcggggacgtacgaggcgccctcctgcacctctattacggtgtggtttgtcgaattcttggaaggtcgacatgttgatcgtaggggagggagggggactcgctattaggtttttgttgg

SEQ ID NO: 683735 - DNA, 238 bp, Homo sapiens
gaaaatcttagtatagtagaaagacatctgcctgtaattaaactagtttaagggtggacaaatgcccatatctgctaattatcaatgggatatgattggttcagttgagtctgacccagagttgttgtttgccaagcaaatctcgcctgggtttatttatacctggttattaatgtttcttctccaattctgacatactttgagtatggctatctatacctccctttaagtttgaact

SEQ ID NO: 683736 - DNA, 257 bp, Homo sapiens
ggtaaaagaaataattttctgtattctgccaatcttaattttatataatacgtcatccatttccctcttaaaatagtatggattgactgtttctaaaataccaatctgtggttgtggttttcttttcttcagcatttccagcatccagtaaacatagtccttatagtgctgctacttgatggtaaatttggttgctgggtctttaggttgcactcacaataaatcgtgcaagcattgtcatgcctattactccattt

SEQ ID NO: 683737 - DNA, 142 bp, Homo sapiens
gtcgtactcatggtgctctcctcttctttgctctctagccgaggtccctgatgagctggcagcaggaggctgctctggctggactctgagctggactcagtgctgtgccatctggctggtccttggtcctcacttcttcctg

SEQ ID NO: 683738 - DNA, 467 bp, Homo sapiens
  misc_feature (357)..(357): n is a, c, g, or t
  misc_feature (374)..(374): n is a, c, g, or t
ggaccagtcggttctacatctgcactctcttccttccctcagttgagctcatcccctttcacacctagcttcatcccaatgcacttctggtccttccctgtgtccgtgggactttttctactgctgtgatatgtccttgtattcttagcattctcttagaaagtatcctttattgccccaccataaaggactttttccatgtactgtatcaggtatccttccaaggttgcaagcagcgtagaaaactctggagaagttgagcaaaggggaacttagtggaaggagagtgggagctcagagaatcactaggcaggctatagcaccagtgctaaaaatgggcatggggaatgtttcccnaaaaaagtccttctgtnttagagatgcatactgaaatatttatgactaaaatgatgctttttctagaagttgctccattgtagggtgggggtagataggattataaaaga

SEQ ID NO: 683739 - DNA, 706 bp, Homo sapiens
gggctgcgggtaacaaccatgcgcaggatttcggatgtgtagcctaactaggcaccggagctttcgcacggtggagtcaaccattgagagtacctacatggagcttgagggccacgttgaactaggacaaagacatgtatccttgctggccccggggcctcacatgccgagatctcgcatgccctgagactccaaacaggaggcatcaccggaagtagcaccctccggaggaagagccacggacacgacggataatggccccgagaggaaacaaacgctaggcacacgtggctcacaccctgtgaattttcggaggactgaggacagtgtaggattcacctgaaggtcaaggatgttctgagaaccaaccttcggccacatcatgagcaaaactcatgttcttctacctaaaaataacaaaatcttagccggagtgcagtgccaagtgtctgtagtgtcccagctaactcgggagggctgaggcaggagaattgcttgaacccacggaggtggaggttgcaatgagctgagatcacaccgactgcaatccaggccggggcgacagagcaagactccgtttccaaaataaaaaaagcaaaaaaattagccaggcgtggtgacgcacacctgtagtcccagcatacttgggaggctgaggcaggaggattgcttgagcctgggaggtagaggttgcagtgagctgaga

SEQ ID NO: 683740 - DNA, 808 bp, Homo sapiens
  misc_feature (661)..(661): n is a, c, g, or t
ggaatcttttttttctgagcagtaggtctcattagtgagcttagaatactccataaaccatgctgtaaacagatgcactgtcatccaggctttgttattccatttccaacacaggcagagtggatttagcatcattcttaagggtcctagaatttttggaatgggaaatgaccattggcttcacgtcaccagctgcattcgcccctaacgagagtcagcctgtccttttcaatctttgaagccaggcattgacttctctctagctgcgaaagtcctagatgccatcttcttccaatagaaagcggttttatccacactgaaaatctttttagagtagccaccttagtcaaccatcttagctagatctggagaacttgcttcagtttctcctgtaaagcttgcagcttcaccttgcacttctatgtgtggaagtgacttctttccttaaacctcatgaaccaacctctgctggttttctgcttttcttccgcagcttccctcacccgtctcggccttcatagaattgaggacggttaggaccttgctgtggattcagctttggttgccagtcacaccagccgtcgggcaaagttgttgttttaatctctccagaccactcagacttcttccacatcagcaataaggctgcttgctatcctgncatttgtgtgttcactggagcagctcgtttaatttccttctggggcttttcctttgcattgccgctcaaccgtttgatgcaagaagcccggctttctgactggagttttagacatgccgttccttacaaagcttaatcatttctagc

SEQ ID NO: 683741 - DNA, 864 bp, Homo sapiens
gagatcctggaggctgaggtctagatcggtcgccaaggatgggatccaggagaaaacgtgcttgaacgtgcagcttgctcctaccgattacagcccagcaggatgacatagttccactgtgctctagtccattgtgggaattatggccctcatgcccggcgtctgtcacaacccaatatttggcgtataacccctgtcccacccccagacatctcagaagtgcgtaccctctcagcacatccagaaactgtgtgcttcacggtactcttgttatgcttgcagactcgaggcttcatactaagctgattagtgtaccctgagattggatcatttcccgctgctatctgtgatgcatattatccgatccacagagatggcagattctgtacctgatagtccaagatccaaggactgggtgggtacttctatttatgggctcatgatctattcttcctctcgctgtttattcaatcgggccatttgatttctccatagaacagaaagaattgaagcagagatgacacagatcaagagcccaggtttcttgatatctaatactaatatactgatggagttaacattccaaggtacgaatgtgtccagaaacagttttaaccttaccctgggtttccatcagtgaaaccaagttaacatctggcaaaagatagcgatctagcctcaggggtttcagtcaagttgcgcttaaaagaatgccttaaaatctgtagttatggtgtcaaatataataaatcttcaccagctcatgcacgtacaagtctgaaatgtttcataaaaggtttagatgacctgataacatgtttctaaaacccagagagaaagagagagactgatacaaacgtcaag

SEQ ID NO: 683742 - DNA, 358 bp, Homo sapiens
  misc_feature (18)..(18): n is a, c, g, or t
gggcccattttgggtttntgcccccccccccccccgggggtaagggattttccccccccccccccctgggggggggggggcccaggggtgccccccccccccccccttattttttggtttttttgtagaaacgggggtttcccccggtgccccgccggggttccaacccctgccctttaagggtccccccgccccggccccccaaaggggtggggtttttggggtttaccccctggggccggcccaaaaaagcccttttttttgggggggggggttgggttttccccaaaaaaatggggcccggggggtttttggtttcccccccttccctttttttttttccccgggttccttttta

SEQ ID NO: 683743 - DNA, 567 bp, Homo sapiens
attacgagatattacctaatgtaaatgacgaagttaatgggtacagcacaccaacatggcacatgtataaatatgtaacaaacctgcacgttggtgccatgtaccctaaaacttaaagtctaatacaaaataaaaaataaaaactttggctgttggccccaaatattcctgcttcatcatctctccactccagaaacttttaacatgcttacaaagggtgtccgtttctcatcgaagtatttgccccccagccccacctgcaagaaggtggaagtagggcctctgcctgggagggtaactctcaaatgtaaggcaagaacctgtctctccaccaatatctccaggactgaaggactgtgaaagtctgcatattgatcaagcttctccctcccttatccgaagggacttacttccttcaagacacttttcctcttcccaactagctccatgcccccatccagtcatcttccaactcatctctccccacctgcatgccacacaagaggaacgtgaccacagcacctggaagttccttaaaattgaatggtgtgtcaggccgtgtgtagt

SEQ ID NO: 683744 - DNA, 559 bp, Homo sapiens
  misc_feature (2)..(2): n is a, c, g, or t
  misc_feature (74)..(74): n is a, c, g, or t
  misc_feature (200)..(200): n is a, c, g, or t
  misc_feature (216)..(216): n is a, c, g, or t
  misc_feature (449)..(449): n is a, c, g, or t
  misc_feature (452)..(452): n is a, c, g, or t
  misc_feature (455)..(455): n is a, c, g, or t
  misc_feature (548)..(548): n is a, c, g, or t
gnagctccgcttcccgggttcacgccattctcctgcctcagcctccccagtagctgggaatacaggcgcccgcnaccgcgcccggctaattttttgtatttttagtagagacggggtttcaccttgttagccaggatggtctcgatctccggacctcatgatccacccgcctcggcctcccaaagtgaaaggaaaaaaanaaaaaaaaaaaaaaanaaaaaaaaaaaaaaaaaaaaaataaaaaaaaaaaaaggggccccatttcccaggatacctggacaaaaccattttttgagccttttgtgcccaaccatagtcattagtcttttaacagagccatctgttcatttatgtaacagacactgattgaatatctttcacgttctggtataaggctacaccgaggatatagtggtgtgcagtactgccatggtgcccaactgtatggnggnggnactcatagcaaacaccggttgcctcccaaagaacttttccaacacagcagaatctccttcattggtatcccataccaaaacacaggggtcatncaagatgcctc

SEQ ID NO: 683745 - DNA, 111 bp, Homo sapiens
accagctatgaaaggcaaagggccattttattcttcatagccacaatatacataacaatacagctgtttcaacatctgaagatcaattaatagtaatccatcacaccagga

SEQ ID NO: 683746 - DNA, 119 bp, Homo sapiens
ttttttttttttaattagcagagcgcgcgcttttatttaaaaaaacccgccagaataaccggtcataattagggagggcacggcttccgataattaaattctattaaaaaaacaccatt

SEQ ID NO: 683747 - DNA, 990 bp, Homo sapiens
ggaaagcggaggcagcgggggaagatggcggcggccgtccacagcggcgtgaccgtggagcagctgccgcaagtgagcagctgcccaaagaaggacattatcacgtttctgcaggaacacggttcagactcgtttctgtgcagaacaataaattattaggaacacattcaaattgtggccaagaaagttaaccaaggaccactttggttacagctataacccatcttttgggaaactaagcgtttcaagggtccttgacagttataagtacagtgtcttgagcatgtacaaacaactgtgacgctacagtgaggataacccaaaggaaacaaggtctgaagagaccctggatgagggccaccaaaaaatatactaaattcgtgtgctgaacaagggagataaaacccaattttcccaaacaagggacgactgtgtcactgtggtatacagggaaccactacaagatggggacgtgtttgggatactaatatgcaaacagtggcagggaagagaaaaagtgcaaggcttaagttatagggtcggactaggcaaaggttatccagaggatgggatgaggtctctggaaaatgagtaagggggacaggtctgactgggattggaccagattggttacggaacgaatgacagcttgtgcaaatccaccaaggcaatccttgaggactagggatatggtgaaagagggttcggctaggatttagacatggtactgggtgaaattaccacgtgtgatgtccttggaggggagccggcaatgggtaaattgtttgcaggtagaaaccttaacggtaaagtcaggaagtgagactatcagtgcaggtagagctggtgaaacacaacaggtgtctttttttttttttctctttttttttcttgtgttctctgttagacaaaggagcagagagataagagaagagagaaagaaaagaaggaagaggcgaagggaggaaaaggtcagacaaaggagaacaa

SEQ ID NO: 683748 - DNA, 700 bp, Homo sapiens
  misc_feature (16)..(16): n is a, c, g, or t
  misc_feature (18)..(18): n is a, c, g, or t
agcgggcgggagctgngnctctccagctctcaacgtctcaactgctgttcatcgccaggctctaagacagcgagccatgttccttcttctggtgcttctcactggacttggtgggatgcatgcagacctcaatcctcataaaatcttcctgcagaccacaattccagagaagatttcatcatcggatgcaaaaacagatccagaacataatatcaattttatcttcagcttctgttattaattcttatgacgaaaatgacatccgtcattccaaacctctgctagttcagatggattgcaattataatggatatgttgcgggtattccaaattctcttgtgactctcagcgtatgttcaggactcaggggaacaatgcagctgaaaaacatctcatatggaattgaaccgatggaggctgtatcaggatttatacacaagatttatgaagaaaaatatgctgacactaatattctcttagaagaaaatgacacttatacttggtttaattcagagtatcaagtcagaaaaagttcagaaaaaactgactttattaagttattccctcgatatattgaaatgcatattgttgtggacaaaaatttgggagtgtcagcagctatagtgaagtttcaagaagggggaatgctgtcgggactgagcaggcaatggcctaaaaacaataaaaagccctactaaaa

SEQ ID NO: 683749 - DNA, 633 bp, Homo sapiens
  misc_feature (16)..(16): n is a, c, g, or t
  misc_feature (18)..(18): n is a, c, g, or t
agcgggcgggagctgngnctctccagctctcaacgtctcaactgctgttcatcgccaggctctaagacagcgagccatgttccttcttctggtgcttctcactggacttggtgggatgcatgcagacctcaatcctcataaaatcttcctgcagaccacaattccagagaagatttcatcatcggatgcaaaaacagatccagaacataatatcaattttatcttcagcttctgttattaattcttatgacgaaaatgacatccgtcattccaaacctctgctagttcagatggattgcaattataatggatatgttgcgggtattccaaattctcttgtgactctcagcgtatgttcaggactcaggggaacaatgcagctgaaaaacatctcatatggaattgaaccgatggaggctgtatcaggatttatacacaagatttatgaagaaaaatatgctgacactaatattctcttagaagaaaatgacacttatacttggtttaattcagagtatcaagtcagaaaaagttcagaagagtgtcagcagctatagtgaagtttcaagaagggggaatgctgtcgggactgagcaggcaatggcctaaaaacaataaaaagccctactaaaa

SEQ ID NO: 683750 - DNA, 902 bp, Homo sapiens
agcggagtgccgagccgggactgtccagtgggagcaggcgccccggccagcgcagacctggaggcgcacgggcgccgcagcgctacgattcggcatcggggtagagcggagccgcagccccactgcgcagcgccaggacccactcgaccaaccgcctgcgttccttcagcaccctatgggggtaccagcgagactttagaacgagtttggtggatttcggagagctaggggaaatcacgggatccccgctcctgtgaccctcgtcgctcgtccacctcatatgatggagctaaccaactgtgaccgcatcacccaaccatcaactgacgagacgaagtttgcccagcagggtgaccctggtcgggtgattcgaacagagtgacgacactgctggagtctgagggttggcctaacttcttctcgtgatgatcgaggaagacgctggacgaacgacgggcagcaccgacagggttttggcgtgaaaggccccaccctgtggttggcgacctccctgtcccgggagtagccctcgagtcgcgtacgagtcaacaacgagctggctgggaccaggctaggtccatcagaactgatgagatcacgtgttccagcctcttacgggaggcccaggaagtagccatcttgttaccaagaggtagaagcgagtgtgaatcgtcatgggacgcctgaccataaaagcttcgtaactcaggtgcagaccagcaacttgccaggggctccttgctgatacccacggccgatccttggctggaagcttgcgtgtagtgcttgcgatgccccggctgccggtggcccggccggcgaccccgccccgcacctgggggccggctatcagtgggccggcgtggtcgattagtcccctctggcaccaaggggcgagatcc

SEQ ID NO: 683751 - DNA, 817 bp, Homo sapiens
gatatctgctcatctgccaggctgtggggtccccctggaggcacatgggatggcccacctgccacaaccacgatggcactagcagccccagggcccccagtgtcctccctcttgaagtgtaagcacttgagctgtaacgtgtggcagtgaaaggcgtaacgatttccctcaatgacaggagccccagaggactgtgaaggggagttataaaaatatacaaacatagatattttaattcgtggcatagttcatgtttttaagaaagtaattagtaattaattatctgacactgggtaaggacacgtggaagattgtgggagattataaatttatataaagattataatttatacagacatataaattatgatctatgtaaaatatcagtggggagaaacccctcattttccatggaaaatcgtggtacctttaagtacttcccaaaattagagacaatttcactgtttaacataatggtgggaaaatggaacaaaagaccatccataataatgacgcattaagggtggtaataaaataattgcagcttttttgggcaactcctttcttattgggttcggtgcccctttttttgcctgcataatggggggaaccaaaccgcgacctcgcatagccccacacgtgcggcgcgcaccccgcccagacagccgacgacacatcctgtgcgcgccacgtgcacgctgtcacgcaacccttcacaagcggccacgaacacgcactgaaaagggtcgagctcacgagaaccgcggcccagacgcccgacaacgacacccgacaggggacaccgcccaccgtattc

SEQ ID NO: 683752 - DNA, 902 bp, Homo sapiens
  misc_feature (16)..(16): n is a, c, g, or t
  misc_feature (18)..(18): n is a, c, g, or t
agcgggcgggagctgngnctctccagctctcaacgtctcaactgctgttcatcgccaggctctaagacagcgagccatgttccttcttctggtgcttctcactggacttggtgggatgcatgcagacctcaatcctcataaaatcttcctgcagaccacaattccagagaagatttcatcatcggatgcaaaaacagatccagaacataatatcaattttatcttcagcttctgttattaattcttatgacgaaaatgacatccgtcattccaaacctctgctagttcagatggattgcaattataatggatatgttgcgggtattccaaattctcttgtgactctcagcgtatgttcaggactcaggggaacaatgcagctgaaaaacatctcatatggaattgaaccgatggaggctgtatcaggatttatacacaagatttatgaagaaaaatatgctgacactaatattctcttagaagaaaatgacacttatacttggtttaattcagagtatcaagtcagaaaaagttcagaaaaaactgactttattaagttattccctcgatatattgaaatgcatattgttgtggacaaaaatttggtactctggtggtgtaaaggattttaacatctgtagcttggatgactttaaatatatttcttctcataatggccttacatgtcttcagacaaaccctcttgaaatgccaacctacacacacaggagaatatgtggcaatgggttgttggaaggaagtgaagaatgtgactgtggcactaaagacgttagtagaatattttttctaaaatttaaaaaatgttctagtagtaaagaagataaatgccttatctattagtaaacacagatttgaaaaatatattctttggaaaagaaaaa

SEQ ID NO: 683753 - DNA, 687 bp, Homo sapiens
  misc_feature (16)..(16): n is a, c, g, or t
  misc_feature (18)..(18): n is a, c, g, or t
agcgggcgggagctgngnctctccagctctcaacgtctcaactgctgttcatcgccaggctctaagacagcgagccatgttccttcttctggtgcttctcactggacttggtgggatgcatgcagacctcaatcctcataaaatcttcctgcagaccacaattccagagaagatttcatcatcggatgcaaaaacagatccagaacataatgttatttacatgattaccatagggaaagccatattttgtccatctcaaaaagcaatcaattttatcttcagcttctgttattaattcttatgacgaaaatgacatccgtcattccaaacctctgctagttcagatggattgcaattataatggatatgttgcgggtattccaaattctcttgtgactctcagcgtatgttcaggactcaggggaacaatgcagctgaaaaacatctcatatggaattgaaccgatggaggctgtatcaggatttatacacaagatttatgaagaaaaatatgctgacactaatattctcttagaagaaaatgacacttatacttggtttaattcagagtatcaagtcagaaaaagttcagaagagtgtcagcagctatagtgaagtttcaagaagggggaatgctgtcgggactgagcaggcaatggcctaaaaacaataaaaagccctactaaaa

SEQ ID NO: 683754 - DNA, 505 bp, Homo sapiens
  misc_feature (112)..(112): n is a, c, g, or t
aaaccaacccgggtttaaaataagcgtaccaccacgggaaggttcaaatggaaatccaaaaggtgtattttttctgaaggctgttggtagaccatttctcaagaccctaaanattatgtcttggaaaggacaatatttaagaagtataagggcccttgaaacctcttccaggcaggctttcctcccccctctagcaggccagtgggtcaggattctgggcgctcccaaattttggacactttggggcctgtccctttcttaccatagtcagtgtttctgccgattcctttggttgaagacaatttcacctcagattctaagcagcctctgtttgctgcctggaaccctcagcaaacctattcatgatctaaacccagagtcctggctctgggctgttgattgtcttccaaagttggtggtgaagctggaggaagtgaagagccctgcttgctatattctgacaacacaaaccttgggccagaaaaaataaagggactaagtagtg

SEQ ID NO: 683755 - DNA, 98 bp, Homo sapiens
ttttattggtactttattctatatgtttgaccttattgatccatttattattatgaacaaatgtattcatctgtggaggggttcaatgacttgaaatt

SEQ ID NO: 683756 - DNA, 348 bp, Homo sapiens
aactatagtcagcagcgtgaggaggcagcagaacacagtcagctcggggagggtgaagctaggaagaacaccaggtgggctccttttggtttcccagtcgttaggcgagcagaaggctagcccacatgactaccagcttctgggtttctcagtctggccgtagtctggcaaggctggtcacaggcttgcttcgggcagacgggtgcctctccttggggtggtattttcaggccgtattcatttcactctgtaagaattcagccgtgggtcagattctcccttattccttcctccatctcattttccgctaagtccctcatggcctggtttccatcttcccagatcctc

SEQ ID NO: 683757 - DNA, 124 bp, Homo sapiens
tcatgtgcctgcctcggacattcaacgcttgctgcgcgaagccccgcaggccatcggccttgcggcgcccgacatgccggtcggttcgcccggcatggattgtccggcctatggtggacgcaag

SEQ ID NO: 683758 - DNA, 211 bp, Homo sapiens
cgacgctcagcatgtgtcagcatcagcttcagagcagacattcggaagcaagcgtgatgtagagagttagggtagggtgctccagcttgtgagtcaggcaagtcatcaggcatagcgtcgacagaacgagctcgccatattgtgattccagttcttttaacgaagcatattttgaagtcccttcttggatttggtgatggtcgtgaagttg

SEQ ID NO: 683759 - DNA, 139 bp, Homo sapiens
tagatccatggagaatgtagcttgtttttgaaaagagccaggtgcagtgggtcactcctgcaatcccagtattttgggaggcgacgaggtagatcacctgaggtcaggagtttgagaactgctattgaaacttctaaaa

SEQ ID NO: 683760 - DNA, 821 bp, Homo sapiens
ctgcgactcctttgacgttgactattcgagtagtactcccgattgaagcccccattcgtataataattacatcacaagacgttcttgtactcatgagctgtcacccacattcagggcttaataaactagtatgcatattacccggtggcgtctaaaaccagagaaccagtttcaacgcatacaggaccgggggatattacctacgggtcgaagtgcgtctgcagaagtcgtgtggcagcaagaccacagattttccatgcccatcgtcctagagattaacttgcccgtaagagaatctttgacagatagggcccgatatttaccctatagcagccccctctagcccctctagagccgaagaaaatgaacccaaaaaacaagcacaaaagaacaagacctagacagagaacatagagacacaccagagaacacacaacagaagatagaaaagccgagtggacggcaactcccttcaagataggccacgcaccacccggacgaccacacgcgacgtgccggggaccaacccccgagtcctttccggtcatgagcaatcggagggaagccccgataccaataggggggtgccatataataggaatccacgagtagataccatggatcagaagcgtcgttgaccattccaccaatatatcatgcaccgacagctcgttttgaagcaaaggagcgcaaatgtaagttccccccattcacgtgaccacaaatctcgttccgaggtactaaaccaggagcatccccatacgttcgcaatcgtgaacggaagcaccaacacagagccggacggagtcaagtgaaccctc

SEQ ID NO: 683761 - DNA, 155 bp, Homo sapiens
atgttagatctcagtcagaactaactgtggctagtgtgcaggtagttgcttgctgcttagtctggagtgcatctcagttcagagagcaggcaagtcagactgtgtatgggtctttggctctgaggtccggaccactgttttggtttatcccccag

SEQ ID NO: 683762 - DNA, 295 bp, Homo sapiens
tgacaacatgaagaatgattgtatactgattgtgtatctgactgtttgctgaagtatatcagctgcacggagctttgggctgagactatgggtttatgagatatagaattaagtcatctgcaaagagacgtagtttgacttccctcttcctatttgaataccctttatttctctctcttacctgactgccctggccaggacttccagtactatgttgaataggagtggtgggagacagcattcttgtcttgtgtccgttttcaaagggaatgtttccagcttttggttatttcag

SEQ ID NO: 683763 - DNA, 151 bp, Homo sapiens
attactgctgcgatacctacgcagagatcgtggagagtggagcaggacaacaagatgacccccgggaaacctgggcatcgtgttcgggcccacgctgcttcggccacggccaccgaggccaccgtgtccctctcctccctggtggattatc

SEQ ID NO: 683764 - DNA, 140 bp, Homo sapiens
cccttcagacagccgtgacccccttcttcatgatgcctttaacaccgggtagctcaggcccatggactgcaagcctccagacttcttcttcttcttgttctagggcacgcaccatctcccgggtgtccggctagtcatga

SEQ ID NO: 683765 - DNA, 399 bp, Homo sapiens
  misc_feature (18)..(18): n is a, c, g, or t
  misc_feature (72)..(72): n is a, c, g, or t
  misc_feature (142)..(142): n is a, c, g, or t
  misc_feature (208)..(208): n is a, c, g, or t
  misc_feature (241)..(241): n is a, c, g, or t
  misc_feature (300)..(301): n is a, c, g, or t
  misc_feature (305)..(305): n is a, c, g, or t
  misc_feature (320)..(320): n is a, c, g, or t
  misc_feature (390)..(390): n is a, c, g, or t
  misc_feature (393)..(393): n is a, c, g, or t
tgttttaattacttgggnatccccaggaagctttcccagtgatctcctaccatgggcccccctccctgggancaagcccctcccaggccctgtccccagcccctcctgccccagcccacccgcttgccttggtgctcagccnctcccatcgggagcaggtcggctccacactggaggcccgggctggaggggcagtgttgctgttcanagattttgttccattggcgttgctctgttgaanttaatttcagtcttcctgattcttcccttctgtaaagtgtacattaccaagttccgtgnncctntatatatatatatanatatatatatatacaaactgtactctttttgcctttgtacattcaggcaagaagagaaaataaatctatnttntgagac

SEQ ID NO: 683766 - DNA, 172 bp, Homo sapiens
tggggagttggtggccaccgccagagagggttgattgcccggcactggctatgtctgagtccccgcggcttggtactgctggttcagcgaagcgtcacgtatttcctccattgaaggactgcagtctactcttaatggtcggtcctctcactccgggctccatgaccgccat

SEQ ID NO: 683767 - DNA, 195 bp, Homo sapiens
atttatttttttgaaatgtagtctcactctattatccaggctggaatgcactggcgtggtggcgggtgcctgtagtagcagctactcgggaggctgaggtaggagaatcacttgaaaccgggaggtggaggttgcagtgagccgagatcatgccactgcactccagcctaggtgacagagcgagactccatctca

SEQ ID NO: 683768 - DNA, 777 bp, Homo sapiens
tcgttgcccacagtctgtttgcatccctgtatcgtgttactcttatcttttctttctttgatgctatctgtccaacgagcggtacttcgtctctcttgtgtgcccagaggtgctgcgctcctcgtcttgcgtgctttgacatcactgcaacccccgtgctcctgggttcaggcgattctccgtggcccgatgcctcccaagtagctgggaggacgaggtgtgcagctgccgaacccagctctgtttctctttttccactcttcgtttttgctcatctctttctggggttgcctgtcggatttcttatctgcctgttttgcaagcaccttctcctgtgtccttgggagccctgagacttcttactctccttgcctccacccacgctccaaatggtgctgagctcacatccacaccccttgcagccgtccatgccacagccccccaaggtggccccattgccaaagcatgcctgcccaccctcgctgtgccttagtcagggtgtacgtgtgtagtgtgtgtgtagtaaaggaggagagtagaggagaagtagagagaaacatggggattggggccctctttctcccagtggaggaaggtgtgcagtgtacttcccctttaaattaaaaaacatatatatatatatagagaggtcacgaaatttccaatgggacgggaggcaattaagcaaccgacccctgggtcccataggccccagctggcactcagccttgccaagagattggatccagaaaatattgcaaggctaacagaaacacc

SEQ ID NO: 683769 - DNA, 225 bp, Homo sapiens
gaacttattgtccccattctacaaataccgaaactgaccgtccagagaggcaaagcatcattctccatatctcacaacctgtaatatgcacatatttctttcatccccacatctgtcaacctcccaatctgtaacgtccacccctacggggcttatcgcgttttctccctatgtgtggaaacgagatattgtgagatatatagacacaatactatgagattctga

SEQ ID NO: 683770 - DNA, 230 bp, Homo sapiens
cttaccttactgcttctctctctttctttcttctttctttctttctttcttccttccttccttccttccttccttccttccttcctttctctctctctctctctctctctctttctttctttctttctttctttttgatggagtctttctctgtcgcccaggctggagtgcagtggagtgcaatctcagctcgctgcaacctccgcctcctaagttgcccgccaatcgaa

SEQ ID NO: 683771 - DNA, 712 bp, Homo sapiens
  misc_feature (87)..(87): n is a, c, g, or t
  misc_feature (138)..(138): n is a, c, g, or t
  misc_feature (141)..(141): n is a, c, g, or t
  misc_feature (330)..(330): n is a, c, g, or t
ggtacccgccaacaagcgggaccgagcaggaatccgtatctgggaacagaatgaacggagaccagaattcagatgtttatgcccaangaaaaggccaaggactttcccgttcacaagcgcagccttcctcccacaggnaantcccggttaaggggggatggcgcttggaacccttggaacggggcaaccttggaacgcaacctgggggggtggccaaacacccccaaagggaacaggaaacttaaccggcggaacggcaaccttgggcgcccttacaaattcttcgcggcgccccaccccgtggtggccctttcccccaaaaacgggggncacaagggacggattcacccccatgtgtgggggcccaaggactttataagaccgaataacattgggcgccccccaaattcttgcgggggccaacgggcggcggcaaagaacgggctttcgaattctaaaaaaccgtccaggtgggaacggggtctttattcccatcaggggaaaaacaaccgggggggggagattgtgtaagggacaattttacaaaacgggccgatttttcacacggggagccccgagaaaattttgttacacacacccaggggggggacgggcaccaacaggacgcccctttgggggggccgttgggcggggaccaagggcaccaccacaaaaagaggcctcacaaaaacccacaggcggaccaattggc

SEQ ID NO: 683772 - DNA, 247 bp, Homo sapiens
ctctagaggatccaccgccgttcacaactatctgacattatattatggatctgtcgagctttctactcccattaaaatgtaagctccatgagagcaggaacctcatctggcttatccattcctctgaccctttcacctaatatagtggctggcacacaataggcattcagtaaacgtgtggaagggcgaggctcctaccagtaacatacactaagaatatttctgtgagagatagttgtaaatggcg

SEQ ID NO: 683773 - DNA, 350 bp, Homo sapiens
gttgatctagaggccccttcttatctccacccaccagaaaactttctacaatagactatggtattacttttgagtaagggaaacatagtcaaacgtcatgtttgaaggtgaagttaatataatgggagcacgggataagcaccttaaattctcaagatgggctgataacctacaactatgaaatgcaaatattggtgaaattaacaaaacagaactcactcctaactaaacctagcaatggcaagttgccgtgggagagctgatttcttctctacactaagcctaagcaatatctacaggcatcagggttgagtctgcacagtacggctcacctcctatgtcctcattac

SEQ ID NO: 683774 - DNA, 337 bp, Homo sapiens
ggaactcgtgtgccattttttccactctcatatgccacaggattgttgtggggaatttttatcttttttctccctactgtccatactgatttaattttaccaaatgtagacaaatttctttgtccacacattggtttgcccaccattggttctttcatacattttttttctggggtgaggtttgatcttagtgaagcctataccaggttatgggtcttactgtgtgatctgctgaccagaggatcagaatcgcctgagagcttgttggtgcaaggtttcaagttctaccccagacctactggattagcctctgggggtgggacacccgctttgtttt

SEQ ID NO: 683775 - DNA, 296 bp, Homo sapiens
tttggggattcccccgatgcaaaacccacaatgaaacatcctatcatggtagggtcattcctttttctaacaccaggaaaattaataattttcatgatttgagaagccttcgcttcgaagcgaaaagtcctaatagtagaagaaccccccataaacctggaggggctatatggatgcccccccccctcccccccatttgaaaaacccgtatacataaaatttaggcaaaaaaggaaggaatcgaccccccccaagctggtttcaaaccaaccccatggcccccatgactttttcca

SEQ ID NO: 683776 - DNA, 310 bp, Homo sapiens
gagcttaggagccttagccgtcgggctcatttcgtagatgagaccacctcctcaacaaaacatctacccttctcggtgtccccacagggcctgtgtcacatccctgagaagtaacatgccctccccctacaaacacagtatccacccggtcctgtctcccccctgggacttgtgggtcatcctggaagatactatccccaccctttccaggtccccaaaaacaccaccagggataactcattccgggaaggattccattcatctctaagacacaagtgtaccaggattttcgttcgtgccgccttgggct

SEQ ID NO: 683777 - DNA, 113 bp, Homo sapiens
ggcaagtcccggcgctgtgtcccttgtgctctcctcacctctcagaacgcagcaacacatgctgcccatttgcctggtgtcagcccagactctctcgtggcttttcagcactc

SEQ ID NO: 683778 - DNA, 227 bp, Homo sapiens
  misc_feature (106)..(106): n is a, c, g, or t
  misc_feature (156)..(156): n is a, c, g, or t
  misc_feature (163)..(163): n is a, c, g, or t
  misc_feature (210)..(210): n is a, c, g, or t
  misc_feature (215)..(215): n is a, c, g, or t
gtgccaaatgattttgtgtttagtaaaataatggtctaaacacatggatccattcaaacgcacaaatgtggaaagtattgaacacggaaggaaaggctttgaaagnaattactgcctcaggaagcagtgcccatggtatgcgaatttaacacagtnctacttncttacctaaggaatatcaccccaggaatgtcaaaaattaaaatcacntttantgtaaaaaaaaa

SEQ ID NO: 683779 - DNA, 263 bp, Homo sapiens
ttttaggtacctaaaacataattccagtggagaacaaagtgggaatgctgtgccacagagcatctcctaccgtaatgccctgtggaaaaaacttcatatcttcttgctctgtgccagattttctaaaatttctggctcctgtagatgaacataacacctctgagtttatgaacacaaacagtgactttgaatccacagcaaaccatcttggtgattctggtgcgactcctgtgcagacccggaggctatctggaagccgagac

SEQ ID NO: 683780 - DNA, 192 bp, Homo sapiens
ggatggtctcaggaaattaaatggaagaaggagctcggtctgtactacaggcagttcaagggaaagtgactttatcacatggttcagaacaaaagtgcattttgtatgggggagtaatcaaggatcgacataaagctaccaattcctgtctggaaatatttcattcaagtctttctggcaagcgaaggggga

SEQ ID NO: 683781 - DNA, 413 bp, Homo sapiens
  misc_feature (52)..(52): n is a, c, g, or t
  misc_feature (59)..(59): n is a, c, g, or t
gcactgaaggagtcttgttgggggtaaggattcagttcaaactcttttgtantcagttngctatctcttaagagatccctcttctccaaagttggaggcatcatgctacttgacttcaaactatactacaggctacagtacccaaaacagcttggtactggtaccaaaacagacatatagaccaatggagcagaacagagacgtcagaaataacaccacacatctgcaaccatctgatctttgacaaacctgacaaaaacaagcaatggggaaaggatctcctattcagtaaatggtgctgggaaaacaggctagccacatgcagaaaatgaaactggaccccttccttacagcttatacaaaaattaactcaaggtggattaaagacttaaaagtaaaaccctgtctctact

SEQ ID NO: 683782 - DNA, 119 bp, Homo sapiens
ataaaaactctagctacaaaaaagtcttaaataatatacagctgcaaacagaataaacaggtagaggagttaagtagtataaacacattattatccacactgatatgtatgagactatc

SEQ ID NO: 683783 - DNA, 847 bp, Homo sapiens
  misc_feature (7)..(7): n is a, c, g, or t
  misc_feature (105)..(105): n is a, c, g, or t
  misc_feature (107)..(107): n is a, c, g, or t
  misc_feature (109)..(109): n is a, c, g, or t
  misc_feature (113)..(113): n is a, c, g, or t
  misc_feature (121)..(121): n is a, c, g, or t
  misc_feature (127)..(127): n is a, c, g, or t
  misc_feature (131)..(131): n is a, c, g, or t
  misc_feature (133)..(133): n is a, c, g, or t
  misc_feature (136)..(136): n is a, c, g, or t
  misc_feature (138)..(138): n is a, c, g, or t
  misc_feature (162)..(163): n is a, c, g, or t
  misc_feature (175)..(176): n is a, c, g, or t
  misc_feature (181)..(181): n is a, c, g, or t
  misc_feature (184)..(184): n is a, c, g, or t
  misc_feature (190)..(190): n is a, c, g, or t
  misc_feature (194)..(194): n is a, c, g, or t
  misc_feature (200)..(200): n is a, c, g, or t
  misc_feature (207)..(207): n is a, c, g, or t
  misc_feature (225)..(225): n is a, c, g, or t
  misc_feature (227)..(227): n is a, c, g, or t
  misc_feature (236)..(237): n is a, c, g, or t
  misc_feature (242)..(242): n is a, c, g, or t
  misc_feature (244)..(244): n is a, c, g, or t
  misc_feature (255)..(255): n is a, c, g, or t
  misc_feature (261)..(261): n is a, c, g, or t
  misc_feature (282)..(282): n is a, c, g, or t
  misc_feature (296)..(296): n is a, c, g, or t
  misc_feature (302)..(303): n is a, c, g, or t
  misc_feature (320)..(320): n is a, c, g, or t
  misc_feature (337)..(338): n is a, c, g, or t
  misc_feature (357)..(357): n is a, c, g, or t
  misc_feature (362)..(362): n is a, c, g, or t
  misc_feature (371)..(371): n is a, c, g, or t
  misc_feature (374)..(374): n is a, c, g, or t
  misc_feature (403)..(403): n is a, c, g, or t
  misc_feature (405)..(405): n is a, c, g, or t
  misc_feature (430)..(430): n is a, c, g, or t
  misc_feature (432)..(432): n is a, c, g, or t
  misc_feature (458)..(458): n is a, c, g, or t
  misc_feature (467)..(467): n is a, c, g, or t
  misc_feature (470)..(470): n is a, c, g, or t
  misc_feature (493)..(493): n is a, c, g, or t
ggccgangcgccgcggtcggctctgggactcgtctggcgtccctcagaggcagaagaggcctggaccttggcgcacacagacccaggaacagatgagcggggatntntncatncacacctngctgtncacntnctncntggagcccaagaggcgatgggttnntggacagctgtnntttanatngctgtngctnaggttnatgactnacagcactggagagattntngtcagcttnnccctntncagcatagttnagattnagaaggaggctttacattttntttttagctccatnaccatnntggagaagggccatgcnaagcactggtttagctnnctgcggccaagttgaaatntggtntttagcatnatngagcattttttgagggagctgctgctgtntnagcctggagccgtggcagacgcatntnttccaaggacccggggcgaggagctnacgggactnatngctggttctcagaaacgcctggnggacacggcgagggtcctgcaccaccagggccagcagctggacagcgtcatgagaggcctggacaagatggagtcagacctggaggtggcggacagattgctgacagaactggaatctcctgcttggtggccctttagctccaagctttggaagacaccaccggaaacaaagcccagggaagatgtctccatgaccagttgtgaaccctttgggaaagaagggatactgataaaaattcctgctgttatttcccacagaacagagtctcacgttaaaccagggaggctcaccgtccttgtgtctgggttggaaatacatgactccagttctttgctcatgcacaggtttgaaag

SEQ ID NO: 683784 - DNA, 95 bp, Homo sapiens
ggtttgtgctaagcatgtgttagatttaaaaaattagtggattgactccacttgttgtgttgttttcattgttgaaaataaatataactttgtat

SEQ ID NO: 683785 - DNA, 692 bp, Homo sapiens
  misc_feature (3)..(3): n is a, c, g, or t
cgncttatctgcttgtcgcttgctacgagcaccgctccgtgttgcctgctttattttctcttcctgtgttggtgccgtctctttgtcttgtcttccttgtggggcgcgcgggctcgtaccgtggacggtccctcggtgaccccccgatttaccccccttgcctttccccccgtaggccgtccccgacttgtcgggacgcccccaacttgttgcccctaacgagttccctcgccgtccgcatatgccggtccccctcgccgggtgcgctaccccgtaccacttaccctgcgcgcccaaccgagtctttctgggcccgagtcgcgaccccccggccaacccagggaccctctccattggtcaacccacgaacctaaaccttcctgtacataccccccaatcagacccttcttgttgttacccagaagagtattctggagagagaactaagatccgaacggttacgagtatcccaatctgagcccggcctcacatcgtatcccgccctctgggagacgaggtgagtagatcacccgagttagagttcacagatcagccggacatgggaacccgtcgtctgatcccatcacggtatggtggacacccgtgatcccgtactggacagctaggccgagatactgacccaaggccgattcctgagccggagtcactccccgacttaccctggtaacggc

SEQ ID NO: 683786 - DNA, 167 bp, Homo sapiens
gcatttggcgaggcagctcaaactcctgacctcaggtgagcacccacctcggctcccaaagtgctgggattacaggcatgagccactgcgcccagccaacttgtgtttttttttttaaaaggtgaaattataataccaagataacagacaaatgtgcattgtagtag

SEQ ID NO: 683787 - DNA, 204 bp, Homo sapiens
agtgctactgcgtccattgtaagaggctgtatcgagtgagctctttgcttacgtccctcccactatctttaaagaattgctctccatctcctttggcaaagttcctttgcccatttgtcttatttctagtgaaacccctccaagtgtatttccaagtccattctgcatccagatctggcatctttactggagagcggtctcata

SEQ ID NO: 683788 - DNA, 392 bp, Homo sapiens
gtcttctatcagggtgatagtatggcccaaatggggtgtgaggagtcagttatatgtgagggatttcttaggtagtgggtgttgacgcttgaacgcttactaaatggggggctgcttgtaggcctactaggggtgtaaaatattttactctctactacaaggttaatacctagtgtccaaatgagctgtacctcttgggactaacagttaaatttaccaaggggattaagagggtcctgtgggcaaatttaacagttgacctatgattctatcttggacaaccagctatcaccaggctcggtaaggttttgtcgcctcttacctataaatcttcccactattttggctacatagacgggtgatgacaaattagctgttctagggtagctcgt

SEQ ID NO: 683789 - DNA, 1333 bp, Homo sapiens
  misc_feature (774)..(774): n is a, c, g, or t
cccacgcgtcgtgcccgcatgcggcacatccagcttgagccccgaggctcatgacgtggcgcgatctgcgctcaacgatcgaggtgcggctctctagacggcaccactggccatggtaagcatgcgggtatacccaccaatgacaggaagaacggtcgcagcagtctctggggctccttccgtgtgggtctgctcctgcgtggaagtgcgagcaaagcctgcgagcccggcaagccaggcatcgattcaacatgcgcttgtcatcgccctggtgccgtgccccagcgaccgaggaacctggcactagagccatctggtgcgtggcgctctatgtgaagaggctcgatgtgtgagacaggaatctcttcagcatcaacccgatcaccaatgcccagagcccagtgtggcaatgcatcgggccgacgatgcatccaacccgatgatgcatgcagccggttggtgggagatgctgtcgcaggggacgctagtgcgcctagcatcctcgaggaggctatcaccgtgatcatctctagccaggctccttccgggcaaacgaatcccctgcgacaatgcgaccaggcgacgggtgggcgacaactggccccgtagcgcacacgggcgcccactgtgggcaataaaggccgattcgggccttgcgaggactcaaacggcgtctatagtagttcgttgagggaccgaatattgcgccccgaggacagaaggtagctcctcaagcgactaacaaggggtaacctgggatcgcgaccgggaccntgcatggggcataacaggggcgacacataacggtgttcctaggcgcacattccgctccaggttaaggagcccccattaggttttatccatttggggccacacccaaaggtgagacattcaccgcaatagtaattgtgcgatctatggaatagaaacggtgagctaacataaatagacacttggttcaaaatcctagcttgctgggattcaaccatttggattggattgggttgtaaccaagttgagctatggcaaaatggggatgaggcccattgtgggcgagttggacgaccatgtgatcaaggcctttgacaagggttagtatgtacacagggctatatagcaaagtgtaaaatttcacgctgtgtaaaagtgtgacaactttaaggtatgtgagatcacaacaacatgagtggttggcccagggtaacccagtgaagagtgtgtcaatataacgtgggcgaaaatattgatacaaaagaagggattcattgacaaatttagtaagtgtcatttaacaaatacgcgagatactataactagacgaaggacatatgaa

SEQ ID NO: 683790 - DNA, 732 bp, Homo sapiens
  misc_feature (505)..(505): n is a, c, g, or t
  misc_feature (645)..(645): n is a, c, g, or t
  misc_feature (732)..(732): n is a, c, g, or t
gatgataaaacaaaattcaaatatatatacactttacaacagaaacacataacatgaaatgacaagaaaatttgaacactgaaagaagaaatgtttacatcccagatgaagaatcgcaaagaggaagtgttgctgtatggccaattaaaataagcaaccgatttttcccagaaaatacacgacttcacctatattctcaaaattgttggcaaaaagttaatcatagttgtggtaggcagaaaaatgatccctaaaaggatgctgacaccataatccccagcaaagaagcccacgacattaggactaaataaaaatgttaaccaggaagacatgagaatttaaaatgtgcattattatacagtatgttatcaaataaatgaaggaaaaaactcacagaattacaaagaggcactgacaaatacacaatcatagttgaaatacttgtctcacattgatctaaagtcaaccttttgtggtgttaattcccccagcatctctggactgnacagatgtggggccgagtaagtccaaaggcctcttctgcctcaggagcaacagggaagccagggcaggtctgggcagtatgaacagaacataaggaaggttccgtgaagttggtccaagttcctgcagataatccatctnggcggcaaggacagatgagaccaggagaatcagacactgaatctgccaggtcttgctctgaaacttcccagtctggttacacagcan

SEQ ID NO: 683791 - DNA, 398 bp, Homo sapiens
agcccccggccattgaaaacccatgcctggggtccccgggctcccccaggggggaatccccgggccaatgtcccccagggggggcagcaaatcctggggccggccggggggaggggccccagtaaaatttgtatattacccagcccggatttcagccaatttcccccttaatttttttaaaaaagaaaattttaaccaaggggtttttaacccttttcccctttaaaaagcatgggttgggggggttggggagggggggggggggtaaggaggggcccagggtttcccccccccaccccccggccctgccccttaatccagaccccgagggagggggcctttttaatttttttccccgaaaagaacttggttttaaatgggaaaaaattttgttccca

SEQ ID NO: 683792 - DNA, 195 bp, Homo sapiens
  misc_feature (177)..(177): n is a, c, g, or t
ttaccactttcgacctttctaatgtgcctttggagcagaccgtccacctctcatcctttcaactaccatatctgctggaaacaataaattttagattatatttttcaccatccatttccattccctcaaagtttgctatttgctttccatacattcacacttaagagccatttagcnttatagctgtcaccacat

SEQ ID NO: 683793 - DNA, 443 bp, Homo sapiens
ttcggacgacttgcgcaaagccttagtcaattagtgccagtactcctcagcgctacccacgctatctggctggtgaaaaccgcattataccttcagatcctgcgattttccaacggttcgatcatggactttgcgttattactgcctggccagtgccgtggtgctgtacggcgagcctaaatcggtgatcgccaccgcgagcttgctggataccgggcgtttatgcgcacggtaccgtctgcctcatttacgggcaatttcgatgtgaccctctcccactccaaggtgaacaactcggacattccgagcgagatccagggtcaagaaggtacgctgatgattgacaaaatttcggattgtcagggcgtggtactaacgccacgcggtggtcagcgccaggatctgacccatccgcaacatatcaataccatgctgtatgaagc

SEQ ID NO: 683794 - DNA, 240 bp, Homo sapiens
  misc_feature (11)..(11): n is a, c, g, or t
  misc_feature (58)..(58): n is a, c, g, or t
  misc_feature (160)..(160): n is a, c, g, or t
tagctccccanaattccccttgtgttgtggggaggggacccagtgggagataattgantcatgggggtggtttcccccatactgttctcatggtactgaataagtctcatgagatctgatggctttataagggaaaaccccttccgcctggttctttcantctttcttgtctgctgccatgtaagacgtgccttttaccttctgccatgattgtgaggcctccccagcctcgtggaactg

SEQ ID NO: 683795 - DNA, 164 bp, Homo sapiens
agtcggtccgtgttgagcggtctcggtagagcggctcacatgggccaaagaagcacggtaaaaatcctactcctctgagaccttcagaaaccagaaaatggaccatccaaacctgtgcgtgatgccgttatgtcaaattggatgcgctacgtatatgcatgaac

SEQ ID NO: 683796 - DNA, 188 bp, Homo sapiens
gcagatggatccacgcagagtagtagtttcactgaattgaagacacggaggctggagttgacaggacacataaccacaaaggaaggtatcctgcagcacaaaagtttcagaaatcttcatgcagcatctccaagactggtggtaaggatcaccagcagcccctacttgcagtcaggcatgcagcactg

SEQ ID NO: 683797 - DNA, 935 bp, Homo sapiens
tggactctctctgctgccacttcaccttcctgagagaggaccagcggccatcagcctcagtgactgccaccctggaggacaggtcacaacaaccgtattctggagatgaatggagagcgattccagaggggccatatatcggacactatggctgcaaggtagtatcagacacgactaatctctgtctgctacacctaccggcattgaggcattagtcctagtgggcaaaacagtgctgcgggtagaaagtgcactacatggagaactagccatctcttgagtccatgcaccgatgttctgagtccatagtctgagggccccatgatcaggtgacacaggagcgatgccacgtgctgcaaacaacaggacaccagtggtagatcgggagggaaagtcctggtggttgacactgccctcctatctattgagttcacaaggtccgattacctcaatgagtctgctagcaagcatatcagtcggtggatcttgtctacactgcttctctagcccctggcggcccccactggtcctgctgtctggtcgcatccagtctgtggcgctgttatctactgtctcggtgtacatcatgggtgtggcctatcagagaaccgtgaatagaggtcctttgggatcagggagccatgtagtaccatgtggttcattctctctgtcactcctatcatagacgcagtgcacttaaggggaggtccagggccttgggactcacctagtgtacgcaaaagcacgggacgaacttgcctggcctgcatcaggacctcgcggtgcgtgcgcacgtgtgtggatcagacggtacttgttggcctttcatagcaaccttggggctcttgttgcgagcgcagcctagatggccagctcctgggcgtgatctcctggctggtgcttggcgaggctggggccgggcgcgcgagggctcg

SEQ ID NO: 683798 - DNA, 198 bp, Homo sapiens
gttacgaagcatactgggaggctcaggaaacttacaatcatggcagaaggctaagaggaagcaagcagatctttacatggaggagaaggagagagagagagacagcaaagggggaagtgcacacacacacttttaaaccccatcagatcttgtgggaactcactcactgtcatgagaacggcaagggggaaatctggt

SEQ ID NO: 683799 - DNA, 128 bp, Homo sapiens
  misc_feature (99)..(99): n is a, c, g, or t
  misc_feature (119)..(119): n is a, c, g, or t
ggggcagcgcggaggccgcacgatgcctggagttactgtaaaagacgtgaaccagcaggagttcgtcagatttcttggcagcctgccgcaaagagtacngcgagctgaaaggcccccgnatggggggg

SEQ ID NO: 683800 - DNA, 347 bp, Homo sapiens
ataggtgggatggggctggagagatgctcctcaccttccagactgggcagccaggcagagtggctcctcacatcccagacgatgggcggccaggtagagacgctcctcacttcccagacggggtggcgtccgggcagaggctgcaatctcggcactttggggcgccaaggcaggcggctgggaggtggaggttgtagcgagccgagatcacgccactgcactccagctgatttttgaaaaatcttttgtagggatgggatctcgctgtgttgcccaagctggtttcaaatgcctggcctcaagcagtcctcccaccttggcctcctgagtagctgggactataagcg

SEQ ID NO: 683801 - DNA, 215 bp, Homo sapiens
ggctttttttttggggtttttttttcttttcccccggttaaatttgggggggggttcccccgtttttaaaccccttctttttcttttggggtacccttcttggtaatgggcttggggattgggtttaccccgtttggcttttcccaaagtttcccggggtattttttcctggggaaagccaatttgcccgttattaattttttttattttaatta

SEQ ID NO: 683802 - DNA, 331 bp, Homo sapiens
cgcgcgcacagatgatcaggaaacggaatacttaggcaagagaagcaggtgaactcccacgattcacctgaagcatccccacatcgattcttcaaagcaatatggtacagtaccgacttgacattgggccacaacaccacaatgaataatatacaactaggctaaggcaaagatatcttattacataacatatccttgtgaaaaacagcaaaactagttgatccatggtacaaatataacctgtttaacaaaaatcgttgcttacataacatctccttagatgagacgggcagagtggagcagaggacggagaaaacatgctaccataaaa

SEQ ID NO: 683803 - DNA, 1720 bp, Homo sapiens
  misc_feature (583)..(583): n is a, c, g, or t
  misc_feature (826)..(826): n is a, c, g, or t
  misc_feature (832)..(832): n is a, c, g, or t
cctacttttgtgtctctgttttgcgcttgtacgtcacgttctgactgtcggcgtacgttacattcgattcgcttcttggctctttgttttgttgtcctcttcctccctcctcgtccttcttgcttctcgtgtgttgtcgctgcttcggttgtgttaccattagtttcctctctgtggggggtcctcctcattgtaaaggtgcggtctcttcccacaatcatagtgtgtggcgacggcatatgtgttgcaccgcaccacccccgggagggggtgcgcgcgcgactacacatatatgatatccctcccctttttgttgatccccacctctgtggggcggtcactactttactctggggggttgttgtcacacaaaccctctcgtgggttacagtgtcccccgcgccgccactcacttgggggggccgcaccttcgcgtggactcctttcttcgtggtttgctcaccggggggttgttcctctcttcgctcccctctccccttcatatggtgctccccccctagtgatattcccccgggggggggggccaatactacctttgccgccctccccctatgttcagacnccgcgtctggtctctggtgaatttgaatattttgggtagcttcttgatagcggctcctctcctcgcggatgttgtagcgccgtggttgtgtttgtagtcgactagcggtctctccccactgacggtgagtgtcctccctcgggggatggattctccccgcccaagacgtgctattgtgttcgaaatgccctttctgcggggtaaaccccccccacagccgtgtttggtctttggcacccccgnctcatngggcctctccttttatctactaggccgcgtcgctatgcttggcgcgccttgcgcgtcccccttgagtgcctcccctagggccccctttttctgctcgtccttcgctgggccacctctctggcgcaacacctctgtggctggccccctgttctcatctggactggagagcgctcccatctgtgctacattcgagaggagactttagggggctcccgcgccccacacaccctgtctgtgctctgctctctctcctcgctcgccgtctgcgctctcgtcgccacacctctggcgcccctttctccacagccacgacaccgcccgccccgccccctccacgctttggtaagtgtcccccaccctctcccgcccctacacacctcgccacagaggagataacgccgcctctcctctggcggagacacactgtggggaggagaagaaggaaagacacagacgccggcgtatacacttatttctccgaggaaattgcccgcagaggagagtctgtctcgtttttatacgcctctctcctcgtttacacttttttggctgggagcaccggcagactgaccgggggcccaccccccgtcgcccccccgggcgtcgccggggcctctttgcccgcgagggcccggccctataaggttttgattgtgttttagtttaaagcgtgccactcttttaattttatttttaatactcttttttgtaagaatcgaaacttgaggcctcctcgtaaaccctaacaccctggaaattcgctctaggagttcgctagcggccccggccggccgaggctgccctcggcggggtgtggcccctgtcctttccaagtaattttcataattataaccaaacacccacagagaaaaaaattcttatctaaaa

SEQ ID NO: 683804 - DNA, 163 bp, Homo sapiens
tccacatagttgtagaccttggtgtagactccaggtctgttcttccaggcacagccattggccccagtgagacaactcctatggagcctgtccgtctgcatgaccacatggggccaccaagagtcacgctaggcctaacagcaacatagcctggggtaaccga

SEQ ID NO: 683805 - DNA, 454 bp, Homo sapiens
  misc_feature (190)..(190): n is a, c, g, or t
tcgggaaagacaaagcttacattatccctgtttaattgtcaaccaaacatctatcacggcatataattctgggatgaaacgaagctatggggtttgcatctgtacccccaccaaagaaatgagaaattgtctttatataaaagatatgtgtatatcattgctggttaatggtgctttagtacaatgctgngatttttggccaaacttgatgccagatacacgtatgcatttaatgtaaatgtaaatcttacataaaatgttagtatttgatataaaaattagctgggcatggtgccgcatgcctgtaatctcagttattcgggaggctgaggtaggagaatttctcgaacctgggaggcggaggttgcagtgagccgagatcacaccactgcactacagactggatgacagtgagatatgtctcctttccaaacaattggcccataatattgtt

SEQ ID NO: 683806 - DNA, 937 bp, Homo sapiens
  misc_feature (49)..(49): n is a, c, g, or t
  misc_feature (152)..(152): n is a, c, g, or t
  misc_feature (159)..(159): n is a, c, g, or t
  misc_feature (172)..(172): n is a, c, g, or t
  misc_feature (180)..(180): n is a, c, g, or t
  misc_feature (228)..(228): n is a, c, g, or t
  misc_feature (246)..(246): n is a, c, g, or t
  misc_feature (251)..(251): n is a, c, g, or t
  misc_feature (279)..(280): n is a, c, g, or t
  misc_feature (296)..(299): n is a, c, g, or t
  misc_feature (303)..(303): n is a, c, g, or t
  misc_feature (320)..(320): n is a, c, g, or t
  misc_feature (325)..(325): n is a, c, g, or t
  misc_feature (329)..(329): n is a, c, g, or t
  misc_feature (333)..(333): n is a, c, g, or t
  misc_feature (335)..(335): n is a, c, g, or t
  misc_feature (339)..(339): n is a, c, g, or t
  misc_feature (345)..(346): n is a, c, g, or t
  misc_feature (405)..(405): n is a, c, g, or t
  misc_feature (409)..(409): n is a, c, g, or t
  misc_feature (411)..(411): n is a, c, g, or t
  misc_feature (443)..(443): n is a, c, g, or t
  misc_feature (469)..(469): n is a, c, g, or t
  misc_feature (478)..(478): n is a, c, g, or t
  misc_feature (484)..(485): n is a, c, g, or t
  misc_feature (487)..(487): n is a, c, g, or t
  misc_feature (489)..(489): n is a, c, g, or t
  misc_feature (528)..(528): n is a, c, g, or t
  misc_feature (532)..(532): n is a, c, g, or t
  misc_feature (534)..(534): n is a, c, g, or t
  misc_feature (541)..(541): n is a, c, g, or t
  misc_feature (544)..(544): n is a, c, g, or t
  misc_feature (585)..(585): n is a, c, g, or t
  misc_feature (588)..(588): n is a, c, g, or t
  misc_feature (715)..(715): n is a, c, g, or t
  misc_feature (773)..(773): n is a, c, g, or t
  misc_feature (776)..(776): n is a, c, g, or t
  misc_feature (835)..(835): n is a, c, g, or t
  misc_feature (860)..(860): n is a, c, g, or t
  misc_feature (890)..(890): n is a, c, g, or t
ggagcaaggacgtcctggcctggcctccgattcgctggaattgcaaggnccctcccccagtaagggggctccctcaagggtgggaatagagtggaggcccgcacgggagttcttgtctgtgtgcaatccactttgtgggcgtgtgggtttangtctggntgggccgtttctnaacttganccctgaggactcatagtaccttaggggcggggctctccagtgggtggngcctcccgctctgagagnaaggnctcggggtctggaggacccggctttttnnggagggcgcggcctcnnnngganagggcgagccgagcggnctgtnaacngaanancttnaggaannagggctggcagtagggcttgccggcgcgctcctggaaggaccccttggtgagcgggcgnaggnanaaggtgcatgtaaagtggtccgggtggaagcngcgacccagggccgaaacgcagcggntggttatanggaggnnanangttgtgaacagcgaaccgcgtcgtgcgtggaaatggttnttgnanaaagggnggnactcgtgataaaaaaagctgcctcccgagaagggcgcgaanatntccctgcagacgaaacagtccgggtgccagagcgcgctgagcccgagatgtagttatccaggatggggccctggcagccctggcagcgcggggcgaacagctgcaggaagtcccggcggcagtaggngcggccctcgcgctcgtggaaaccctcatctccgaagggctacccgcaactgacgcancanaaatgctctgggtgccagtgagtgcccaaggcggtcaccatcttgtgtcggatgggctngttgcagaagccacatcttggcganaagcgctcaaagtagcacgcggggcagaanggggctccatccttctcgaaaagctgctgcctcccagggcggtggaa

SEQ ID NO: 683807 - DNA, 441 bp, Homo sapiens
  misc_feature (10)..(10): n is a, c, g, or t
gttctccttngcggtaaagaacttagtctgttctcccccctactccagcctgccttgctgtgcttgcctgatgcttagaatccacttttcccctggctcttcctgaggagaccttaagacacacaccaaggatttctagtctcctcttgggtgttagattcagggcacaccagacagcagatccctctctctggggaatccaaggcagagctgaggagacaggagaaagcagaagctgtcaagatgacaaagggtctatggtggaagatgtggccttcctcctccctgaggacttaataaattggattgaaataccaaccccaaatctggatagtcttaaggatcatagggggaggtagctgcacaaagaagcttatatctctggaaaacgaactggagttttaacaaaataattaaagaaagtcacctactggttttatg

SEQ ID NO: 683808 - DNA, 238 bp, Homo sapiens
agcagtttccggattctgatagcataactcagttatccagcagcttgaagaacaggtattccacctgtgcaatccacacaccaagcccagctggcggcagcagctgaaatttgatgaatgaaccagtcagctaaagcaaaacagagtcggagtgaaaagaaggcacggaaggctatgtcctaactggcgtcttcgtgcaggcttccgggagttactagagtctctatcagtatccgga

SEQ ID NO: 683809 - DNA, 125 bp, Homo sapiens
  misc_feature (1)..(1): n is a, c, g, or t
ngttctctggatctcttcgcatcccatcagccatgcagtggtggcactgtgcttgtgtcctgggtcttggcttgatgccaagtttgggaaaggagctaagaagacatcccactaggaagagagag

SEQ ID NO: 683810 - DNA, 178 bp, Homo sapiens
  misc_feature (15)..(16): n is a, c, g, or t
ggggtatgcgtgtcnnattcataagaacaggtaggttagaagtagggtctgtgtgacaaaactatgttgtgtacagttcagcgcgagagtgcgtcatatgtcgttcctagtgtagattgtagtggtgagggtgtttattatgataatgtttgtgtattcggctatacgtgtccggcca

SEQ ID NO: 683811 - DNA, 1051 bp, Homo sapiens
gttattccggcgcattttcgtttcttccgacaagcagatgtgaaaattcctccctcgggatgggagcactcaccggttactaggttttcaagtgcccgaccaacggagccccaacaactcccgaacagtagcaggcaattatggatgaaaaatgcttgctcttggaagacactttctaaacacccccctggcaattgcaacagtcggcttacccagtcgtcgccagtccaatgtacctcctatggataggacctccggccctggtgctcggatggtaaggctcatggcgtcgtcggtacgtaggtccccatcgtacgagggttatcctttgcccagcatcaccggaaggcatggactacgcgggctctgacctgacagcctacctgcatgggcctagctgaacagtccaggggaacgaattcaacccaggaccagatgggcatcgtggaggacatctaagaagaaatgctagctttccgttggccctggatcccattgaggagaagaaagtccctctcagtgatgcatacgatccgctacgtgctgccggatgggaagggagattacagctgtgcacaggaacaggttcctccgacctcggagatgttcttcaagccatctgctcatcaacgtccatgcagctgggcctccacacccaaaccagtgtccgtgccttaacaagtgagacatcgccctcaaactgggacctcatggggaacatccatgctctgctgggggcagcactgattgctcaagtggcattccgctaaccgtctgcagaaggagctaagcagcatgtgtctccaagtgacacccacgcaggtaaacgtgctgcgctgaaagagacatgtgtccgtgtggaacggtggctccatcctggcctcactctcagggtttccaacgcattgtgggtcacaccgctgttgagtacgaggaacaccggggcctttcattcctctaacagaaggtgcttctgaacggcgacgaggatggacactgcacatggcaagtgcctacccttcgacagggtgatacactccgagacacaggg

SEQ ID NO: 683812 - DNA, 782 bp, Homo sapiens
gggggtttggcaatctcactaaccaccattaaactgaggagagaacaaaaaaaaaaaaaacaaaaaacaaaaaaccacacacacttttgggtacggggtggggaggggaatggggagggggtttgggcaatcttcacttaaccaccatttaaactgaggagagaacaaaagaaaaaaaaaaaaaaaaaaacaaaaaaaaaaaaaaaaaacaaaaacaaaaaaaacaaaaaaacaaaaaaaacaaacaaaaacaaaaaacaaataataaaaaacaaacaaaagaacaacaaccacaaagaagagagagagagaggagcggggcgagtgtagtatttatctctctacctctcagcgaggcgcgcccattctaggcgtccgactcgtctactttttcgtctctcatcaacgctctaactcgcccaacataaataacacatactaatctatcaaatatacacacaaacaaaatcctaatagctcaccctactcccactctatctattatcatacatacaataaacacatcacatatcctatttctacatagtaacaactacaccaaacaacactacacccacacataaatacagaacaccatatacactataacaaacaaaaaaaaaaaccacctcctataatatcattaaaggtagtacaaacacatagataaaaacctccaaacagacagaaagacaccaaaacacacccaatctacccaaaaatacacttaaactaacataataatacaaatcacatactaatcccgacaaacacaactctaa

SEQ ID NO: 683813 - DNA, 122 bp, Homo sapiens
tctgctacactacctgcccatatcagtactgaaccacggaggctcacattcttctttaccaagtcccagcatcgtccgcagctagatgcccttctctccgataagagcccactgcaacttca

SEQ ID NO: 683814 - DNA, 287 bp, Homo sapiens
actctaagaggatccccgactgcatcaacgccgcgatgagagagtctccgtcgaaatgactgcatccaacgccgccaggaagttgagtgagaggattgcctgagcccaggagtacaagactgctgtgagctatgatcatgccactatactccagcctgcgcaacacagtgagaccctgtctggaggggtggggggagaaaaaaaacaccatagaaacatcccaaatgtccaataacaaattgtagtccattgtatggatggactacaatttgttattggagggtacc

SEQ ID NO: 683815 - DNA, 383 bp, Homo sapiens
  misc_feature (383)..(383): n is a, c, g, or t
taattttcccagatttaatcagaaaatggtttctacaataatggacacaactcacttctgggtccttcctccttctcctccttcaaaaaaaaaaaaaaaaaaaaaaaaaaaaaaaaaacctcccggcgcgccttcttcttctggggtggcggggagaagaagagagcgaagtaatagagaaggggcgcccgaggtgcgacatcagctcggtgctctcctcggccccagagttcttcttgtggaacacaagggggggagataatacttgcgcgcgcgggtccccccctattatagggggagcgcgcgattatatcttctatcgtagctaatacccgcaggaggaaacacccggcgtattatgttgtctccctcgggcaaccggn

SEQ ID NO: 683816 - DNA, 378 bp, Homo sapiens
tccactagtgtaggccttcttgggaaggaactaggaaagattgacttgggccaggcgcagtggttcacgcctgtaattcgagcactttgggaggcctaggcaagtggatcatctgagcccaggagttggagaccagcccgggcaccatggtgagatcctctctctattaaaaaaaaaaaaaaggaaccgaaatttagctgggcatggaagcgcatgcctgtagtccattgcactccagcctggacaacagagcaggaccttttttcaaaaaaaaaaaaggggaaagggtttttcgcccttcttctaaaaacctgcccctgggaaaacttaacatttgtccccaattccttcgggggggtttaaagccaacctttaaag

SEQ ID NO: 683817 - DNA, 654 bp, Homo sapiens
ggggattgatctagaattttttttgtctagtctgatgcctatataagggttatgcttccttcaataattaaccaagtagtactttattcttttaatgctcaaggaaactaactgttccttgaggatttgacaaaactcacctgtaaaaaccaccttgtgaagggacagttctttgataacttttaattccttccatggtaattggtctattcaggcttttcttcttcagtcaattttgataatttatatttgcctataaaatgatccattccatcaacatgttcaatttattagcacagaataaacccagaattaaaataaaaatgtcagcatataattatattcccatttttgcttttaaatgtgaatgtttattacctttgccagaaggttatttattttatttggctttttaaggaacccgcttatggatttaagaattctactatttctaatttaataatttctaccattatctatttactttctcttttcctaaaaggccttttgctatttggtttctaaccacctggggtggatgcgttaaacatttatttctactctatttaccaccagagggtatttatcctttttttttggggccagtttgggcctatcccataatttttgatatatgtatttggaaattttatt

SEQ ID NO: 683818 - DNA, 207 bp, Homo sapiens
ggcaggaagagagctagctggaagacacgtaccccctgaagatcaagagggaggtcgccctggtactacatagcagtcacgttaggctgggacaattcctgtttacagaggactataaaacccctgccccatcctcacttgggctgatgccattttaggcctcagcctgtctgcatgcaggcgctcattaaaacagcatgttgctcc

SEQ ID NO: 683819 - DNA, 138 bp, Homo sapiens
tctgaagttgctatatacgtctcctgtcacagaacacactgcttagacatcttgctagcccaatatccttctcaatagagaatatgagaatctgtgtcttaccatagaaagtctaagttcacgtgtataggatctcat

SEQ ID NO: 683820 - DNA, 253 bp, Homo sapiens
ctgtagtgacttggtttacccgactgtggttgaatgggacaactcttactccgacagcacgattccttttgcctgagcagcacctccacaagggttggcctatacggctgtgcccaaatagactttcttatactgtttatcatgccatttctggtctcgtcggtaacttaggagcttcctagcagtacgaagtccaatacacttgcccatcctgtacacgccacggtcctgagcaaaagaagagggtggtcgt

SEQ ID NO: 683821 - DNA, 129 bp, Homo sapiens
tcctggtacgggagttggggatgtctctgatagacttcagttcaacagatacatatttggctcacatactgaaaacctggatctttccaacctggtttcttttgataattttggtctccaggggtacct

SEQ ID NO: 683822 - DNA, 212 bp, Homo sapiens
ggtgactcttgaggatcccataaatctggaagtcggattgtcagcatcctagcatccagaggctcgcgccttctgtactgcccagagcacagttccatttagactccactgtcaatgaattgatagcagcgctcagtatccatatgcatagttcaaaacaggtttatacattgtgatttccctttatttacttatagggcatttctctttct

SEQ ID NO: 683823 - DNA, 896 bp, Homo sapiens
gagaagtggcgatcaaaatgggtatcagttagcagagcaatcaagccctttgcagaacctggccgccctccagactggttctctcaaaaacattgtgcttcccatgatacatggtggggagatacagcaaacacccaatactgttgcagcctcccctgctgcatcagtgagtcaacccgacaactgtgttcccatggaggctgtgggggatccacatactgtgactgtttccatggacagcagtgaaatatccatgatcatcaacttctatcaaagaagagtgttttcgatcaggggtagcagaggctcctgttggatcaaaggctcccagcatagatgggaacggaagaattagatctggctgacgaagactggcatactcgctgtgtcttacacaggtgaagcacgctggacttccgagcactcgtcggacgaccatcattggccatcatccgacggacaacggtacgatgatcatcctgaacgctgctggcatgtggcacgcacgcggacagcagcactgtcattctcgcgaagcacacactgctgatcctcagtccctgcctggcccctgggagcatcctatccagcaggagcgggacaagccagtacctctccctgcaccacacactggacggctccaagccaggagcacgactcggacctccgacgcgcaaccggaccacacacgggaactacatgacactggcggacctcagggagccccagatgcagagatcacccgcggcaccctgccacaaccagagccaccccactccaccgcagccggaaatagacacctggcagccgcccaagcccccaagtctgcgccccacccacactcaacgcactcggacccaccacgacgaaccggccaagccctgccgcgccccacc

SEQ ID NO: 683824 - DNA, 1131 bp, Homo sapiens
gcagagaagagaggattggacctccagggcttcctgaatgatctggagaatgctcctgagttactccatatgtacgtcctaccacgcctgtgcacacaacccaactgggattgacccaactccggagcagtaggaagcagattagctactgtcatagaagcaccggtaatctagtaaccccattctattgactcagactatcagggcttcgcatctggaaacctaggagagagatgcctagggccattacgactatatataagtagtctgaaggcttcgagttacttctagtgcccagatcctatactccaagaacttacggtgctactacaatagagagagtaagggaatactagactgtggttggaaaagaacctgagagcatacctgcaagtcctttacccagataggagaagatcgtgcggattactatggtaccaaatccccccgcccaggcagcacgaatatgaggccagcaccctctctaaccctgaagctctctatgcaggcatggcacaggtaaatagtgaagacaacaggctgaccggattactgaccatgagatcatgaactcaggggcacaaacctcaaaagccacgacaaaaaacccagagagaccggggcaaccacgcatcaactgaaacaaaaatagagcagtgtacagcacaacacaggagtacgacacgcacaaagcaaggaaagaagatatcaggacaagtgaaaaaagacacacatctagccatgatagaccacaagaagagacgcaaatcacaacggaggagatggggactcaacaccacccaagacacatacgcatacaacgtggaccaccaaccaataccatgaagaacacaaaccaaaaacccagcgacagaaaacacacccagcacagaaacaaacaacaagacagaacacaatgaacaataacggtgaaacccaaggcaggaacaaacactcacggtctcgtaaccaggaaaacaagacaacaagaagaaccagcaggcaagaccagagacaagaaccacacgacaaccaggggacccagatatagaaaacacgcagcacgaccatggtacacgagaaacacagagaccaaccaagacgaactacaaaaacagcgaggacaaccaa

SEQ ID NO: 683825 - DNA, 1677 bp, Homo sapiens
  misc_feature (213)..(213): n is a, c, g, or t
ggagagaagggcggcgtctacgtctccaaggtgaccgtgtgggagcatcgctcacctagtgctggacctcggagtatggggaatcagattagtggagttcaactggtcagtaaaaccatggcggtagacgacacatcgggagcatggagagcagcggcatcactcgatcgaggcagacgagctgttgatacgcattcagctcaatcacttggncccaggtaactaatccacgcgctatggtagcagcgcaaggcatgcaaggccagtccatccttcactcgaggtccgcgagtcgtacaacattcgcttgtgcacctcgccttgactctgagattaccacgcatattacacaacattcgttctcaaggggtaccaccggtggtcggcaaccatgtcataccccggtggcaggccatttccacgtccttgttcacactcagaacgcacaaacatgaaatgaggaaggccagagaaacgtaagagggaggcacataagacagcacgcacgcaccaggtctcgagagcccagggaggccaggacgtcccacgaggagttggccgggggacgaaatgcgcgagaacaatgacagaaccactgtggaagacccaacgcctgttggctcctctgcagtccagagacagatgttccccaagccgttggacgccattcgtgtggctatggcgaccgtatgctgatggagtaggggtaaacccttgcgaatgggcgagattggtgttcgtgggcacctggcagggttttgcgcacggagtaatggaacgcatggtgcgtcttaggtccctataacgtgtggttcccttggcaccccgtgggtctgtccgtgtggccccaagatgggggggagcgtaccacacttccctatggtgcgacgcttaattatgtgcaaaggcgctgagaggaccggtagcggagtaagggaacaacaggtacgtagggaaccgacaccaggcctacagtagcctcgtgggacgaaacctgcccgttggggattcgccccactttgtcgggacgaattgagggggtgtaaccagctccgtgggacacgggctcgcacaagctggacgcccggcgctgcggcaagagagagcggttgcgcatctgggaaacaggggctcaatccagtggggcacctggaacgtttgtgggcatcacagcaacgcgttactctaaccggacatttcaaggcaggtccaccgctcggcttcccacatgccggggattggtggccaacagagcttcccggtggtggcgacaccaatcactatgcacggcgagtcccaaccggacaacggtcggcgcacaaggttcctcgccacaacgacggtcgcattggcagccccatgacaccacctggcggggaccaaggactcggggggcccacggggctattccgctatgggggccacgcatttgccgcctgggacacacttatacccactaagataatagcaactatcgcggccggccgggcacacgagatcccccacgcagcaaagcaatacgaagtaaggggcccccacagacatctccatcagcacgacactgcccactcggtcatccgcgatactgacgaacataaaatgacgtcgcgacaaacagacgtgtctgagcagtagtgacagagccaactaacgagaagatcacctcgcatacagtcg

SEQ ID NO: 683826 - DNA, 264 bp, Homo sapiens
taggcatagcctcatggtatcctgaactccggggctcagtaatcctccggcctcagtctcccgagtagctaggactacagtcatatgccaccatacctagctaatcttttttatttttattttttggtagagatgggggcttcactatgtagtccaggcgggtctcaaactccgggcctcaaatgaccctacggcctcagcctcccaaaatgtggggaccacaccatgagccaccgtgccgggtcccaacttctttttttctgc

SEQ ID NO: 683827 - DNA, 316 bp, Homo sapiens
  misc_feature (36)..(37): n is a, c, g, or t
gcgtcgactgtgagggagtgtgagagagtgttcacnnactgcgttagatatgtgtgagggagtgtgagagagtgttcacacactgcgttagatatgagtgagagagtgttcacacactgcgtgagagacgagtgagagatgagtgagagagtgttcacacactgcgttagatatgtgtgagagagtgttcacacaccaccatcactgcgttagatatgtgtgagagatgtgtgagagagtgtgagagtgttcacacactgtgtgagagatgtgtgagagagtgtgagagagtgtgagagtgttcacacactgtgtg

SEQ ID NO: 683828 - DNA, 235 bp, Homo sapiens
gctcactgcaagctctgcagttttttttaaatgtagtacatttgtgccaggcacagcagctcgcacctgtaatcccaacactttgggaggccaaggagggaggatcccttgaggccaggagtttcagactagcgtgggcaacatagggagaccctgtctgtacaaaaaaaacaaagatttgccaggcatgctggtgtgtacctgtaaccctagctacttaggaggctgatgtgac

SEQ ID NO: 683829 - DNA, 1288 bp, Homo sapiens
  misc_feature (1288)..(1288): n is a, c, g, or t
ggctggaccaggcgtgatgcggtggtgaggctgagctgccttcccgcctataacgacttgattgcaaatgttcaggcacagcgaccaattgtggcgatctggacgtggacagcagcgtccccgtgtagcaagcacatgtgcccttacctcctggagtgaacgtaaacactcatgctaagcacccgattgtgccaggcctatcccaccgtcgctgtcgtcctgaattcctagtgctttccgggcccgatctgcgcatgttgtgccatggcccaacatgttaagtattccaactaaaccattgtggaagcaggtcttctcagtgttcctatcatggaagcagctcgtctcggacctgtacccacagttgttgggtcacagcaggttgcaagcccaatcatactcctgtcttacatggtgctctgctggccattgggttagtgagtgtccagttggcaccaatcgtacggaaggcaactttgtctagtccccgactccatgaacgaacggcacgcatcacgtttcagatttggcaatccgtggctcctcgactaggaaaggggcttttttaccccaaaggcactgtattaaggggccaattaaaaccgaaccggtcttgtccagaagtccgggggccagggtggggtggacttggctggataggatactgcttgctactcttggcgtccgcacatgagggtttgcgcttgaattcgcaagggctgggacgcacagaaaggttcgacattttccccttgtcaagctccggctttgccctcgcctatcacagaactcgtcggcatcgaccccatgtggacgattcagaacctcccgaggggtggccctgtcagcaaatcctggcttccggtgccaggggcacttgtaattcttattagctggtctcaggaggcacatcccgggccagggggatagaaaagggccaaagcgattgactcgagaggaacggtttccaaccagggaactcctacccgtttcttccacgtaacttatgcctaagagttctcccaaacgaaaccagtttccccggtttggtagattcccctggcgctggggcccgtggattccatggcggattcctacttccagtgaaccgtcatcaaccgaattcggcatcccacttgagtagtggacaacaagaacagcttgcaactccggaagaaagtcctagagagacacgagagcaaactctcaaggattagatatgcaaaccggttgtcaagaaataaagggccaaacgcgcccgcctgagacaccgctggtgatagaaccn

SEQ ID NO: 683830 - DNA, 445 bp, Homo sapiens
gatggtgaagaagaggagttgatgaagaagatgatgaagatgaagatgtagaaggggatgaggacgacgatgaagtcagtgaggaggaagaagaattggacttgatgaagaagatgaagatgaggatgaggatgaagaggaggaagcaaggtgggcaacaggtgcaacaagcaggcaagcagcagcaaaccagcatgcatgcaaggcagcaagatgcattaagaccccgagaatgacctgccagcaaacagcaactgttcagtattggttcggactgctcatggattattgtagctgtttaaaaaaaaaaaaagaggtagccggtcgatccaaaccccagtgacacccacccacccaaagaagccacacgcatcgtccccctgtgcacatcaccgcctctacctcaccatggctagctcccctcctgtggctcacatctcaccac

SEQ ID NO: 683831 - DNA, 169 bp, Homo sapiens
  misc_feature (96)..(96): n is a, c, g, or t
gtgcatccccggagttcagaaacagcagctgctgggggagcgtggcgaggagcactccccccttcagcgggacagcttgatgccctcttatgaggncagcgagagattccgccaagcctggacaggatcttcacagcgtagctcccgccacctggaggaggactatgca

SEQ ID NO: 683832 - DNA, 102 bp, Homo sapiens
ctacaggatctcggctgagcagcttggcaggaggggcaagttggaacagttatctccagaagaagaagagaaaaggagaatccggaagggaaaggaataaga

SEQ ID NO: 683833 - DNA, 142 bp, Homo sapiens
  misc_feature (5)..(5): n is a, c, g, or t
  misc_feature (57)..(57): n is a, c, g, or t
  misc_feature (138)..(138): n is a, c, g, or t
cctcnagtggtactaaattgatgccttaaatgtattgataaggtgactagttagccntcagagatacagtatcagaaatagtattattacagaagcacccaggacattttatttctctttgaataaatctattgtttnaccc

SEQ ID NO: 683834 - DNA, 782 bp, Homo sapiens
  misc_feature (1)..(1): n is a, c, g, or t
  misc_feature (105)..(105): n is a, c, g, or t
  misc_feature (128)..(128): n is a, c, g, or t
  misc_feature (131)..(131): n is a, c, g, or t
  misc_feature (135)..(135): n is a, c, g, or t
  misc_feature (180)..(180): n is a, c, g, or t
  misc_feature (184)..(184): n is a, c, g, or t
  misc_feature (191)..(192): n is a, c, g, or t
  misc_feature (314)..(314): n is a, c, g, or t
  misc_feature (434)..(434): n is a, c, g, or t
  misc_feature (567)..(567): n is a, c, g, or t
  misc_feature (569)..(569): n is a, c, g, or t
  misc_feature (756)..(756): n is a, c, g, or t
ntaagaataaggagtagatgggaataaaggtgcgaaaaaaaaggagaaggtaattttttgtatttttagtagagaaagggttttaaggtgttaggaaggatagtntggatttaatgaatttgtgagangantgantggggttaaaaaagtgatgggattaaaggaatgagggaaggtggntggnaaagttnntattttagaaatgagaggagtgaatggaaataggaaaaatgaaaattttaggaattgaaagtggaaaaaatttttttatataaaaattattgcaaataaaaaaaattgggttttagtgttgnattttaaacagaggtaaagttgtgcgattttagcaaggatttaaacaaagcaaaagaaaaacaccaatcctaataacccccctccttgccccgtctccacgctgtgggagaaggctctancccctcagtcggacttctccttctccttcatgtgcaagaagacgatgctgaagatgaagagccccagcatcatggagaaggcgctggcgtagtaggggtaggccgaggggatgaagcgctcatactgcgtgtncnggagtggccgcacggatacctgagtggaagagtacaggtgtgtgtagcctagccggttgtaatccactttaaactggaatacaccatacacgtcgggcaacttgaactgaacactgtatttgccacctttcttcttcaggaaggtcctcacaaaaggatcaatgcggacaaactccagctgaatgtnatcgccatcaaaggggacccatttgc

SEQ ID NO: 683835 - DNA, 1009 bp, Homo sapiens
tggtttcgtctgcgagccgctattttgggtgccacgcgtgtgcgcccgcgtcatgtgcgccgcccgaattgtgtcgtcctcagaagcgcgccacaatatggaacacggtcccagggaacgtttctctacatccccggacaagtgtgggtacccgtagacaacccctttggaagaccgcaacacccacgcccttggtgcgacagcccggccttccataatggtccctgccccccgccccttttcggggtgtgggtgccctcctcctctcgcgctgcccgcgccaggcctcttcacgctgggggactctccagactctgctggcccgaggacacatacaaaacaccggcacaacagcgcgccaccacaatgaggacggtcgcccagttttcgtccgccccccggatattgctgcgtgcccccctctttccccgcccgccggagttgccctacggggcaacccgttgttcccaaagcccccatttgtgggggcccttttttccctccaggccccggcggatgaggattcccgcgagagagccccgtgcggctatcccccagtgtaccatcacgacgcccttggcagaatttattgagcgccactcttgcctccagggggcgcagcgtgagccgcccccctcatttgcccccagtctggtgtacacacgcgaagagggtcgtgtgagggcgcgccccaacacaaggcgggcacacttgtggcagacggcatttctcctccccatccccacactcgggggagcccatcccgcccaaccactgcgggcacccgacaaggaggggggccagaccaccacaaaggaacccacaaaaagggacggccaaaacaggggaaggaacacccctagcccgcgagcgtcgtgaggcacaggcgccggcgccttgacgagatgagaacatggggccttcgacgacgcacgtcgtcaacccccccgacgctctcccccccccccgcttttttaaaaaatcgtttctttttccccaccacaaaaca

SEQ ID NO: 683836 - DNA, 126 bp, Homo sapiens
acgactttgaggcgaggctgacgtgaatggcgtcgactggtataggggcgaagataatcgaacattagtagctggttcctccgaatccctcagatatggctctgagaccgagcacccacccggcgt

SEQ ID NO: 683837 - DNA, 429 bp, Homo sapiens
tccatgactttttctaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacgcggggcgccggttgggcccatcggaatttaagcccgggaaaattttggggggggccccaaatttaggcctcttgggccaaatccccttttggggggctggataaaaagtaagggggccggttttaaaagggtttccaaggggaaacccggggggaatcccaattagaaacccttgggcggaaatctccttttgcaacgtgggggaaaatctggaggggccccccaggtgggcccttac

SEQ ID NO: 683838 - DNA, 282 bp, Homo sapiens
ctcaggatccccggaggcgttgaatggccctggaggctttgaatggcccggaggccaatggcctcttattacactacacgtctacgttttatctcatttccactagttcctatcaataggagctgtatttgccatcataggacgcttcatttcactgatttcccctattctcaggctataccctacatcatacctacgccaaaatccatttcactatcctattcactcggcgtacatctgcctttcttcccaccacactttctcggccattcaacgcctccg

SEQ ID NO: 683839 - DNA, 258 bp, Homo sapiens
gaaatggccagaaatacagtacctgcttagacgcatcggtttggctcagctgagggatcataggagtgcttttatggtgttgaatttctttgaaaatttctttagaactctagagcccagtgccaggctggagtctttgttctcccacttcctagttggctgtccttcagcaagtaacttaatttctagggcctcaatttcctcatactgcgaatatctagtgcccttattccaggtgtaccagagctaccaattacg

SEQ ID NO: 683840 - DNA, 273 bp, Homo sapiens
tgagtataaagcctaggaagcaattgatatcatagctcagaccataccttttatccaaatggttcttatttggccaggagtagtaatgtaacaagtatgggagattatcgccgaagcttggtaggatatgaatataaacttcagggtgacagaaaaatcagaataggtgtaggaatagaagggggtctcctcctccggcgtgctcaacaaaatggttggagttagaaggttcgcggtcggtaagtagtattagtgattgccagcagctaagga

SEQ ID NO: 683841 - DNA, 510 bp, Homo sapiens
  misc_feature (7)..(7): n is a, c, g, or t
agtattntgagccgaaaggaattcagcctctgaatccctcctgggcctggggtggagcagggtgaacacatacggaagcgtaaacacagcgggccgacttcagcctgcagctcagccctgcggtctcctgggcaacgcgctgcgtggggacattgtctctcacctgaaaagctgcttatgggcccccacctcgtcgtgacggcagcccccttcaggtgaaggccaaggcgcggctcttctcctcccagcctgaagcagatcctgttgtctgcaagtacccagcatccgatggcttctcacggcctccaccccggccacctggtccgagacactgctgtctccggcctggactggtgcagtagccagcagctgctgctctcgccctctatggggcagcctcacacggcccgtggtgcccctgctggtgctcagtccttgtgcgctccctcccttgagcatgtgcgggacctgtggtttatctcaaatgaatagaaaatggcaaaagcaaaa

SEQ ID NO: 683842 - DNA, 319 bp, Homo sapiens
gcgaattcactagtgattgtgagctgagatcgcacccggccattagatttctttctaaaaagctttcctatgtaaaaattacttttcatgtcaaagataggagcagctggtacatggatatggagcagctggtacatggatatagcagcacacacacacgtacaaaatagaaacagaaacacatcatgaatttaaaataaaaaaataaaattgataatggaagacatcctcatctcattttctttgatacaacatctcactgttatccaggctagagtgcagtggtgcgatctcagctcacaatcgaattcccgcggcc

SEQ ID NO: 683843 - DNA, 225 bp, Homo sapiens
cggcgcgaggttaacttacaagtcttatcttcggaagcataatcacacgaaacaacatgcaagtcagaatatgtatgtaatgtgcacaagtcttcttagggaagcaggtgatggaagtggataatgtacttggcactccatcactccactgaaccacccattctttttttttatctgtgttctcttgattttacaatttagtatacatacataagcacacacatt

SEQ ID NO: 683844 - DNA, 93 bp, Homo sapiens
tgggccccaaggttttaaaagcattccctttttttccattgaaaaaagttcgcttgtttgggcccattcaaaggatcaaaataaaatttactt

SEQ ID NO: 683845 - DNA, 239 bp, Homo sapiens
tgagcacattgtagattgcttttattgaacaggtactttaagactgttgaagcattgtttttaatcttaagaatgtgaaggttgttattagtttttctgcttttgcaattttgtttatgaaatctgcatactttcaggccatgtatgtgaataattccagcgggggacttgggagataattcatacggggaattcttaaaactgtgctcagctattaaaatgattgggctgttgaaaca

SEQ ID NO: 683846 - DNA, 206 bp, Homo sapiens
  misc_feature (5)..(5): n is a, c, g, or t
ttcanggcagcaggttgcagtgagccgagattgtaccaatgcactccagcctggataaacagagcaaaactctgtctcaaaaaaacaaaaaaaaacttattgagtttaacacaagattttccaaagagtgtttgtgtctcatttcatctttcacgtaaactgttcaattatttataacgtatcgtatttatccaccaccaccccta

SEQ ID NO: 683847 - DNA, 141 bp, Homo sapiens
aggccttgactccaggatgtggtgtgctgtcgcctcagaaaacccaaaagcagaggtctccacgatgtcaggctgtttgtattgtacaaacctcaaggagggttttgggtgggggcccaaaaacattttccgggtgggcag

SEQ ID NO: 683848 - DNA, 174 bp, Homo sapiens
  misc_feature (20)..(20): n is a, c, g, or t
gtgaaaagaaggccggaagnttatgccaaactggtgcttgggcgggttacaggagttctagagaactatccggaatttaggaatatcctttggcatcacaaaaccagatgttacaagagccctgttaagatactacatagtttttggggagccaagatggaagtttatcccagt

SEQ ID NO: 683849 - DNA, 185 bp, Homo sapiens
gtaggggcagagaatgtgctggtggtagtagcggaggtggtgctggttgtagtcgcagaggttgtgcgtggtggtagaggcagagatgtgctggttgtaggggctgaggttcttctgggtgtaaatgtgagtcatggttttagcattgtagaaggacaactgtcctccttcataatccaggtata

SEQ ID NO: 683850 - DNA, 101 bp, Homo sapiens
actttgtggaggtcctcgcctgtgctggaggatgcttaaatggcagagccaagcccagactccagacggacatgcggataaggcctgctgcggcagatgga

SEQ ID NO: 683851 - DNA, 232 bp, Homo sapiens
  misc_feature (1)..(1): n is a, c, g, or t
ncgacccagcgctgagaatacaggatgtgctggcttagactgacttgaagaagatccctgtacttttctgattcactgtctttcatatctatgttggtgcctcttcagattgcagtaagggtttgtggaattttttttttttttttttggaaatagggttttgctttgtcgcccagcctggggggcaggggaacagatctgggccttccaggaaaaagcgatactccgccgg

SEQ ID NO: 683852 - DNA, 722 bp, Homo sapiens
cccggagtggttctatcccaaccagccccatggctcagtgtagccccctcctcagctccaagtccttcggacgacccctggtattttgcgggaaatgcgccatctgatctccagatgccgaagattccgccgaactgccgacttaaccggctccctggagaggtcctgaaaagcttagccactgcgggccctttggaatacgggaagaaggtgccaacggaggttcttcagaagaggccagccggagaaagccccatatgatgaatgctattaagaaatatccagaaaggcgttctctgataaactggatttccctgagggagatccagaaacctctggcaccagcgccagaaggccggagcccaaggcccagccagatgaggaaggggccccgtgctaaacgacggtattaaaacccgaagtttggttttggtggaaagaagaaaggctccaagtggcacactcgggagagctatgatgatgtatctagcttcccgggcccagaccagctcatggccgaggcctccagaggcctggccagaaagggtccaaataagagaccctgggaaacgaaccagagagaagatgaagaaccgacaccctaaatagcatctttgaataccaagaacccagaaaaaggaatgaagactcgccatttcacgacaccctttgatcccttctttggtgtcatttgtaaacctttctttccaataaactaaaga

SEQ ID NO: 683853 - DNA, 223 bp, Homo sapiens
ttgctcgtctctgagacccccgttcctgcttctatgaaaggaagttgctgttctctatcagcctctattctataagcgatttgatattatttactgcatattcatgaacctactgcagaagaatgtgaactgaataccatatgaagatagatgagtactttcggtaggaattgaaacgaagcaggactgggaggaactgcgtttcacagaagcacggaactgg

SEQ ID NO: 683854 - DNA, 1506 bp, Homo sapiens
  misc_feature (833)..(833): n is a, c, g, or t
tccttctgataattagccccgggtgtcccttccttagcaataagagggtttatagatccccgaaaggacgcccaccccttcgtggggaggttggggcgaccgacgaacaaatttgtttccgcgcggccccaccaccgcgatgagggggggttttggggtggttttttgtgctccccccagtgataattgtaaagaaggaggattggttgtggttaaaatagtaggggccccccccgccacaccttctgtgttttgtgtgaagtactgtgttaaaacggggggatgtaatactcaacaacaaggggggtttttgtccccaccacaaaccaccgggcgccattttggcctctcatttgcccaccactttgtgtgcgcgccccagacccaaaccctcggctccgtggtgctacgggccccccacaggattcttctcccgtcgccccccttgtgtccttttgggggtgtttttatgaggaatgagaaggaggcggccccggcggtgtgccccccctcaccaaggagggcacgacaagattttggtggcggcttggtaccacatgacacagcccctgtgtggacaacccaccactccggggagagtatttttctcgtggtgtgtgtcctctgtgtggccttctggtgggagaactcgtgagcccctctatggctcttctctgggcacacagaggggggagatatctccgggtctttatagcgcgggcgcccacaacacggcccaccctctggcggtggtgagacgtcccacaccatacacacacatctggggagagtggtgtgtggaaaagaacgaccgtgttgtcaactgtcgcgcnccctggtgtgtgagacccctcctgctgagagtgattatatagagaagtgtgagacactcttctcgggagaaacgcccacacgccacacagggggacgcacatacgcaccctgctttcacacacagagagagtgttctgccgcacctctaaagtgtcttctgagagtgtgagaaggtgtctcaacagagtgttttggatatttctctcccccccctgctcactctgagagagagagaaacggctcttgtgtgagtgagtcctcggtgacacacggctctaagacacacagctggagtgtgtcctcccacacactctgacacctctccacagggctcggagagagagagagtgtggagagagacccacacgcgctcgtgttctccctctccctctgtctgaatggagaattttggctcgcaccacccataattcttccgccctgcggtggctcgggccaataatacctctaagaaacattcaccaactcttcctcgtgtatttatacctcgtggtggacaccacctcgtgccacctcttattggggggaaaaatagcctgaaaattaggggccacttccaagtagaatagacttctatttcccataatttgtcttatataccagtatttgccttttatcccaaataattcccatataaccccttttataaggtat

SEQ ID NO: 683855 - DNA, 468 bp, Homo sapiens
  misc_feature (209)..(209): n is a, c, g, or t
ggtgcttgcattttatccaataaccactactacattacacggttaatcctcccacaaactatataattgagggagacggtgaccacctttcttaaacgaacagtacacctagtttatttaaagcatttggaccaataaaataaatagcggcaacactagaagctaaaactaccagaataggaaactttctgaactcaccgtcactacgnaatccactctcgacccatcacaccccacctctccactaggaccgcaataacaacaaatcaaccacgcccctcaaccaacccaactttacacaacacacccacaactccccccccttcacccactccctcccaacacaatccccccactccctcccccaccaaccaccctcccccccctctcccacctacacccgcaccccccaacaccccacacccaccacccccctcccccacccctaccccccattacctcttacac

SEQ ID NO: 683856 - DNA, 158 bp, Homo sapiens
aattgacagtttcacctatgtctcattttatatgatttataacagtgtaagattttacaagtgggattcaggattcaaattacagggagagtatgaagacctattcagagtttcatctggggatgaaagctatggaagatgatgtacaaatgttattg

SEQ ID NO: 683857 - DNA, 230 bp, Homo sapiens
tgggttgcattttgtaacagatgtgactgtcatctatggcttgtgttccatttctagagtacaggcagaacagatttagcataatttttaagggctctaggattccaaacatggtaaatgagcaggggcttcagcttcaagtcatcagatacattagcccctaacaagagagttagcctgtccttttaagtcaggcattgacttctctctagccatgaaaggcccagata

SEQ ID NO: 683858 - DNA, 325 bp, Homo sapiens
  misc_feature (13)..(13): n is a, c, g, or t
  misc_feature (43)..(43): n is a, c, g, or t
  misc_feature (133)..(133): n is a, c, g, or t
  misc_feature (233)..(233): n is a, c, g, or t
  misc_feature (256)..(256): n is a, c, g, or t
  misc_feature (259)..(259): n is a, c, g, or t
gcctccctgctgngattacaggtgtgagccatcacacctggcnttgattatggtagttttatgtttggagtatttcattaaatttaataaatatgagtgtttcaagtattactcttcactgtcattaaatggngagtttattctggaaattcctatacttttgctcgtttaatactttgccatttgaagagtaaattactttttgcatttccttccttaatatgctttcatgnctcttcttgggcatagtttatgntgntatttcccttataatttggtactctctctctcttttttctttctctttccttcccccagacacttt

SEQ ID NO: 683859 - DNA, 551 bp, Homo sapiens
  misc_feature (459)..(459): n is a, c, g, or t
cagtgggctgggcatgacgtgggccaggtctgtgaaagagaggctttcatgtgctgaaatgctggaagtgcggtcaaagtcaattgcggaggccaggggcagtggctcaggcctggtaatcccagcactctaggatggcgagtcagttgaggtcaggaatttgaggccagcctggtgaagacgggaaaaccccatctctactaagaatacaaaaatgagctgggcgtgtgggcaggtgcctattatcccagctactcgggaggctgaggcatggagagtcgcgtcgaaccggggaggcagaggtttcagtgagccaagatcagaccactgcactcgaggctggtaatagagcgagactccgtcccctcaccccctcaaaaaaagaaaattaccacgggtataatactcttaactaaaggtggtttctttctttcttgatttttcaccaatttcccatanttgtactctttctgtcccaggatccaatccagggtcccactttgcttccagttcttattctccccgtcctcctctgggctggaacagtttgt

SEQ ID NO: 683860 - DNA, 379 bp, Homo sapiens
  misc_feature (13)..(13): n is a, c, g, or t
  misc_feature (43)..(43): n is a, c, g, or t
  misc_feature (133)..(133): n is a, c, g, or t
  misc_feature (287)..(287): n is a, c, g, or t
  misc_feature (310)..(310): n is a, c, g, or t
  misc_feature (313)..(313): n is a, c, g, or t
gcctccctgctgngattacaggtgtgagccatcacacctggcnttgattatggtagttttatgtttggagtatttcattaaatttaataaatatgagtgtttcaagtattactcttcactgtcattaaatggngagtttattctggaaattcctatacttttgctcgtttaatactttgccatttgaagagtaaattactttttgcatttccttccttaaaaaggaaatgtgtgggttacctgtgtttgaataacaaattatatgctatttacatatgctttcatgnctcttcttgggcatagtttatgntgntatttcccttataatttggtactctctctctcttttttctttctctttccttcccccagacacttt

SEQ ID NO: 683861 - DNA, 232 bp, Homo sapiens
  misc_feature (24)..(24): n is a, c, g, or t
  misc_feature (51)..(51): n is a, c, g, or t
  misc_feature (174)..(174): n is a, c, g, or t
caaggccttttgggggaacccccncccccttggggtccccccctggggttntcccccccccaaaaaatgtctctgtgtgtgcgccccccaaataaggtaaccaaagaaaagcggaggagtcggccggggaatgggatttgggttcctttggctattcccccaaaaacccccccncttagccagttttttttgcaaaacaaggaaaaaaagggtttcttttttaaaaaggcca

SEQ ID NO: 683862 - DNA, 807 bp, Homo sapiens
  misc_feature (186)..(186): n is a, c, g, or t
  misc_feature (266)..(266): n is a, c, g, or t
  misc_feature (326)..(326): n is a, c, g, or t
  misc_feature (343)..(343): n is a, c, g, or t
  misc_feature (465)..(465): n is a, c, g, or t
  misc_feature (467)..(467): n is a, c, g, or t
  misc_feature (540)..(540): n is a, c, g, or t
  misc_feature (618)..(618): n is a, c, g, or t
  misc_feature (678)..(678): n is a, c, g, or t
ggtttcaccatgttggccaggctggtctcggaactcctgacctcaagtgattcatctgcctcagcctcccaaagttctgggattacaggcgtcagccactgcacctggccttggtatatgtgttttaatttgtattcattcatttaagcctcatgacagctctgcgaggaaagttcactatacgtnttcaggctgcaggtagaggacctgaaagggacaggaggtaacagtctggccaagaccacagagccaggaatagcagaggnacatttcacctgggcattgcactccagagctgggcttctcactgttctcaacccctggcnaatgctcacttgaacanagccaggtggtgatacaaaggtatttgttatattagtctctacacttttctgtgtgcttgaaataactgcaacaaagaatatatcagtatttagagtaatgggggattgcttgtgtgtgtantnttgagatggagtctcgctctgtcgcccaggctggagtgcagtagcatgatcttggctcactgcaacctccggnttctgagttcaagcgattctcctgcctcactcctgtaatcccagcactttgggaggtgaggcgggtggatcacttganctcaggagtttgagatcagcctggcagcatggtgaaaccccgtctctacaaaaactacanaaaattagctgtgtgtagtcccagctgctctgggggccgggggagaaggattgcttgaacctgggaggtcaagactgcagtgagccatgattgtggcctgtactatacctggcacaagtagccgccctt

SEQ ID NO: 683863 - DNA, 296 bp, Homo sapiens
  misc_feature (255)..(255): n is a, c, g, or t
gctccctctgggctctattcaggttgcagtgacacgctcatggacctcgtttgtccctgggcagccctcagcaggcgcaccagtgcatggcacaccacctgcagtcccgggatggctggccttgttgtcagtgtcgcggccataggcgcggttgcgcagtgccccacaggcccggcgccgcacctcagccggtgggtggtccagcagtgccacaagcaggggaagcccctgaaatttgcgtacacgcggtttganaccctcgttctcaaagcacagatgctgcaggtagggggggg

SEQ ID NO: 683864 - DNA, 707 bp, Homo sapiens
  misc_feature (707)..(707): n is a, c, g, or t
cggcacgtggagagagagagagagagagagagagagagagagagagagagagagagagagagagagagagagagagagagagagagagagagagagagagagagatagatatagatgatgagggtatatgggagagttagaagggcgcgttgatccgtgcatgtgacagttggcctttctgctcctcctgttgctgcttgtgctggcacatgtgtgtgcacgcgtgtggtctgcttgtggacatgtatttttcttacttgttcccttgctcatcttgtccactaatttgtatgtttatttttaggtatatgtgtatacttctttatgccgcagctctctacgtgctaccagagagctctcctaggttcttcttttaacttcttgctattctaatcgctactttgattactagtgctcaggtacatctgccgcgtacaatgcctgttttgtctctgtttttgagatccgctgtatatcttggtgctatatgttggtactcttcgggataccattgtttgccgctgttatttcttatgacatttttttcccgatttgattgtccagttctcgttttcttcgtctctcgtgtatgctttacctatttgtacttgaatttcttttctcttcacagtgttttttgcgcttatctctttgctccgcttttctctatattgccttcctgttggttgtatggtcttgttgttccn

SEQ ID NO: 683865 - DNA, 1385 bp, Homo sapiens
tcaagtatcatcacgatgggcaaacatgctgaaggcagggggcaggcagccccactgtgtactccagcatgcaggcaagcaaccaaaaagcatgcagcagtgccacaggaaacaatgcattcaaagccataccagatgacaagtcatatttttataaagtcatatagaaaacacatccatattgctcaacaaggatccaacgatctgatcatattaaagacacaatagagtgcattaacacatatatcaggacaagattatcgcagcacatatgacatatacagatacatactcacattcaaccatccacatagaatgcacaacaataaataacaaaatataaacatgtcattataagcagagtgcgaatgcagtgatgctgtatgggtaggatgatcaacgagacgaatcacacagacaacagtgcacacgtatgcacaggatgcactgatcaaaatacaacgaagtggtaacaagatcacagtgataagataaacatgtcagtaatccatgatacgataacgaataacaacagagaaactagaacaagtatgcacaacacgtgactggatcgaaaaacgcatggaacgtacgaccaaaaaggacagacgaacacataagagagatcactacaaccaccacaacgacaacaacgaggtaaagacaatccgttaacaacatgatggacaagccaaaaggacaggcaacacaggaaataccaaaacatatatatcaagagatcacaatggaaactgacataccatgataaaacacggaacaaacgcaaaaatacacgcattataataagacacaccataccacaaaacggagacattaaaaccatggaaagatagacaacacaagagcataagagaagtcaataacctaccataccaagaaaaactcatggcaaaaatggagaacacgaaaagacacaatagagaacaatggaacaatcaaacaagcaaccaggcaccacgacagcaagaagaacaatgaaaaacccaacaaaaaacgagcagctaagcagcagacaaaagcaaaaggaacacaaatagaacaaaggagacaaaacagggaactgcaacaggaccgcaagaagagacgacacaccgataagaccacacccaagcaacaaccacaccaacagaaaaacagaagagaaaaaaaaaagagaaaaaacacaaagaacaacgaacaagcacagaggaagaaacagaaacaaacagacagcaagaccaaaaaacaacaacgcaacaagaaacagaaaaaaacacaaacacgacacaaaaacaaaagaaagagaagaacggaagcagaacacagaaacacacaacaaaaaaagacaacacaacaagacagaatccaaacccacgcagaacaca

SEQ ID NO: 683866 - DNA, 287 bp, Homo sapiens
tattttcacacctccaccctatataatgggtcagtctcccatgttctcatagctaggggaggtaacccattgtaatttgtatggggaggttaacgtatagccatatatgatgatcccagctccctttcactacaacccccgtctgcatcctttgctttgcagtaggatttgagagaggaaggatgaagatttagcacacaggatacatttaaacaggcacagattttgaggggtgggggggaacaaaagcaaaacaataaaactttcaccagttattatcgaaatga

SEQ ID NO: 683867 - DNA, 261 bp, Homo sapiens
tgtattggtggtgctccgtgtagtggtgctcgtgtattggtggtgctccgtgtattggtggagcacacttgtaatcccagtactttgggagcctgaggcgggtggatcaccggaggtcaggagttcaagaccagcctggcaaatattgtgaaaccccgtctgcactaaaaatacaaaaattagccagtgtgatggtgcatgcctgtggtcccagctactctggaggctgaggcaggagaatcacctgaaccccaggggcgg

SEQ ID NO: 683868 - DNA, 208 bp, Homo sapiens
  misc_feature (14)..(14): n is a, c, g, or t
  misc_feature (23)..(23): n is a, c, g, or t
  misc_feature (52)..(52): n is a, c, g, or t
  misc_feature (125)..(125): n is a, c, g, or t
  misc_feature (139)..(139): n is a, c, g, or t
tagtctcccttctnaagggaaanggtgggcgaccgaggtgcgcctggagggnccccatgtgggaagggaagacttgcggaagggcaattcttccagtgcggagacgaggaggccagcccagccgnacttcggttgccancgtccgcctggtggtccgcagcccttccaggcggcttctccgggtggggcgtgctagtccggggctaac

SEQ ID NO: 683869 - DNA, 293 bp, Homo sapiens
gcttgtggtcgatctctagcaggatcccccattggtccgagagaaattaggcctacccgccgcagatactgatcattctatttccccctctatggtccccacctccaaatatctcatcaacaaccgactaatcacctaccctactattactaatcgaactaacctcaaatacaaatgataaccattcacaacacttacaggacgaacctgatctcttatactattatccttaatcatttttattgccacaacttatttctctcggaccaatgctaatttctctcggaccaatg

SEQ ID NO: 683870 - DNA, 1276 bp, Homo sapiens
  misc_feature (467)..(467): n is a, c, g, or t
ttttagaaccgccgccaccattcagtctgttgcctttttttccctcttattctcgcttccctctagctctgtgttgtcttctctcattctctttatatctttgccatcatgctgtacgtctcggtccacttctcttagtgtttttctcatgtcctctattgtaggtcttccccgtattctcttgcgtgcagcacctatctgtctagttttttttccgccggtcccattagttcccccgctgcctcgttgcaccccttccttgctttcttgtgcccaaccagctttcgaaggcccgtgccagtatctcgctgcaatcttccccaccacggtcagcgtccgtccccacgtctttcaagaaggcctaccctttccccgaggttcatgctggactgcctcaccgtaccctgccaggacgtcgagcaagagtattggggctgatgaacatcctggcagtgtacgctctctgngactacagccccgagttcgggacgagctgtccttccgcgagggcgagtcggtcaccgtgcttcgcagcgacgggccggaggagaccgactgctgctgttccgcgctgcacggccaggagggctacgtgccgcaggaactacttcggtgctgttcccacagggtgaagcctcaagaggagtaaacgtgctacgcaggatagaaggagtgtttctcgaggcttgacagataccaagcattgcctgccggtccctctcagaccgtctgccctctgtgttttgtgactgcctgtgtatcctgcacccctcacgcctgtctgagtgtgtggtccgttgccaccggttcttctgttctcctgcgcaagctccacgggaacgaagagagcggcccccagaccttctagaactcttcagtcaatctcgcacgttagcctgtggcgagtgtcatgggaacggtgctcgcgacaatcccatgtgcgctacatggcaataccactttccgtatttgaccaaattcagatgccccatgccaaagtgccgtcccaatgccctaccaaccactcagtcacactcccccagcaacgccacgccacctgcccagcccgggcatgggatgggccatccagcaccagctggatagttcctgggagtcactgctgacaccatgctctcccagcagtctctggggtctgcggtgggaaacagttggtctctaccaggatgcctgccccacctctccccaattgaagtgccttcaccacagcactggtttaatgtttatatactaaatcgaggacttcctaatatttttt

SEQ ID NO: 683871 - DNA, 202 bp, Homo sapiens
gactgattcttaggctgtctgtgctattgtaacaaaacacctcagactggatgatatgtattggctgcagccccacccaaatctcatcctgaattgtagctccctcaattcccacattttgtggcaaggacccagtgggaggtcattgaatcacgggggcggctctttcccgtgctgttcttgtgatagcgaataagtctca

SEQ ID NO: 683872 - DNA, 80 bp, Homo sapiens
agttcaacatcacagatgaaatcatgtctcagttcccatctagcaaggtggcttcaggagagcagaaggaggaccagtct

SEQ ID NO: 683873 - DNA, 931 bp, Homo sapiens
ggctcagaccgttcggctggctcgctcccgatctggtgtatgtgtctggtttgagatgtgtcgagacacattgtgttgttgctgcacagcttggatgttctcgaataagcaaggcgcggctttgcctgagacgtcttggacaaactctggatgaagtacatgtcggtacagtaatgtgtatctatcacccgtgatcatgtcgatgtgccactgtccaatgtattctcaccctgcgtgaaaggggaaacacccgttgcacaaggatggcccagatactttctttcactaaacagtggcggtggtggacgacatccaccaagggcttccagtctcttctcaccgaagtgaaaccaagactggcaccgcaggtactttggttaagggtggccaaccagggatcttttggggaaaagttctgtgattcctctaaatctttatagagattcctgccaagaaaattctacccaagcaagaagaatggaggagctttgacttttactcagggccgtagagaaggttccagaaaacacattaaacacctgggttggtgaaaagaacgaagggtaaaatttggggagatggcttctctcggggctcaagtgcattccattgacaaaggctggttctggtgaatggtgtctattcagaggaactggatgaagtttggcagggtaaccggagagagctggtaaagtcagaagattggggaaccgtgaatgatgtagaactactttaagagacaattggagaatttaccaattggggtcattttggcagactgcatgcatagtcgcagaactgttagacgtggagatcttacaattgaatgaagtgatgagaagggaggccgggaaagagagatgagttgcgagtgttagaggtggcaactgtagttgggaacgattgtttttttcttttattgacttttggg

SEQ ID NO: 683874 - DNA, 169 bp, Homo sapiens
agaggatcgcccggaaaaccagcggcatctgaaactctatcctcagatatggtttttgaaggtaatttaccatatgatcaccttctcaaatttcttagacctactaaaaatcagaacatgtactataaacattgcattgcttagatgtatatagtttaagcagtctatt

SEQ ID NO: 683875 - DNA, 286 bp, Homo sapiens
  misc_feature (135)..(135): n is a, c, g, or t
  misc_feature (184)..(184): n is a, c, g, or t
  misc_feature (207)..(207): n is a, c, g, or t
atgagctgtgaaaacagaacccagtgagtgcgaaccgcagtgacccagtcaccttgaatgtcacctattggccggacactcccccaccatttccccttcagacacctattaccgtccaggggcaaacctcagccntctcctgtctatgcagctctactaacccactctgcacagatactcctgngcttatcaagtggaacattccangcagagcacacaagaagctctttatcccgtaacatcactgctgaataaatagtggatcctataccgtgccacggccaat

SEQ ID NO: 683876 - DNA, 624 bp, Homo sapiens
  misc_feature (3)..(3): n is a, c, g, or t
  misc_feature (180)..(180): n is a, c, g, or t
  misc_feature (210)..(210): n is a, c, g, or t
  misc_feature (223)..(223): n is a, c, g, or t
  misc_feature (254)..(254): n is a, c, g, or t
  misc_feature (258)..(258): n is a, c, g, or t
  misc_feature (270)..(270): n is a, c, g, or t
  misc_feature (276)..(276): n is a, c, g, or t
  misc_feature (285)..(285): n is a, c, g, or t
  misc_feature (287)..(287): n is a, c, g, or t
  misc_feature (310)..(310): n is a, c, g, or t
  misc_feature (315)..(315): n is a, c, g, or t
  misc_feature (318)..(318): n is a, c, g, or t
  misc_feature (320)..(320): n is a, c, g, or t
  misc_feature (327)..(327): n is a, c, g, or t
  misc_feature (331)..(331): n is a, c, g, or t
  misc_feature (334)..(334): n is a, c, g, or t
  misc_feature (344)..(344): n is a, c, g, or t
  misc_feature (349)..(349): n is a, c, g, or t
  misc_feature (355)..(355): n is a, c, g, or t
  misc_feature (358)..(358): n is a, c, g, or t
  misc_feature (365)..(365): n is a, c, g, or t
  misc_feature (379)..(379): n is a, c, g, or t
  misc_feature (385)..(386): n is a, c, g, or t
  misc_feature (400)..(400): n is a, c, g, or t
  misc_feature (402)..(402): n is a, c, g, or t
  misc_feature (414)..(414): n is a, c, g, or t
  misc_feature (416)..(416): n is a, c, g, or t
  misc_feature (427)..(427): n is a, c, g, or t
  misc_feature (437)..(437): n is a, c, g, or t
  misc_feature (473)..(473): n is a, c, g, or t
  misc_feature (478)..(478): n is a, c, g, or t
  misc_feature (509)..(509): n is a, c, g, or t
  misc_feature (552)..(552): n is a, c, g, or t
  misc_feature (554)..(554): n is a, c, g, or t
ggngcttgctgggctggagcgttttgacccttctgagcttttggagcaggcgctgctttctggcctgttgctttctgggcaggaaccttctgggctggagcctttttactcgcggcggtgatcttttttgctggaactttagcagcagcagcagcagcagcagcagcagcagcagcagtncccttagtaccaggtgcttttttgggagangcttttaggaganctgccttttgaagcttctcaacttcattctngcantatcctgtcccncatttnctttgcctncntaactttaaaacgatcaaaatcngtcanctngnctttccnttcnctngcttcaatcncctcngcccancgngtggctncccatctcgtattnatgtcnncctccccccaggcntntcggacatactncncgtgggcactntccggaaacntgacgatgacatcagtcacccgcatgcccttcacangcatngcctgtctcctcacttgactcccaggcccancgaccaaagccctgtcctcatcaataacacctacaatcgcgancnattttccggcatgaggtccaaaggagaaataggccacccggccaacctccacgaagcgccttaacaccat

SEQ ID NO: 683877 - DNA, 111 bp, Homo sapiens
tcagtatcttccctggaagaaatgtctattcagactcttttgcctgtctattagtcagagttatttggcgtaaacatgttgtgaatatagacaatggatgccatttcctca

SEQ ID NO: 683878 - DNA, 2737 bp, Homo sapiens
gctcatgaaagtgtaggggccccccatgggatccccagaatattttctctctcaagctagtctacactcaagtcttcagtagttagctagttgtcttttaagttgctggcttcagtggcattttctgctcccagtaggttgtgattctctgttttcaacttgtctccaatttccaaggtaggtgtttgttctccttaaatagaggaagaactgttttatgagttaatgtgagattattttattgtgcatatattcactttgagatggctgttagactagagctatctagtagtcaattattcacatgagtatgtgaacctgagaatttgagacaggtctcagttaatttagaaagtttattgtgccaaggttcaggatgtgtacccgtgatacagccccaggaagtactggcaacatgtgcctaaggtggtcagggcatgtctttgttttatacattttagggaggcatgagacatcaatcaatatatgtaagaagtacattggttccatccagaaaggcagggacaacttgaagccccatccatccgcctgcagccgggagactcagagcctgggaggggcctgaggcccgggccgcccgcctccttcttccaggtcacaggtaggtgagagacaaatggttgcattcttttgagtttctgataagcctttccaaaggaagccatcagaatatgcatctatatcagtgagcagagggatgacatttaatagaatgggaggcaggtttgtcttgagcagttcccagcttgaattctcccttagcttagtaattttggggcccaaaatattttccttttacatttcccccatttctttttaaaaaaatcttttggagaaaacattttagaagaaaatgagtctctggtctcaggttttatctgatctctcatggctaggacagtttgttcctagatgggttaggtcccaaagctcatttttagcagattgtgaagtctcatgtcctatgaagaggaaacgggaggaagggagaaaaacaacaaaagaacaaccctggaaaaattgatataggctatattactctgaagtccatacatcagtaagtaggtatgaaagtggcttatgtatgtaaataggttgctgtttattttcttctgaagtttaagttgtctggcttcagttcacagggctttaagaaagcacagcttagttttcagtgactccaacttaggaaaaatggggcaaaaaagaaggaagaaaattgaaaacattattttgaagacttgtggccaagaaaaattagaatttggtccaaactgtagaaaataataaacattgagaaaacattaggaaagactagaatctaacaacaggtctactatagttttgaaacataatttttctctccagtttcccatttttactaaagacaaatcatggtatgactggtttgctttattatacttggcctaattatttctatacaatgcaacaagaaaatttttacataggcttttaaactggcttttttggactttcataggagaaatctcaaataagactcttttaaagccaagcccagccatggatttatgcaatcaaatacctatgagttgggtgaatttcctctcctcttgaggttccaagataaacctgaggcttctgggcctgtcagaaagtgacattcttcacttaacacaggtcagaaaccctgtacagggactatgtacacaaaatatgaggccagtttttccaagggctttattggttccataagtcacgtttgattccttaaaggaaagcacactatttcagtcaaagccttggtaaaataaccaatttctccaattgtatcctgttacgaattaaaacagattcttattgcacttgtgcaaatgactgtattaccataagttaagaatactcataaatatttccaaattctggagaaatcaggtagtgaaaaacaaatatgctcaaaattttgttcataggagtatactaaactcttaaaagctgtcaatagctcaaaagaaaagtttgaagactaaaaaacaaaggataagcaacatttaaagcaagagttaaaaagattgctttagtctcttgtcagttcagtttatggagttaactcctgttctgcttgatagtcatgaacacttcagctctccatgagaatcctgcaagttttttttccccctctattctaatgtcacaatctgcaaagttatcagaaacttgcatttaagaacacctgtttgagttccatagttgattatagaaccacctaaaaaggaccaaaacaagacaacaattgtccatggatgacaaaaattttagggcagccataatcaaagacacaattgacaaatgtgttacctctgtggcacacaataatttaacaacaattacaattactgataacgttcactaagttaaatcagaattacaggagtttcccatcattttggaacacataccaataacatttatacaaatatagcccaaagaaaaccaaacatcatttcatatttgacaatgctccctgtctaatttttataccaaataagccaaattatgtcatttttggactttaggggacctaatatcttaaaggattaattaggtcaggaaaagacaatttataaattgattttggaaagtttgtaaaatatcaaaggtttaaaagacttgataccatgaaataggatcataggtcattgtaaaataagtcattcatttaaccaaagtgataagg

SEQ ID NO: 683879 - DNA, 93 bp, Homo sapiens
gtacgagtattgctcttgatggcaaatcaaaatatgctttagaaataaaggtaatttactggaaaataggagtttttgtaccaaaccataaaa

SEQ ID NO: 683880 - DNA, 678 bp, Homo sapiens
  misc_feature (9)..(9): n is a, c, g, or t
  misc_feature (196)..(196): n is a, c, g, or t
  misc_feature (273)..(273): n is a, c, g, or t
  misc_feature (278)..(278): n is a, c, g, or t
  misc_feature (290)..(290): n is a, c, g, or t
  misc_feature (292)..(293): n is a, c, g, or t
  misc_feature (299)..(299): n is a, c, g, or t
  misc_feature (320)..(320): n is a, c, g, or t
  misc_feature (328)..(328): n is a, c, g, or t
  misc_feature (330)..(330): n is a, c, g, or t
  misc_feature (336)..(336): n is a, c, g, or t
  misc_feature (350)..(351): n is a, c, g, or t
  misc_feature (353)..(353): n is a, c, g, or t
  misc_feature (369)..(369): n is a, c, g, or t
  misc_feature (387)..(387): n is a, c, g, or t
  misc_feature (394)..(394): n is a, c, g, or t
  misc_feature (396)..(397): n is a, c, g, or t
  misc_feature (401)..(401): n is a, c, g, or t
  misc_feature (406)..(408): n is a, c, g, or t
  misc_feature (411)..(411): n is a, c, g, or t
  misc_feature (415)..(415): n is a, c, g, or t
  misc_feature (421)..(423): n is a, c, g, or t
  misc_feature (425)..(426): n is a, c, g, or t
  misc_feature (428)..(429): n is a, c, g, or t
  misc_feature (433)..(433): n is a, c, g, or t
  misc_feature (438)..(438): n is a, c, g, or t
  misc_feature (440)..(441): n is a, c, g, or t
  misc_feature (443)..(445): n is a, c, g, or t
  misc_feature (447)..(447): n is a, c, g, or t
  misc_feature (461)..(462): n is a, c, g, or t
  misc_feature (468)..(468): n is a, c, g, or t
  misc_feature (473)..(473): n is a, c, g, or t
  misc_feature (479)..(479): n is a, c, g, or t
  misc_feature (488)..(488): n is a, c, g, or t
  misc_feature (490)..(490): n is a, c, g, or t
  misc_feature (497)..(497): n is a, c, g, or t
  misc_feature (503)..(503): n is a, c, g, or t
  misc_feature (514)..(514): n is a, c, g, or t
  misc_feature (517)..(517): n is a, c, g, or t
  misc_feature (524)..(524): n is a, c, g, or t
  misc_feature (527)..(527): n is a, c, g, or t
  misc_feature (549)..(549): n is a, c, g, or t
  misc_feature (584)..(584): n is a, c, g, or t
  misc_feature (610)..(610): n is a, c, g, or t
  misc_feature (613)..(613): n is a, c, g, or t
  misc_feature (659)..(659): n is a, c, g, or t
tttaacatnggcacctctcaaatctgatatatcttgtggggcttacaatttgccttacactttcatttaaagttaccctgttctccactcaccacatgtataaaatatcctattttttctcttaatgttttacaaaccggtaattttcactatcagtagcggatctttttataactcaccctatgttgcccaaaanacaccaataatataatgattagattaaaaaacttggcatcttttttaaaaaaatgtgctttcttttccgtgtataanaatcnactataccattngnnaatganaccctagttacacaacacccncacacccncncctgtnagaattcaccctanncntccaagaccccacctncaacagtaagataagtcnacccccngnntccnaagannngtnttcncttttnnngnncnnattnttttntnntnnntnttgtgaatatgggnnaagaanaagangggganaagagattnantatcccntttttntttttttattnacnattttanctnatcacaattctttaaagtctanactagttttccgtatgttttccacattttattctnacatcatatcttttaaaaacaaaagnatncgaacatttgcacttctcaatgtttttttttttcccatagatgtantttcacttatttccttcag

SEQ ID NO: 683881 - DNA, 106 bp, Homo sapiens
cattccccattcctccaacccattttttccctaatccctagaaacccccaatttggtgggtatttcatttattgccaacatttcatataaagggcttcatccaata

SEQ ID NO: 683882 - DNA, 136 bp, Homo sapiens
atactggactttaattaccatgcagcaatgctacgcatctgctgagtccgttagaagcatttgcggtggacgatggaggggcccgactcgtcgtactcctgcttgctaatccacatctactctgcaatggaattgt

SEQ ID NO: 683883 - DNA, 225 bp, Homo sapiens
agatgacttgactaagatattatacaagtgtatatacaaatgtacctgtgctaggggaccagacatagcccaaagaatccgtgttcttcctagacctaggatagctcctactgacagtaatgacttcccattcatggtatattgcagacctgatgaggatctattgtacggataacgtgagaatgaaccttataccacgtagtatggtccgctgacagtggttgg

SEQ ID NO: 683884 - DNA, 231 bp, Homo sapiens
agtgtggataaaaattcataaagtgaaagggtgtggattcgatcaatctgatgctgcccatcgcttgcactgggggtcttggtggatcgggcaggagttttcagtgtgtggggtgtggctccttcctatgtgtctttggaatctgaggctgacattggctgggaaggccagacccttgctccatcagagagggcaggggcaaaggccagtgaggcagctgtgagtgggaca

SEQ ID NO: 683885 - DNA, 1003 bp, Homo sapiens
  misc_feature (6)..(6): n is a, c, g, or t
  misc_feature (92)..(92): n is a, c, g, or t
  misc_feature (99)..(100): n is a, c, g, or t
  misc_feature (111)..(112): n is a, c, g, or t
  misc_feature (128)..(128): n is a, c, g, or t
  misc_feature (150)..(151): n is a, c, g, or t
  misc_feature (153)..(153): n is a, c, g, or t
  misc_feature (156)..(156): n is a, c, g, or t
  misc_feature (159)..(159): n is a, c, g, or t
  misc_feature (171)..(171): n is a, c, g, or t
  misc_feature (173)..(173): n is a, c, g, or t
  misc_feature (177)..(177): n is a, c, g, or t
  misc_feature (179)..(179): n is a, c, g, or t
  misc_feature (182)..(182): n is a, c, g, or t
  misc_feature (189)..(191): n is a, c, g, or t
  misc_feature (196)..(196): n is a, c, g, or t
  misc_feature (200)..(200): n is a, c, g, or t
  misc_feature (202)..(202): n is a, c, g, or t
  misc_feature (204)..(204): n is a, c, g, or t
  misc_feature (211)..(212): n is a, c, g, or t
  misc_feature (222)..(222): n is a, c, g, or t
  misc_feature (228)..(228): n is a, c, g, or t
  misc_feature (237)..(237): n is a, c, g, or t
  misc_feature (242)..(242): n is a, c, g, or t
  misc_feature (248)..(248): n is a, c, g, or t
  misc_feature (250)..(250): n is a, c, g, or t
  misc_feature (265)..(265): n is a, c, g, or t
  misc_feature (276)..(276): n is a, c, g, or t
  misc_feature (279)..(280): n is a, c, g, or t
  misc_feature (284)..(284): n is a, c, g, or t
  misc_feature (286)..(287): n is a, c, g, or t
  misc_feature (289)..(290): n is a, c, g, or t
  misc_feature (292)..(295): n is a, c, g, or t
  misc_feature (298)..(298): n is a, c, g, or t
  misc_feature (300)..(300): n is a, c, g, or t
  misc_feature (303)..(303): n is a, c, g, or t
  misc_feature (305)..(306): n is a, c, g, or t
  misc_feature (310)..(310): n is a, c, g, or t
  misc_feature (319)..(321): n is a, c, g, or t
  misc_feature (331)..(333): n is a, c, g, or t
  misc_feature (339)..(339): n is a, c, g, or t
  misc_feature (348)..(348): n is a, c, g, or t
  misc_feature (355)..(355): n is a, c, g, or t
  misc_feature (359)..(359): n is a, c, g, or t
  misc_feature (364)..(364): n is a, c, g, or t
  misc_feature (368)..(368): n is a, c, g, or t
  misc_feature (370)..(370): n is a, c, g, or t
  misc_feature (380)..(380): n is a, c, g, or t
  misc_feature (382)..(382): n is a, c, g, or t
  misc_feature (385)..(385): n is a, c, g, or t
  misc_feature (388)..(388): n is a, c, g, or t
  misc_feature (392)..(393): n is a, c, g, or t
  misc_feature (398)..(398): n is a, c, g, or t
  misc_feature (414)..(414): n is a, c, g, or t
  misc_feature (419)..(421): n is a, c, g, or t
  misc_feature (426)..(426): n is a, c, g, or t
  misc_feature (429)..(429): n is a, c, g, or t
  misc_feature (434)..(436): n is a, c, g, or t
  misc_feature (442)..(442): n is a, c, g, or t
  misc_feature (448)..(448): n is a, c, g, or t
  misc_feature (450)..(450): n is a, c, g, or t
  misc_feature (453)..(453): n is a, c, g, or t
  misc_feature (457)..(457): n is a, c, g, or t
  misc_feature (459)..(459): n is a, c, g, or t
  misc_feature (469)..(469): n is a, c, g, or t
  misc_feature (473)..(474): n is a, c, g, or t
  misc_feature (476)..(478): n is a, c, g, or t
  misc_feature (483)..(485): n is a, c, g, or t
  misc_feature (494)..(494): n is a, c, g, or t
  misc_feature (498)..(499): n is a, c, g, or t
  misc_feature (512)..(513): n is a, c, g, or t
  misc_feature (517)..(517): n is a, c, g, or t
  misc_feature (523)..(523): n is a, c, g, or t
  misc_feature (532)..(532): n is a, c, g, or t
  misc_feature (540)..(540): n is a, c, g, or t
  misc_feature (554)..(554): n is a, c, g, or t
  misc_feature (580)..(580): n is a, c, g, or t
  misc_feature (598)..(598): n is a, c, g, or t
  misc_feature (963)..(963): n is a, c, g, or t
ggcggnaccgtccggaattcccgggatctgcgtccatggcgcggcgcttgtggcctttgcagacacgtcgggggttccggccccggggaggntgcatcnncaacgaaagtnnaaggagaagtttcacnaaagaaaaacgaaaccggaacnncntgnacnagtatgcgcgcnanggcnanagngcactcnnncagcngganananagcggtnnagcgcatgcncagaanaggccgcanacgcnctggancnccgcaagggggagcngcgctcggcgnaanngcanannannannnngananggnannagcngaggcagcnnnaggagcaaannnggagcntggaagaanaaaaggnagcngtaantaangnagtgcgggcncnacnggnaaannaaganagtggtgaagtgcagnaggannncaagnacnagggnnnacgggnacatananggnaaancnggaaagagcntgtnnannngtacnnnagggaggcncaanntaaagagcaattnnacangaaggnactaaaacngcccaacnaaaaacacccagangtgcacgtaaggataagagccaggcncgaatacaccacataagncggagacaagccagtttttctccttccaacctcggggccacctggaaattggcgagatactcgacatcatccgtcagaagcgcctgtcccacgtgtctaggccaccggtcctattacctgcgcggggctggagccctcctgcagcacggcctggtcaacttcacattcaacaagcttctccgccggggcttcacccccatgacggtgccagaccttctccgcggacagtgttttgaaggctgtgggatgacaccaaatgcaacccatcccaaatttacaacatcgaccctgcccgcttcaaagatctcaacctggctggaacacgggaggtggggcttgcaggctacttcatggacacaccgtgncattcaaggacctgcaatcaagattgttttctcacacctt

SEQ ID NO: 683886 - DNA, 174 bp, Homo sapiens
  misc_feature (55)..(55): n is a, c, g, or t
  misc_feature (108)..(108): n is a, c, g, or t
  misc_feature (146)..(146): n is a, c, g, or t
  misc_feature (149)..(149): n is a, c, g, or t
acaagttgaatagagaagaacactgattgataataggcattttagtggtcttttnaatgttttctgctgtgaaacatttcaagatttattgatttttttttttcactntccccatcacactcacacgcacgctcacacttagtatncgngcaatcctcccacaccaccagcccc

SEQ ID NO: 683887 - DNA, 139 bp, Homo sapiens
agtgatatcggtccgtgttcttgtgatcccagttttaaagtcccatctgtgtttagttctttctggcaaatatcttctttttgcctgggaatgcttaaccaatgccagtacagtcattgtaccttgagaagtagttact

SEQ ID NO: 683888 - DNA, 941 bp, Homo sapiens
gctgcgggcgctcgtattggtccatctgggtcgtctcggggtgagttaactacgattataagcctgtagtcgacattaagctgtcgcgaacccatggctaggtgataatttgttccttcatattccaggaccggtatgtcgtcattcactgtgttctgcctgtgtcgttgtgcctcggggcccgcttcggcggggtcctctgtctcggatcgtacgtagctcttctctgatcagcactccgtgcgtccgtgtccgcggggtgtctcgctgggacttatgttgccgccaatgtgcggcgtagcctgggttcgttgatatgatcaagcgtgctttcctgttgggagagccgagggtcgtgggtggcgcgggtgtttgatagtgcgtcgaggccacagtagtctagtttaaggttaataggaatcctgaggctctagtatatgtcatcgcggttgccaactgagggctgccaggcaacattccgttggcttaacccgatgggtggtgaccgcggagagaacggattaaacggatgagaagagtccgggagaagggcccccatatggaacaaacaaatggtttggggggttcaaaaaaaaaggactagacagcgtggggtgggccccccacatgaaaaaggcctggagcagcgggctgtatgtcgtaacacaccaacggcgtctgagggaggtttgttttccccagtagcgccgcgggcggcgaatctagttgcccaacacagcgaagtgtgtcgcgaccaacggctacaacaggaggccgagtgaggataaatagccccgtggtaaaaagacgacaaaaacacaagcacagaaccacacgaaaaacacgaacaagacaatcaacaaaacagacgcgaacacagacagaacaaaaaagaagagacagaacacaagaagagcacagctacaaaacaaagacaaaca

SEQ ID NO: 683889 - DNA, 130 bp, Homo sapiens
caccccaaattaactcccaaattaaaacacagttgtgctgtcaatacctcatactgctttacctttttttcctggaaatcggggaatttccaaaggttctaattttttaagcaggaaatatacccaaaaa

SEQ ID NO: 683890 - DNA, 350 bp, Homo sapiens
tccaggattcggtgggctcatcttcttgggccttttgattgtgatctgtgtagcaggatcttgagagtccttgtccttacataggcattgctctagtttgtctttgtgcaaaaaaaaaaaaaaaataaaatgtaattttccgggaacccttgcccagcatattatggtgggtggcttaagaaattcaagccttctccaagagatactttcatacccagatttgtctggtgggctagcagttgtcacagatgggcgggccattgggaatatgaccttttctgtccgggtgatccacagacaaaactttttttatcctcatccaagagtatggattggggactcaagttgtc

SEQ ID NO: 683891 - DNA, 878 bp, Homo sapiens
ccggtcttctggcgacgacgtaccgggaataagtggtgcagtcaaggactgcggactataagcgtcgacgtgcagggcgagtgttgatcgacttgcatagcagccaccccctgtgaagcagcgaatgatatgacctttctggatatggccgcaatggcgagactcgtgactggccccagagaaacctagactcgttggaccgggacttgagatgtgtaccgtccgtccggacttccagtcggtctgcatgctacgcgagggaccgttcgcacggttcctccgaagaagagtcgccctggacgcgcggtgagttgctcgtccgtgtcagtgggggcctggctgtgcgtgagagcgtgtcgtcccctggatccccggtgcttgggagatcctgggtgctggtgcccaggactgtgtgtgcctctccaggcatgaccggaggagtcgcgagcggctcgtggggtgttggcggcctggctccgagtggttacgcgaagagccacgttgccatgcagcgcatgggccccgaatggcttcccataacggtgcggaaaaccgcgaagcatggccatggggatcgaaccccccatggctttgcgaacctttgctatcgcgggccctcggcaatacgacataggatcgcgattggtacctagtagacgcccatgggaggcgttgttgtccgcttgtgtcaacgcccaggaaatagataccaccaaaaaacccacgtaggggtaattgcctgcgattgcttgaacggtaacgcggcttggaggcgcgcccgtggagtttatccagtcccacacgaggccccccgctgggacgttgtggacgggagtccatggtcacgggtactacaaccttggtagttagtttgaccc

SEQ ID NO: 683892 - DNA, 285 bp, Homo sapiens
cctagccactcgggaggctgaagcacaagaattgtgtgaacccaggaggcggaggttgcagtgagttgagattgggccactccattccagcctgagaggcagaacaagactctgtctcaataaacaaacaagcaaacaaactgtccaggtgtggtggcacagccctgtagtcggagctaataaagaagctgaggtgggaggatcgcttgagcccaggatatggaggctgcggtgagctatggatctcaccactggcactccagcttggggggacaggggcaagtc

SEQ ID NO: 683893 - DNA, 357 bp, Homo sapiens
cggtgttgccaatcgtgcagccgttgaagagcatgtacagccattagatcaagataatcgcgaagagattggacaaatcttagatggtatcgaacaaggggagtatacggagccttttacaactgaaacactcaagtcagtccgtaagcgatccgcactggcaacaagacttaaaaatttacaagtgggcagccgaccatgattacaatggcaacgatattctagccgcttacgagctataccgtcccgtatttcattagttgataacacggtgctgaatcaatatttacaagacttagagagtcgcttggacattggcttctttgagctagcggactttgaagagtcactactgaa

SEQ ID NO: 683894 - DNA, 233 bp, Homo sapiens
cattcgagctcggcacccaatcctcagccctggatgtccgggttcggcatctgggtaggcggctgctgacccttgtcactgctgagctggttctgcaactggccctgtgccaggagagcggacatttgggcctgctggatggtcgcgaaattctgggcctggttcatcgactcacggtgcatgagaagggcctgatcggcgtacagacgctgctcgacctcctgcttaaagct

SEQ ID NO: 683895 - DNA, 275 bp, Homo sapiens
  misc_feature (66)..(66): n is a, c, g, or t
ggggggggccccccccccctttttttttcccccttaaaaaaaccgggggggggctccccccccggntttttttatggggggggggggggggaaaattttttccccggggaacccttttcccctttggcctttttttggggccccaaaaaaaaagttttttcaaaaaaaaggggggggggggggggggttttttcgggggtttttgcccccccggggggtttttttccccccccccccggggtttttttggggaacccggttttggggggttttta

SEQ ID NO: 683896 - DNA, 113 bp, Homo sapiens
ctgttgtctatcctatggggtctgattgtgtcacgtgtagtgttatacgcaggtgtatggtctaccttatagataatgctgcttacagcttctatatattctcttattattct

SEQ ID NO: 683897 - DNA, 351 bp, Homo sapiens
tctgagcaagctgggaaggatagatgactagttgatgagtgcagcaaaccaccacggcacatgtatacttgtgtaacaaacctacacattctccacatgtatcccagaacttaaagtataattaaaaaaaaaaaaaaagagggagccattttgcagttttgactgagctttgttctgcttattgaaaaggtaagaaacccaaacggaaagaaggggtgagcaatgcaggaagggctcaagccttgtgtaaaacaggaaaacttctgtttaatggtttgggttgcacagcgccccttggccaaagaggaaagagctaattttgagataagaaaccattgcttttaatttttt

SEQ ID NO: 683898 - DNA, 867 bp, Homo sapiens
ggccacccccagggggggcccccatcaggaggagtttccccttcctccgggcaagtattgccgcatagatggatgctcatggaatcgacacgtgttcctattcttgtggcgccccccagtggtgcgggttccccgcggcccttttgttgccgccgcgcttgtggtgaccaacactcgagccacaagtgcggcggtttcccgataaatccaccaccggctgaaacacattgttggcgccgcccaatacgtagcgatttggcacctttcgttatcggcgaaggccatctgtgcggcgtacctgcgcaaactccccttagtgtcctcccatggtgggccgccccccctttcgcgccacacacaggggtcctaccccggactacgcggtatccgtggcgacaaacataacggtggcctttttttattccttagtgcggcggctttctttccaaacaggccctctttatatctggcggccgacaccacgaacgtctcttttctgtgtgtgccccttgcacgcgagaccgtcggtcgtcaatcggggtgataccagatacacaaggtgcggtcccccggctgtagaacgcgtaggaactcaccacgcgggctcctttgcagtcatcgtcaatacaaaacacttcccaatcaccacccctctctaaccatcctcctctctttcttccactcccccctgctcactcccactgtaatgatatctccttctgtagagaatgccgcactaccacgtggaccgttcaagaacaattgtatctaccacgcatctatgttgcacggcgcgctaaccacagttttcacaacaaataaaaaacaaacttgtgtagctctcttcgccccaaaaaacataacaaa

SEQ ID NO: 683899 - DNA, 99 bp, Homo sapiens
cagaattctatcttttctgtatgtttccatgtgtcaggtagttgtaaatgaatgtatttacctatgcaaaagatttattaaagcctagagaatatgaat

SEQ ID NO: 683900 - DNA, 321 bp, Homo sapiens
ggttaagggctaccataaaatgagacaaaatattgccaatcatatacctgataaggggaataatatccagcatatataaagaactcctacaactgaataacaacaaaccaaccatccaatttaaaaacggacaaagaactcatacagacattttcccaaagaagacacacacatggacaataagcgcatgaacagatgtgtcacaaatgcaaatcaaaactacaatgagatgtcacctcacacccgctagcctggctactatgaagaaaacagaaaataaaaagtgttggtgaggatgtggagagggtagcccttaaactg

SEQ ID NO: 683901 - DNA, 219 bp, Homo sapiens
  misc_feature (18)..(18): n is a, c, g, or t
  misc_feature (34)..(34): n is a, c, g, or t
  misc_feature (156)..(156): n is a, c, g, or t
  misc_feature (171)..(171): n is a, c, g, or t
  misc_feature (192)..(192): n is a, c, g, or t
  misc_feature (214)..(214): n is a, c, g, or t
cgagggataggagtatgngctggactagtatgtngagtcctgtaagtaggagagtgatattgatcaggagacgtgttctagcacagagagtctcccagtagttatagtgggggtaaggcgagttagcgagcttgctagaagtcatcaaaagctatnagtgggagtagagtntgaagtccttgagagaggatnatgatgcgactgtgagtgcgtncgtag

SEQ ID NO: 683902 - DNA, 210 bp, Homo sapiens
  misc_feature (129)..(129): n is a, c, g, or t
gcgggcctcggcctcctgctcgcactggcgtgagtacctcttctatccggccctgtggcccagctccgcatctgcctccgcgtctcgcccgcggagaagtcctcggctggaattcctcatgcgcaagtncggctagttcgtgcgaaactgcgttttgaattcgccgccgagaactatcttagccgcggatggccaagggacggacgtatg

SEQ ID NO: 683903 - DNA, 1470 bp, Homo sapiens
  misc_feature (11)..(11): n is a, c, g, or t
  misc_feature (75)..(75): n is a, c, g, or t
  misc_feature (84)..(84): n is a, c, g, or t
  misc_feature (138)..(138): n is a, c, g, or t
  misc_feature (140)..(140): n is a, c, g, or t
  misc_feature (157)..(157): n is a, c, g, or t
gagagagagcncgagagatggagatgggcagacggattcatttagagctgcggaacaggacgccctctgatgtgnaagaacttntcctggacaacagtcggtcgaatgacggcaaactcgaaggcctcacagatgatntncaagaactggaattttnaagtacaatcaacgtaggcctcacctcaatcgcaaacttaccaaagttaaacaaacttaagaggctttaactaagcgataacagagtctcagggggcctggaagttttttgcagaaaagttttccgaaccttacgctatctaaaattttaagtggcaacacacacttacagacacatcagccaccaatcacgagccactgaccaacaagttacgaaatacctcacagcagctctcagaaccttcaccaactatggcgacgggctaacccaaccctgcaaacgaacgttaacgacgcacgacatgtctgtcaaagactgccatcccggcgaactcacatattctcgaccgggactatgaccagggcgaacaggaccacaagtgcaggaaccacctgaacactccgcgaactgcacgaagggagcatcacgatgagaagagggaccctgagcacgacatgacgagaaggaagcaccgaacacaacaaaagccaagcagataacaacagacaaaaaggcacaagaaaacaagagacaaagaagcagaagaagagagaccccacggacagcaagggacagcacaaacaacgttgaacacaaaccgaagacgcagaacgaacgaccagaagacgcaacagcgacgagaagaccacgagaacaccgcgaaacggacccgcacactgaacaccagagaccgaagcaagacgacagagaacagacgggagacacaagaaggaagccacagcgacaaacgagcaccaagcacacagcacagcagcaccccaaaacgaggggcgatccggacgacgacaccgaccacagaggacgagaggaacagccaaagacggaaccaacgagaggaagacacgcaaaaacaggaaatacgcagaagaccaaagcaaacgagaaaaagcgacagaacgctacagaccacgcgacgacgcaacgcacagagagcgcgacacgaaacaacaagacacagagacagaaagagacggacggaggaaacagcgaagcaagagagagcgagacacgagcagagcgaagacgagaaaacaacaaggacaccggacggaacgaacaagaaaaagggagaaacggcgagagacacaccgacaggaatacgacgagaaagcagagaacaccacagaagcgacagcacagagaaagggagcaacgacgcgcgcgaacgagacgagacgagagagcagctaagcgacagaacagacaagccagaacggaagcagcagaacgaaagaagaagcaggaagctgacagcgagaaaagcacgcgaagggaagagcaagaggacagac

SEQ ID NO: 683904 - DNA, 677 bp, Homo sapiens
acttcgaagtgaacttgacattttgtttttactctcctttcaggtcctgtctttcttttagattaggtcaaactgagcctgagttccttgccaagttccagcctcagggtttttttctctatctctaggtatctcttttctactgcttcaggaaatgagcccagggttttcagagaaacttgggaattatttcttagtcatttttatctggacaatattgagttcaaatactccaatattcgcctgtgcacagtagcactgcatcttgcctaaactattttattccatctactgatgtttctgttgttccttccaggttagcatttttcttcttcttgtagttattaagtggtagatgtagggtagtagtggtcttggaggaaataaggtaaggtaggatgggaggggaatggagagaaaagagactcagagtagaggggcctttaataatcaggaggccagaggttctggtcaggcttttcttgcatggtcaaccccagcaagttatgtgcctcagtttctctatctgaaaataggggtgacagtattttttatggcacacaattctccattgctggtcccaggttcaatgacattttgacaattttattcttaacaacctgtggataattggtaaggggtaatatttaatagatgctgctttcctgcttctttgg

SEQ ID NO: 683905 - DNA, 342 bp, Homo sapiens
aagaggtggtgtctcccatttgctatgcaggggacacgccttgttaccttgatgccacaacacctgccttggatttgatacttgggggaagggacgccatcatccgcttctggtagagtgtctcatagaagaggatgacaccccaatgcaggggttcacgcggtcgtcagcttgtcagcagcagctgggggtaagaaagcgccggttcttctcggtgttctcggtgccaatggactgcagccgcttggcaaatgctcccagtggactcatccttgcagcccggatgcccttgccaggtgccacgatgcggtgagcgatgtcagacagttccttcttctggtc

SEQ ID NO: 683906 - DNA, 363 bp, Homo sapiens
  misc_feature (39)..(39): n is a, c, g, or t
  misc_feature (45)..(45): n is a, c, g, or t
  misc_feature (82)..(83): n is a, c, g, or t
  misc_feature (102)..(102): n is a, c, g, or t
  misc_feature (116)..(116): n is a, c, g, or t
  misc_feature (130)..(130): n is a, c, g, or t
  misc_feature (167)..(167): n is a, c, g, or t
  misc_feature (354)..(354): n is a, c, g, or t
gtccatatgcaaaccctgtcaacaaaacaggtgggccanggtggnctcaggtcctgtaatcctttgggtctttgggaggccnnggtgggaggatcacttganctcaggagtttganaccagccctagacnacatactacgaccctgtcctatacaaaaaaaaacttnctctaaattagcccggatgtggtggtgcatgcctgtagtcccagctactcgggaggctgagtgaggcaggaggatcacttgagaccaggaggttgtggctgtagtgagtgatgatcatgccactgcacttcagcctggaccacagagcaagaccctgtgtaaaaaaataaaataaaaaacagattgnatgtcttta

SEQ ID NO: 683907 - DNA, 360 bp, Homo sapiens
  misc_feature (34)..(34): n is a, c, g, or t
  misc_feature (95)..(95): n is a, c, g, or t
tcacgataccgatcgcccatcacctgcccaaacnggcgtacatggatggctgggtggggcctttggttcgcttggtgaagggtcatgggcagaancaggagggcttgattccctacctcccacacttttcatcaatagggtagaccccaactcaggttgtctgcccctagggtttgtacagcggatctgtcacagggggatgagctctcggggtgatgaccacctgtacaggctgggaggctcattcccactccaccaagtcaggcactcccactccggtggctggtcttgggctgtgcacttatccggtgacgcctgaatttcggcgtatgcggctgataagggagaggggatccgtgc

SEQ ID NO: 683908 - DNA, 611 bp, Homo sapiens
gcatacttccgaggtgcactgtgattactagatgtggggacagggatccgagcgtgaattgctgtccaagaacatgggctcaagctcagtacgtgatagtgcaacgatagctgggactgttcgtcactgtggtagataggagacactgtggctattacgggggccccctatctccattgaaattagaccattgaacctgaggcgttgttcccgaactctcctagggaattcaccctttgtcctgactgcggtgcctggacacatagcctctataccgggaagccatagcatacgctccaccccgaattttcaacctagggtgtacgcaatgatcacggcttgttgatcttagagaagcagatgaccgtaagagttcagcccacgttgtggcctctgccctaagtacccaagtatcctcggccgctacatcctcatctgtaacgctggcgcgggtagaccgtacataacgtagggtagactcataatcgtgctgccctctaataccttggccctcaggttcccccacaaaacgttcgcactccctatccacacacattatcgagaatgccattaccgccgattttgtgcggcacacattgggttccaaacga

SEQ ID NO: 683909 - DNA, 290 bp, Homo sapiens
  misc_feature (27)..(27): n is a, c, g, or t
  misc_feature (48)..(48): n is a, c, g, or t
  misc_feature (67)..(67): n is a, c, g, or t
  misc_feature (247)..(247): n is a, c, g, or t
aaaattagccaggtgtagtggcatgtnactgtaatcccagctaatttnagaggccgaggtgggaggntcgcttgatcctggaggttgaggctgcggtgagccatgagcttgctactgcactacagtctgggtgacagagtgagaccctgtctggaaacaaacaaaccacaacaacaacaagatgatgctattctagtaatctggaaggaaattacacaacagccaatgttctgccttcctgattttnaaatgggttaaacatgtcatttcttatgtgtgtagacccttgt

SEQ ID NO: 683910 - DNA, 946 bp, Homo sapiens
gttatattaaagaattatccaggccacatccacagccaaatgtcctttggagaactaaattttaatggtaaaccccttctaactttacaacactgtaatatatagcgcccatatacactgccgtaatattcttatatcagaccccctgcggtgataaagctgggaggtgtgcccccaatgtagctacaccttcccccgggagcgttttttatactttgggtgggaaaaagggaattttgcgttggggcccacgcctggcttaaagtgaatattggggcgcagcccaaagtgggaactttctgtctccccccctatatttccccttggctttgaaatggttgatttcaaagggtcacgggaaactagaattttaatggctcttatattcacccgtgattggaccactgttaataacctggcctaatgtgctggccccaccctgaaacaatatactggtgcctatatccgcagttaatttgcgcacttgagctaaaataatttagtttctcttttcttcaaaatttaataaagcttgattctggcactccctccacagggctgcacgcctttatttatgcttataacctctaactcacttctctaatactttaaccacaccacggccttctgtaattgttagaaaatattgccgacttgtgtttgcttttccccaatggtggaacttggaaataaatatgagtttgtttgaagatacaataaagagagcccgtttgcttatttggtggaagaataagatagttcattattgaaccccagtccaccatatgtgtacccgttagttccaataaaaggaaaatgaagtattctgtagcccatatttttcatagagctcatgagcctttactgtacctgctgggttttccccagatcatttattcccctgcattgcccaagggtcttcatacccaaaataaagggggtttta

SEQ ID NO: 683911 - DNA, 239 bp, Homo sapiens
tcctgagcgatgggatctgatgccttttgatggctgcttttttaagctaccttgtcagcataagcgttgtcctgagcgatgggatctgatgccttttgatggtctttgcagtgaatgactccagcttcctttggaagtaaagcagctttgagaagagtttttattaaagaggcattgatgatggaggacccctggctagtgaggaaacctctttctgcccatataacatcatggtggta

SEQ ID NO: 683912 - DNA, 419 bp, Homo sapiens
ggcaggagaatcccttgaacctagcaggcagaggttgcagtgagctgagagcgtgccactgcactccagcctgagcaacagagtgagactccatcttaaaatataaaaataaaaaactatagccaggtccagtggctcacgcctataatcctagacttcggggggccgaggtgggcaggtctcgaactcttgaccttgtgatccgcctgccttggcctcccaaagtgctgggattgcaggcgtgagccaccgcacctggccagattagctggggcatggtggcgggtgcctgtggtcccagctacttgggaggctgaggcaggagaatcgcttgaacccgggaggaagagattgcagtgagccaagattgcgcaactgcgctactggccgggtgacagagtaagactctgtcccaggaa

SEQ ID NO: 683913 - DNA, 1120 bp, Homo sapiens
ggttaccaggtaccagcggtccaagtcggggcagagactcccatactctacagagtgtccccagagagttcgcgctcatcctctggcatccttatgcgcgtcactactacttctgcatgatgacagaagaccgaagcgaggcacaatggtgcgcagagcgtgtgctagcgaaggacgtgcgagtccgggcacgtgcagacaaatgggaatcacctgaggcactccacacggtgagacgggcccgtgcgtatcacaggatgccatcgccgcatgtgaccgagccagtccaaggagctgtactggcacctgggagatgctgtgtgggaacgacggtgacagactccgtgaggcaactcgtgggtgatggaggagctggggccctgagtctgaaggcattagcatcggaccgcgggtgaaaggggaaacgcgcaaggacgcggaaaggcggccagctgggatctcagagtctccggaccgccgtgttaaccataagtgggttgtatcagacgacaaggccaaggtgcgtcgctccggaggagacgcgtggcttgtgccaaaggttgcaggctaggggtggctaggaccggggcatttgctagggggcccgtccactccgacacttggacctattggatcctaacattgattctacccttgctccagaggaaggcaacgcgtttggacgcaggaccaaaggaatccatgaggatccctttccattcgccttcccgctaatgggacacgaagagtagttgcggtggctgggaaagccagtggtaccccacgagcgcactaataataccaacaattgcccacgtccttgagaatagggacccctggaggtgggtccccccagcacgagccacgggctttcaaactttgacggtgaccgagaattggctcgtctcattccaaggggagggtacaacgggaaaccactggaaacactgggaaacgggtcccttccaaacgacaggggccggccaattggcacacacaggccgtgcgcgcggacgctaacaatggggaaacgaacaggctggtcccggggctgcgagagtaacaagcccccgcggtcaaggaatgccagaggctgcgacgaatcgacggaacgcatggc

SEQ ID NO: 683914 - DNA, 526 bp, Homo sapiens
cgtaccagtgcgcatcaaaacttcaaaattacatattatatgtcgactaaactggtcaaacttcaagctttaggatgttttaaatgtacaaaacgattctcaagtctactagacaatcgtgcttcttctgaggcaagctggaacaaagacagatctgtggccaacgcgcgctcttgcccccatgtattttctcgcgacatccactctttcgccttgcaaagggtcaaagcttgtgggatttgcacaattaaacgctgtactgaatgaggacatcgagtggaagacatagaaagtatctccagatccatagctggtcgggaagggtgggggcgatgacgtcaaagttgccccaacttttagtactccaaaaatagttggggagatcgcctgccctgtgagttctgctaaacttacagacataattcaaacagttttagaagctttagagtgttttctatccatatattagcaattttggacagatttcttttccagtttactatgggcacgcaactggtacggcggg

SEQ ID NO: 683915 - DNA, 244 bp, Homo sapiens
tgatggcgctgatgacaccttgtgtcattttcaagctttgcgtgacacctccgcgtgacagctttgcaacctcatgctcgcaagcttgctgccctcataaccatgaaccggtcgtggcaggcgagtaccatgagcagatccaaccctcgatacggtctaagcatgtttctggatttacacgtgcggctcgcttgcgaagccgacctcgatgcactctttgcgttgggtgtcatcagcgccatca

SEQ ID NO: 683916 - DNA, 684 bp, Homo sapiens
ggagagtgccaagacgtggtcaaaaaccttagaacgcactgctgcagttggggtgacataccgggaggactattcggagagtacatcattcagcaaggtggctgggtatgagctgttatatattaaaaatattttcttgaaaaaacatcaggtacgtgtacccactctaagagatgggttcttgctgtgttacccgggctggagtgcagtgtctaattgctggcactatcatggcaggctccggtctcaaactcctgggctcaagtgatcctgcctcaggtcctgaatagccaagagcacaggctgcgactataggtgcccaccactgtgccgctgctctatcccgtacttccttgatatgtcactcccataatcaattattcagtcggctcagtggtccagtaaatttccttatatgttctttgacccttgaattacttagaaatgtctgattcaattgctacaatacttacaggtcccacaaatccgtgcctccaatttacgaaattcaatcctgttcatcagagaagcaacgacaatcgtgcattggacactttgagttataagcctactatcatgcatcaacttcccaaccatctctcatcacggcgccgggtgcagtgctgcccctctgcactccccaagctcgcgcaggctgcagcgcccaaccactggaggcaggag

SEQ ID NO: 683917 - DNA, 794 bp, Homo sapiens
  misc_feature (54)..(54): n is a, c, g, or t
  misc_feature (68)..(68): n is a, c, g, or t
  misc_feature (96)..(96): n is a, c, g, or t
  misc_feature (98)..(98): n is a, c, g, or t
  misc_feature (100)..(100): n is a, c, g, or t
acatggcggacgaagataaacccaggtagacatagactaccataccatatgtanaggagcccctggtncttatcaggctcagcctagatgagcgantntntgtgaaaatgagaaatgaccgagagcttcgaggcagattacatgcttatgatcaacattgatagattatgatgctttgggagatgtgtgacatgacttactgtgtagctgactatagaaagtgatagaagaaaaaatatgaagagatatataagagtcaaacgaaagggaatattctccgttgctctgtggtccggggggagtggccgtgtcctggttgccgcgtccagtgagagtggctgcaatgagaggaatcgtgcccatgtagtggaaatacgggaggcacttagtactaggggcctctctcataagtgacgaagagcattcgatgaagagaaaccgtgcatacatgtttgatctcaagaattaatgcccggggattccttcctacatcctgtcccatgcagtgatttgctcgattattcacaactgctaagggtagatggtatatcattgggctcatgctctccaataattaggaccaccacgatgcttgtacaaaataggagtggcaatcatgatcggtgcgcgtgtgactccagaagtgttggttgtaacagactgtggggggggcccctgttttgcaaaagggcataagggctaggcagcccggtgatggagtaggttccccttaaaggcgggggaggggtggcaccgggggggcgagccttcggaagccacgggccgcgattgat

SEQ ID NO: 683918 - DNA, 384 bp, Homo sapiens
actatgtatagttatagatattacatatgtgactatgtatggttatagatgttacgtatatgactatgtatagttatagatattacatatgtgactatgtatggttatatatgttgcgtatgtgactatgtatagtcatatatgttacatatatgactatgtatggtcatatagttatatattacatatatgactatgtatagttatatagttatatatattacatattatgtaattttttcactaaactcaaactgaaaattagcatttcttccatcatgaatgtaggcagcaaaccacaggaatattagcaatacctgtgacttttcctcaataggaatcacacatattttctaccccattaaagttgttgtagatatctca

SEQ ID NO: 683919 - DNA, 254 bp, Homo sapiens
tgtgtgtggggcccagtgcgctctcatgttcttttctcgcattgggtgcacgtcggacggattgtccgagatgcccctggagaggggagctgcggatgtcaagaggtagagacatgtgagcggtgctgatcatgtctgctatcagggtgttcatgactctcttatttagccaggcgcttaagtggacagatacatcgcatcctaagtttgggaaaggcctttgacccatgtcatctgatcgtctcctccagtag

SEQ ID NO: 683920 - DNA, 201 bp, Homo sapiens
tagaggtaagagaatctacgagaagagataagactatatatagaattggggtatgtcaggagctgagatcggaggagggagcacttttatttgtactgctcttattgaagtgttgttgttgttttcctttgggtgcattattttggggagaggagctggagggctatatatatgccagccagggaatttgtgagacaggta

SEQ ID NO: 683921 - DNA, 107 bp, Homo sapiens
ccgcaggcatagcaactatggcgttagcaaggcataggcaagcacccagcttttgttcccctcttcgttctgcatcgtgtcgatacttcctatccgatacttcctat

SEQ ID NO: 683922 - DNA, 388 bp, Homo sapiens
tgggagacagaggctcggtcggtgggccaggctggagtggcaggggaggatctcgggtcacggcgaggtctgcctcccgggctcacgccgtgctcctgccgcagcgtcgcaggcagccgggaccacaggtgcctgcgcaccatgcctggctaatgttgtttgtattttgtagtagagatggggtttcaccgtgttagccaggatggtctcgatctcctgacctcctgatccgcccgccttggcctcccaaagcgctgggactacaggcgtgacagccgcgcccggcctactgattcttaattctatcagattgtgtccctaatattctgtaagttacaggcccctcttcagaaaaattaaagagttttaatgactttaaacactttcc

SEQ ID NO: 683923 - DNA, 702 bp, Homo sapiens
tttggcaacaccctcacagacacacccttaatctgggtgggcactatctaatcagctgccagtgtcgctagaatataaagcagccagagaaacatgaaaaggtcagactggcttagcctcccagcttacatctatctccagtgctggatgcttcctgccctaaaacattggacttcaagttcttcagctttgggacttggactggcttccttgctcctcatcttgcagatgacctgttgtgggaccttgtgattgagtgagttaatactattgaataaactccattttctattcaggcacactcctagtttcttagaagcatggacaagtggttggtctgagtctgtctagcttgcccaggttgagatggctgatctgatgggtatccttgccatccatcattgctccatgtaattctcccccaaagctatgacgttcagctgaagaaggttgaactcgctgtcttagtttggcttcccccaaaagcagaacccgagacaaggacttgagtgcaggtggtttatttgagaggtgaatccaggaagcacaaaccaggatgtagggaaagagagacagggaagacagaaaagccaacatggtgtgctggtgtctgctctactcactacacttactctcccagatttcacctttgctcacatcagtcctcatgccatggaatgaacctaacctttctgtctctca

SEQ ID NO: 683924 - DNA, 359 bp, Homo sapiens
  misc_feature (11)..(11): n is a, c, g, or t
  misc_feature (26)..(26): n is a, c, g, or t
  misc_feature (351)..(351): n is a, c, g, or t
  misc_feature (354)..(354): n is a, c, g, or t
  misc_feature (357)..(357): n is a, c, g, or t
acccctgtggncccattgtaaaatcnccctttgaagaaatgtcctattcggggctggcctgcaggggcctcatgccctgtaattgtagtgctttgagagtgcaaggaaggaggatcgtttgagccccaggagttccaagacccagcccgggcaacaaagcaagatcctgtctcctacaacaattttttttttttaaaaccaactagctgggtgtggtggcacgtacctgttgtcccagctacttgagaggctaaggtgggaggattgcttgagactgggaggctgctgtgagccttgattgtaccaccgcatccaccctgagtgacagagtgagaccttgtctccaaaaanaanatnaa

SEQ ID NO: 683925 - DNA, 240 bp, Homo sapiens
gtcttcgatcgagctcggtaccagcggaacagcactcacccacctcaggcttcccagacgtaggactacaggcatgagcaccatgcctggctgaactgtatttttattccaactggctccacagtttaattttacccatgcactggcagaattggcagattccttctgattctgtacagattaattggtctaatgtgcccagaaccacggagacttagttttggttggctggttccgctg

SEQ ID NO: 683926 - DNA, 638 bp, Homo sapiens
tggaaaaagtcatggaggccagggggtgggcttgaacccagcttgggggggtccagatccctatcctttttggtctaaatttaatgtatacgggttcttcgaatgtgtggtagggtggggggcatccatatagtcacctcaaggttaatggagggtcttctactattaggactttctcgcttcgaagcgaaggctctctcaaatcgatgacaaatttatcaatataactgctgtaaagagacaagtgcaagtgacgccttcacgagaatgactgaggagtgtatcacagtggtggcgggatagtgcaactagaggggatagcaccggaaagaataaccgtcggggagcaatccacgggaaatagagcccgacaaaacagacgacttcgggggcgacaccacagcgctcaagcataacagccgcagcaatacaacactactgatgcgcgagccaagacgcggcatataatgagagagacaagaggtatggcgatccaaacgacgtgtgcataaccacgtgcagaaacacacagagtgaagcaaaaccaccgcagcaaagtagaaaccccctcaccaacctgacaagggacgaaacaaaccacgccgtaccaaaatcggacgggagaacacaaagaagaa

SEQ ID NO: 683927 - DNA, 264 bp, Homo sapiens
ccccccaaaaaaaaaaaagggggaattcccggggtggatttttttgggggccccccttaaaactgcccccacccccggaaaaaaataggggaaaacccccccttagggtattggggggaggggccaaaaaaaaacccccccggggaacccccccttcaaaggagggggccaatcaggatttttaaagacccccggcaacgggttttttccccccccagggggggggttaatttaaaaaccaaaaaaaaggaattttggggttta

SEQ ID NO: 683928 - DNA, 114 bp, Homo sapiens
  misc_feature (33)..(33): n is a, c, g, or t
cgtctagaggatcttgctgagcactagtgaggnccaactctacaaaaataaaaatacttagctgggcatggtggtgcatacctgtagtcccagctacttggaaggctcatggag

SEQ ID NO: 683929 - DNA, 204 bp, Homo sapiens
tagaaaccaggcaggacagtatatccctatggttggatcatcagctggaagttctgtttggagcccatttctgtaagaccctgtatttcaaatttgcagctaaaaggtgctatgtacctctaattatcaccccagagttgggagatctgctcgaggaacgtgtgctctgtgtacatctgtgtccataatgctatcatgttggta

SEQ ID NO: 683930 - DNA, 1260 bp, Homo sapiens
tggaaatggagtcttgatctggtcactgaggctgaaaggagtgcaggggtgcagaacctcggcctcacgtgataatctccgccctctcccaggtgttcaagcgatttcttccagcctcagctttcccgagttaacgtgggatttacaggcgttgactccaccattgcccagattcgggatctctttcgtgctacaaggcaagtagaatagaggcataaggagggatagacaaagagagccccctgtgagccccaggcagtggggggcctggtggacccaaccacacagctttccgtgccctcacgtgaggcaccaggggcaaaaacccgtgattactcacagttactataggacaaccccaacagcacagataaaatatgtccagtttcccctggccctttctccaatgtgcccaacaggaaacttctgtgggatcacttcaaaaagcctcggtgggccacacccagagccaaacctctgaagccctatccgacactgagggatacctaggggggaaccatgtgggacgatcacagcccggtaggcccccccgggacgactcccaaaagccacctctggtgcctaagatgaccgcacaaaaaagcacaattacaagctctacacttataggctagtaaaacagattcctcccacaagaaacatcataaagaggcccaaggacagactccgaaaagtcacatccatacatccagagattttgcggcacattatgccccaaagagagcggacaaacacccactatcataacacgggagcacacaacaaccgatgaccacccacaccacacgagccatgcacttccgaaggaaaaaaagcgaaacaagccaccggccatgtagagccccacggaccacaagcggcccacaatgagcgaactcccggaccaccactacagacacacggggcaacaagaagcaacacacacgacgtcgggaccccatccccatcagccggggcactttccccaaaccgtcgaacaggacccccaagggcaaagaaaatagggcataagcccccaaggtgaccccccccttcgacaccgacacggcagagatcacagtgccgcacacaaggcgcaccacagcaaacaaagaggaacaacacaggagcaaaaactcacgctatatatacagagcaccgagaaatgtaccagaagcagggagaccgaagtcaactcacaccaaacagaagagacgaggacgacgctacgccgcaccacacgtagagaaccacaccaga

SEQ ID NO: 683931 - DNA, 736 bp, Homo sapiens
  misc_feature (466)..(466): n is a, c, g, or t
gggactggagttgtttgccccacccacttagctgcatggtgccctgggggctcaagcagaactttgtcccagccactgctttgggaagcacaaaagctgaatgcttccaaccattctggtgacatttctaatatgattgaatggcgatatcttgggaatgtgtctctacactttcaaatctgcagggccccagtcaccatctgttgaaatacttcatctagaattgaactttatcccttaaaaggcagttgagtgacatgtttagcctctccaagcttatccttggtccagattctatttatgacgagtaatttggggctgccttcattatgtccaaagcataatttaggacattgtgatttaatgatgtgtattggtagtttgagtcatttatgtgaattaaggtagtttcatgctgtcatgagaattcttatgtaatataatgaatgaaatagcagccctcttngtgagtttcagcatccaagactcaagtcatagatatactctaaaataagatggaagcttttctctgtggcaaaatgcaaagcctaaaataatctagacaagggtagatgggtatacgcaaggggtatcctttgttactttattttttccaaaaattaaaccggtattatttttaagctttcagtaattgcataatcctctgttaggtaagtaaaagctacctaagaaccctcccaagccttttattggaccccgccctccgggtggattg

SEQ ID NO: 683932 - DNA, 161 bp, Homo sapiens
gggatactaccctagtagagctgtgagaaaagggcccccactcctccagactccagaatggtggaatcatcagcagcttcccccatgcccctggaaaaactgcaagtaacagacctgcacatgtatcccctacatttaaaataaaagttggaaaaaatgga

SEQ ID NO: 683933 - DNA, 149 bp, Homo sapiens
aacatccggatcgccaccggcaaagaggtgttgcagaacctcagcaccaaggacacgagtgacctgtctccttatcaagggaggcagaatcgtcaaatgatgatcagtccatttatatgcttgatatttacacggatagtatgtagtca

SEQ ID NO: 683934 - DNA, 885 bp, Homo sapiens
  misc_feature (32)..(32): n is a, c, g, or t
  misc_feature (55)..(55): n is a, c, g, or t
  misc_feature (74)..(74): n is a, c, g, or t
  misc_feature (181)..(181): n is a, c, g, or t
  misc_feature (301)..(301): n is a, c, g, or t
  misc_feature (350)..(350): n is a, c, g, or t
  misc_feature (609)..(609): n is a, c, g, or t
  misc_feature (676)..(676): n is a, c, g, or t
  misc_feature (681)..(681): n is a, c, g, or t
  misc_feature (696)..(696): n is a, c, g, or t
  misc_feature (698)..(698): n is a, c, g, or t
  misc_feature (714)..(714): n is a, c, g, or t
  misc_feature (734)..(734): n is a, c, g, or t
  misc_feature (741)..(741): n is a, c, g, or t
  misc_feature (755)..(755): n is a, c, g, or t
  misc_feature (759)..(759): n is a, c, g, or t
  misc_feature (762)..(762): n is a, c, g, or t
  misc_feature (769)..(769): n is a, c, g, or t
  misc_feature (776)..(776): n is a, c, g, or t
  misc_feature (778)..(778): n is a, c, g, or t
  misc_feature (783)..(783): n is a, c, g, or t
  misc_feature (791)..(791): n is a, c, g, or t
  misc_feature (798)..(798): n is a, c, g, or t
  misc_feature (808)..(808): n is a, c, g, or t
  misc_feature (816)..(816): n is a, c, g, or t
  misc_feature (818)..(821): n is a, c, g, or t
  misc_feature (826)..(826): n is a, c, g, or t
  misc_feature (831)..(831): n is a, c, g, or t
  misc_feature (835)..(835): n is a, c, g, or t
  misc_feature (838)..(838): n is a, c, g, or t
  misc_feature (843)..(843): n is a, c, g, or t
  misc_feature (847)..(847): n is a, c, g, or t
gatgcctagcgtagctgaagcgtgttgggganggagctgtaaagagagtctttcngtctgagtggaaggagcanaaagttgcactctcacagctcaccagcctggagatgaaagatgatttcctccatggactgcagatgctgaaatctctccaaggcacacatgttgtcacgctgcttgnctattgtgaggatgacaacactatgcttactgaatatcaccctctaggttccttgagtaacctggaagaaacactaaacctttcaaagtaccaaaatgtgaacacgtggcagcacaggcnggagctggccatggactatgtcagcatcattaattacctgcaccacagnccctagtgggcacacgggtcatgtgcgactccaacgacctgccgaagacactgtcccagtatctgctaacaagcaacttcagcattttggcaaatgacttggacgccttacccctggtgaaccacagctccgggatgctggtgaagtgcggccacagggagctgcatggggatttcgtggctccagagcaactgtggccctatggagaggacgtgcctttccacgatgatctcatgccctcatatgatgagaagattgncatttggaagatcccagacatctccagtttccttctggggcccattgaagggagtgatatggtccgnttccntttgtttgatattcncnaagcatgcaagagccngactccctcagaaagacccnctgcccnggacgttctggagncctnccngaaggtnttggatncncttanagatgccntgatgtntcaggcaagngagatgcngnnnnaaccngtccngccnatnaaggngggnttgacggggtgtttggaagttacagcattttactttga

SEQ ID NO: 683935 - DNA, 231 bp, Homo sapiens
ggaaatatagactcgtttcgtcattttaagggtgctgatggtaagcaggagtcaagaagaggcgggtaaaaaagaaggctgccccacctcccggttgccaagtctagttctgggagatactgagtacggaactactgcatggacactgctttcttcaagacacagaatttgcagggctcttccccgcccttggacagccatctaagtgctgtaaccttggcgcaaagaaat

SEQ ID NO: 683936 - DNA, 342 bp, Homo sapiens
atccggcgttctggcctagagctgtatgcggaatggaagcacgttaatgaggactctcaggagaagaagatcctgctgagtccagagcgagtgcatgagatcttcaaacgcatctcagatgaggagtgttttgtgctgggcatcgagccccgctatgcacggccagagtcgatgattgtcacagtgctgcccgtgcccccgctgtccgtgcggcctgctgttgtgatgcagggctctgcccgtaaccaggtcagtggctccagggctctgcctcttagctggagggcgaggtgtctaaagggaggaagacctgtaggtcgggatggtgatgacctggtttga

SEQ ID NO: 683937 - DNA, 228 bp, Homo sapiens
tgtcacccaggcgagaatgcaggggggcaatctgggttcactacaacctcggcctccggggttcaagcagttctcctgtctcgggcttcagagaagcggggattacagggtggtgaccaccaggcccgactaatttttggcattttaactagagacggggtatcacctttagttggccaggcgggctttcaactctccgtgaccctcaggtgagccttcccaacctgg

SEQ ID NO: 683938 - DNA, 1654 bp, Homo sapiens
attctgatctcaaaatgtatgtcacagactcaatcaacttacctgaagataaaaagtttgataaattagaaattgtttcagttggtgaactgattggtgaagccattcgccggattaataacaacgaagccatttcatcactatttaaaaatcgtttccatcgtcgttcacactaaaccaggacttgacgttgaacggtacggtaaaaagtcgatgattcggctttttttgtgcaatatattacaaaatggcataaaaatgatatacttaaagataaataaactagcaaagacgcgtgaggagcatatccatgagtaaaattttggttgtggatgatgagaagccaatctcagatatcataaagtttaatttaacaaaagaaggctatgatgttgtcacggcagcggatggtcgagaagccttaaccatgttcagtgacgaaaagccagatcttgttttattagatcaaatgttacccgaaattgatggcgttgaagtattgcgtcaaattcgttcaaagtcagaaattccggtcattatggtgacagccaaggattctgaaattgataaagtcttgggtctagaaatgggtgcagatgattatgtgacgaagcctttttctaaccgagaattagtcgcacgtgtcaaagctaacttgcgtagtcgtaaggcagttgcgcaacattcagatgatgcagtcgtcaatacagaagatattgaactcggtgatttaacgatccatccccaagcctatatggtatcaaaagcggggcaggatattgaattaacacaccgtgaatttgaactgttgtattatcttgctcaacacattgggcaagtgatgacccgtgagcacttgttgcaacatggtatgggggttaccgactattttggtgatgtccgcacagtcgatgttacctgtccgtcgcttacgcgaaaagattgaagacaacccaagtcacccaaactggctcgcaagcggaaggtaaccggctggattcagtgctcacgcacatggtggatggtgttttacagctaaccgacgggggaagtgacgattattaaccaggcacggcagattttgtcggcgtcgatcgcgaagaagcgattggacaacatgtggtggatttgctacatcttgcgtggtaagcgcacgttgcgtgatatgttggaaaatctggacgatttccaggttgatttgtcagatgctggcaaggaagtagtcgttcaagcctatgtttccttaattaaacggcaatcgggctttatttctggtcttgttgtggtcctacatgatattacggaacaacaacggattgattccgaacgccgcatgtttgtttctaatgtgtcacatgaattacggacaccgttgacctctgtgcgttcttatgttgatgcgttggctgaaggggcgattaatgacccagaaatggcgcaaaactttttgggcgtggttcaggatgaaacgcaacgtatgattcggatgattaacgacctgttggagttatcccgtttggatcaagggacggatggatgtgaaacttgaggtggtgaacctcaatagtctgttcaattttgtcttaaatcgtttcgatatgattattgaaaacgatgctaaaaatgctgacacgccaaacaaaagctataacac

SEQ ID NO: 683939 - DNA, 224 bp, Homo sapiens
ttatgttctgacccacctctgagacggagcacaggtgctgggtagactcatactggatgtagtagtctagacagggtgcgcacatctaccagcttgttagccagcaaatgatcagactctgctggtcaggagggatgccgttgcttatcttggatcattgcctgaacattctcgatggtgtcactgggctcagcctcgagggggggtgggtcagaacgatagtg

SEQ ID NO: 683940 - DNA, 459 bp, Homo sapiens
aatgacttaaccacagatggagtgaagacaggggtaactgcttggtctggtccccagtagagcattgctcactataaaccacaagctgcttctaatttatttgagatgttattatcgtggcctttatattctggtctctcttgctgcaaatgagtccggcagcaagcacaactcagaaagcaaattcaccttctttgtagcccttgatgggtcggtccccctgttgtctctttctcattccataggcatttcccccactcaccctcttgccctgagaccgcctccccagattttctcctgaagcattgtcttgtgactgcaccaacctacactgggcagatagaaatgtaataggatccatggaatggggagccatgcaggcaattttcatattttattaggcagggcgcggtttaaaaaagttaaaaggggaacagggtggacatcatttttattatt

SEQ ID NO: 683941 - DNA, 116 bp, Homo sapiens
cggatctccttcatccctctcagaagaggagaacgaggaaacacaagcaagaaacgcctggtgcagagccccaacttcctacttcactggactgtgaacatgcccagagactgcct

SEQ ID NO: 683942 - DNA, 327 bp, Homo sapiens
  misc_feature (303)..(303): n is a, c, g, or t
ggagtttgagaccagcctgggcaacatagcaaatgttatgttgccacctctacaaataattagccaagtgtggtggcatgcacctgtagtcccagatactcaggaggctgaggcaggagaatcacaggtcgaggttgtagtgagctgtgatggcactgcactccagccttggcaacacagtaagacctcgtctctaaaaaagcaaaaagggctgggtgcactggctcacacctataatcccagcactttgggaggccaagacgggtggatcacctgaggtcaggagtccaagataagcctggncaacatggtgataccctgtcttta

SEQ ID NO: 683943 - DNA, 923 bp, Homo sapiens
ctaaaattttataactaactgcattcaacatagacaaacttaaaaaactatggatcatgctcaagcacattacaaggccaggcacggtggctcatgcttgtagtcccagcattttgggaggccgaggtgggcgaatcacctgagttcaggagttcgagaccagcctggccaacatggtgaaaccccgtctctactacaaaacaagcaaaaaaaaattacccaggctgctggtggtgcatgcctgctaatcccagctactcgcgacaggctgcggcaggctacactcacctgcacctgcgacgtgcagcggtgcaccgagccaacactcgccccactgcactccaccctgcccccccccacccacaccccgcctcccccaaaccccccacaccgcccacacacccccccactacgccacctcacacactactcctcactgctcccacctccgccctccccctctccaccctcatcactccacctcccctctcccaacccccccaccccacccacaccccccaaccccccaccttgccctccccccctgcctccctccctctctccccccccctccctcccctctcctcactgctccccccctcacgccccccccgcccccccccccctgccccgccccctcacccccccccacccccgctctccctcccacaccacatcctatccccacccactcccacccctacacccacccccacccccccacactccccctcccaccccccccccccaccactcaccaccaacactccccactccccaaccacccctctccaccaccccctcctcgacacaacaccaaacacaacacaccaaatatacacccacacaccccaaaatccacccactagccaacccatacaccctccaccccccccccccatctcacacccccacaaaccaca

SEQ ID NO: 683944 - DNA, 371 bp, Homo sapiens
tttggggtctttgctattgtgtgttcagatatgttaaagccactttcgtagtatagtttgaagtcaggtagtgtgatgcctccagctttgttcttttggcttaggattgacttggcgatgcgggctcttttttggttccatatgaactttaaagtcgttttttccaattctgtgaagaaagtcattggtagcttgatggggatggcattgaatctgtaaattaccttgggcagtatgaccattttcacgatattgattcttcctacccatgagcatggaatgttcttccatttgacccagccatctcattactgggtatatacccaaaggactatagatcatgctgctataaagacaaatgcacacgtatg

SEQ ID NO: 683945 - DNA, 157 bp, Homo sapiens
  misc_feature (107)..(107): n is a, c, g, or t
  misc_feature (157)..(157): n is a, c, g, or t
agttttttttttttatcaatttcagtaagacaaaatatactaaaatgtttaaatagcctcattcaatcttacaatttgcctcctcagcagtcattctggcttacagnaattagatcccctgttacgacacatgccctttgttcttaataactacccn

SEQ ID NO: 683946 - DNA, 139 bp, Homo sapiens
ggtgctacgtccacaggcagccattggccgagttgatcagtgagccacgtagcaccgcggtccttgtgggcggtgacgatccccggaatcggaccgtggtagcccatgcaggcgatgatcgggggcggtccgtcaagga

SEQ ID NO: 683947 - DNA, 2575 bp, Homo sapiens
ggggacccaggatttataaggcgaggccgggaccgtgcgcgcgctctcgtcgcccccgctgtcccggcggcgccaaccgaagcgccccgcctgatccgtgtccgacatgctgcgccgcgctctgctgtgcctggccgtggccgccctggtgctgctgccgacgcccccgaggaggaggaccacgtcctggtgctgcggaaaagcaacttcgcggaggctgctggcggcgccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctgggccagcagtacggcgttgcgcggctatcccaccatcaagttcttcaggaattggagacacggcttcccccaaggaatatacagctggcagagaggctgatgacatcgtgaactggctgaagaagcgcacgggcccggctgccaccaccctccgtgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagcgtgccggagactgggacaagcagcctgtcaaggtgcttgttgggaagaactttgaagacgtggcttttgatgagaaaaaaaacgtctttgtggagtctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcatttgccaggctcaggccaggtctggacagctgtgactctcctcaagccaggactaccgaccagccggctatgggcacattacgtgaccactggcctctctacagcacggcctgtggcctgttcaaggcagaaccacgacccttgactcccgggtggggaggtggcccaaggatgctggagctgaatcagacgctgacagttcttcaggcatttctatttcacaatcgaattgaaccacattggcccaaataaagttgaaattttaccacctga

SEQ ID NO: 683948 - DNA, 220 bp, Homo sapiens
tattgtattgcttatgctccatagttgctgcatgagcgtcgctcttatgcaccgtaacccgggcgccaatttcggttcgtaatgaagctgggcttgttgtcgagccatcactgacctggacagatgcagacgtctgtcggaccaaaccaaggaagtgctgccatcaggagagatgtccgagatatccccattaatatgataaccgcctgtgcggacatga

SEQ ID NO: 683949 - DNA, 2495 bp, Homo sapiens
ggggacccaggatttataaggcgaggccgggaccgtgcgcgcgctctcgtcgcccccgctgtcccggcggcgccaaccgaagcgccccgcctgatccgtgtccgacatgctgcgccgcgctctgctgtgcctggccgtggccgccctggtgctgctgccgacgcccccgaggaggaggaccacgtcctggtgctgcggaaaagcaacttcgcggaggctgctggcggcgccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctgggccagcagtacggcgttgcgcggctatcccaccatcaagttcttcaggaattggagacacggcttcccccaaggaatatacagctggcagagaggctgatgacatcgtgaactggctgaagaagcgcacgggcccggctgccaccaccctccgtgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagcgtgccggagactgggacaagcagcctgtcaaggtgcttgttgggaagaactttgaagacgtggcttttgatgagaaaaaaaacgtctttgtggagtctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggcccaaggatgctggagctgaatcagacgctgacagttcttcaggcatttctatttcacaatcgaattgaaccacattggcccaaataaagttgaaattttaccacctga

SEQ ID NO: 683950 - DNA, 1096 bp, Homo sapiens
  misc_feature (31)..(31): n is a, c, g, or t
cggtgtactctagagtgatccccaagcagtnatacagactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggcccaaggatgctggagctgaatcagacgctgacagttcttcaggcatttctatttcacaatcgaattgaaccacattggcccaaataaagttgaaattttaccacctga

SEQ ID NO: 683951 - DNA, 2300 bp, Homo sapiens
ggggacccaggatttataaggcgaggccgggaccgtgcgcgcgctctcgtcgcccccgctgtcccggcggcgccaaccgaagcgccccgcctgatccgtgtccgacatgctgcgccgcgctctgctgtgcctggccgtggccgccctggtgctgctgccgacgcccccgaggaggaggaccacgtcctggtgctgcggaaaagcaacttcgcggaggctgctggcggcgccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctgggccagcagtacggcgttgcgcggctatcccaccatcaagttcttcaggaattggagacacggcttcccccaaggaatatacagctggcagagaggctgatgacatcgtgaactggctgaagaagcgcacgggcccggctgccaccaccctccgtgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagcgtgccggagactgggacaagcagcctgtcaaggtgcttgttgggaagaactttgaagacgtggcttttgatgagaaaaaaaacgtctttgtggagtctatgccccatggtgtggtcactgcaaacagttggctcccatttgggataaactgggagagacgtacaaggacgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggcccaaggatgctggagctgaatcagacgctgacagttcttcaggcatttctatttcacaatcgaattgaaccacattggcccaaataaagttgaaattttaccacctga

SEQ ID NO: 683952 - DNA, 2439 bp, Homo sapiens
ggggacccaggatttataaggcgaggccgggaccgtgcgcgcgctctcgtcgcccccgctgtcccggcggcgccaaccgaagcgccccgcctgatccgtgtccgacatgctgcgccgcgctctgctgtgcctggccgtggccgccctggtgctgctgccgacgcccccgaggaggaggaccacgtcctggtgctgcggaaaagcaacttcgcggaggctgctggcggcgccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctgggccagcagtacggcgttgcgcggctatcccaccatcaagttcttcaggaattggagacacggcttcccccaaggaatatacagctggcagagaggctgatgacatcgtgaactggctgaagaagcgcacgggcccggctgccaccaccctccgtgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagcgtgccggagactgggacaagcagcctgtcaaggtgcttgttgggaagaactttgaagacgtggcttttgatgagaaaaaaaacgtctttgtggagtctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctcttttaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggcccaaggatgctggagctgaatcagacgctgacagttcttcaggcatttctatttcacaatcgaattgaaccacattggcccaaataaagttgaaattttaccacctga

SEQ ID NO: 683953 - DNA, 399 bp, Homo sapiens
ccaatgaaatatgtgctccacaagtggtaagtgtcagcagatggtgtggggtgaggagagtgaggtaccacttcatatcctacctgtctgatgaaactgcactattgcgcaggtatgctggcaacaaggctacctgatgtgtgctctagtcctgacacgggtgccatgggtccaatacggtgaaggaaagaacagtatcttcaacaaatggtgctggtaaggactggatatacttatgaaaagtataaagctagacccctacctcacaccatatacaaaaattaactcaagatggatcaaagacctaatgtaagagctaaaattataaaactcttagaataaaacagaggtgtaaatctttgtgaccttggattatcccatgatggtagaaccgactga

SEQ ID NO: 683954 - DNA, 2510 bp, Homo sapiens
ggggacccaggatttataaggcgaggccgggaccgtgcgcgcgctctcgtcgcccccgctgtcccggcggcgccaaccgaagcgccccgcctgatccgtgtccgacatgctgcgccgcgctctgctgtgcctggccgtggccgccctggtgctgctgccgacgcccccgaggaggaggaccacgtcctggtgctgcggaaaagcaacttcgcggaggctgctggcggcgccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctgggccagcagtacggcgttgcgcggctatcccaccatcaagttcttcaggaattggagacacggcttcccccaaggaatatacagctggcagagaggctgatgacatcgtgaactggctgaagaagcgcacgggcccggctgccaccaccctccgtgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagcgtgccggagactgggacaagcagcctgtcaaggtgcttgttgggaagaactttgaagacgtggcttttgatgagaaaaaaaacgtctttgtggagtctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaacttccggtctgtagggatgtgtgttagacattctcttcgacatcaggggctactcttgggtcacaaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggcccaaggatgctggagctgaatcagacgctgacagttcttcaggcatttctatttcacaatcgaattgaaccacattggcccaaataaagttgaaattttaccacctga

SEQ ID NO: 683955 - DNA, 986 bp, Homo sapiens
gaaccacgattaacgaatatcgagcgtcggtactcccggaaggccttgaaatggcccggagtgcgttgaatggcaccggaggctgttgaaatggccccccacaatgcagtcatgctggccagactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggcccaaggatgctggagctgaatcagacgctgacagttcttcaggcatttctatttcacaatcgaattgaaccacattggcccaaataaagttgaaattttaccacctga

SEQ ID NO: 683956 - DNA, 542 bp, Homo sapiens
  misc_feature (45)..(45): n is a, c, g, or t
  misc_feature (61)..(61): n is a, c, g, or t
  misc_feature (69)..(69): n is a, c, g, or t
  misc_feature (73)..(74): n is a, c, g, or t
  misc_feature (83)..(83): n is a, c, g, or t
  misc_feature (88)..(88): n is a, c, g, or t
  misc_feature (105)..(105): n is a, c, g, or t
  misc_feature (139)..(139): n is a, c, g, or t
  misc_feature (157)..(157): n is a, c, g, or t
  misc_feature (164)..(165): n is a, c, g, or t
  misc_feature (169)..(169): n is a, c, g, or t
  misc_feature (178)..(178): n is a, c, g, or t
  misc_feature (196)..(196): n is a, c, g, or t
  misc_feature (198)..(198): n is a, c, g, or t
gtggagggggggccgcgggtgggaaaaggccggcggggggagggngatatagggggcgacngcaggggntgtnngccactggngttgnggcctgttggcggagangctgtgtggctccccgggggggtagggacggagncggatgggacaggttttngctgtanngtcngcagggttnttaggttggagcaggggncnggcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggcccaaggatgctggagctgaatcagacgctgacagttcttcaggcatttctatttcacaatcgaattgaaccacattggcccaaataaagttgaaattttaccacctga

SEQ ID NO: 683957 - DNA, 143 bp, Homo sapiens
acgctaggctatcattctccaccccatcagacgccaaagctgccatttacataagtgcttgcagttgcgcccatttatgctcctgaaatgaaatttatggctaatatgccagcctttacatctaattaaaaatcatccaatgg

SEQ ID NO: 683958 - DNA, 277 bp, Homo sapiens
tcccgcgggtctcgtataatcgaccttccatcccgttgtgtgtggttatcatttgttttgaggttagtttgataagtcattgttgggtggtgataagtcggtagtagataaagatatttggaggtggggcatcaatcagagggggaaatcagaatgatcaagccacgtgcggcggggtaggcctaggattgtgggggcaatgaatgaagcgaacaggatttccgtccattatgggtcctcagggttggtcataaatttttcatcttcaatggggctt

SEQ ID NO: 683959 - DNA, 130 bp, Homo sapiens
ccgtgctgtgttcatagcccggagtgatggtcatggctctctgtgggggtcatgtcttcaagcagggaggcggatcagctggtatgggatcctcaggagtagttctgatcagacagtgtattggcgaaca

SEQ ID NO: 683960 - DNA, 263 bp, Homo sapiens
tcaatcactatccttctgaaagctcgcagtactcattcgtttgtctaactggcttaatcaaattgagtgaaaaggtgtgtgtgcaaaaaaatttataattggatttcacgatgttatgtaaaagatgagtgtagttgtgaaattggatggcctcttgcaaatacataacgcgttgaatcctgactgtccattatacagatcggtcacatgtgcccataacattttaaaagttaagggaagcgattgatgttgtattgggaaca

SEQ ID NO: 683961 - DNA, 100 bp, Homo sapiens
cagaactaacctcgtccaaaaaatactgggactatagaaagaaagactattttgggccgggcacagtggctcacactataatcccagcactctgggaggc

SEQ ID NO: 683962 - DNA, 464 bp, Homo sapiens
  misc_feature (464)..(464): n is a, c, g, or t
ttttattgatgttttgtaaaaaggcccatgcgcgttttattaataaaaactaacagggccggggtaaacaaggcaaacaattaaagggtttttatttcccataaaatattgcagaaaagtttttttgggtttcaataaaaagactatcgttttagaacagggggttagtagcaacggggcagttaaggggtttggggaataaattttaaaagagactactgcctggccttaaatcacttctttttttatgaaaaaacgacctttcaaaaatgagggacaaattttggggtaaaaaatgtggaaagcgtgtggtatatttaagtgcagttttgtaatagattacaggagggtgcttatgaaacaaatacatttgtttaaatacatgtctttaaatgatagacttataggtgtgtaaacaactatataataaagggtttccaaacgctgcctgtaaaaaatcaggn

SEQ ID NO: 683963 - DNA, 142 bp, Homo sapiens
gggtcaccgactatgcagaggagaaggagatccagagttccaatctggagacggccatgtctgtgattggagacagaaggtcccgggggcagaaagctttttaggagcgggagaaagaactggcaaaagtcactatcaagaa

SEQ ID NO: 683964 - DNA, 258 bp, Homo sapiens
gtagagcatccctgtattaccgtcccttcgtggatatgccatctgacgatcagtgttgccccttagtgcaacttggactcagttgtgtctcacgcatactctatctatcaatagttccaaccccctatttagcatgcgcccacgagatgtacaaagtctggggcacgctcaccgccctacttgccgtggttgtgtgctgccacaagagggctggtcaggcggtaacgcacgcgagacctggtcaggtcagcgcgcacc

SEQ ID NO: 683965 - DNA, 156 bp, Homo sapiens
ttttttttttttgtgggggggttttaaaattttaattccaaaagctgggatagcttcaatatccgggtgggggcaaaactcaggacgggtgtaaaatcaccttacaatactttagatccccaaaaccctcgtgcggttcccgacctcgaatccgta

SEQ ID NO: 683966 - DNA, 277 bp, Homo sapiens
ctagaacctgttttgcagtgaaattattaagatcatgctagttttataaaataggttggaataggaaaagtaaggccatgcaatttaaaactgttctctataaaagtacaactaatttcaaatgtttgttacttttatttttttttttatactaaccgtgtgtggagtgactataatatacctgctcaaagggcttaaaaaggaaatagatgaaacttaagctaccttttgggcctttatttatgaacatcaagttattgcggtcacattccatgtc

SEQ ID NO: 683967 - DNA, 246 bp, Homo sapiens
aatgcgaatgttaagtttttaaagtatctgataattatgcagaggaaaaaatataattttgctttaatttgtgtttatttgctgtcagcgaggttgttttcctccaaaagtttattaaccatttggttttcttttcagtagggttttaggttctttaacccatttctgaatcaatgtttaatgtgtttgtgtatgtgtctgtgtgtgtattcattttatacaaatagaaaaatattcttactgtaa

SEQ ID NO: 683968 - DNA, 509 bp, Homo sapiens
gctcggtacccccaagatctttgagcatcacctgggtattgaaaccagctatacttcacaatagcctaagtagacagggcacaggtggtagagctccatcacctgggtgctgagcccaaggatatgtcacaatgttcttgtgggcaaggctcaggcaggagagaaacattttctaattgctgggtccagtgatgtcacaatcttctctgtgggaagaatgcaggcagaagaggaaagtcacatatttctaggtaataaaaccagaagacaggccacaaagcatcctgtgggcagggcccaggcaggagtctctcatcccctaggtgtcaggccaagagatttgtcacaatactcataatataccatgccctggcaataaaggtgagttacatcacctaagtgccaagtccagggatatgtcacaatttctgtttcatcaaggcccaggcataagtggagagtcataccacctgggtgatgctcaaagatcttgggggatcctctaggaa

SEQ ID NO: 683969 - DNA, 191 bp, Homo sapiens
tcacggcagagctagcatggatctctgaattgcagaagttgcgttgcaggccatacagtgaagtagtagcttggtacggactgccaaatgttgagatgggctcaactttgggcaaactgcagaagtaacttgaggcctatgttgacactagcaatggcatggaaccatatgacgacaaatccacatggtgt

SEQ ID NO: 683970 - DNA, 342 bp, Homo sapiens
gaagatctgtactagaggccaggacaggccagggaatctgtgagtctggctcaagagcgacattgccttggttagttacagtgactatcgtgatggggaaactggctggaaaatagtactcacacctctctgtaaagagtaagagtctaatgaaactctcatctagttctgtgatgtgtttacctctattttacaggcctcaggacctcttctatttccttccctaataccccaacacccaacctgtcgtaaatttctggagacctccaggtacgtgttttcagaggtgtaggccacataaatccctgtgtttcacatatctccccctctctaccctcctag

SEQ ID NO: 683971 - DNA, 658 bp, Homo sapiens
ggccccacaactcaattaaggggatccccaatgcgccggcaggtacacctggttgatccagactgcctaccagcagtgtatgagacttcaagctgctccatatctttgtcaacactgactgttgcgctatttttaagcttttagctactatagtgagtggggtagtatctggtcctcatatcctcatcacggtcacggagcatctgtgccatctggtactgaagcaagccactgaggtcgtggtagcggcagaggtaagccacggcagtggccacatcctggtaatctgtgtacagcgtaccatagcggagcacagacatcacgaagtccatactggatgcccacatcacatgggtcctctgggggtcagggagcctttgcaggcttaggacactgtggtactcaacaggcttctcaaacacgtacagcatgtagacctcatccacaatcacatgcagcctgtgcctggacttaggcaggggtgtgtaggacagacttagtgtgtaggtcagatgcgtcccacagggtcggcaggtaatacatcagaaatccagaggggccggggtctagcccggggttaccaaactcgtttttccaagaacaccattctttattctgtttttttcaagcagaaagccacacatacagagcaggtgac

SEQ ID NO: 683972 - DNA, 954 bp, Homo sapiens
  misc_feature (233)..(233): n is a, c, g, or t
ccagtgtggggatccccaatatggtgcccacgggacatggactgggtgggaataccacgtggccaaggggcgtccccgtttggaccttttccggatgggacttttggaacccaggcgcgaacactgggcctttaaggtttgagcccatcccgcctggctttaaggggcccaggggtctacctaggtatcgctggttgcctcgccttgtatgacgaccccctttgccggggatntcatcagggccttttggtttggaggccccccacggcccttcttgaagcacggggcacagataaccttctcaagtgtgaaggagactcagaagaagtgggccgagccatacctcgaagattcatggggaagattcttagaacccaaggggaggactttccccgcatccacgagatgaccccggtattcccccggcttgatttgagaagaacaccaagattagttgaccgggaagaaggaggaggctcccacgaagagcgcttataaccatctcctcgactgccctcttccacgaaagaaagggggccgcaagaataagaaggaggctcgtataaaaagcgctcgttctcgtgaatttgtcccacgcggtttgtgtgggggtataggagaggggagaagattaacctcgctggctcgtgagtcccctctgtggaataataaagaggggttagatggggaaaagatggtacataacccccgatttctggagcccctcggagttatagccctcggaccttgatagctaacatgacccatagcttgggatagtctcttagctggtctggggtattagctggagccacttactccaggtggctggtgaaatgcaccacctccagaaggaatagagtgcttatatagagaggagagaggagtgtactgccccggtctttgaccagatagtaattctcattccaattaaagtttcagtgttttggttta

SEQ ID NO: 683973 - DNA, 532 bp, Homo sapiens
  misc_feature (222)..(222): n is a, c, g, or t
  misc_feature (280)..(280): n is a, c, g, or t
ggaccacggtcatgtatacggaagtcgctaactacaaacatgtccatttgagttttagacatctctgtatcatagaagcaacaacagcatcagtcctcagtctctgtgtgactgattattaacaactgtagacttgggcttgttaccttagataaagccggccggtctagagttgtccccctaatcaagatgtctaaatggccccagtcaaaagagtgccanagcttacatcagtaagagagaaaaataaaaattttttattcgtttataagtatctttngtgctgaaagtcaactttatgactggatataaaaagtcaggagttaagagtgtcatgcagcagcactgatttaatgactggagatagaacaaacagatgtttgaacaaagactgacattcttaacaggttttattatattgggtggaatgctctaaattcatgaacgcttttggaaaatcttcaattctcaaccccttaaaaaagtaccctgaaccaggaagaaaaaacaagagacagaaataatgatctgg

SEQ ID NO: 683974 - DNA, 331 bp, Homo sapiens
  misc_feature (108)..(109): n is a, c, g, or t
atcatcacaccactgtactcctgtactctagcctgggcagcctcgttctttaagtaagacactgtctctttaaaaaaaaaaaaaaaaaaaaaaaaaaaaaaaaaaggnntttagtggaattttttttaaggggaaccaggtgtatttttaataattggctttaattggattctattaaatcacctcaaaagctgaatctcgattccggatttggatggaaattattttaatttaagggaggagggatagattaattgacacgaattaggggaaaagacttctggtaataagggccggggttttttaaattgatttttggaatagtaagatg

SEQ ID NO: 683975 - DNA, 427 bp, Homo sapiens
  misc_feature (19)..(19): n is a, c, g, or t
  misc_feature (233)..(233): n is a, c, g, or t
tttaaaggtattaagttanagatgtatgtagagtatagactctagtttaaaagagtagaaactgaacttcatgccatatggattgtaattatatgtaaatgtcacttgtatttactcagatgaaggaaagagatgaaagtcataccctaaccttaccaatatatggcttgggctgagcccagagtgtttccttcttactatccctaggcctaggcctagaggcttctagcccntgtacaatctaatcttcaacaagtatataccttgaaggcttcagctcctagcctccatctgctaacctaggtctagaatgttttaggctctgagacttactgctgaataaactcactctttctagaacattctgaactctggctgactggttaaatccgcagtcctggcccaaagtcagattctcagtcgacgc

SEQ ID NO: 683976 - DNA, 932 bp, Homo sapiens
  misc_feature (21)..(21): n is a, c, g, or t
  misc_feature (161)..(161): n is a, c, g, or t
  misc_feature (280)..(280): n is a, c, g, or t
  misc_feature (338)..(338): n is a, c, g, or t
  misc_feature (404)..(404): n is a, c, g, or t
  misc_feature (480)..(480): n is a, c, g, or t
  misc_feature (524)..(524): n is a, c, g, or t
  misc_feature (644)..(644): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (690)..(690): n is a, c, g, or t
  misc_feature (692)..(692): n is a, c, g, or t
  misc_feature (699)..(699): n is a, c, g, or t
  misc_feature (714)..(714): n is a, c, g, or t
  misc_feature (788)..(788): n is a, c, g, or t
  misc_feature (819)..(819): n is a, c, g, or t
  misc_feature (822)..(822): n is a, c, g, or t
  misc_feature (828)..(828): n is a, c, g, or t
  misc_feature (837)..(837): n is a, c, g, or t
  misc_feature (850)..(850): n is a, c, g, or t
  misc_feature (862)..(862): n is a, c, g, or t
  misc_feature (866)..(866): n is a, c, g, or t
  misc_feature (868)..(868): n is a, c, g, or t
  misc_feature (906)..(906): n is a, c, g, or t
tcagtaaagtcatggcaagtngcatagccacccatgtcagaggttcgaacctgtgggggagaatcatcatcatccatgtggcctgggccccatcctaacaatccccatcaccacccaacagtctgtccccaaaggaagccggcccaaggacaacctaggcnctacccagcaaggggaccatggtccactgcttagaggcacaagggctctcccctggaacactgcactgaagggtatggggagtgtggcccttgcaaggttggaagaaataaagggctcnagccccctttagtctgcaggggaccgaggacagacttgatgaagtgggttgtggtgcngtagccgcccatgtctcgagtccgcacctggccaactttgatcaccttcttcaccgcatctgcgancatgccggagtaaaacccaagattaagaggccgcagcatgtgggaagccgacagcagcatggccgtgggaatggcnaaattcctgcccactgcctgggcaaatgggtgccgggcaccgtnctcaaagactgcgtatcccgcactatagccctcaccagggaccacaccagcccccccaaccaggccagcagccagaatgtcaataatgtccccatagagattgggcatcacaagcacatnaaactngtaangattctncaccagctgcatgcagcagttgtttatnancattgtntcaaatttgattttngggtacagttcagcaacttcctcacagcacttcaggaacaacccatccccaagtttcatgatgttggccttgtngacagcagttaccttgccccgccccttcttngtngcatantcaaatgcnaactttgcaatcngctgagactttncttntntgaaaattttcaaacactcaatcacaccccttgcactntcatgtgccagagagctgtactccct

SEQ ID NO: 683977 - DNA, 578 bp, Homo sapiens
gttatgtgccattggcttgatgtgcatcccggtattcttaattgatatttgattaatcccataccttgattaaaacatgctagttcaaaataagactgctcagtttccaagggtttcaaagcctacttacctttataaagggtctctagtctctgattagccatgactgtattggactttgaacattttctgaactaaaaacctctattctaaactaatctcatttggatgtgtaagtcttttgtaaaggcaagaataaataatatccaggacaatttttagttttctcagtattttcccaaagattgaatattacttcatttttggtggcggcctttgcgctcgatggtggcgtggggggagtagtggcggtatctgggatataatacatagtctccaaataggtaatacttcgcaattgattagattttcagagtagatttagagttatctgtttttctggtgagggtcaaatatttttgttaattaagctcacaaatttgataaattaagaattatctgcatttgtctcgtaacataataatgtgtaataaagtctatagaaaattaaaaaaaaa

SEQ ID NO: 683978 - DNA, 398 bp, Homo sapiens
tgactgactatcactaatgactagggcccgcttggagcaatggaatacattgaacgtatggcccaggcagctgatatctacacagctgaagatgagaagcagcagggacacggtgtcatccaaaaattcacttcattcctattccttcagcatgtaaagcaacctgattgaacgatgagatacatcttcaaggcacgattaccgatgaggacaaacataagattctggacaagtgtaatgaatattatcaagctggcctgataagcaatctcgaatgctgagaaggaagaatctgaacatcaacagagagacctggataaagtaggcaaccccatcatcaccaatctgtaccagagtgcgtgaggcatgccacggaggcaatgcccgcgggtaggagg

SEQ ID NO: 683979 - DNA, 429 bp, Homo sapiens
  misc_feature (41)..(41): n is a, c, g, or t
  misc_feature (43)..(43): n is a, c, g, or t
  misc_feature (48)..(48): n is a, c, g, or t
  misc_feature (61)..(61): n is a, c, g, or t
  misc_feature (65)..(65): n is a, c, g, or t
  misc_feature (76)..(76): n is a, c, g, or t
  misc_feature (84)..(84): n is a, c, g, or t
  misc_feature (90)..(90): n is a, c, g, or t
ccgcggttatgtcttacgaccccacttggtgattttttttnanctctngattacaaagtanattnatttaattttntattatanttgatntacaatgttctgtcaatttctgctgcacagcaaagtgacccaattatacatacatatacattctttttctcacatcatcctccatcatgttccgtaagacataaccgcggccgcggttatgtcttacgcttccttgtgggctaagcaggataggatgtttctttcacattatacaagtgatggggacaaaccaccatagttatctttgactccggaggtgggcatggccttccagcactaggggtccatgaacaggcaccacttgtggccccaatcacctcagaaggcaaaacagaggatggcattgtgagcaagcaacacctgttgttgctcgcaagg

SEQ ID NO: 683980 - DNA, 396 bp, Homo sapiens
tccgtacagcgactcctaacgtcctaacacgcccagactgctacaagctgggcgctcgttacggaggcgctcgttaggcgctcgttacggaggcgctcgttacggaggcgctcgttaggcgctcgttacggacgttacggaggcgctcgttacggaagcgctgttacggaggcgctgttacggaggcgctgttacggaagcgctgttacggaagcgctgttacggaggcgctgttacggaggtgttaggacgttacggaggcgctcgttacggaagggtgtaacggaggcgctcgttacgggtgtacggaggcgctcgttacggagggttacggagggtccgttaggaggcgctcgttacggaagcgctgttacggaagcgctgttacggaggtcg

SEQ ID NO: 683981 - DNA, 421 bp, Homo sapiens
actctgggacaatcagatttcacatattctgtgagcttgcataagccattaaaagcttggagattactgtatttggcattaaaaaaaaaatgtcacttaggtcagcactccgagacgtagcgcagaaagaccctttgagacaaaccaggtgttctggtttttgtgtcagaagagagtgaaactgtgagttgtgtttttgttgacaactggggagaaacagaaacagaaaactatagttagaaagatggaagttccgtagggtctatttcttactctatgtatggctttgtgttcagtctatttctaggagcttgctctgaatcgctaattgtccttgcagttgaaatctaatttatacaatcagtctatactgaaaggttgaatacatcttaattagttttttcttaaagtcaaaaaaaaa

SEQ ID NO: 683982 - DNA, 395 bp, Homo sapiens
  misc_feature (76)..(76): n is a, c, g, or t
tatcgcccaacactaggaacacccaaattctgtaatggtgaatggttaaagaacctatgtgacatccataccatgnaatacgatccagccataaaatggaaccaaacctttcacacaggcaacaacttggaagaacctcaaggaaattatgctgagtgaaaaaaaaaaaaagcccggtctcaaaatggggccatacgacatagtcctttttttgtaccatccaaaaaattaccatattaacagagatgaagaacagataagggatggtcaggagttaagagatatgggagagagaataattgtcgctggaagaggaatagctctaaggaagtctaggggtagatggtaagtaatagtctctgagatggtggtggtggtggggaataacttcaagg

SEQ ID NO: 683983 - DNA, 886 bp, Homo sapiens
tacgacaatgggccgtttaacatttaagctgcttaaaaagtcacgcagttgaatgatgcatttagaacatcttttttagcttactagctctcagaatggatatggaatctgttaaatatagaggccattctttaacataaggccgacagttaacattgggaagccagagaattaggattggaactgatttacgatgagtctacaggacattaacgacaaacactaaacgttagcaccacggaaatccactggctgcattggctatattacagcagagaatttttactttttcatccctttttgaaattggctggactactactgggtaatgcatagaaacagaccttttcgggacaaaaaattgacaggaacttttcttctctacatatattgttctgggcatcggtttggtattggcatcgtaaagcctctgactataaccaagtcagatttcttgtattatgacacgatacccacaccttttattttcacattaacatgagaacaacccatttccccttaacaaagcacttaagaacgttgacattcactaggaagcttggcatatgagcaactacttttgttgggtgttcattgcccgcatttgaccacattgggatccctataattaaaatacccatttttggcacgaattgacaccattgggcttgttgcgtataatagggaggctatatactatacttggtggtaaatccatccaacacaattggccttatattccgcttttcataagcaacttggatacatgccatttccgatacatatcgcaccagcacataacgtttgtctaaccatttttattgggagaacacaaaagcaactgttaactctcacctaaacacgtgttatctacacatatatacac

SEQ ID NO: 683984 - DNA, 703 bp, Homo sapiens
acatacaagcttaaaaacagaaagggtccgactcgatggggtgcgaccagtaccggttggcggctcataatccctaggacagaggggtagtaaagtgtaatatgagtcaccatataccacagatagttgcggactcgacccaagaatgcattaagtcacaagtaacggcaagaacacaaacgttgatctataaacaagttgaagttgtcacgtatactgtactcctctataccgatcggtaagctgtaagcccttcgcagggcactcgtaacacgcacagcatagggtcaatgttgaccatagatcttcacccgatactggccagatacgctcctatatgtgtaggtacagcacttagagtctgtccctaaccagtgcactgtgtgttcccatgactccagaaacaatgtgtcgcccagtgcagtattaagtccacagccaagtttatgctctaactatccacagcaccggcaaagacaaatgacgcgacaatttgttagataatcaacaggattacttagaatgcgaccacttcaagtcaaatttcagtggccgccaggtcacagcaccttcacagtgtcgtgcatgtcatcatgtggatcttgcaaaactgaaggatctgcgatggacatgtcctataagaaacatagtgtgtccctcgtcgtagctagcccgaagttccttgtgactttgtaagttgtac

SEQ ID NO: 683985 - DNA, 117 bp, Homo sapiens
gagccggaccgggatatccaccgcaaggtgatggtttatgaggattctgggttcattgctcctagtttcatctgcttcatctgtgtaaactcttcttcctctttgaaaagaaacagg

SEQ ID NO: 683986 - DNA, 494 bp, Homo sapiens
  misc_feature (103)..(103): n is a, c, g, or t
gggtccatgcacgaacagagagaacatgctatgacttgaatgtaacagtacactggtgctgtgtggaaatagacggatggggcaacatgaggtcattgtgctnaatctagataagatgtgtatccagttgttgcatagaaggtgagagtggttggatctagaaatatttgacagaaagagctgtcgaattgttgatgatttacatgcagggataagagaaagggagatgtcaggtgattccactgtttgtgacctgaataattggaaacatgcaatacaattggctgaagaaatctgggagagagaagaaaggggatttgtgggggatgtgttaaatttgagacaatcaagtgtgatatggagaagacagttggatatacaagactggagctcagagaagtctgggtttgaagatatacatttgggagttggtatttatcaccacaggagtggattagtttccctagaaagtgaaggagacaagaattccaagt

SEQ ID NO: 683987 - DNA, 518 bp, Homo sapiens
  misc_feature (3)..(3): n is a, c, g, or t
  misc_feature (59)..(59): n is a, c, g, or t
  misc_feature (137)..(137): n is a, c, g, or t
ccntagtaactgtcaggttcagctctattctggtagaagcacaactttcagactgaggnatgattaatttgtctcccgtttggaccttttcacatgcttctagactgatgtgtctaatacttcctgctgggcaaatntccacaagtacagaccatgataactccaccctgagctcaccaaaaggaagaagagcagaatacaacgctgtggctagggtacgcctctctgatttcacttttcctgaagagccataaaggttacctgatggccaggcgcagtggctcacgcctgtaatcccaacactttggaaggccaaggcgggcagatcacaggtcaggagatcaagacctcctggctaacacagtgaaaccccatttctactaaaaatacaaaaattagccaggcatggtggtgcgtgcctatagtcccagctacttggaggctgaggcaggagaactgcttgaacccgggaggtgtccctgcactccagcctgggcaacagagcaagattctgtctc

SEQ ID NO: 683988 - DNA, 225 bp, Homo sapiens
ataaagtggaggggagaagcggcctccttccacttaggacagtggtccaagccagagcggaaaggcaggggagtaggatgaatgggacagaaagtgaaatgaccagagcagagtctcaaagcgcgtgccctcaaccaggtgcaagtcctgcaagcccccgagggaaggaaagggggcagctatcagggcacaccccaccccaaaccgcctaacaggaatttctgc

SEQ ID NO: 683989 - DNA, 114 bp, Homo sapiens
ctctgcagtgtctaggtctacttggcagtgtgaggaaggcaagcttctatgtgctcactgctaagcacagacacagcttggtcccctggcagtgatatacagcaaacgtcaata

SEQ ID NO: 683990 - DNA, 276 bp, Homo sapiens
ttcatttgtcttattcatcatgtcttgcccctacatattggaagaatatttgatagactcattttaatttcacaaaattttaaacagtatattttgtacatagagcttcttttttgctttgggtacagggtctcattttgtcacccaggctggagtgcagtgacatgatcatggctcacagtagcctcaacctactgagctcaagcaatcctcctgccttggcctccctagtagctaggaatacaggcatgtgccaccatgcccagccaatttttt

SEQ ID NO: 683991 - DNA, 192 bp, Homo sapiens
tgagctggtacctacttttcacaggttatccactgcattccagtctggcaacaagagtgaaactccaggccgagcacggtggctcatgcctgtaatgccagcactttgggaggccacaggcgggtggatcacctgaggtcaggagttcgagaccagcctggccaacatggtgaaaccccgtctctactaaaa

SEQ ID NO: 683992 - DNA, 217 bp, Homo sapiens
ctaattggttcttcgatgacggatgccatattgctgtgcctatggcgtataccaacgattacagatacgactggacccctagccgggaaacctcgatatgctgcgggagtgtccctagaaaaggctaaaagacagacatacacacacacacaacacctcacaaaagctgtatttcagtgcaaaataccaagagcaacgcgatcgaagaaccaattag

SEQ ID NO: 683993 - DNA, 234 bp, Homo sapiens
ccccccatttggggggggtaaaaaaggggggggggtttttgggcccccaaattttgccaaaccccgggggcccccgccccttaaaaggggtttttttgataaggattgggcccccccccccgggggactttttttgggatttttttccccccagggccgggggggttttttttttttttttgccgggtttgttttttttggcccccccccaatttacccccccccgggggccca

SEQ ID NO: 683994 - DNA, 125 bp, Homo sapiens
ctgacgtcaacccaatcaactctttatcatttatgtttaaaagatcagtgccgggtgctgtggctcatgcctgtaatcccagctacttgggatgctgaggcaggagaatggcgtggacccgggag

SEQ ID NO: 683995 - DNA, 216 bp, Homo sapiens
gctcgggctgatttgtattttttgctagtagaggcggcagtcaccatgtggccaggctggtcttgaactcctgacctcaaatgatccagccatttcggcctcccaaaaggctgggattacaggcatgagccactgcacccagccaagtttctaaggctacgcttatgtatctggaagcagtcccagagctcgagggtcgtgctgtgaggagcggtg

SEQ ID NO: 683996 - DNA, 157 bp, Homo sapiens
  misc_feature (92)..(92): n is a, c, g, or t
ctcataaaggtggtctgcacatcatagcagagcaagctggggctgtcgggctagtcgggggctgtcgggctagtcgtgggactggtcaggcntagtcgagggactagtcgggctagtctgtggacttgtcgggctatgtcggggagcggtcgcggct

SEQ ID NO: 683997 - DNA, 897 bp, Homo sapiens
ggacgcgtgggtcgacccacgtcgtcgcacaggccccagccagtagcggttagggttggaggcagaatgagagaataagatagtaatgagttagaagctaagtaacgattgtcacgaaaagttgtaaaagaggaaggaagaagattgacctaagtataattatataatgagctctaggtattaggagtgatgagcttggatatcataggtaaaggatggggtacagccggtacagacccatgggggtgccgaatgctgatgaggaattgagcatgcatacgaatgcgaggcacccgaccagcctaaacgacaggcataaaactaggacaagcaagacagatgtgaacagagaagaaaaaaagaaacaataacgcgagagagcgacgcacacacgagagaaagagagaatacgacacaaacagacacagcagtgagcaccacaacacaccgcagacattagacgcacgcggattgaacacacacgagcaaacaaaaagaacaaaagagaagaaaaacaaatggacgacagaaacacaaccgaccatacagataaagagcgagaaaagaagccaacgcaagagcgtaaacgaaagaagcaccagacaagcgacacagagtgagcaaacaacgagaacgaggccagttgagaaccaacagacgcggcgccacacaaggagaaaataggaggacaaaaaaaacaagacgacgatacaaaaagagataagcgacaaacaataacaaaccaacgaagagaacacaatgagcacaccgccaataagaaacaaagcctgacacgacaagagaaagcataagaacgaagagaagcaattagagaagcgaccaaaaaagagagaagacgagaccacaaacacaaacaaacgaactaccagaagaaaa

SEQ ID NO: 683998 - DNA, 435 bp, Homo sapiens
aaaaaaaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacctgggggggggccccggacccaaattgccccaaaggggggcggaataaaaataaaggggccggggtttaaaaacgtgggaacgggaaaaacccgggggtacccaaactaaatcgcttggaaaaaaatccccttttggcaagtgggggaaaaagcaaaaaggcccgaaccgatggcctttccaaaaagtggccaaccctaaagggcaaagggaaaatggaaagcgtaaaaatttggtaaaaatccgggtaaaattttggtaaaacaagctaatttttaaaccaataggccaaaatgggaaaaacccttaaaaaattta

SEQ ID NO: 683999 - DNA, 304 bp, Homo sapiens
  misc_feature (282)..(282): n is a, c, g, or t
aaaaaaaaaaaattagtcgggcatggtggtgcacacctgtaatcccagcttgtcaggaggctgaagtgggaggatcacctgggcccagggaggtcagggatgcagtgagccatggtctcaccactgcactctagcctggggtgacagaatgagaccccgtctcaaaaaaaaagaagaattagataatcttgaatagccctatatcttttaggaaactttaatagtgctggggagatattaggtattatttatcctccattttttacagatgttgaaaatttnaggctcagagaagtaaagtcta

SEQ ID NO: 684000 - DNA, 237 bp, Homo sapiens
tccacactgggtatgatttttaaaaaagaagctggggagatgacggcccaaagctaatagtggttatctctgatgggggcggggggtggtgaatgtggcttgaatagactttcccattaaaaaaaaaaagaacatatattcatatattactttggtttggtttggtttggttttggagacaggtctcactcccgttgcccaggctgaaggggagtggcataatcccggctcacccag

SEQ ID NO: 684001 - DNA, 557 bp, Homo sapiens
ggcacccgggtgctatagccacttattgagtattcttgctttgatcgtctacgtaagcatgtaagactacaacattacgacccacctcttcaagaggaaggcaaggcattatggaaaaacattatgtcatgcatatgtgtttctcatacagcatgcccatcacgcaccaatcagctggcaaggtattgggtgctactcaatccagtgaagtcttgagggtcccttccctctgtgaagcatataatctagtggggtagactgctagctactaactatgaaaacaacatagtctgacttgagagtggggaaagtggaacaagggagtaattcttatatttatgttcacatttaaaaatatttcctaaacaatccaatataatcttttctataatttccaatacaatcaacatgtattacttgtaaaataatagcatacatatatcgacagactgaagaaggtatactattagagaacatttgcagaaaagaattgcacatcttttttttgagacagagttccgctgtcacccaggctggagtgcagtggcagcaatcta

SEQ ID NO: 684002 - DNA, 392 bp, Homo sapiens
tgtcgctacacaagaccaaatttattattagacatgttctgactaaccagagaactctaattacacctttatcaacagattactgaggtaagccaatgttttactttctcatgtactagacacaggcaaatgagcaccaaaaggcacccaatatattttttctagcttcaaagtggttattttttttttagaaataaagcagcacatctgaaaacatataaataaataaatactgcaattatatacactgaaggtgcaaacatgtactatcctatgagctgtctatctcgataatctaacagaagtctgcagaaaagtcagcttggctctaaaattttgggtcataacctggcaattgcatttattcaataaagaaaattaatgtccaccac

SEQ ID NO: 684003 - DNA, 222 bp, Homo sapiens
ccctcccttggctggaacgaccctgtggaatataagacggacttagatatttcatacaaattttgaaaaacctgtggttagctgttaaggctattagtcctcctaaggaccagtattatacttaggaggttcttgttggctctggagtattattttaggatattcagaacttgggccttcagaacctaagggaggtctggaaagcagcacggctttcccctc

SEQ ID NO: 684004 - DNA, 127 bp, Homo sapiens
gtgtgctgcggttgttctaaggatccgaagggtgatgcggtggactagaaagtagtgggggacccagcgagtggacgccgctcgggattcctgagtctgtaaatagtgtgcccagcagctgtgaact

SEQ ID NO: 684005 - DNA, 363 bp, Homo sapiens
ttctaaaatagggacgtggccgggcacggtggctcatgcctgtaatcccagcactttgggaggccgaggcaggcggctcacgaggtcaggagatcgagactatcctggctaacacggtgaaaccctgtctctactaagagtacaaaaaattagctgggcgtggtggtgggcacctgtagtcccagctactcgggaggctgaggcaggagaagggcatgaatccgggaggcagagcttgcagtgagctgaggtcacgccattgcactccagcctgggcaacagtgttaagactctgtctcaaatataaataaataaataaataaataaaaataaagcgagatgttgccctcaaacttcaaaaaa

SEQ ID NO: 684006 - DNA, 149 bp, Homo sapiens
ctagcagttaccttatctgctcgagtgctgacagctaaccctggtcccttccttgtctcagaggggaaaaaggaattggatttcctcagggctctggggcctgggctgtggcttgaggttccgagactgatgaatccaatgcatgcttg

SEQ ID NO: 684007 - DNA, 109 bp, Homo sapiens
tacaacgtcaaagctaattaaagtcacaaacttcggtgaaaccttaaaagtccaaatcctcttgatattgtgaaccgtaccccttagcaccagacgaatccagacacca

SEQ ID NO: 684008 - DNA, 509 bp, Homo sapiens
  misc_feature (16)..(16): n is a, c, g, or t
  misc_feature (62)..(64): n is a, c, g, or t
  misc_feature (72)..(73): n is a, c, g, or t
  misc_feature (79)..(80): n is a, c, g, or t
  misc_feature (89)..(89): n is a, c, g, or t
  misc_feature (101)..(101): n is a, c, g, or t
  misc_feature (110)..(110): n is a, c, g, or t
  misc_feature (117)..(117): n is a, c, g, or t
  misc_feature (128)..(128): n is a, c, g, or t
  misc_feature (137)..(137): n is a, c, g, or t
  misc_feature (140)..(140): n is a, c, g, or t
  misc_feature (190)..(190): n is a, c, g, or t
  misc_feature (192)..(192): n is a, c, g, or t
  misc_feature (196)..(196): n is a, c, g, or t
  misc_feature (199)..(200): n is a, c, g, or t
  misc_feature (206)..(208): n is a, c, g, or t
  misc_feature (214)..(214): n is a, c, g, or t
  misc_feature (266)..(266): n is a, c, g, or t
  misc_feature (440)..(441): n is a, c, g, or t
  misc_feature (494)..(494): n is a, c, g, or t
ccttttcctacagttngtaatattctgtttccagatggccatctccaccactgaatgattcnnngcttcagnnctcatnngtgttctgnactcacaaattngcataattngtccaangcttgattttnttgtttgangtncagcaaacatcaaattatttttttcctaattgtttttttttgtctctttntngttnttnnttttcnnntttttnctcctttttctgtttttttctgttctttgtttctttttgttcaacaccttcnttctttatgcttctttgggcatcacaggtttttgaaatttttgttttttttgcattccacagtaatgatcactttcaacaactgcaatatacatctgcatgttacactgacatacaacacataagtattttgtcacacatcaacttttagcctcaaataatagaatacaaaaannaacactggacataacaccacagaacttttgaatatccccttttcccaattgtnaacaggtagtacttt

SEQ ID NO: 684009 - DNA, 164 bp, Homo sapiens
gcggccgcctactactactactgctcgaattcaagcttctaacgatgtacggggacatggcataggctgcaacccagcagagggcagctagatggacatttcccctgctcggaagggttggcctgcctggctggggaggtcagtaaactttgaatagtaagcca

SEQ ID NO: 684010 - DNA, 1032 bp, Homo sapiens
  misc_feature (1010)..(1010): n is a, c, g, or t
aaggctaggtagaggctggggtaaatcggccgaggaagtgccttccagccgcaggcgcccttcttcttctgtgcgctcgggctcctggtcccggctccccggttaccggggcgcgagtatgaccacaatggcggccgccaccctgctgcgcgcgacgccccacttcagcggtctcgccgccggccggaccttcctgctgcagggtctgttgcggctgctgaaagccccggcattgcctctcttgtgccgcggcctggccgtggaggccaagaagacttacgtgcgcgacaagccacatgtgaatgtgggtaccatcggccatgtggaccacgggaagaccacgctgactgcagccatcacgaagattctagctgagggaggtggggctaagttcaagaagtacgaggagattgacaatgccccggaggagcgagctcggggtatcaccatcaatgcggctcatgtggagtatagcactgccgcccgccactacgcccacacagactgcccgggtcatgcagattatgttaagaatatgatcacaggcactgcacccctcgacggctgcatcctggtggtagcagccaatgacggccccatgccccagacccgagagcacttattactggccagacagattggggtggagcatgtggtggtgtatgtgaacaaggctgacgctgtccaggactctgagatggtggaactggtggaactggagatccgggagctgctcaccgagtttggtataaggggaggagacccagtcatcgaggcccgtccctggccttgaggtcggacctgaagttagccgaagtcggcaaaagctacggatgcggggacctattcatgccccgaccggaaaacttcggggcagtggagcgcgtacccgccggcgggccggggaggcactaaggggctaaacggacggggcccgaataaaaccctgggctatcaaaggggcacggacacgggcacaaaagctaagagagagcaggcgtcatacgggngtctgcgaagggccgcggcgat

SEQ ID NO: 684011 - DNA, 912 bp, Homo sapiens
tcctggccgcggcgcagctcgcgttcgccatgccgttcctccgggcccggatcccacgctccgggctttagctgcgaccgagtaggcagtcggggcgaaggaaacgggaactgaaagcgatgaaaagcgttccacacgccacgagcccgcgggatcctcggagagtatggaacccttcccctccgctctcagccggaggccagctgcgtccagccgggctcggtcttctgaacaccgatttcaaatcaggtccccggggcccagcgtcacttagggaagtggtggcattttgtggttgctgctaaatcacggagagcagccttggcgctgccggtcccaacttgatccaaggagccttgagaaggagatgagattcagtaccaggggccggccgtggctcccatcctccggaatctgcaaaatggctacttcttcagaaataatggggagagggatggcaagaggccagagatcaaggccctcgagtattaacttgagcatttgggcacaaaatagacacttttggattttcccgtcttttccaacaccaaggatgagattatcaaaagatgtgttaaattaatttgtaccggccgggcgcggtggcttacgcctgtaatcccaacactttgggaggccgaggcgggcgaatcacaaggtcatgagttcgaaaccagcctggccaatatggtgaaacccccgtctctactaaaaatacagaaattagccgggagtggtggcgtacgcctgtagtcccagctactctggaggctaaggcaggagaatcgcttgaatccgggaggtggaggtcgcagtgagccgagaccgggccactgcactccagcctgggagacagagcgagactctgtcttcaaggaaaaaaaaaattcattggccaattccttgcccaac

SEQ ID NO: 684012 - DNA, 295 bp, Homo sapiens
  misc_feature (202)..(202): n is a, c, g, or t
actctagagatccccgactctgctctcattcctgaaaatctttccaggaagagtgtccagataaacccactcttcacgcagcactggggctccagaagcacagtttcccagtgctcctgaactgagtgtgtctctgcatcagaagagcttccccgaccctccaaagaacaggacttcagttacctgaacattccctttctgngccctgagcctttcttctccaaggcagaacctaaagcaagggatcttggtggtgccactccaacctttaacaacgcccccaatcaaggccaag

SEQ ID NO: 684013 - DNA, 202 bp, Homo sapiens
gcactccagcggtgaaacaagagtgaaactccatctcaaaaaaataataaaagtataaaaaggcagattcaatatgtgcacggtcctctttatcaggcaaaaacacgtttatggagacttgaaatgaaattcaggctgaaggaatcttgcagctgaaagatgattatttccatagaattgaagagatgacttttccaaagaa

SEQ ID NO: 684014 - DNA, 548 bp, Homo sapiens
cggccgctgctaaggatttttgcatacccctgaccccacctgagaatcccggcctcccatcttccggtctctctgactctaggttgctgctaaatcacggagagcagccttggcgctgccggtcccaacttgatccaaggagccttgagaaggagatgagattcagtaccaggggccggccgtggctcccatcctccggaatctgcaaaatggctacttcttcagaaataatggggagagggatggcaagaggccagagatcaaggccctcgagtattaacttgagcatttgggcacaaaatagacacttttggattttcccgtcttttccaacaccaaggatgagattatcaaaagatgtgttaaattaatttgtaccggccgggcgcggtggcttacgcctgtaatcccaaagtgctgggattacaggcatgagccaccatgcttggccaacctgagatgactttggtggtggctgatcacacttttgggaacactgatatgaggacatgcagacatatggtccatgggtgagggtcttaatctgt

SEQ ID NO: 684015 - DNA, 354 bp, Homo sapiens
tggagctgcgcgccctcaggacgacacctggtgaatcaaagaaattggcacgagagattgcggacatttagacttagcggtccaccaaaagcagccgaccactttttaaaacaagaagaggggccctctggagaacttgcaaggagaagcccccgcggaactttaagaccactggccttggcttaaggacaccaaggaggcttttagggcacccccaattacacgagatctccccttacggtcatgtgtccacctgagggcggatctctctttcgcgtaccagagagagcttaggacactgtaatctcgagacaatttacaatccgtaggacatccgcccgtgagcgcacagac

SEQ ID NO: 684016 - DNA, 988 bp, Homo sapiens
  misc_feature (36)..(36): n is a, c, g, or t
  misc_feature (813)..(813): n is a, c, g, or t
  misc_feature (817)..(817): n is a, c, g, or t
  misc_feature (819)..(820): n is a, c, g, or t
  misc_feature (838)..(839): n is a, c, g, or t
  misc_feature (843)..(843): n is a, c, g, or t
  misc_feature (845)..(845): n is a, c, g, or t
  misc_feature (849)..(849): n is a, c, g, or t
  misc_feature (855)..(855): n is a, c, g, or t
  misc_feature (859)..(859): n is a, c, g, or t
  misc_feature (868)..(868): n is a, c, g, or t
  misc_feature (871)..(871): n is a, c, g, or t
  misc_feature (873)..(873): n is a, c, g, or t
  misc_feature (884)..(885): n is a, c, g, or t
  misc_feature (898)..(898): n is a, c, g, or t
  misc_feature (904)..(904): n is a, c, g, or t
  misc_feature (907)..(907): n is a, c, g, or t
tctaggagaggccggtgttaattggacgaggcttcntcttctgtgcgctcgggctcctggtcccggctccccggttaccggggcgcgagtatgaccacaatggcggccgccaccctgctgcgcgcgacgccccacttcagcggtctcgccgccggccggaccttcctgctgcagggtctgttgcggctgctgaaagccccggcattgcctctcttgtgccgcggcctggccgtggaggccaagaagacttacgtgcgcgacaagccacatgtgaatgtgggtaccatcggccatgtggaccacgggaagaccacgctgactgcagccatcacgaagattctagctgagggaggtggggctaagttcaagaagtacgaggagattgacaatgccccggaggagcgagctcggggtatcaccatcaatgcggctcatgtggagtatagcactgccgcccgccactacgcccacacagactgcccgggtcatgcagattatgttaagaatatgatcacaggcactgcacccctcgacggctgcatcctggtggtagcagccaatgacggccccatgccccagacccgagagcacttattactggccagacagattggggtggagcatgtggtggtgtatgtgaacaaggctgacgctgtccaggactctgagatggtggaactggtggaactggagatccgggagctgctcaccgagtttggtataaggggaggagacccagtcatcggaggctctggtcctgtgccctgaaggtcgggacctgagttaggcctgaatctgtgagaagctaggtgngggncnncatccaggcgccggacgnnaacncnggcngggggnggancccggcggncgngnaggccaacggnnaaaggaaggggcnaaaaanacnggggccgagccaacgacaggcgacaccgcaagaaggcgcgtccaagcgccgccccgcccggccgcacagcaatgcaagggg

SEQ ID NO: 684017 - DNA, 751 bp, Homo sapiens
gttttggctttggaccggaggtgtggttattgcttgttatggaccgtagatagggagttggtaattgtgaatttaggggaagggaaaaaggagacattggtggatctagggaaggagcacactatagttgttaacttgttttacaatttgagcaggacaccaccgctgtgttatttgttttaattgtgccgtagctagggttgcagaggctaggattagtggttttttatttttttgtggattattatagttttttataattagaatgaaaagattataataattaaaagagaataaatatataaacttgaaaataagtacttcttaaacgcagagagctggcacgggagcggaagaaagagaggagcgaaattggccttcttctgggtggacgccaaattttttgtcttgttatttttaaaatcacatagataacctacgaaggaatgaagaaacttgtctgtcggtcgcaggggaagcacgtcaagaatgcattggtttttgtttgagggttcgtttcagctctgctagtctgtttctaaggtaggttacctcgggtattggtgtctggtgaagtttgattatattgggtatgtgtcttgtccgtgtttgggtaggccgtgggctagggaggttgaaaggagtggtgatgttcgagagtaggtcttctggctgagagggtgggtagtacgtcagaacgacgcatgcacacagttaaacacgtgattaaaagaaaacctgaaaaaaacat

SEQ ID NO: 684018 - DNA, 2009 bp, Homo sapiens
gagcagtcggagccgcagctgcctcccggagcccgagcccctccctccgggtccggcctagcccgcctgactcccactctgatcacctccacagcccgccgacctgagaactactacgcccatgagccttcgcggcgccggtgatttaggggacgctcctcagtgccccctgcgaccgccagagagaactacgttgcccctcagcccgagaggcgcgagtggtggaaaacctctccatcatactccgccctcgagacaccagccccctccatgacgtcttcagccgcgcgcccgacgtcggctgagacggccatagacactggcggctagaggggcccggacttgccctcccagctctaacttccgccggaagtgccttccagccgcaggcgcccttcttcttctgtgcgctcgggctcctggtcccggctccccggttaccggggcgcgagtatgaccacaatggcggccgccaccctgctgcgcgcgacgccccacttcagcggtctcgccgccggccggaccttcctgctgcagggtctgttgcggctgctgaaagccccggcattgcctctcttgtgccgcggcctggccgtggaggccaagaagacttacgtgcgcgacaagccacatgtgaatgtgggtaccatcggccatgtggaccacgggaagaccacgctgactgcagccatcacgaagattctagctgagggaggtggggctaagttcaagaagtacgaggagattgacaatgccccggaggagcgagctcggggtatcaccatcaatgcggctcatgtggagtatagcactgccgcccgccactacgcccacacagactgcccgggtcatgcagattatgttaagaatatgatcacaggcactgcacccctcgacggctgcatcctggtggtagcagccaatgacggccccatgccccagacccgagagcacttattactggccagacagattggggtggagcatgtggtggtgtatgtgaacaaggctgacgctgtccaggactctgagatggtggaactggtggaactggagatccgggagctgctcaccgagtttggctataaaggggaggagaccccagtcatcgtaggctctgctctctgtgcccttgagggtcgggaccctgagttaggcctgaagtctgtgcagaagctactggatgctgtggacacttacatcccagtgcccgcccgggacctggagaagcctttcctgctgcctgtggaggcggtgtactccgtccctggccgtggcaccgtggtgacaggtacactagagcgtggcattttaaagaagggagacgagtgtgagctcctaggacatagcaagaacatccgcactgtggtgacaggcattgagatgttccacaagagcctggagagggccgaggccggagataacctcggggccctggtccgaggcttgaagcgggaggacttgcggcggggcctggtcatggtcaagccaggttccatcaagccccaccagaaggtggaggcccaggtttacatcctcagcaaggaggaaggtggccgccacaagccctttgtgtcccacttcatgcctgtcatgttctccctgacttgggacatggcctgtcggattatcctgcccccagagaaggagcttgccatgcccggggaggacctgaagttcaacctaatcttgcggcagccaatgatcttagagaaaggccagcgtttcaccctgcgagatggcaaccggactattggcaccggtctagtcaccaacacgctggccatgactgaggaggagaagaatatcaaatggggttgagtgtgcagatctctgctcagcttcccttgcgtttaaggcctgccctagccagggctccctcctgcttccagtaccctctcatggcataggctgcaacccagcagagggcagctagatggacatttcccctgctcggaagggttggcctgcctggctggggaggtcagtaaactttgaatagtaagcca

SEQ ID NO: 684019 - DNA, 428 bp, Homo sapiens
  misc_feature (241)..(241): n is a, c, g, or t
  misc_feature (294)..(295): n is a, c, g, or t
  misc_feature (311)..(311): n is a, c, g, or t
  misc_feature (339)..(339): n is a, c, g, or t
  misc_feature (401)..(401): n is a, c, g, or t
gttagaaactatgggaggtggagacggctccttcacatggcaagagaggattagaaatggctaccatcagacaaaagagcccctatggtctccgtcgagggcaaagccctctctgtcttctctgcagtgggagcagctctcctgccacagctcctcaccccctgtgttcgcctgctccaagtttgtctccactccctccttggtcgagcacctcacagctgctgagccgtccgctatctgnagtggtgctgcgaccggagatactgacagatgagagcctcagcagcttggcanntctcatgtccccttanctcacttgtctctagccgcagcttccanaccagcgccatttcaagggactcgacacagcagccgtttcattggagctggggctgccacanttggggtggctggttactggggctggg

SEQ ID NO: 684020 - DNA, 1631 bp, Homo sapiens
aaggctaggtagaggctggggtaaatcggccgagggggctcctggtcccggctccccggttaccggggcgcgagtatgaccacaatggcggccgccaccctgctgcgcgcgacgccccacttcagcggtctcgccgccggccggaccttcctgctgcagggtctgttgcggctgctgaaagccccggcattgcctctcttgtgccgcggcctggccgtggaggccaagaagacttacgtgcgcgacaagccacatgtgaatgtgggtaccatcggccatgtggaccacgggaagaccacgctgactgcagccatcacgaagattctagctgagggaggtggggctaagttcaagaagtacgaggagattgacaatgccccggaggagcgagctcggggtatcaccatcaatgcggctcatgtggagtatagcactgccgcccgccactacgcccacacagactgcccgggtcatgcagattatgttaagaatatgatcacaggcactgcacccctcgacggctgcatcctggtggtagcagccaatgacggccccatgccccagacccgagagcacttattactggccagacagattggggtggagcatgtggtggtgtatgtgaacaaggctgacgctgtccaggactctgagatggtggaactggtggaactggagatccgggagctgctcaccgagtttggctataaaggggaggagaccccagtcatcgtaggctctgctctctgtgcccttgagggtcgggaccctgagttaggcctgaagtctgtgcagaagctactggatgctgtggacacttacatcccagtgcccgcccgggacctggagaagcctttcctgctgcctgtggaggcggtgtactccgtccctggccgtggcaccgtggtgacaggtacactagagcgtggcattttaaagaagggagacgagtgtgagctcctaggacatagcaagaacatccgcactgtggtgacaggcattgagatgttccacaagagcctggagagggccgaggccggagataacctcggggccctggtccgaggcttgaagcgggaggacttgcggcggggcctggtcatggtcaagccaggttccatcaagccccaccagaaggtggaggcccaggtttacatcctcagcaaggaggaaggtggccgccacaagccctttgtgtcccacttcatgcctgtcatgttctccctgacttgggacatggcctgtcggattatcctgcccccagagaaggagcttgccatgcccggggaggacctgaagttcaacctaatcttgcggcagccaatgatcttagagaaaggccagcgtttcaccctgcgagatggcaaccggactattggcaccggtctagtcaccaacacgctggccatgactgaggaggagaagaatatcaaatggggttgagtgtgcagatctctgctcagcttcccttgcgtttaaggcctgccctagccagggctccctcctgcttccagtaccctctcatggcataggctgcaacccagcagagggcagctagatggacatttcccctgctcggaagggttggcctgcctggctggggaggtcagtaaactttgaatagtaagcca

SEQ ID NO: 684021 - DNA, 1639 bp, Homo sapiens
  misc_feature (30)..(30): n is a, c, g, or t
aggctagtacgaggccgggtgttaatcggncgagggtgcgctcgggctcctggtcccggctccccggttaccggggcgcgagtatgaccacaatggcggccgccaccctgctgcgcgcgacgccccacttcagcggtctcgccgccggccggaccttcctgctgcagggtctgttgcggctgctgaaagccccggcattgcctctcttgtgccgcggcctggccgtggaggccaagaagacttacgtgcgcgacaagccacatgtgaatgtgggtaccatcggccatgtggaccacgggaagaccacgctgactgcagccatcacgaagattctagctgagggaggtggggctaagttcaagaagtacgaggagattgacaatgccccggaggagcgagctcggggtatcaccatcaatgcggctcatgtggagtatagcactgccgcccgccactacgcccacacagactgcccgggtcatgcagattatgttaagaatatgatcacaggcactgcacccctcgacggctgcatcctggtggtagcagccaatgacggccccatgccccagacccgagagcacttattactggccagacagattggggtggagcatgtggtggtgtatgtgaacaaggctgacgctgtccaggactctgagatggtggaactggtggaactggagatccgggagctgctcaccgagtttggctataaaggggaggagaccccagtcatcgtaggctctgctctctgtgcccttgagggtcgggaccctgagttaggcctgaagtctgtgcagaagctactggatgctgtggacacttacatcccagtgcccgcccgggacctggagaagcctttcctgctgcctgtggaggcggtgtactccgtccctggccgtggcaccgtggtgacaggtacactagagcgtggcattttaaagaagggagacgagtgtgagctcctaggacatagcaagaacatccgcactgtggtgacaggcattgagatgttccacaagagcctggagagggccgaggccggagataacctcggggccctggtccgaggcttgaagcgggaggacttgcggcggggcctggtcatggtcaagccaggttccatcaagccccaccagaaggtggaggcccaggtttacatcctcagcaaggaggaaggtggccgccacaagccctttgtgtcccacttcatgcctgtcatgttctccctgacttgggacatggcctgtcggattatcctgcccccagagaaggagcttgccatgcccggggaggacctgaagttcaacctaatcttgcggcagccaatgatcttagagaaaggccagcgtttcaccctgcgagatggcaaccggactattggcaccggtctagtcaccaacacgctggccatgactgaggaggagaagaatatcaaatggggttgagtgtgcagatctctgctcagcttcccttgcgtttaaggcctgccctagccagggctccctcctgcttccagtaccctctcatggcataggctgcaacccagcagagggcagctagatggacatttcccctgctcggaagggttggcctgcctggctggggaggtcagtaaactttgaatagtaagcca

SEQ ID NO: 684022 - DNA, 3186 bp, Homo sapiens
  misc_feature (2064)..(2064): n is a, c, g, or t
  misc_feature (2068)..(2068): n is a, c, g, or t
gagcagtcggagccgcagctgcctcccggagcccgagcccctccctccgggtccggcctagcccgcctgactcccactctgatcacctccacagcccgccgacctgagaactactacgcccatgagccttcgcggcgccggtgatttaggggacgctcctcagtgccccctgcgaccgccagagagaactacgttgcccctcagcccgagaggcgcgagtggtggaaaacctctccatcatactccgccctcgagacaccagccccctccatgacgtcttcagccgcgcgcccgacgtcggctgagacggccatagacactggcggctagaggggcccggacttgccctcccagctctaacttccgccggaagtgccttccagccgcaggcgcccttcttcttctgtgcgctcgggctcctggtcccggctccccggttaccggggcgcgagtatgaccacaatggcggccgccaccctgctgcgcgcgacgccccacttcagcggtctcgccgccggccggaccttcctgctgcagggtctgttgcggctgctgaaagccccggcattgcctctcttgtgccgcggcctggccgtggaggccaagaagacttacgtgcgcgacaagccacatgtgaatgtgggtaccatcggccatgtggaccacgggaagaccacgctgactgcagccatcacgaagattctagctgagggaggtggggctaagttcaagaagtacgaggagattgacaatgccccggaggagcgagctcggggtatcaccatcaatgcggctcatgtggagtatagcactgccgcccgccactacgcccacacagactgcccgggtcatgcagattatgttaagaatatgatcacaggcactgcacccctcgacggctgcatcctggtggtagcagccaatgacggccccatgccccagacccgagagcacttattactggccagacagattggggtggagcatgtggtggtgtatgtgaacaaggctgacgctgtccaggactctgagatggtggaactggtggaactggagatccgggagctgctcaccgagtttggctataaaggggaggagaccccagtcatcgtaggctctgctctctgtgcccttgagggtcgggaccctgagttaggcctgaagtctgtgcagaagctactggatgctgtggacacttacatcccagtgcccgcccgggacctggagaagcctttcctgctgcctgtggaggcggtgtactccgtccctggccgtggcaccgtggtgacaggtacactagagcgtggcattttaaagaagggagacgagtgtgagctcctaggacatagcaagaacatccgcactgtggtgacaggcattgagatgttccacaagagcctggagagggccgaggccggagataacctcggggccctggtccgaggcttgaagcgggaggacttgcggcggggcctggtcatggtcaagccaggttccatcaagccccaccagaaggtggaggcccaggtttacatcctcagcaaggaggaaggtggccgccacaagccctttgtgtcccacttcatgcctgtcatgttctccctgacttgggacatggcctgtcggattatcctgcccccagagaaggagcttgccatgcccggggaggacctgaagttcaacctaatcttgcggcagccaatgatcttagagaaaggccagcgtttcaccctgcgagatggcaaccggactattggcaccggtctagtcaccaacacgctggccatgactgaggaggagaagaatatcaaatggggttgagtgtgcagatctctgctcagcttcccttgcgtttaaggcctgccctagccagggctccctcctgcttccagtaccctctcatggcataggctgcaacccagcagagggcagctagatggacatttcccctgctcggaagggttggcctgcctggctggggaggtcagtaaactttgaatagtaagccaaaaaaaaaacaacaacaaaaaaaaaaaaaaaaaaaacacaaaaaaaaaaaaaaanaaanaaaaaaaagggggggcgcgcgcgcgacgaggatcagactccccgcagagagaggcgcgccacacatacgcgcacgcagcgaaccgcacgtacactctggagaaaaaagggcgcgcccacctaaggaggcgggcgacctatactaagccagcgacgcacgcagaggcgagcacgagacacaagagccgcgcagcagagagggaaacagaggcgcgaaacccggaggaggcaacactgcgggacaggaagaccgaacacactaaaggcccgcgtggggagacgacagcccaaagagggcggccgaccacaccccaccacccagagagaacagtattaagagcacgccccacgagggaggcgcaaatcaaacagacctgagcgcaggactccacaggagcggcagacaccgcagacaccgccgcgccgataagagtagccagcaagagacacaagacaaaatgtccagcgcacacccagccgaggaaggacgacaaacacacaacaaagaagaaaaacagaacgacgccgaaggagcgcccagaagcggaagacacacaaaacccagcacaacggcaacacagcgaggcggagcgacgcacacacaaacaccacacaccgagaccacagactacacacgcccgggaccggatgcgcgagcagagcgagagagcgcgccaggaaacagagcgcagacacacacagaccggaagaccagcgagaagagcgcgacacgccggcgaccagcaggagaagccacgaacaagcacagtgagcaccgagcaagcaaacggaagaaagagcgagcagagcagagacacaaccgacgcgagggagaggaaggaaggggagcatagcagcgagcgagagagcccacaaccgacgccaagaagcgacgcacggcagagacggaagaggagcagacgccgaggaagaacaggacagcaccaggaccgagacgacagagaagagagcaagacaaacgagccagccgaagaagagcgcacgacacgggagggaacaggcgacgcaagagcaacagcagacgcggacgcagcacaagacacgcgcgaacgaaccacgaaagcgagcgacagcacagccaacgagcgacgacacgca

SEQ ID NO: 684023 - DNA, 2629 bp, Homo sapiens
  misc_feature (2064)..(2064): n is a, c, g, or t
  misc_feature (2068)..(2068): n is a, c, g, or t
gagcagtcggagccgcagctgcctcccggagcccgagcccctccctccgggtccggcctagcccgcctgactcccactctgatcacctccacagcccgccgacctgagaactactacgcccatgagccttcgcggcgccggtgatttaggggacgctcctcagtgccccctgcgaccgccagagagaactacgttgcccctcagcccgagaggcgcgagtggtggaaaacctctccatcatactccgccctcgagacaccagccccctccatgacgtcttcagccgcgcgcccgacgtcggctgagacggccatagacactggcggctagaggggcccggacttgccctcccagctctaacttccgccggaagtgccttccagccgcaggcgcccttcttcttctgtgcgctcgggctcctggtcccggctccccggttaccggggcgcgagtatgaccacaatggcggccgccaccctgctgcgcgcgacgccccacttcagcggtctcgccgccggccggaccttcctgctgcagggtctgttgcggctgctgaaagccccggcattgcctctcttgtgccgcggcctggccgtggaggccaagaagacttacgtgcgcgacaagccacatgtgaatgtgggtaccatcggccatgtggaccacgggaagaccacgctgactgcagccatcacgaagattctagctgagggaggtggggctaagttcaagaagtacgaggagattgacaatgccccggaggagcgagctcggggtatcaccatcaatgcggctcatgtggagtatagcactgccgcccgccactacgcccacacagactgcccgggtcatgcagattatgttaagaatatgatcacaggcactgcacccctcgacggctgcatcctggtggtagcagccaatgacggccccatgccccagacccgagagcacttattactggccagacagattggggtggagcatgtggtggtgtatgtgaacaaggctgacgctgtccaggactctgagatggtggaactggtggaactggagatccgggagctgctcaccgagtttggctataaaggggaggagaccccagtcatcgtaggctctgctctctgtgcccttgagggtcgggaccctgagttaggcctgaagtctgtgcagaagctactggatgctgtggacacttacatcccagtgcccgcccgggacctggagaagcctttcctgctgcctgtggaggcggtgtactccgtccctggccgtggcaccgtggtgacaggtacactagagcgtggcattttaaagaagggagacgagtgtgagctcctaggacatagcaagaacatccgcactgtggtgacaggcattgagatgttccacaagagcctggagagggccgaggccggagataacctcggggccctggtccgaggcttgaagcgggaggacttgcggcggggcctggtcatggtcaagccaggttccatcaagccccaccagaaggtggaggcccaggtttacatcctcagcaaggaggaaggtggccgccacaagccctttgtgtcccacttcatgcctgtcatgttctccctgacttgggacatggcctgtcggattatcctgcccccagagaaggagcttgccatgcccggggaggacctgaagttcaacctaatcttgcggcagccaatgatcttagagaaaggccagcgtttcaccctgcgagatggcaaccggactattggcaccggtctagtcaccaacacgctggccatgactgaggaggagaagaatatcaaatggggttgagtgtgcagatctctgctcagcttcccttgcgtttaaggcctgccctagccagggctccctcctgcttccagtaccctctcatggcataggctgcaacccagcagagggcagctagatggacatttcccctgctcggaagggttggcctgcctggctggggaggtcagtaaactttgaatagtaagccaaaaaaaaaacaacaacaaaaaaaaaaaaaaaaaaaacacaaaaaaaaaaaaaaanaaanaaaaaaaacaaaaaaaaaaaaacacaaaaaaaaaaaaaaaaaaaaaaaacaaaaaacaaagaaaaaaaagggggggggagaggagcaaaaaggagggggggggagagccacacggcgcgcccgcgcgggagacaggagaacaaaagagagagagacagaacaaaagaacaggggaggggaggagaaccagagagagggaggagagtgagagaggaagagaaagaaaaagcgagagcgaagaaaagagagggggaaacaagaaacggagagagacacaaggaaggaggagcggggagcagaaaagacagcaaagaagaagagaaaaaagagaaagcgagagagagaggaaaaaagagaacaaaaaggagagacgcacagagggacaggcagaaagagaaacaaacaagaaaccacaaaagcaaaccagaaagaaacaggggaagagagaggaaaagggagggacgagaggaggaaggagagggaaagaccgaaagaaagaggaaggcaaaaggaagcaaggaggaagcaggaaaggagacggagggggaaaggcagcacaag

SEQ ID NO: 684024 - DNA, 2392 bp, Homo sapiens
gagcagtcggagccgcagctgcctcccggagcccgagcccctccctccgggtccggcctagcccgcctgactcccactctgatcacctccacagcccgccgacctgagaactactacgcccatgagccttcgcggcgccggtgatttaggggacgctcctcagtgccccctgcgaccgccagagagaactacgttgcccctcagcccgagaggcgcgagtggtggaaaacctctccatcatactccgccctcgagacaccagccccctccatgacgtcttcagccgcgcgcccgacgtcggctgagacggccatagacactggcggctagaggggcccggacttgccctcccagctctaacttccgccggaagtgccttccagccgcaggcgcccttcttcttctgtgcgctcgggctcctggtcccggctccccggttaccggggcgcgagtatgaccacaatggcggccgccaccctgctgcgcgcgacgccccacttcagcggtctcgccgccggccggaccttcctgctgcagggtctgttgcggctgctgaaagccccggcattgcctctcttgtgccgcggcctggccgtggaggccaagaagacttacgtgcgcgacaagccacatgtgaatgtgggtaccatcggccatgtggaccacgggaagaccacgctgactgcagccatcacgaagattctagctgagggaggtggggctaagttcaagaagtacgaggagattgacaatgccccggaggagcgagctcggggtatcaccatcaatgcggctcatgtggagtatagcactgccgcccgccactacgcccacacagactgcccgggtcatgcagattatgttaagaatatgatcacaggcactgcacccctcgacggctgcatcctggtggtagcagccaatgacggccccatgccccagacccgagagcacttattactggccagacagattggggtggagcatgtggtggtgtatgtgaacaaggctgacgctgtccaggactctgagatggtggaactggtggaactggagatccgggagctgctcaccgagtttggctataaaggggaggagaccccagtcatcgtaggctctgctctctgtgcccttgagggtcgggaccctgagttaggcctgaagtctgtgcagaagctactggatgctgtggacacttacatcccagtgcccgcccgggacctggagaagcctttcctgctgcctgtggaggcggtgtactccgtccctggccgtggcaccgtggtgacaggtacactagagcgtggcattttaaagaagggagacgagtgtgagctcctaggacatagcaagaacatccgcactgtggtgacaggcattgagatgttccacaagagcctggagagggccgaggccggagataacctcggggccctggtccgaggcttgaagcgggaggacttgcggcggggcctggtcatggtcaagccaggttccatcaagccccaccagaaggtggaggcccaggtttacatcctcagcaaggaggaaggtggccgccacaagccctttgtgtcccacttcatgcctgtcatgttctccctgacttgggacatggcctgtcggattatcctgcccccagagaaggagcttgccatgcccggggaggacctgaagttcaacctaatcttgcggcagccaatgatcttagagaaaggccagcgtttcaccctgcgagatggcaaccggactattggcaccggtctagtcaccaacacgctggccatgactgaggaggagaagaatatcaaatggggttgagtgtgcagatctctgctcagcttcccttgcgtttaaggcctgccctagccagggctccctcctgcttccagtaccctctcatggcataggctgcaacccagcagagggcagctagatggacatttcccctgctcggaagggttggcctgcctggctggggaggtcagtaaactttgaatagtaagccagcctgtgtcctgtgtcctttgtgcaaattggagaggataggggaggacaaaaagggtgttgaaccccagacagatggggagcttgtgagatcccagagcagttttaacggataaatcaagtccagtgagcttagtgattgcctagacacagtaggatgccgttattcagcctcctgggagatagtgggaaagaatgttctatcgctctggagccagcatggcttcagctcaggtgccaaacccatcttgtttcctcggaatactaagtgaatgtctagcatccattcacattctgtgggaacagggactggacaggcatacctcagatgctgtaggtttgcttccagactaccacaataaagcaggtcacaaattaaaaaaaa

SEQ ID NO: 684025 - DNA, 154 bp, Homo sapiens
agcgagagattggacggcgtggcggtttcagggcctggttaacgcgcgaaggcggctctagtggggccgcctttttcacactcgaggcgtgttgatgcacgccagcagctgggtgaaggccgcggacatctgctcttccggtacgcaggcaaat

SEQ ID NO: 684026 - DNA, 173 bp, Homo sapiens
gtcggttcaggtaccagtctgctggaaggttctgttcggatagctggtgctacctagctctgagcctgcttcaagaacacctgtagtcatcctctgattctctgtgtgtacctcttgtggcgttacctctcccgggtgtgaacatcctaccgttattgtgctaacccaagaac

SEQ ID NO: 684027 - DNA, 1983 bp, Homo sapiens
gagcagtcggagccgcagctgcctcccggagcccgagcccctccctccgggtccggcctagcccgcctgactcccactctgatcacctccacagcccgccgacctgagaactactacgcccatgagccttcgcggcgccggtgatttaggggacgctcctcagtgccccctgcgaccgccagagagaactacgttgcccctcagcccgagaggcgcgagtggtggaaaacctctccatcatactccgccctcgagacaccagccccctccatgacgtcttcagccgcgcgcccgacgtcggctgagacggccatagacactggcggctagaggggcccggacttgccctcccagctctaacttccgccggaagtgccttccagccgcaggcgcccttcttcttctgtgcgctcgggctcctggtcccggctccccggttaccggggcgcgagtatgaccacaatggcggccgccaccctgctgcgcgcgacgccccacttcagcggtctcgccgccggccggaccttcctgctgcagggtctgttgcggctgctgaaagccccggcattgcctctcttgtgccgcggcctggccgtggaggccaagaagacttacgtgcgcgacaagccacatgtgaatgtgggtaccatcggccatgtggaccacgggaagaccacgctgactgcagccatcacgaagattctagctgagggaggtggggctaagttcaagaagtacgaggagattgacaatgccccggaggagcgagctcggggtatcaccatcaatgcggctcatgtggagtatagcactgccgcccgccactacgcccacacagactgcccgggtcatgcagattatgttaagaatatgatcacaggcactgcacccctcgacggctgcatcctggtggtagcagccaatgacggccccatgccccagacccgagagcacttattactggccagacagattggggtggagcatgtggtggtgtatgtgaacaaggctgacgctgtccaggactctgagatggtggaactggtggaactggagatccgggagctgctcaccgagtttggctataaaggggaggagaccccagtcatcgtaggctctgctctctgtgcccttgagggtcgggaccctgagttaggcctgaagtctgtgcagaagctactggatgctgtggacacttacatcccagtgcccgcccgggacctggagaagcctttcctgctgcctgtggaggcggtgtactccgtccctggccgtggcaccgtggtgacaggtacactagagcgtggcattttaaagaagggagacgagtgtgagctcctaggacatagcaagaacatccgcactgtggtgacaggcattgagatgttccacaagagcctggagagggccgaggccggagataacctcggggccctggtccgaggcttgaagcgggaggacttgcggcggggcctggtcatggtcaagccaggttccatcaagccccaccagaaggtggaggcccaggtttacatcctcagcaaggaggaaggtggccgccacaagccctttgtgtcccacttcatgcctgtcatgttctccctgacttgggacatggcctgtcggattatcctgcccccagagaaggagcttgccatgcccggggaggacctgaagttcaacctaatcttgcggcagccaatgatcttagagaaaggccagcgtttcaccctgcgagatggcaaccggactattggcaccggtctagtcaccaacacgctggccatgactgaggaggagaagaatatcaaatggggttgagtgtgcagatctctgctcagcttcccttgcgtttaaggcctgccctagccagggctccctcctgcttccagtaccctctcatggcataggctgcaacccagcagagggcagctagatggacatttcccctgctcggaaggaagcctgcgtgctgggatcata

SEQ ID NO: 684028 - DNA, 261 bp, Homo sapiens
cagaggagttaccagactgcgagtcgcagcgaactgcttgatttcaccagactcgcccgtttactgtctcaccgccgcctgtaatgagattctcgggaccatctacatcagtgggaactgccctggtcatgttaatgatctcaaacaatattcaagtaattctatgtatatgaattataatccaaaaagcaataaaatacaatttctagcacaagtttactgtatattagcactgatttgaaatgtcaattggcataataa

SEQ ID NO: 684029 - DNA, 140 bp, Homo sapiens
gcccagcaaacacattcacattttagagccgacaagcacacttgattcatttggtggactaatccttcgatagttaatcagtcccgagctacaaccaatgtggtggtgagttgaactaaactaaaatagttgtgaggatg

SEQ ID NO: 684030 - DNA, 939 bp, Homo sapiens
tctccagagactcgactgagcctgtgtggccgacatgcgtttgacaaaagcacttttcccccgccgcgaatagtgtcgtggttgcaattgtgggtggacgcagcgcctcttttattaaaatgtggttccgcgcgccacaattctgtcgggaaggactcgtacctgggtgcccacggttgtttgaactgggcacccaaatgtaggaagcggggttgagccactccccgcggatggtcaaaaattctggggaaaaagatgtgtgaaaggccacgatgctgtttcttaccagacgaagatgtgtataggcgcgcccccctcttgtctacgctcacggcccctcctccttttaccccgcttggtcccttccccctgcccaagctagttttagtaggaaagcataagggggtgttattcatatggattgtaacttgcgctcacacaagaggggtgcccaaccacgcctctgatgccgcggtggccacgagtgcagagttcaccacctcacgccttttgtatacattccgccagtacaagtataatgctctcctgcaaaagtttgggtgagatgacaaaaaaattaaggtggagttaccacctctccgcgcccccccaggtaagcctccttgagaacaaacacgctcaagatctatcatgggtacaaaacaacggggggaaaaaattgagggccccacgacaattcctcgcaaaacactgtggtgtctatagagcctcgcctcaataaaagttattattttggaaaaatcataattcagcaaagatacttcgcccatcgtgaacctttctaatgagattaggtctgtccacgacgtagataggacagcgatacagtaggacttcatttggatgtctttgccggggtgatgtcccggtaacaagttcccccccattaaaaattccaaaggcccccccaaacataac

SEQ ID NO: 684031 - DNA, 442 bp, Homo sapiens
ctgatggcgctagaggccgcgttgccaatgcttgcagcgagctgagatgatgcgcctgtactcaagcctgggtgacagagcaggacctcatcgcaataaataaacaatgtaaccaaaatgcactggcataaggcacgactcgaccctgcctaagtgcttctaaaatcaaactgaaaagcacttcttgcattaaagcagatagcatgtgatgggagcgtcagaattacctgcaggacttttgcacatagaaaaagcagttgggaatgtgaatcaatagggctctttaccactgtattgcaacttggcttatattggctgtttcccaaaggtgtttataatatgcgtccatgagtaagtatattgcatgctgtaaatctaaagaacactgaagtcatgatctacattctgggcatggctcagccccttactaagagtacaggtt

SEQ ID NO: 684032 - DNA, 902 bp, Homo sapiens
  misc_feature (52)..(52): n is a, c, g, or t
  misc_feature (118)..(118): n is a, c, g, or t
  misc_feature (160)..(160): n is a, c, g, or t
  misc_feature (242)..(242): n is a, c, g, or t
  misc_feature (249)..(249): n is a, c, g, or t
  misc_feature (260)..(260): n is a, c, g, or t
  misc_feature (318)..(318): n is a, c, g, or t
  misc_feature (333)..(333): n is a, c, g, or t
  misc_feature (335)..(335): n is a, c, g, or t
  misc_feature (345)..(345): n is a, c, g, or t
  misc_feature (347)..(347): n is a, c, g, or t
  misc_feature (351)..(351): n is a, c, g, or t
  misc_feature (373)..(373): n is a, c, g, or t
  misc_feature (378)..(378): n is a, c, g, or t
  misc_feature (391)..(391): n is a, c, g, or t
  misc_feature (404)..(404): n is a, c, g, or t
  misc_feature (501)..(501): n is a, c, g, or t
  misc_feature (512)..(512): n is a, c, g, or t
  misc_feature (529)..(529): n is a, c, g, or t
  misc_feature (559)..(559): n is a, c, g, or t
  misc_feature (563)..(563): n is a, c, g, or t
  misc_feature (575)..(575): n is a, c, g, or t
  misc_feature (599)..(599): n is a, c, g, or t
  misc_feature (603)..(603): n is a, c, g, or t
  misc_feature (613)..(613): n is a, c, g, or t
  misc_feature (617)..(617): n is a, c, g, or t
  misc_feature (635)..(635): n is a, c, g, or t
  misc_feature (658)..(658): n is a, c, g, or t
  misc_feature (673)..(673): n is a, c, g, or t
  misc_feature (689)..(689): n is a, c, g, or t
  misc_feature (701)..(701): n is a, c, g, or t
  misc_feature (703)..(703): n is a, c, g, or t
  misc_feature (714)..(715): n is a, c, g, or t
  misc_feature (732)..(733): n is a, c, g, or t
  misc_feature (807)..(807): n is a, c, g, or t
  misc_feature (809)..(809): n is a, c, g, or t
  misc_feature (811)..(811): n is a, c, g, or t
  misc_feature (818)..(819): n is a, c, g, or t
  misc_feature (849)..(849): n is a, c, g, or t
agacctcaaattacaaaacatggtggcaggtgatacttacaaaaataaagcnaaggtctattttttacagattttttcatgtttccttcaaatctcagtctgtcctgtcattaaaaanatcatggaatctatgttgttcctcatgatggaatagtaaaanaactgcattccactgacaaaaaaaataactttgcttccaaatagcacaagtctttaaagtgacttttcccaacaataaatanaaaaaanagcctattaanaagcgtcttttagcttaaatcaaggttaaaaaaaaataaaaaaaaaaaatacatccanatcccactgcagatnanaaaaccccananagcntattccagattctcccgaagtntttgngtgcgcacagctnccaggcggggaantctcactggacggcagaaccactaagtccctcctgacgggatccacaggaatcttctcgatgtaccaggagcctctgcccatcacaggagggcaggnccatgtagaanagactctaacaaacctncagctggaaactggatcccttttaaaccanccgncaccacagctcngctcacccaccaacgccgtccgtnaagnctctctctgncccncacggtcagccaggttgncggtcacaccgaaggggtctttngcgggtgaacctacngcatgaactgcgggcncttcaccctagncntcctccgaaannaacctgctcttggcctnnttggatttgttcctacaaagaaggccagggccaaccattggctcccaggaaggcaaagacagggataggtctgncncncctcctnnttgtagcggccaggcatgatccctccaagnatatcccaggcgccgctctctccaggggacaagggcctcacttaagggcgatt

SEQ ID NO: 684033 - DNA, 1487 bp, Homo sapiens
  misc_feature (365)..(365): n is a, c, g, or t
  misc_feature (496)..(496): n is a, c, g, or t
caccatagctccgtcattgtacccatttctaccctccgctgggggtagtgccttaactgacttgacctgatccgagtactcctagagctagtagtacgaacctacgcacaaggcctcgctacacgtttgtcgtgcctcgcttatcgggcgtacttactaatcccgttcgacagtactgcgctagataacatatcgctttcacccacaagatgtgccgctaaaaaccacagcacgacaatctcaccatcatgccctcgtagcaatcaaccgagcgtgatcattacgcatctgcaccagtcgtttgcggttcgttacctgtcgaaaacgcctcgcttggctcaagaaatctccacacgacgcttcgngacgagtgcgtcgagagactcaacgccgtctcctagtgctcatgggcgtagcgctctatctcgtgcataaccacttgttgtacgtgtaacgtcgcagacacttgttgagtcaccgagaactcgaaagacantcatgagctgcccgtttgagcaactccgtaagatcggttgaaagcacatagcccaaacagagatccgacctaccagcacaatcttggctactatgcgcaactgtcgctcgcctatcacgactcatataccatagcaaactgaggtccatgtatctaaatagagtcagatccgctcattttgaggcgccaacggttctccttgcaaatctattcccctatatggctaaggtaagcaaagccatcaatgagtttagcaacgcggtgtcacaaaacggaagaaccccaatgggacaccgcctggatttatttgcgtccctttttaacgcaacaacctttagacaggcctgggccaaattgcagtaatcccccaccaatgggtctcagtggcgcttcgatcaaaggggggaaacgttgcaggaacgctgggctcacatcacggggcgccaaatacttggaggatacagagcctgttcccggccccgcttaattgcccacgccgtccaagaggggcccaccgggttggtcaattcaaatctcaataattagaacgcggcatccactctggttgacttctcccactcccagaggggcgcctctttttagagacaaactattcccccttggtgaacctttacgccaagggttcaaatgtgtctcgcacaagccttggacaccggttatattgagcaaaccctggggcgtcacctggtgtggggccccttagtgtggcaccggtattttctggacaataagccggcagttgccacacagttgcaattccgcgggaagagtgataaccacctaaagttacacggggcacagttgacagtatataagccgccctacccctcatagaaagaagctcaacatcctttcccctactgacaaagcagtatataacaagcactttagcgccactactaatgcacccagcaacatccattaacacttatacacaccacacagcaatacccatactagaaatataaca

SEQ ID NO: 684034 - DNA, 889 bp, Homo sapiens
cgtgacgcgtgggacaggttccaactactggagaaacagggtaatgatggaggcaacagtaaattcctggtatgctggagcacaaactcaactttgctgtagctagccgcaaaacctttagccatgaactttctgattttggcttggagcagcactgctggagagattcctgttgttgctatcagaactgctaaaggagagaagctttgtcatgcaggcacggagctcctcgccgctgatgggaaggctctggagcacggttcctgcacggattactttgcatggcaatcatgaagagatacctgaagtctgaacctactcccagagagcaaccgatgggccatgtgaaggtagctggctagcagacgaactctcgatgacaatagtgaactaatgaaaactaaagatgtgctgactcgaattaatatgcccctaggctgtggtcactgctaacgaacctggagcccacagctactacaccgcaacttgcgcgaaaagctcagcaacagacccaaatatcgtcatagccacgatggatgccacagccaatcgatgtgccttctccatatgacgtcacgagcgtatctcctaccatatacttctctccagccaacacaccaacagctaaatccaacgcaaatatgaaacgtgaccgcgacattaactgatacataacctatctaacaaagagacactacaaccacccatgtaattacacaagaacaaaccaacaaacaccaaaaacgcactacaaaacatctaagcgaaccaccaaaaaaccacgtggataaaggacatctacaacagagattgcacaaaccagcagacaacaccacacactgcaactcacaacaacaaagacaagggaacaaggacaaaactgaaaccc

SEQ ID NO: 684035 - DNA, 1498 bp, Homo sapiens
ctcgtgggcttgcggatcggtcatataaagggctatgtctcacctgggtggtgtgtttatctcacatagtatggtgcattaagtggctcctatcatatacggtgtacatctgttggcttcaaaccggcgtattatcttcggttatagtggtttatatggtacacgagttatacagaaatgtgtaactcttgcggctctcttctatctcatcggaatgtacctgtggctttcccatgtaatgatctgcgcctatatagttttatcgcgttttcttgactactcgtcgtagttaatatcatcgtcccctatggagcgtggtcaatagtcataggtccgaggttctccccatctttggcaagaggttacagacttttcggggcgataattaagttgaggctacctgtggtatttgctatcaggatattcgtttcaccccacaccggttgccaacctaacttcccacacttagtgaacctccccactttagaatagaggctgtgctctactcctacctcggtgtttctagctgatacccgtgagagggtcgcggggtgatatcatttgccatggggaactatgcttccatggagtacagtacgtttggaacagaagcttgttttccgcttgagactaccactggtagcactgtagcacccaatttgtgctttcttctttggggctgtcagcgctcatttgtttcggctctgcatgcttgggttattgacccttcggccgtcatcgcgtcttttccaatccgccttttttaaagcgtctaggtagcttatgtttctttgtgtaaggcaacctataggcttattattaattcactacggtaggcctaccctcgggcgtttagtcatgaaaggtaatttgtaagcgggcctggggtggtgttctgggggggcgttaagtaccccctagcctcgctatgtgttcatctggtgctcaataattcgccaggtaaggctctggaggtgtgaaagcactttttagggggctctggatagcatatcgctctatacacaggatatatgcacttttcggcaaactaatgttgattgtatagatgattagagtttgttatattctacattattatcttacattttctctctgcgattagtcataacctaggccacgatcactgcataacagtgatggtaacggtcaggacagtgcacattctgcgtagatagcttagggctagacgtagtaggttgctattttagcgagcaatttggatgggcccacggcttcactctaggatcctgcgtgggcttgtgtacctcgcaggagcccttcttaagtatcttttgtacgcttttcaccccacccccaagtcctgggagtaatgccaggcttaccactgagacatgggagaggccatagatatgcttgacagataagggtgattttgaggctctagttaatcatctccaagaattgttaccgtagtcaaattaactcgtatttagagtatttatctccggtggtgcga

SEQ ID NO: 684036 - DNA, 192 bp, Homo sapiens
accctagtccaatctaagtaagtcatctctccctgtctgtcccctgaagccctgagctagccagtgatcaggggaacaccggatggttcctctctcggggatggggggccagaatggaacctcgggggtgacctgggcctggggtcccctgcccaatagagtctgcctccgggcaggtactggggaaactgg

SEQ ID NO: 684037 - DNA, 665 bp, Homo sapiens
  misc_feature (7)..(8): n is a, c, g, or t
  misc_feature (38)..(38): n is a, c, g, or t
  misc_feature (40)..(40): n is a, c, g, or t
  misc_feature (49)..(49): n is a, c, g, or t
  misc_feature (56)..(56): n is a, c, g, or t
  misc_feature (58)..(58): n is a, c, g, or t
  misc_feature (251)..(251): n is a, c, g, or t
  misc_feature (257)..(257): n is a, c, g, or t
  misc_feature (261)..(264): n is a, c, g, or t
  misc_feature (269)..(269): n is a, c, g, or t
  misc_feature (274)..(275): n is a, c, g, or t
  misc_feature (280)..(280): n is a, c, g, or t
  misc_feature (283)..(286): n is a, c, g, or t
  misc_feature (338)..(338): n is a, c, g, or t
  misc_feature (343)..(343): n is a, c, g, or t
  misc_feature (345)..(345): n is a, c, g, or t
  misc_feature (452)..(452): n is a, c, g, or t
  misc_feature (455)..(455): n is a, c, g, or t
  misc_feature (486)..(486): n is a, c, g, or t
  misc_feature (634)..(638): n is a, c, g, or t
  misc_feature (640)..(642): n is a, c, g, or t
aagaaanntaatatttattaataactgaaactgtttgncnccctttggnatatagncncgcatattatattatagcaggccaagataaaattttgacagctctttaagcccacatgcagcagtgggtcagataaccctgtggcagtgacacgggcaaattggcatttgaataaagccctgggaccacctcaacatgcgtagcctcttgtcttaaatgtactccccatggcagcatggaggaggcaagaccngtgggncaannnngaacnggccnnacttngannnntaaaacaagagactcagggaaagtactaaaccaaaatctctgattttacttngcgtntnctgtagtttttgttttactgagatgcttttgtaaaggaaaataatactgtgacagtttagtaattctacagattcttaatatttctccatcatggccttttacttcncanttttctgaagtctgaattcaattacaatttnttttttaccaatttaatctcaaatgttgtttaactgctttaaattcatatacgtagagtattataaactgcagagatgaaaaatgtgttttcacgggatttatattgtgaactaaactaagccactttttggacttatttgtgatgcnnnnnannnatatgtgtataagttgtttaaaa

SEQ ID NO: 684038 - DNA, 475 bp, Homo sapiens
cagaaagagtctcgctctgacgcccaggctggagtgcagtggcgtgatcttggctcactgcaagctccgcctcctgggttcatgccatttaggctgaacttatgtgaggaggcagctttaggctaagcttatcactctgaattctcagtggcatgtcggagtttgcaagaaaggtggatttcccattcatgccaactcctccagcatggctacagatcgcggctcatcaacaactcacacgttcctcccaggtgttagggcaggactcagaactggaggtccgtgcactggctcgtctatgctccagcctagaaatgtccccgaggcatggccagagtcctccaggctggggagcagcggaggccaggccatgccagatctgtcgtctgggtttagcttcgttgcagtgagtgtttacagctgagtggtgctctggtgaccgttgctctacaatgatccctctggcagctccacg

SEQ ID NO: 684039 - DNA, 383 bp, Homo sapiens
tgtagccttatacttcgtttctggtaacagcctctgacgataattctgaggggtctgctactcgtgggaatcgtggtgtctctggggtttcagttggccctattgtttggtgagggaaaccatagtgaacctcagagaggattcaatagtaataaaaacaacagaaacaagattcatatttccacagctgttttcttatttggagtctcataacaaccctatgaagcagacattgtgatcatgttttacagaggaggaaacgaggcctcaaagaggttaagtatccccaaagtcgtatagctagaaggtggagtaaaattcctggcataagataatcagattgcacaaggaacctctaaatctaacttctaattcccactggg

SEQ ID NO: 684040 - DNA, 133 bp, Homo sapiens
cacacgcacgttaaaggtctgacttttattccatcatttacttgaccctcctgcctcctcttaaaatgaccttgtgattacattgatcccacatagttaatcctggttcaactcccttctccggtggcgtggt

SEQ ID NO: 684041 - DNA, 428 bp, Homo sapiens
taagtgtgacagctcctagtctggaccacccttaagaggagcttaaagaagggtggcaacaggccagacgcggtgctcacacctgtaatcccagcattttgggaggccaagcgaggcggatcacgaggtcaggagatcgagaccatcctggccaacatggggaaaccccgtctctactaaaaataccaaaattaattggccaaagttgggggtgcctgtgatcccagctacttgggaggttgaggcaggagaatcgcttgaatccaggaggcggaggtttgcagtgagccgagatgatgccactgcacaccagcctgggtgacagagcaagactccgtccggggaaaaacaacacaggcaaggttcgcaagtttccgggaggtgttaaaataacctaggatagcaccaacattgagactcgttggcaa

SEQ ID NO: 684042 - DNA, 1159 bp, Homo sapiens
ggtggctcacgcctgtaatcccagcactttgggaggcccaggcaggcagatcacaaggtcaggagatcgagaccatcctggctaacacagtgaaaccccgtctctactaaaaatacaaaaaaatgtggcgggtgcctgtagtctcagcctcccgagtagctgggattacaggtgcccaccaccgcgcccagctaattttttaatttttagtagagacagggttttaccatgttggccaggctggtcttgaactcctgaccctcaagtgatctgcccaccttggcctccctaagtgctgggattataggcgtgagccaccatgctcagccattaaggtatttatgttaagaactttaagtttacgggtaacgacgacatgacacgatgatccagaaaaaatgcacgcaacgtccacatggccgattcgccggacactggttaccgacctccacttccttaggtataggtatactatgtcactgaatgcaacatactacaacaatatgcggcataaaaaaactcgatgacactcatctgaggcaatcaccaagggacgaagagagcccataagcgcagactactaacatctacaagcttgggacatatcatctcttcccccaagttgcaacacaacaaccacaccacacacccgccgcctactcctcccacgcgtgcgcaaacacgaggaaatgacaatgcaaccagaaaccacacgactccgccccacaccccactgcacaaaacggcaaacacgccgaaccccaaaaaaagcacagaaaaaccatagcaacaacccaagacaacccgcgcaaagcaacacgcgcacaccacagcagaaaacaacacaacaaacacacaacaaacacaaagacaccacaaaaccgacaacccaacacaaaagcaaggcaccacaccaggcgacgaccgagcggcggaaacgaagcggagaggcaccagcacacggaagaggggagacgagaccacaagcaacgccgctcgaacgccggacacccgtcgcctcgccacggcgccgagacggccgccagacgatccgggacacgcgcaacagccaccgcggggagaagaaaggtagaggcggcgcacgacgcccagcagacgagagggagaaaaggaagcagaacgacagagagtgagcaca

SEQ ID NO: 684043 - DNA, 1324 bp, Homo sapiens
  misc_feature (188)..(188): n is a, c, g, or t
cgacaaaattagcgcctcctctaataaaagttaatttaagctcactacattactagtcgtacctcccgcatcccctagtccacagcgatcagtccgacactgactgaaaacttcgggcgtcacgtccattgaggcgtcctgcctctgagtctcgtccacagattcaccaccagggacctattcctagnccattgcatgctactcaccagactgccatcaaccgacatttgtcatcaaatcgctccacaatcactcgagacgtagaagttatgagcatgagatcatccggcgtacgcttgcagcagccaatgggcgccatcaactaattctttaatgcgtgcgctctttccttagcagcagtcggggcggaggggcctactaattaacgggattcactgtgtcttccttaactcaagatagaccttgaagacaacgatccgggcatttagttcgcttccattggcgttagcaaagcgtaattaaggccaaataagccctttcagtacgggctaattcgttccttcccccagatgagggggccaaaactatttcaattccgtggaaggagagctcgcgcaagtgaatttcacagatatgcttaactaaatgccagcctagtcccaatagcatttggggacagacccgaagttcaaatcgagctcatgacggacgcgctaactccacgtgagcaccatgtccccaaactcgttcgcacatggattcttttaggccgtttttgcactttcagtccttaacccgttctagttacattggccaggccataaagcgagggacatccggggcgtcctgaataccttggcgacgaagaacggcgattccaaacggaatccgccctaaggaattcaccttccaaattccgggtgtgaagtcgccctgttcagccctttctcacacagattcacaggaggagccccccgggggggaaaaggtactctatctcactgttgttcccctaatgtaggggtttaaccccattattctcccgagcaccctttgatggcgcagcaaagataaacccctgcagaacgcgctgagtaaccccctccctagacccgacgtgaatgtacactgatgccaacaactttgcgcgaccctctaacaacaacagatcattcaacaacctaaatcactcacatccaaaagtcatacctcatcctctaaaaacaatctccctaccccacctattccttccgcccacacattcatccacaacgccacctaacacactcatatcactaacaacaccacaaaaatctttctcgatatgctctcagcaacactcccatcacaccacacaagagaa

SEQ ID NO: 684044 - DNA, 105 bp, Homo sapiens
tgttaacttttaacaattagaaaaaaatgactgctttataataaactcttctgagttaattattcattcggaaatgtacagttttaactccttaagtttactatc

SEQ ID NO: 684045 - DNA, 114 bp, Homo sapiens
atgccacctcctctgtgctgtccagtgctgtcacctccatctgtgctgtccacctcctctgtgctgtccacctcctctgtgctgtccagctgtccacctcctctgtgctgtcca

SEQ ID NO: 684046 - DNA, 1424 bp, Homo sapiens
gtatattctttttatttttacattgaaatcaccttggcaaatctgacaacatgattatcagaattcagcagagaatgatgtgtcaatcaatcacacatctactttcttgttttttattgttattgttgttgttgttgttggcggtggtggtggtggtggtggtggtggtggtggtggtggtggtggtgtttgagacagagtcctgtgtcatttgagacagagtcctgtgtcatttaggatgaccttgaatgtgtgactcactcatcctgcacctcccaaatgctaggatggcaggtaggcacaatcatgcctagcttcatagggtgcttagggctgagctagggccttgtgcttgttctgcaaacactccgccaactgaaccacatcctcaaccccataaggacattatggagaagagaacctgccacagaacaagatgctgctggttttctggtgccagatgaagaaaaggaatgggcggtcacgacagaaccttggctctattctgcagctccgggtattcctgatcactgcagtggtcgcagctgcttcggtgccttcctcattaacctccacaaagcacttgtgggcaaccttggacacaggcacattcttcttacttgtcatcccagagaagtcagcctttgtttcctcaaaggcatctgtcattcccaaactctgaagaacagtttccaggtcataactttcctccagctttaatctggggaaaaagacttgcactttactttctgtcagggtttctgggtttgtccaagctctaagcttctcatatgtaagtgctttctccaccacagtgagatcagagctctcatcaggaaggagaacgaccatgctcagctcgtcctcagcatagggcagagccagaacctgcgcgttcacctcatccacatgtgccatcttaaatttagcatgcttgaacatcatctggactgtcttcttctcctcctggttagttttaaagggcatgcccctcgtgtacttcctgtcaaactgagccttccacttccctttgaaatacatggcattaacaagaaccagcttagtcagtgggcaaactgttccaggactcagaacttcggaaattttaccttcagttttttccaacacccagtcattgatgcgtttcctgcacccttcagtgtctttaacaaaggacatctcttctatcccagcctggtagaacttctggcaggattccttgaaggtcgaaaggaaatcacatgattcctctccactggagcccccagctttgtaatcatgtgatcagtctgaatcattgtttctgtcacctgacttttcagctagtgtctggagccctctgaactccagcgtaatctctagggtgcccacaccatcaagactccccccagtggtttacttgcaaaaataaaagctgcagaagc

SEQ ID NO: 684047 - DNA, 343 bp, Homo sapiens
gaatttgaacttggttgctctagatatcttctaaccgaactcagctcattaaggatacagattcctcagggtgaattagtcccctctgcaggtcaaccttaaggttccgggccacgtgaaccggttccatagcttgaacctctctctccagaatggatacacacaaagtagtcttttccctatggtcctcgttaacgcagggagaagacgcggcccaaggcgcagttccgccgcttgctggcaaagctcgttgagcgcgcacgtgcttacagcacaatgtagagcgcgcgtagctcctacagcggcgcttacagcctcgctacctctctcaacagcgccagag

SEQ ID NO: 684048 - DNA, 95 bp, Homo sapiens
cgggaagcttatttttggctccaaacattctagctactgctcattttaattgtctgaattccaggaacatgtaaattttaacctataatcagtct

SEQ ID NO: 684049 - DNA, 756 bp, Homo sapiens
cgctgcagcgggcctctgcgtgggcggcgggaatccgcggacgatcgggtcgggtctatggctcccgatgtccgcgctcctgggcgggagcccttgtctgggtctcgcggggtggctgccagatgcgtaggccacactgacctagttccttcttgtcgccttttccgcagcaaactggcgtgatgactggcctggtgcagctggggcggtgcccggcgggccctgggtggccctggcgatggggaaccgtggtggcttcgcgtggagcgtttctggccagtggcatcctggggtcgtgggctctgccgtggcgtgggacgagggtccgggggaccggacggtccgcgggaagtctcgccgagatgcgcaaggctcgaggtataacggtatgtggatgtcccgttcacacacagtatggtgccgtgttgggtcaatggacatgaaagcatcacaggtccctggagggtagatctatctctatactccgcgtgcccattagaggaatcacggagatcattgattctcttgcctgggggttctctctcgaaggatgaggttattgaagattgatgccagtgcataatgcagatccgtgccggccagcgcatcaggttcactggcgttatgtgtgctatcgggggactacaatggccacgtcggtctgggtgtgaagtgtgccaaggagtgtggccacgccatccgtggggcatccttctggccagctctccatgtccccgtgggcaagggtatggggga

SEQ ID NO: 684050 - DNA, 217 bp, Homo sapiens
gggaagtcccagctacagtaagctgtgatcacaccactgcaatccagcctgggtgacagagtgagatggatcaataccagagtgataaataccatcacaataatacaggaccgcatagaactttaaaggaagttctgagtaagaaaagcctttctatgtactgattcaaaacccaaataaatataaaaagaatagaacaataaatacaagctcaata

SEQ ID NO: 684051 - DNA, 761 bp, Homo sapiens
  misc_feature (24)..(24): n is a, c, g, or t
  misc_feature (431)..(431): n is a, c, g, or t
  misc_feature (443)..(444): n is a, c, g, or t
  misc_feature (457)..(457): n is a, c, g, or t
  misc_feature (459)..(459): n is a, c, g, or t
  misc_feature (468)..(468): n is a, c, g, or t
  misc_feature (474)..(474): n is a, c, g, or t
  misc_feature (481)..(481): n is a, c, g, or t
  misc_feature (488)..(488): n is a, c, g, or t
  misc_feature (507)..(507): n is a, c, g, or t
  misc_feature (520)..(520): n is a, c, g, or t
  misc_feature (523)..(524): n is a, c, g, or t
  misc_feature (526)..(526): n is a, c, g, or t
  misc_feature (528)..(528): n is a, c, g, or t
  misc_feature (531)..(531): n is a, c, g, or t
  misc_feature (539)..(539): n is a, c, g, or t
  misc_feature (546)..(546): n is a, c, g, or t
  misc_feature (567)..(567): n is a, c, g, or t
  misc_feature (571)..(571): n is a, c, g, or t
  misc_feature (573)..(573): n is a, c, g, or t
  misc_feature (575)..(575): n is a, c, g, or t
  misc_feature (582)..(582): n is a, c, g, or t
  misc_feature (584)..(584): n is a, c, g, or t
  misc_feature (588)..(590): n is a, c, g, or t
  misc_feature (592)..(592): n is a, c, g, or t
  misc_feature (607)..(607): n is a, c, g, or t
  misc_feature (612)..(612): n is a, c, g, or t
  misc_feature (649)..(649): n is a, c, g, or t
gggcaagatatgcaggtcgaggcntgtttaattggacgaggcgaggccagcgttccccgggactcgctgctcaagttgtctattgcctgccgcacatcatcctagcagggccccgtgcccaccaggcggacaaaagcggtccgtgaacaccatgcggccgctcgggtgccgccaggctctgtggtgagcgccgccaccccgcgccaggtcccgcgagcccgctgccggcacctcgccctgtcccagctctactccaggccccgtccgcccgggggcgccgcccacctggccttcgctcgggccgttggccgtctgcacccagaccctgagccgggcgccgccggccatggaggtggcgccggagcagccgccgctgatggcgcacccggccgtgctgaaatgcgcagcaccccgattcacaccacccgggncctggcgcacanntacttggaacccngngcagttgtngcctcngagacgnaggtggnccgtcttcttcaatcaccntcgactcgcaggnganncncntanttatgccnaccccgnttcacgcgcggggcgcgggtntcanangncccgggncngccnnncntgacgggaggccganttgtncgcccacatttgtggccagccgtgtttgccctgctgnacgggggaaagagccctttgccgtgggcccacaacaaacgctggcggggccgtttcaagggagtgacctagtggggcctggccctttgtccgggtgggtaggggcgccggca

SEQ ID NO: 684052 - DNA, 601 bp, Homo sapiens
  misc_feature (547)..(547): n is a, c, g, or t
  misc_feature (549)..(549): n is a, c, g, or t
  misc_feature (551)..(551): n is a, c, g, or t
ctttcctttcttttttgttcctgttctcttttgcttctttttttctttcctctgttctttctcttattcttctgtgttcctctttccttttttttctttctctcctctttttttctttttcctctttcctttttttctcctctttccttttgctctccttcttctgtttttcctttgttttcctcttttttttcttctccttttttctcttttttttctctcttcttttcttcttttctttttctttttttttttttctttcttcttcttccctttttgttttcttgctttttttttcctcctcctctcttctttctttcttctctttccttatccctttctctttctttgtttctttttcctcctgctttttccttctttctcttattttcctttctttttccctggtttctctgtccctttttgtttcttcttttctcgtctgtcttcccttctttctcttgccctctttgcttttccctcctttcaaatttttttcctccttgtctcaaaattttttcctctatttgtgtccctgtcccagttntngntagtctttcattgggggggttttggtgcgcttttcaatgtttttcttttt

SEQ ID NO: 684053 - DNA, 325 bp, Homo sapiens
ggtaggacagtcagcatgcgagagcacctaggcggtgagaggagggggccaaggccttattctgatgtggcccagctccatctttcactcgggggatgtccagggtcacaaattcccccaaaccttggaccacgaacagattcaagcaggaaaaccagggcatgggaatgttgaaataagcctgaaatacactggatgcaggggcttagatgatggcaaagaggggcactcaaaaacggttggtcagtaccggggttccttctctttttcctcatcctcctttcggctcagacatgccacaaccagatatggtccccagcaggaa

SEQ ID NO: 684054 - DNA, 132 bp, Homo sapiens
taagcgaacatgcggcgcccagaggtacggcggaggaggaggacctgatcgagtccaccgctcctaccgagagctcttcgagttcttctgcaacaacaccaccatccacggcgccataccgcctgtgtgtgc

SEQ ID NO: 684055 - DNA, 170 bp, Homo sapiens
gatgcgcgatggccaaggattgggtgcaaggggaatgactgacgaatcttcgaaggaccctttgaagaatgcatgaggatgccagacaattggagggaatgactgattgattcaagaaaggctgttgaaagattgaacttgttaattacggaaaagccaagacccctggg

SEQ ID NO: 684056 - DNA, 162 bp, Homo sapiens
cgtgacaattgaagacatggaattaaattggtatgtctctaactgcctcttagtaatcaagagttcctgcttggcaaaacctcatgaaaacagatttaggatttaagacagtgtcagtaaattagtacaagcccatacacaagtcctcaaagtgatggacaa

SEQ ID NO: 684057 - DNA, 804 bp, Homo sapiens
tacctgactttctggcccaacacggcatcgccatgtctccgctcagcaacaacagcctcttcctcagctatcaccggaatccgctaccggagtacctgtcccgcggactaatggtctacctgtccactgatgatcccttgcagttccacttcaccaaggtaaagagccactgactgggacccaactataccaaggaaggccctgaggggaatgactttctccggaccaatgtgccagacatccgcgtgggctaccgctacgagaccctgtgccaggagctggcgctcatcacgcaagcagtccaaagtgagatgctggataccatttcagaggaggcgggtatcaaccatgagcccaaggccttaatgagcctgattcatgaaatgcccaccacattacaacacttttaccacgttttgtcctcagactccgcccatgctgtgtggactatgactgattcaatcttccatgactctgattgcatgttttctaccaatgtactgttcctgggcctacatgagaagacaagcctgggaatctgctattagggatatggctttggttttgagcttggtggcctagctttgaaggtcctcactgttaatgtcttgatccgtgatccttaaaactaattgtcttctgactattttgtgtcatatgtgctttgtagtgtttcgggttactgttacaattactattaagttctaattgggaattattaagttgaccagaggcgaagtaatgaccatattttttctatgatccaggttagtggggaattttcatttttcgatggcatggctg

SEQ ID NO: 684058 - DNA, 268 bp, Homo sapiens
ataacatccaaactgttcccattttgcatcattgtcattctttggcacaaagattctacatagccatgggttaggaaacaactgttcactcatggtcttcattttttttttttttttggcaaaatccatgtgtttggtaaaagaaatactgcactgggctgggtatatactacccactaattataagtaacgacaaatagtatgaccttctctttggacctaatcctactcctaaagcccttgaagtggccgtaacaatcttcttaca

SEQ ID NO: 684059 - DNA, 151 bp, Homo sapiens
ctgcgatcttaaacattggtccagacaccatgcgtgtacactgggctccaccccatcgcattgatttaagccaatcgttcactggtgcgtgtactcagcctgtgaaaaatgacggaagatgtcgcagatgttgtcaagtttctcctgtcag

SEQ ID NO: 684060 - DNA, 228 bp, Homo sapiens
ctctagagtatcccctgtctatggctgcaccctttatccctgctactccgaatgctgaggcaggagaatttgctcatgtccggtgagttcaatggtctgttgtgagctatgattgcatccactgcactccagcctgagctgacagagcatgaccctgtctctaaaaaataaaataaaagatatgtacatctatgtctgaagactgtttgatacattataagagtaagt

SEQ ID NO: 684061 - DNA, 1868 bp, Homo sapiens
  misc_feature (176)..(176): n is a, c, g, or t
  misc_feature (510)..(510): n is a, c, g, or t
gtgtaagtgcggtggggatggaggctgggagtcgtgagtcggggacgactctgtcggagctgcgcggtggagcgctcgcttggtcgtggacgtggcttggcgtgtcgtctccggcatgcagctgtcggtcgtgctgctcgcggtgcgcgcttcaccggcctgtgtcacctgggagnatagggaggtgtgtcgcaggacgtgcagccaccagtgagtcatcctgcgctgtcacctccggtcacgaggaacgcccagacaacaagacatagcattcatacacatctccttgcacatagtcatgcatttgttttgtctcgtcactattgcgctcgtagtcccacattcacactcgcgaggggcacactcgactcttggattgcacgttgttgggcattgaaatgcagatcctcgtagtggtacccaattcttcaggtgacacacttctctatatgtcgctcgtgtgttgagctggaagccacaggtgacacggtgatacgccaaaatgccccncccccttaagggttggcataccctccggttcaaattcgatggctaattctacaatttctggttccccctcttggagacggcatacaatccctattccaggacaaggtggcaacctcttgcgcccgttcgcctcggataccttttcccccgggtaacgagccgtttctggcaacggtgacacattctatctactaataatggccttagtgttaccccgtgggaggacgagggttaacgaccatttcctaaaggttccttttcctcccaaaaagacggcagatctccttccacattttgtgtgccacagttgaaaacctccattacggggttaataaaacttctggaaataccttatttccggcatttgccggaagcgaaaacactgggccatttcgaaccaccttggctttctgtggggcctttatttttgcgctgacgagcacaacacgccctttttaagaggccgaaaaatttctggttccacccaaccacggggaaaaaacccggctttgggggcatgtgggcacgagatatcaccacccgcgttgtggacaggggggatttacttattacccccctctcctgccgcggagggggggtgtgggcccacttacatggggaaagaagtttccgcaaatagggtgttgtgccccacaaggaaggatatatatcccgaaagagaagcacagacggggcaaagggggaagagagcaagcacagtggaggcacccgcccctcttttactacgtgtgtggacactcttcgtaagcgccggaatgaggaggggtgcaaatctgcgcgggacgaagtttgtggtcgtttcactttttggaaacccgagtttgtgaccaacagcacgcacactctcttggcaaactcgaggtttcctccccccgtagtgtgacctaagcatttggcttttggctgatgcgagaccacgcgaacacgtttagggacgcaattgttggtgggaaatggctcccattaataaccccacattctcacagggacagccggtccgatatcgcgttgaggagagaactatggggtggtttgaacaaaggcatttggagttggttgcccctttgtggacatccaagctggctgtgtgcaacgtgtgcaacttgcccgcccccacggtttgtgctaaagcggtacccagatgacagtgttaacaacatgtggctagtgttggtggcaacaccacgcggtaggagggttattatcccaatcatcgttattggttgacgacccaacaatctggctgcacagcggcttgtgtgcacaccaccctcttttggggcacagtttgtctgacacccacggtggtggttatataccattctcatatagagcag

SEQ ID NO: 684062 - DNA, 572 bp, Homo sapiens
  misc_feature (169)..(169): n is a, c, g, or t
  misc_feature (222)..(222): n is a, c, g, or t
  misc_feature (300)..(300): n is a, c, g, or t
  misc_feature (372)..(372): n is a, c, g, or t
  misc_feature (405)..(405): n is a, c, g, or t
  misc_feature (525)..(525): n is a, c, g, or t
  misc_feature (527)..(527): n is a, c, g, or t
tctagcaagtaaaaagttcttgttacacatcacagcaactctgtcaatattttcttgtgccagaattgttattatgcagccttcatttgggctggtttcatcattttgcgctgtaaaatagctttacagtgcattgctacagcccgaagaacatatatatatatatttnaaaatatatcggatagtcatatacaaatgagcgaggcatttgttgcaacttantacatagcatataccccaagtcactgaagaaaatcgccggcattagtgtgcagcaaatttgttcttttggtttcatcncaaacagaagtgcctcatcataaaaatacatttggttttcaaggtgccctattgttaaaattagataacttncgttgaataaatgaatgtgttttatcggtaacnaatttcattacatttaccagttttaacacaggtggatacagaacttcaattctttagtcattccaggtggatctgagttttatattcaaacttttgatacagtttttgagttttgcgtgncntgaatttttaatctttctgcaaaatacataacttaaatgaacata

SEQ ID NO: 684063 - DNA, 90 bp, Homo sapiens
tcgttttgcacggctcagtagaaacgcagtcccattcatattagacagtgtacaaaactgtcaataaatgtgtacagtgaattgtctttt

SEQ ID NO: 684064 - DNA, 447 bp, Homo sapiens
  misc_feature (43)..(43): n is a, c, g, or t
gtttgtgtaatataatcctttatttgcttacctgaccactttnttataagctgttttgtttaaaagcttttggttatagggcatgaatattgttttgatggttaacttcacatgacttatctgtaagtgtcattttatagtactttacagttgtcaaaaaaaatcttacatatattgatctagttgatcggtagaggaagcttgtgaagtaggtaggacaggttatgatgtcttctctgtatggacgtgaacccagggttttaataggttggcttgcccaaggtcccctcccagcttgtcaggtagtaataaggctcaaagtattacttttggttcaagcgtctcactcatcaattatagtatatattcccgaaaatgttagtattgacaactcagtttatctcttacatatcattatgcttattagtttccctccaaaaaaaaaaa

SEQ ID NO: 684065 - DNA, 484 bp, Homo sapiens
  misc_feature (284)..(284): n is a, c, g, or t
ccgagggtttccccatcctttatttattttcgtaaaatttaactcagccttcctcacttagtggggagggatccttcaaaaggaaaaaaaaaggcaagtcccccaacccacggcccggggttcaggctaaagctgtggggaggggctcccgttttctcacccaaaagttttcgcctccccattcttgggggccctcctccaggttagatgtaagctgtccatacctctcccccccctttttcatttgggcttttttctctcgtaataaaaaagtggggagccgntggggcaccaatttttaatcccgggtatttccccctctaataaatttcccccatcccaggaggagttttcaggcctggggtggggccccgggtgggtgcgggggcgattcaacctgtgtgctgcgaaggacgagacttcctcttgaacagtgtgctgttgtaaacatatttgaaaactattaccaataaagttttgttta

SEQ ID NO: 684066 - DNA, 223 bp, Homo sapiens
gagggggggtttgttaaaagtccataggtttagtcaaaaagtctcgcttttgaattaaaaaaggggaaaaataaacccaccctcagagaggtcagaccagggagatgccaaaaaatcaggcttttggggaccctgtcaaacagcttaatcaagtttcttttgaggccagccccccctttgccctttttagtcccccgaaccaaaaaattttttttttttttta

SEQ ID NO: 684067 - DNA, 239 bp, Homo sapiens
ctttttattattacaataaacattcctgtgtatatgtttgtcaccatgatggttttacgtctgcggaatagattccctggagtaggattgctgcattgaggagtatgtatatttaactccctaaataactattgacagattgtgtcaaaagtggccgttacagtcttatttccatcagtaactgtataaacacactgttccctgaatactcatggcaataactattgtcacattaagag

SEQ ID NO: 684068 - DNA, 226 bp, Homo sapiens
ccattgaagagcttcctcagcggtcgggctctttgggagacgctgacttagacatgagggcaaggtgaagagagactttaacgatgcttcttcaggggcgtccaggggcagaaaaagtccaccagagatcttagatatgaagcggcttcattattaattggggaactctcagtttcccctctttggtccccgggatcagtccttcaatctcattcggggtacggag

SEQ ID NO: 684069 - DNA, 198 bp, Homo sapiens
  misc_feature (86)..(86): n is a, c, g, or t
ggtattgagtggcatgtgaggatctctttcccccttgcttcacatgattgtaagttctgaggttccccagcatgcttctatgcagnctaagaactgtatgtcaatcaactcttctttataaaattacccagtctcaggtatttcctacaggcagtgttgagaacagactaatacacctgttaaattatgactgcctta

SEQ ID NO: 684070 - DNA, 725 bp, Homo sapiens
  misc_feature (47)..(47): n is a, c, g, or t
  misc_feature (68)..(68): n is a, c, g, or t
  misc_feature (95)..(95): n is a, c, g, or t
  misc_feature (171)..(171): n is a, c, g, or t
  misc_feature (175)..(175): n is a, c, g, or t
  misc_feature (194)..(194): n is a, c, g, or t
  misc_feature (258)..(259): n is a, c, g, or t
  misc_feature (265)..(265): n is a, c, g, or t
  misc_feature (293)..(293): n is a, c, g, or t
  misc_feature (308)..(308): n is a, c, g, or t
  misc_feature (323)..(323): n is a, c, g, or t
  misc_feature (338)..(339): n is a, c, g, or t
  misc_feature (341)..(341): n is a, c, g, or t
  misc_feature (348)..(349): n is a, c, g, or t
  misc_feature (360)..(360): n is a, c, g, or t
  misc_feature (365)..(365): n is a, c, g, or t
  misc_feature (382)..(382): n is a, c, g, or t
  misc_feature (400)..(400): n is a, c, g, or t
  misc_feature (405)..(405): n is a, c, g, or t
  misc_feature (447)..(447): n is a, c, g, or t
  misc_feature (456)..(456): n is a, c, g, or t
  misc_feature (470)..(470): n is a, c, g, or t
  misc_feature (474)..(475): n is a, c, g, or t
  misc_feature (495)..(495): n is a, c, g, or t
  misc_feature (504)..(504): n is a, c, g, or t
  misc_feature (510)..(510): n is a, c, g, or t
  misc_feature (519)..(519): n is a, c, g, or t
  misc_feature (550)..(550): n is a, c, g, or t
  misc_feature (558)..(558): n is a, c, g, or t
  misc_feature (675)..(675): n is a, c, g, or t
gttggcaatttctgagttcaagacataagaacatctcccattaagcnttatgttaaatattacaaagnttatacagtggattggctcatgggggntgtggagctgatgtcttgagtaactcacccctgatatgggtgcaggttttttaaaggctatcctataatctttttnctcntaaaataactgctcccttnttttcagtgttcccattcttgcgactggggactctgggctggcttaacagttttgctagtgagnncggacnattcttcttaacaaaccaaggatataangggggacccggtaangggcgtgcttttcanggttgacaataaatnngngtgcggnnggtgttcgggnggggnatgtggtgtgggggctncacttgggtgtttggcgngggtngtcttttgggggctcgccgggggtccctgccgttgcgtggtngtggtgctncactgtttggtttngagnngttctcttggagttgtgggnttgtgagtncccggncattgcttntgccagcatgtgaaaactggtgttcccttgnttcagggncagtgtgaacaccatttcctgtacccatattactattcatggaattattcttctgttcactctgtgcccctttgttctgctgtcctcgataatctgggttgggttcactgaaatttngcacttctgaatataccatacaaaattccccatttttttgtagttcacca

SEQ ID NO: 684071 - DNA, 686 bp, Homo sapiens
  misc_feature (471)..(471): n is a, c, g, or t
atcaacaggaccacctttgatcacgattacaaataaaacacatcccgccgtgcataggtgctgcaacccaaaaggtgcttaaacaccaaccttccccccatcctcctccgccgttatcacagcctcgcattgcccaccccccacccccccggtccatatcattggtacatttgtcactataatagacccgggtgttttcaccactacattcttgccacacgaccaggtctgttccaagcatttccttacacctcctcaattcgaacgccatactcacccagtgggcgctccccccccacacagactggagagatcattcacctacggctctagcccaccaccacaaactcgcgccgccatctattctcttctacccactctatacactacacacgctgttttgttttcataccgcccaccacactatctgtttgttgtacacacaccgctctgacactcccttcttatcanttcctcttgcacatgctgcacaaacacctctgttgttcacccaccgtcttttgaaatgcgcccacttctttcccaccaattcggttttaagagagcgccctactatcatcttcgtccccattgttctttttttgttttcccccgaaaaacaccactgacttccagtttttataaaaaaagaaaaacacactcgccccatcaataaaccagaaaat

SEQ ID NO: 684072 - DNA, 153 bp, Homo sapiens
  misc_feature (109)..(109): n is a, c, g, or t
  misc_feature (113)..(113): n is a, c, g, or t
agacgcataagacaccataggagcctacactatagatatgccaccagcgaactctgagaaagagatcacagatgcatatagacacacatagcataatggtactaccaantctnacaattcatacctattctgaaaaagacataaaacagaatt

SEQ ID NO: 684073 - DNA, 1330 bp, Homo sapiens
taaaaaatttaaattttttcatctctttttattacttgaaaaaaaaaaaaaaaaaaaaaaaaaaaaaaaaaaaaaaagagggggcgcgcgcgccgcacaagaataatccccccgcgagggggccccatcgtacgcgcgcgccacccgcgatttttgtggacaagagggggccccataaggagggagagccttgttttatataaagaagcgaggcgagagggggcgcgggttttataacaaagggtggagagaggtgggaacaaaaggtgtaaaacgaggggaaaattttggggaaagagagaaacattattatgaggggggagggagaaaaatatgtggggaaacaaaatatcactcacatcaagagagagagatatttaagaggtcttctagaggggaaatatatataaaatattttaaagggtgtattatatgatggtgggtataaaaaaaaggggaataattgggaggggggaggaggagaaaaagttgtgtggtcataatagagagggagatatagatgtatatatatgagaagaaaaaattattatatacagaggggggagctttattgttttatatataattatagagagaaggaatcaaaggagagaaagaagagagagaaaagagaagaagagagagaaaaagaaaaggaagagaaacagacaagcagagagcgaaacacgaggagcgaccgagggaaagaagaagcagaagacgaagaaaagacgcgaagcggacgcagagagagagcgagagagagagggagaaggagaagaggcagcgagcaaagaaagaaagacacaacaacaaagcaacaaagccagaggagggcgaaaaaaacagaagaaacgcagaaagcgggaacagaagaaacagaggggagagagaacgacagggcaggcacagaacgagaggggaaaggaaaggaaagaggaggaaaagcaaaaaaagcaaaaaaccaagaaaaaaaacacaaagaagagaaaggcaaatgagcgaaaaaagaaaaggaggacagaagagagagaaaaagaaaaaggagggagggaagaaaagggagcgaggagagagagaagaagaacaaagggagggaaaggaaaggaggaagagaagccgagcgagcgagacgaggagaaacgcaaaggcgagaaaaaaagaaaaaagagagaaaaaaacgagaaacgagaaaaaacaaaagaaaaggagagcagaaaggaaagagaaagagagagagaagcgagcacaagagaggacgaagagagagacgagggagaaaaagcgcggacgggcagaaaagaggcaagaaaagaagaccagacgagcc

SEQ ID NO: 684074 - DNA, 845 bp, Homo sapiens
gtagcccgggccgcgagccgggccgggcagcgccgtctccgcctcgggccgccgggggcgccttgttgagcgctaccagtgcgtccgcgccactcgcggcgaccccgggccaaggccccggggaaggcgactcccgggcgcccgaattagccccaagttgggtgccgactgttgctgcgctgtctcccgaccctcatgcgacggcgccgggcctcgccgtacgggtagcgccccccggggatccccttcccgggtgtccccttgggccccctgagttagtgatagttatgaccgatggtcgggccgatgtggaaactgttccgcgtccgaactgagctccgcaaacggtgtcggaactccagtttcccgaggaaaccctgtaggggaaaagagacggacacattaccctgagtgccaacaccatgaagccaccttcgtgcctaaacaggggtcttaaagaaggtttaaagtccgcggaccaaatgggacaaatgaagaggcaagtaacgcaaggccctctttgggcaccgttgaagaaatgaaatacccaggtagtgagagacccaggaacaacacccggaggcagagaaatgctcgtaaagaaaacgaagtgatgcgttaacacaccgggcctgaagcccataacaagggtcgaccgggataaaaccccgaaagtcgcttgagacagtgaatctgtacgctccagccaaagggccctaaggggacggaccttaatagagcgagacggtatacgacccaattgcggaaatactccagttgcataggtgtcccgcgtctcctcaagcactttcttatgtcaaagaagagacaataagaaaagaaaa

SEQ ID NO: 684075 - DNA, 331 bp, Homo sapiens
ggatctgatagtgaaggatataaagatgtaaccatcagtttaaacctctcctgtcattcctagtcatccttggcttcataattgaaatggaagtgggggtgtccgctactctgtagaatctgggactggccacctgtttgaatggcctccttaaactagctgttatgtaatgattttattctttgtgagttacttacgaataaagtcacttttcttccaaggtacaaaacacacaaaaacaacaaaaaaacacaacacaacaacacacacaacaaccacacaaaacaaaaaaaaacaacaccaacacaaaacaacaacaacaacaccaccc

SEQ ID NO: 684076 - DNA, 419 bp, Homo sapiens
tttcgagcaccgccatccccgttagatgtgcataatggcttagatatatccaaagtaggccacatgctacatgttacttgatcaattttctaaaataaggttttatgacaatgacagtaagataagggaagcaaaacatgggaggagtgacgtcctaattactatacatgcatatactgtctgacagtaaggagaaacctttaacagataagtcacacaccacatataaggcaacataaactaatttcgtacaagaaatttaacacattctgtacaaggatctgacacatttgctcatcatcatatgtacaaactcttcatagtttacttgaccatcagcatcaatatctgcttccctgatcattccatcaacttctacatctgttaacttctctccaaggtgtgtcatcacatggcga

SEQ ID NO: 684077 - DNA, 248 bp, Homo sapiens
ggcccccccccccccggccccctttttaaaaggttttttaaaaagggaaaaaaaaagccttccccccgggaaaattcccggaactttttaaggcaagtttttcctccaaaaaaccccatttttccccaggggaacggttctttttcagggggtcatttgggttttttttattcagggaaacaaagttcccgttgtttttttagtccccaaagttttccaaagcccctaaaaaaaaggggtttccccca

SEQ ID NO: 684078 - DNA, 231 bp, Homo sapiens
aaaatgaataagacgttcatccgagttttgagatgaagattggaggtttagaatgtaaaggctgtgtacaagtaatacgtattctaatacaccagttcatttcgactataaattatggcacagattgatgcgcaccagtctagaggaaacgatctccctattcccttaccctgtaactcagcgcacgccgtggtgtaggctgtaccctcaggtggcagagtgtggagaaaa

SEQ ID NO: 684079 - DNA, 117 bp, Homo sapiens
cattctgcttctgcgcttctgcttcctgcttctgcccccccctcaccaagacccttggcgttggggggggcagaagcaggaagcagcagaagcagtgaagtggcagaagcagtgaag

SEQ ID NO: 684080 - DNA, 203 bp, Homo sapiens
cccgatatgctaatcataacataactcatatacacagaaccaaaggccttttctgcatctatgagataatcatgtggttttagtctttggttctgtttatatgctggattacatttattgatttgcatatgttgaaccagccttgcatcccagggatgaagcccacttgatcatggtggataagctttatgaagtgctgctga

SEQ ID NO: 684081 - DNA, 966 bp, Homo sapiens
gcggatagcagtcaggcggtaggagcaccaacgatggatgaaaaaaggcggacacgacctggtcgattcgggagataccacatgggggtctacaacacaaagggggatcgcacaataccagcagtgcgcacaatttcgcggcgacccgcgggtgtaaattcggggatgccccctcccttgagaaaggggcgcctcccgccgccgccccgacgcgactggtcgaccacaaaagagcggtgtgggcgtcgataacgcccgataaacgggggttgcccaggacgcggcaaacgtccagcgggttctgacgaacgagcacacttacgtggccgcgccccggcagtgtcgccgactggaggtcagcacacggggcggtggggagggaggtggcaaccccccgcggagggggcactccaagggcccgacccccgcggacccagagcttgccgcgtaggacacacagaagagtctcgtggatgttccctaggagaaacccacagcactgctggaccagaattcgctgtccgcacaaaagaaagaggtggtgcgaccccacggcccaccgacgacaatggtggacaaggtggcccgccaaaacgccgctgtcgtagggaaaaggtggcagaaccacacgaagcagtcacttatcatcttgtagagatccatcaccaccaaaggggccagaaatatgttgcgaggactcgatgaaacgcacaaagtccacactcttggtggcgatttcctgggggtacaatttagatcgcactcctgcccactggactgaaagtgttcttcctcagcttcttcgggaataaatatgcagtgggaagagcacccaccactagcttgtctattccaagggtgatactattcgaggtatctcgtgcccaccccaagaagacgttctgtggccaaaaaaatttacacccccaaaaaaaagggcgatttttggcttgtcaaaaaaaacga

SEQ ID NO: 684082 - DNA, 307 bp, Homo sapiens
ttcccgggtcggaactactacaactaaattcggcggccgcgtcggacatttcataatcaaatatgttatgtattaattcggaacaaaatacatgaaatcaagtacaaaacatacaaaacatactcccaagaaaattcaaaatagaaacatcacacaaataagtgtcttcctatataattaagacatataatataaacccagtcaataaaatatgtatatgttagaatatctaagactcagagaaacaagatcaagatataatcaactagaaaactgaactgtgtgttaagcaattattcgaaggcca

SEQ ID NO: 684083 - DNA, 916 bp, Homo sapiens
gcacaaagtttggccgtggggactctgcatcccctgcacccgctaccacaccagctcagccacagcagagccaatcacagacccaccacacagcccagcagcccttcgtgaatcctgcactgccacctggctatagctacactggtcttccctactacacaggcatgcccagtgccttccagtatggccccaccatgtttgtccctccagcctcagccaagcaacatggggtgaacctcagcactcccacacctcccttccagcaggccagtgggttaatggccaagacagggttcacggacaacgagtgtatagtagagagatcgtgacccagggacgacagcaagcgaggaagactactccaggaggttggctatgcttggatcatcagacaggcaccaaacaagtctgcaggttctgggcctggcaaaggagtatcagtgtcttcaagcaccactggtctacctgatatgactggttctgtctacaataagacacagacttttgacaaagcagggatttcatgcagggacgcctccacctttcagcctgacctcggtcttgggctccactgggaccctggctcgggagcggccctggctatgagccaccaacatttctacacatcttgccagccaccagcagccccactcacagctgctgaacaacacttccgcaggatgcacaagcgtggctcgggtcaagcgcagccagccagatccatgcagcacaagtctcaaagcctgcaaacctgctacgggaaatctcccatactggacaacctaaaccccagaagagaccgggtgggctggggccaggttactctgggcaggagagacacccgagcaccgtttgggagccagtgcccattcctagaatcccgccatgtgtcagcaatccactgagaagagtatga

SEQ ID NO: 684084 - DNA, 128 bp, Homo sapiens
ttgctgagtaacgtccactgtgtaacattctgtgggtttttagtcattctcttgttgaaggacccctggctgtttccatctagaggctcttatgagtaaacctgttacgctggcctacagcacatagc

SEQ ID NO: 684085 - DNA, 249 bp, Homo sapiens
cctacaaaaacctggaaaatagatcattcttagttttccttccattttttcttctttttataaatggtccattcaacttgtcctccttgtcgacatggttgtaaaaataagttcagcacttaaacagattccgtgaatttagttgttgttagttgttgtgccacagaactaaaagaaatcatagaacaccgtcttattcagcacacacagaagctttagctgtcatttgacatttatctcacgaatggc

SEQ ID NO: 684086 - DNA, 985 bp, Homo sapiens
gctctgattacccctattctcaggctacaccgatgcatacaacacatgaaacatcctatcatctgtaggcctcattcatttctctaacagcagtaatataaataattattcatgattggagaagccttcgcttcgaacgccgaaaagtcctaatagctagaagaaccctccataagagccctggcagtgactatatggatgccccccaccctaccatcacatgtcgaaccaatcccgtatacagtaaagatctagcatcagaagaaaaggaaggaatctgcaatcgccccaaagactggtttcaagccaaccccatggtctccatgactttatcaacaaaaagagaaagtagcactacacaagaaattgcaatgatgtcctgaaagaacaatgaagcctggggccaaaattgattggccggtggagaccacacagggttggcaaaaagacgctacacgcggctctcacgggggaaccatcggaagccttcgtcgaagactcgcgaggcacaaggagccatccagcgacccctactgggagacggaccttccccgtcacatcaggcgatgactagtggccagataacgccccaggcaaaatcactgccctatgaaccaactggaatgccctgcctgtgtggtcgagccctgacctctgactctacgacacccaataggagtggtggcgcgctgggcccggcaggggagaccggactgtgactcaggcccccagggagctatgcatggaccagccccgaaaggctcagactgaggtcagaaccgaagaagctgcacgccaaggctaagaacagaacagctcacaggggctggacgccccctaggagtggcctggggccccactgccttcccagaaagggccacaataaccccgaaacggatcaacaacacacggggacccaacagcaaagcccacccaagacaaacccgggaaaaaaacggccgagcaagaacaagccacaaaaacc

SEQ ID NO: 684087 - DNA, 180 bp, Homo sapiens
  misc_feature (88)..(88): n is a, c, g, or t
gcctgacgctccttgttaatgccggttgctgttacagacttgcaattgtgcaactctgtgatgtaaacaggcaggctttgtatttttncagtgcccctggagagtggagagggtggttctcttggctgtctctggaacaaatttggaggaaaggtcctgtgagggtacagtgagaagatg

SEQ ID NO: 684088 - DNA, 181 bp, Homo sapiens
acctacactatgtcacacagtaactactactaatccacgcccataatcatacaaagacccccgcaccaataggctcctcccgaatcaaccctgacccctctccttcataaattacttcagcttcctacactacttaaacgttggtcgtaatagtttactgctgtaatacgtttacgggctg

SEQ ID NO: 684089 - DNA, 454 bp, Homo sapiens
  misc_feature (9)..(9): n is a, c, g, or t
  misc_feature (381)..(381): n is a, c, g, or t
  misc_feature (397)..(397): n is a, c, g, or t
gatcaggtncgagctcatcgaccctggcgcagacggccttggtcgccgcgccacgaaggtctgggtcgatggcgtcctagcgttcgacggcagcgcgagccccgagagcacgccagcgttctgggcgtcgggtgcaacgttcgaagagagcctggactcgctacacctctgcctcgcccccgcttcgccctttgcgagccaggccgtggtgacggtgcgcgtcgtttcgcggatcaagggcggcggggccgtgctcgacgagacctatcggttcaccgcggaggaccgtacggcgccgaagctcgtcgcgagcgttgcggtgtcgccgcgtgcaatacgactcgcgttcgatgaaccggtgaccgcgccggaaacgaactngattaccatcacgccnctcggcgcgcccgtggtcccggtcgtcgtgatgagcgtgaacgtcacagccagcgtc

SEQ ID NO: 684090 - DNA, 114 bp, Homo sapiens
catcctcctaactcagactcccaaatagcttgagagcacaggcgtccaccatcataccaggccaaattcttgagtacttagtagagacacagtttcagccatgaccgggaccat

SEQ ID NO: 684091 - DNA, 195 bp, Homo sapiens
cacgagggtgatggaatttctgccgtctcaggaacacgcgcgatctcgggcgcaatcaattgggatcgggagacagcgaaaaacccgccatttccttctaaggaattaattacagattgaagctgccgacaggcgtgcgggacgtgtgtaatgccgagggagatcgggaggtttcgcacgttgcaaccgggaacc

SEQ ID NO: 684092 - DNA, 892 bp, Homo sapiens
  misc_feature (7)..(7): n is a, c, g, or t
  misc_feature (22)..(22): n is a, c, g, or t
  misc_feature (25)..(25): n is a, c, g, or t
  misc_feature (39)..(39): n is a, c, g, or t
  misc_feature (50)..(50): n is a, c, g, or t
  misc_feature (60)..(60): n is a, c, g, or t
  misc_feature (69)..(69): n is a, c, g, or t
  misc_feature (75)..(75): n is a, c, g, or t
  misc_feature (78)..(78): n is a, c, g, or t
  misc_feature (82)..(82): n is a, c, g, or t
  misc_feature (87)..(87): n is a, c, g, or t
  misc_feature (92)..(92): n is a, c, g, or t
  misc_feature (99)..(99): n is a, c, g, or t
  misc_feature (106)..(106): n is a, c, g, or t
  misc_feature (113)..(113): n is a, c, g, or t
  misc_feature (120)..(120): n is a, c, g, or t
  misc_feature (126)..(126): n is a, c, g, or t
  misc_feature (131)..(131): n is a, c, g, or t
  misc_feature (133)..(133): n is a, c, g, or t
  misc_feature (148)..(148): n is a, c, g, or t
  misc_feature (166)..(166): n is a, c, g, or t
  misc_feature (174)..(174): n is a, c, g, or t
  misc_feature (204)..(205): n is a, c, g, or t
  misc_feature (214)..(214): n is a, c, g, or t
  misc_feature (216)..(216): n is a, c, g, or t
  misc_feature (221)..(221): n is a, c, g, or t
  misc_feature (245)..(245): n is a, c, g, or t
  misc_feature (265)..(265): n is a, c, g, or t
  misc_feature (267)..(267): n is a, c, g, or t
  misc_feature (279)..(279): n is a, c, g, or t
  misc_feature (287)..(287): n is a, c, g, or t
  misc_feature (295)..(295): n is a, c, g, or t
  misc_feature (303)..(303): n is a, c, g, or t
  misc_feature (316)..(316): n is a, c, g, or t
  misc_feature (329)..(330): n is a, c, g, or t
  misc_feature (342)..(342): n is a, c, g, or t
  misc_feature (364)..(364): n is a, c, g, or t
  misc_feature (366)..(366): n is a, c, g, or t
  misc_feature (389)..(389): n is a, c, g, or t
  misc_feature (424)..(424): n is a, c, g, or t
  misc_feature (435)..(435): n is a, c, g, or t
  misc_feature (519)..(519): n is a, c, g, or t
  misc_feature (536)..(536): n is a, c, g, or t
  misc_feature (568)..(568): n is a, c, g, or t
  misc_feature (583)..(583): n is a, c, g, or t
  misc_feature (643)..(643): n is a, c, g, or t
  misc_feature (646)..(646): n is a, c, g, or t
  misc_feature (671)..(671): n is a, c, g, or t
  misc_feature (674)..(674): n is a, c, g, or t
  misc_feature (709)..(709): n is a, c, g, or t
  misc_feature (743)..(743): n is a, c, g, or t
  misc_feature (745)..(745): n is a, c, g, or t
  misc_feature (747)..(747): n is a, c, g, or t
  misc_feature (782)..(782): n is a, c, g, or t
  misc_feature (785)..(785): n is a, c, g, or t
  misc_feature (873)..(873): n is a, c, g, or t
tgtattnactttgtatttgaanaanaaagtgaaaaaagnggccaaattcnattttctttnaattgcaanaaaaanggntganctgantggcncttcgangaatttnaaccaanaagttcnccagtngttcnanaagcattcgtttttnaaaccttgatgcttcttnaaagaaantttgaaaaaaaaaaagtcttgtttgtaaanngccttgcanangcttnagaaaagggaagaatctttcaaantttcttcctggctttcggancnctttcaaaaatngggctttnagttcagnattgaccncttcaaggcttcngcaaagcaacaanntctttcctttgnggagggaagaagcggggaagtncncttcagcacaatgttcttaaacnctgggccccccaagaatttcaaaaaaaccaccaanagggagggcantgggtccaaaaagggcaagaccaagagcctccaaaagaatgggtggccgttccagtaaacgggcgggagaagaagcggaaaaanccgtaaccaaagcattnggggtaaagtctgaagaaagttggtctgcaanatgattttcaaccanatcatgtattatcgaatcattagtggtttctgaaattttatgaagaggaagaggtttaanaanatctggctgtgcttgagttgtaggngcngggggtccttttcccccaatatgattgtttacaanaggattctgctgtctgcctcttagtagtggaganananaccgacgtcttttagggatcccttgcatatttggntcnccgggtcgtttatgtttattttgaggtccagccacaaattcatctgcttcatctatcatcatacccttcttatccagcttaaaggggntgccaaatgtatgcaacct

SEQ ID NO: 684093 - DNA, 753 bp, Homo sapiens
ataaccaatgctaccaatcaatactcatcattaataatcataatggctatcagccaataaataactaggaatagcccccttatcacttctgagtcccagatgttacccgagaggactaccccgtcgtttatcgatcctggctctgcttcttctcactatgcaccaaacaactgagcccccatctcaatcatataccagatctctccctcactagtacgtaagccttctcgcatcactctctcaatcttatcgcatcatagctatggctagttgcatgagtggattaaaatcgcgaaacaccatgattactgcgaaagagtcttagcatcactcctcacattaccccacaaatgggatgaataatatgcaagtttactacctgtaccaagacctaactagtaaccaattcttcactttaacttatttatattctatcctacacttactaccgcgattccgttacgtacgtccaacattagaacttccagcactcgacataaccttactttacctcagacttcgtccaccatgtagaacgaaagctatactagtgtagcttgaacagcacgctgtacaatttccattcacaaccccttccacttcgtcctctatggaggtccgttgtccctgcgtcttaagccggctttaatgccgcatagaagcggcctattaaatcgatatagattacggtaggaaaaaacaaattggcctacgatacatacgcccaaccaatcataagttcagtcaataaac

SEQ ID NO: 684094 - DNA, 470 bp, Homo sapiens
actgtgcctccagatgtgtgtgtttcacatgtatagtggagtttagatattgaaagacgcatatgcatatgggtggtcctcgagggagagggatatcgaggctgagagtgggtcatacacctggtgtcactggctgaggggcgtgattccatgcagggtgtgagatgagcaggatgccctcagtgtcctcccgcggccagctgagcctgctgctcttcactctcctctgtgcacgggtccacactggggtgggcggggctggtctgcgtctgagatgctgctgcgtcaggggatggctggtttctagatgggtcagagtgagtctcacatgggacaggctgggctctaccagcaggagaattttccctattctcattggtcccctgtacaggctgtatctcagaagcacggttgtctcttgtgagttgcatcatctctttaatttggtagagtgcatagacaaagggaaa

SEQ ID NO: 684095 - DNA, 1205 bp, Homo sapiens
  misc_feature (658)..(658): n is a, c, g, or t
  misc_feature (760)..(760): n is a, c, g, or t
tggaacataaactcaaaattttatggtcttcatataatataaaagatgtgacacttataaaacgtggatctcacttgggcccttttctcttctctttattcctccctcccagttacaaaagtgcgtgggatctcttttaaatagccagcatttctctataaactcgtgcagtgtggggctctccacacgccactctcaacgcctttagccacaaactcttctcttgtgggtgagttatatacgcctatatttctccgggaaaacactccggcttatagttgtgtgcccaaccaattagccaactctctgtgcttctccggtggacttaaccggcccgttttccctctagtggcgtgtaccagagaaagaaatcctcttggcctcttctctgggtacccctggggtacatcttatattggggtgttgggtggtcttggcacaacactctcttcctatacacaagaaaagtgtcccgcggcgcgggttttaaggagagacgctgtataaccacaatgtgtcttggcgcgttagaggccatttacacacccaaacacactctaaaaggggaccagaaccctctgagatttctctctattatacccataagatattcctctataaaatcacatttttatatttgggccccaacaatctaaanctctccctctcgcgggaatctcccgcgtggctcttacatctcactatatttaaacaccacaaaacgcagcccacaaattaatttctaattaaacctcttagnccgagtgggcccaatcccctctttattgaagcgcgggggcgccaggtgataaaatagggggcttacgggcctcttaaggatatacacaaagggcgcctaagcccatctttctttaccacagagggcaaccacctttaacacgccctttattccccaattaataagctttatttatcggaaaacccatagagacctaacttccattttcaacgcaaataagcccctggggccggttaaggccttaaaacgcgggtaacacatctttccgctgtcggggggggccaccctttacattcatgtgccccctattggggggagcgggccccccttaaaactttctacaccccattaaaacttcccctcttaaggtttaattatcttcgacaaacctcaatctgacggagagtatccagaaaaaccgggtgcgccttacacacagcgccac

SEQ ID NO: 684096 - DNA, 413 bp, Homo sapiens
aataatgagcatattgtgtgacaggcttttagaatcttctgtatatctagttcacgcttgagacctttcctatggcaaataaaataaaatatgaaattgtttcttttgtctgattatacaaacagtcaggtatatgtagactttgagctccatgctttgatgacctggacaaagtacagaatctgccagctcagggcacataaggaagtgacttatggacggattgcaggaaggaagcaggtggctttatcagctggtacattacacaacatattttctcccccaccagacccaatatttttcctttttaaagtaaagtcaggttaaaatgaactgtaggtcaggcttgaaaaagaaacaaaataggccagagagaatcacactctgtctgggcaaggatggctgggaggtgt

SEQ ID NO: 684097 - DNA, 293 bp, Homo sapiens
  misc_feature (150)..(150): n is a, c, g, or t
gggggggcccccccccccccccccgggttttttttggggttgtggggaaaaccctttaggggcgttttccccggggggttgggccccccccccggggccccctggggggggggggacccgtttttttcccccccgggttttcaccccccntttgggggtttttcccctttccccccaaggggaaaaaaaattttaaaaaggggggggtttttaggggccctttttacccggggggtgggccctttttttttatttccccccccccccccaaaaagcccttttttcccccccca

SEQ ID NO: 684098 - DNA, 942 bp, Homo sapiens
tatatggccttgggtaaggaaggtaggtggctacgttggtgttaaatattttacagttgggtgatgaggaatagtgtaaggagtatgggggtaattatggtgggcaatgaatgaagcgaacagattttcgtccatttgggtccccagggttggtataatttttaattttaatgggcttgggtgagggaggtaggtaggtagttggtgttaacatattttaagtgggcgtagatgagagacatacgtgtaaggagtatgggggtaaataatggggggggggccgctcccaattaggtcgcatgagtaggtgcgcctgcagtaatgttagcggttaggcgtacggccaggctatgggttcgaatagaggtaggctgatggtctccgataataactagctatgggagataaggggtgtaggtgtcgcccttggtggtaagaaggggcgcataggcgcattttgaaatcttaaagcgaaaagccttataatcactgtggccccgcacataaggggaatgcgccatggctaggttatataagatagctgcgagggtaagattcgataaaggcccattgtacggacggaggagaataaaagcccgggctgttcgatgcagattattcgggagaggggggagaccccaacagagcggggggacattacgaatgggtcccccgtaatcaccgagaggaggttaaggccactgaaggggaaactaagagttttacagaagaaaccaggtgtccggccctcaaaggtgggtgagcggacagggggaacaacccatcgtggttcgagaggtgaagaggtccaaatcaaaactaagacaggaatccacacaacgggtaatattgggggccacaaaaacagtatctataagtccctcacagaccaccaaaatcttggacctaacaccataataggggcaaagagaggacacacaa

SEQ ID NO: 684099 - DNA, 82 bp, Homo sapiens
ggccggggcccggggccttttaaaaagggtttttggtttcccttttgggtttctccccggaaaaatttttttttggccccca

SEQ ID NO: 684100 - DNA, 232 bp, Homo sapiens
  misc_feature (101)..(101): n is a, c, g, or t
ggcacgggggagcagcagcctcaaccgccggcggacgcagcagcaacagccccaacagcagcgcggggccgccaaggaggccgcgggggaagagcagcggncccacctcgctgttcgcggtgacggtggcgccgcccggggcgaggcagggccagcagcaggcgggaggggacggcaaaacagaacagaaaggcggaggataaaaagaggggtgttaaaagtaccacgagaa

SEQ ID NO: 684101 - DNA, 828 bp, Homo sapiens
  misc_feature (214)..(214): n is a, c, g, or t
  misc_feature (412)..(412): n is a, c, g, or t
  misc_feature (513)..(514): n is a, c, g, or t
  misc_feature (521)..(521): n is a, c, g, or t
  misc_feature (528)..(528): n is a, c, g, or t
  misc_feature (616)..(616): n is a, c, g, or t
  misc_feature (643)..(643): n is a, c, g, or t
  misc_feature (669)..(669): n is a, c, g, or t
  misc_feature (677)..(677): n is a, c, g, or t
  misc_feature (680)..(680): n is a, c, g, or t
  misc_feature (702)..(702): n is a, c, g, or t
gctccccagccatggcgttcacgtccgcgagcttctgctacatgctggcgtcgtgtgctcactgacgcgtgcatcattcttcgccatttgtctcattatacgcatttcgacttgacgcttggaaggacggatctacaaagaatcctatatgaccaaggtggaatacgcctgaatcccctggtatctcctcagaggtggtctcatctcacgcctngactatcttgttggcagtgataacgtatttgatgcaagcgacgacgttgagcattactacttgagtgttcttcaaatattggcctccattctatgtgtataatctatattagtcaaggtaagtgtataatgtatgtatgaaccgatgatggtaatgacgttggactcccaaggcacttctaattgtaccgctgagagntcaatctatgataatgcgagagtatttctaagagcagtattgtgctcatgtaacggcataggcattggatgcagataatatagcttttcttttatactttnncttgagncggattnttattttttgaacgttagcgatagtatggtggcatgtgattcgtagttgcttaatgggtgtgacgctttctttatgacaacacagtgngcacaagcacaggatattgtgcgtacnccagatctacatgtggacatttgcanagaaaganggnccaatcctaatagtcgcacagngcgagtatcttaatcgcaacgcacaacaggcattctctggtccactaattgacggtgagtcctggtcgtgacattcggtgcatcaaggttcactttttaccataagaatgtacttccttttaatta

SEQ ID NO: 684102 - DNA, 351 bp, Homo sapiens
  misc_feature (32)..(32): n is a, c, g, or t
tgcaacgcggtcatactgaacaagcggatttnttttacggtgtgttgagagacagggaaacgggaggggagtctatgatgacgctggcgcagtggtttgaagagaaagggattgagaaggggattcagcagggaagacaggaagtaagtcaggaattcgcccagcgtcttctgagtaaaggaatgtctcgggaagacgttgcagagatggcaaatttacctcttgctgagattgataaggtaattaaccttatttaagttacctgtgttatgacagatgacgtggggtaaattaataactggcgccatcagccgtagcgccatttaagtattacgccactcgacccttttt

SEQ ID NO: 684103 - DNA, 357 bp, Homo sapiens
  misc_feature (67)..(67): n is a, c, g, or t
tactccacaaacagcaataagttagaaaagaaatgtcctgaagctgtatctgatatcagcactggantgtagaacttgttgctgattttgaccttgtattgcagttaactgtgccccttggtattaacgtgtcagggctgagtgttctgggatttctctagaggctggcaagaaccagtagtttcgtcttgcgggtctgtcagggttggaaagtccaagccgtaggacccagtttcctttcttagctgatgtcttgggccagaacaccgtgggctgttacttgctttgagtcggaagcggttcgcatctacgcctgtaaatgctatcatactcaactaatgtaagcgttcccccgca

SEQ ID NO: 684104 - DNA, 80 bp, Homo sapiens
ggacgattggattcactagccgaagagtaaaggtgctgcatgatgatagctgtgtgcgctgtggatttgcgcaagacatt

SEQ ID NO: 684105 - DNA, 188 bp, Homo sapiens
ctagcagacatgtagtatttttcttttttagagacgaagtctaaccgctcgcacaggcgtggagtgcattggcgcgaactcgggtcaccgcaaccgccgcctcctgggcttcaagccattctccgtgcctcagtcttcccgaggattgctgggaattatacgcctgtgagcccacccgacgccccggt

SEQ ID NO: 684106 - DNA, 265 bp, Homo sapiens
  misc_feature (84)..(84): n is a, c, g, or t
  misc_feature (150)..(150): n is a, c, g, or t
  misc_feature (222)..(222): n is a, c, g, or t
ggttttgttttgacacatagtcttactgttaccgaggctggagtatagtgtcatgatcttggctcactgcaacctccacctctnaggttcaagtgattcttgtgtctcagtctcccgagtagctgggactacagacatgcaccaccacgnccagctaacccttccatttctagtagaggcagggctccgccatgttggccaggccggtctcaaactcctctngtgccgaattcggcaagaattcatggacaccagccgtgtgcag

SEQ ID NO: 684107 - DNA, 181 bp, Homo sapiens
gttagagttgtttctggcttacagaagggccaaggcatcactcagtgacagcgactggtccacggtgccctcttctataggactgattcactgtgccaatgtgtgtctgtttttttgtttctactttttattaaaaaatataaatcacatggcgctgcaggcctaggctggaaggactctg

SEQ ID NO: 684108 - DNA, 534 bp, Homo sapiens
  misc_feature (521)..(521): n is a, c, g, or t
gacatcatttcttcaatgaacttagtatttagaaagatatcttcactccaagcatcaagtcttttctgtcctgcaaaagtcttaagtcaaaccagaatccactagtagagggcacctttggattcaacagtaaaaggagaatctacaaaaccagctcatcaaaaggggcagtgatgggtatagaagcctgaccttactctaagttcaagcaatgattaatctagcttccctcctggtggatgactgaggcctttgcctgaggacaactttaaagagatattgaatgaagctatgatacctgtagcagttactgccattttggacccataaactgacaatccttaaacattaccaggagggcagagcggaaagaacattgatgtcatcactgagttgctggattaccttactctagaaatagccaactctgcatgtttggttatttttttaaaaagtcttctttattatttacatcattttgaatgggctctaactctagctcttatagtaaaaagcatttnaactgatacaaaa

SEQ ID NO: 684109 - DNA, 304 bp, Homo sapiens
cgtttcctttgtctaattgaatcagttttttacccaatcccccgatttgtaggataatctcccttatctaaagtcaactgattatggactttaatcacatctatacatgtattgacccttcctgtcattagaaaatgaggtctagccaggtgcgatggctcacacctgtaatcccaacactttgggaggccgaggcaggcagatcacctgaagttgagagttcgagaccagcctggccaacatggtgaaaccccatctctaccagaaatacaaaaattagctgggtatggtagcatgcacctgt

SEQ ID NO: 684110 - DNA, 261 bp, Homo sapiens
  misc_feature (23)..(23): n is a, c, g, or t
  misc_feature (45)..(45): n is a, c, g, or t
  misc_feature (72)..(72): n is a, c, g, or t
  misc_feature (200)..(200): n is a, c, g, or t
caagagggtagcccactcccctnaagagtaagtcccaggcctggnagcattcaccacaaactgactggagantccttgggccttagctgaacatcagcagtagcctggcggcactctccatgggcctgtggtagtagtggccatgagcagcggctcctccgcatgtggaaagcagatggaagaggaggaaggactttttnttgtggcttgaaggccagctttagctgcaggagtttagagcataaggtagacttctaaggt

SEQ ID NO: 684111 - DNA, 158 bp, Homo sapiens
gccggccggccgcaataacagcgcgaggcgtcaataccccgcggccagtccagttcactcccaggccatcggtatgctgttttcgttcacatttgaagggggccatatcggatccggactgtgtcgcgtaataagtcggataattggcccatacacca

SEQ ID NO: 684112 - DNA, 184 bp, Homo sapiens
gaggttgagctggcatgaactctggagatgtgtcaactgacaacaccagactgaccttgtctttgacgaagcctgaatagaattggttccaaatgcccactgcctccgtctcctgtggggtgtcgcagtacgtctcacagtgagcacacgccatttgggagctcatggtatgtggtcgctttgg

SEQ ID NO: 684113 - DNA, 808 bp, Homo sapiens
gattcatgaatgcttcactcattgctatgactctagatacagtctgtcctggctcaagcctgatacctagacactgtaatgcgtgagtacatacatgagtgcacatgtcaggcttcatgtcttactccttgtctcctgactcctaccgattgcgacatacactaggaactacagctcactattccttacccctactacacgtcagggactagccgcagactaatagcttacacaggcgaccgagggtggctctgtccaggggcagaagccagttatcggaacagtgctattgtacgcagccatggtagcgagaggcccacaggttgctctgcgaaggcattgcagacagcggcgcaaccccaacctggtccttgtagagatcagcggcgcgcagttcaataggcataaagccatggcgcgcctgaatgtacgttctgaagggaagctgttgatacccttccatgtactggccctctgcctgctgtctcacatgtcccttctggtggtcactatgggctctaggagtatacgtcacctcagaccatctggcagaaatactccaggctcctaccccaaagtcacatgtcagccttgctgctggagcacgaagacaatgtcacatgatacatgaacatggagcgagttgtgagaccctgaccctgagtccttacttgaaagctgctgctggtgtactgagtgtcttttggactcttatttcttgcccttttccttatttaggcaagcagtaacttaggaagtaggtaagagcaataaatgtgaccatgtatgtcatcatagtaggagctca

SEQ ID NO: 684114 - DNA, 112 bp, Homo sapiens
gtatatggctgatgcatctcatgtagtccactttcccgtggccgccttcaccccagggaggagctccctccctgccattttagcggtcaggagtttagcacacaagccctgg

SEQ ID NO: 684115 - DNA, 382 bp, Homo sapiens
cccactactggtattatgtcactagttacctgatacggctctttcccttcatcactccaatcagtaccttcacacaacagtctacactctgtagcagttggtgcactattttcgggcacactattagcaaacatgcatgtagtcacagacatcttatgaaaactgtcttcctggaatttgatttagcatgctccgttgccagttccccttatcgatactctttctttgcagaataccttagaaccgttcattccctcagtgtagattgctcttaaaatgtattcagttatttagtgggccccacaggagtggagtcttgaaatctaatactaaatgccaatagtgggtcccagcaatgggtcgggcaatcgtggggtaacga

SEQ ID NO: 684116 - DNA, 388 bp, Homo sapiens
  misc_feature (42)..(42): n is a, c, g, or t
  misc_feature (69)..(69): n is a, c, g, or t
  misc_feature (85)..(86): n is a, c, g, or t
  misc_feature (150)..(152): n is a, c, g, or t
  misc_feature (193)..(193): n is a, c, g, or t
  misc_feature (235)..(235): n is a, c, g, or t
  misc_feature (264)..(264): n is a, c, g, or t
  misc_feature (268)..(268): n is a, c, g, or t
  misc_feature (288)..(288): n is a, c, g, or t
  misc_feature (302)..(302): n is a, c, g, or t
  misc_feature (331)..(332): n is a, c, g, or t
  misc_feature (380)..(380): n is a, c, g, or t
  misc_feature (388)..(388): n is a, c, g, or t
ggcgctgacacaggaaatgatgggaaccacagcaggggtggnggaggggacgatgcaaagggcactggnggaagggctgctttgnnggctggggtggagaaggagccccagatggcctccctggcaggtgctagtaaacctgatccacannnccccccatccctgctcatttcccagaccctcagccaagctncccaggtcccccttccctgttcctcccctccccgttgcctgnttgccacacacacttccacataaacctgnagtnaggaaaggggaagaagggcntggtcagctgttangggcttgaacagggaggtctctgtactanntttaccatcctaaatccttccctccttctcttctcttccctcccagtncttccttn

SEQ ID NO: 684117 - DNA, 139 bp, Homo sapiens
cgagacctcactgctgcattaatcaaggagtgaatgagaactccctttctgatcatcagactcgatattcgacccgagcaaaacccataaagtacagtctaatcgttcattataagcctgtgtatgggatataaaaatc

SEQ ID NO: 684118 - DNA, 496 bp, Homo sapiens
  misc_feature (189)..(189): n is a, c, g, or t
  misc_feature (241)..(241): n is a, c, g, or t
acccagattaccacagcctggggaccagcagtgagagagagctgaggagtgctattaattgctcgctgtcactataacagatggctctgtcctactacgatgcatctgagttaagaatcctccgtccgatcctaacgtgtatgcaccctaacagcagcagtattactcattagccacagaatacctgtnctgtactcctaatgttgcattggaaaatgggtatataagtacatgttctatntaacagcaccgattccaaagggaagaatattgtgtatcactgttgaaaagacttgttgagaaatccactgaattctattttgagagattgtatttatgagtgcaagtttaccaatcaaagaagcattttgttctcgagttttacaggtaacactcagctgttgtctccactcctcccccatcatgtccttccaaggaggctgggacctctctcttctgcaatctgggtagttctttcagatgcctcatgctgagc

SEQ ID NO: 684119 - DNA, 666 bp, Homo sapiens
cacctcttaatactatgcatgcagattaagtttcaacatgaatttggagggatacaaatattcacaccatagaatatagtaatatagtatagtatatatttgttggtgtctgtctgctttgctcaggtaatgttttgaggttcatctatgttgttgcatgtattagtaggttgtatctattggtgcatagttattccattgtatgtatgtaccacactcttcatttacctgctgatggatattgcattgtttccagatttgggttattatgaataaaactgctgttaaccttaaaatataagtcttgtgtgtagacatatgttttcatttgtcttgagcaaatacctgattggtcagatggtcatatgtcagtatatgtttaatatcatgtacttccaactgtttaccaaagtagttgtgccattttattttcccactagcgatgtatgagttccatttgatccacatcttgtgccaacacttgttattgattttagcccattacattttagctgtataagatgggtgtgattagatgtctcaatgtaggggttataggtagagtggactgtagggattggctttctctatggcgccaggctgaagttgcaggggcacaaatcaataggttcatggagcttcaaattcctagaagtcaagggaatc

SEQ ID NO: 684120 - DNA, 422 bp, Homo sapiens
  misc_feature (13)..(13): n is a, c, g, or t
  misc_feature (138)..(138): n is a, c, g, or t
  misc_feature (163)..(163): n is a, c, g, or t
  misc_feature (297)..(297): n is a, c, g, or t
  misc_feature (326)..(326): n is a, c, g, or t
  misc_feature (361)..(361): n is a, c, g, or t
ttggctggggganataaatcatccctttgctcggaaaatcccaaaagctcccccgcaagtctccctttccttcttgggggggtctggtttaaacttcacggcccatgattacgtcatccagattacttcgaaaattgngtccgcctctgcttgtccggtttcnaggccctggatgtccctccgcctgcagggcccttctggatcctcggtgacgtcttcttggggacgtatgtggcctcttcgaccgcggggacatgaagagcagccccgggtgggcctggcgcgcgctcgcaactncggagcggacctcggatggggagtatgangcaggcgcagttccccgggtgacgcccaagtgaancatgcgcagcgggtggtcgcggaggtcctgctacccagtaaaaatccactatttccattga

SEQ ID NO: 684121 - DNA, 805 bp, Homo sapiens
gatttctgctaagacagtagattttaggagctcttgccatattgaaaaaaaaaaaaaaaaaaagggtaattgacggggtgcgggggctcttccccataatcccagcattttgttggaggccaaggaagggggaaaatcacttgtgagcccctccccaggggtcgtgggaatttacgggcggtgattccaccagcggccaagaccccttattcttctttctccccagaagaaaattcctttaccttaacccctttagtagaagtctcagaaaagaatttcacccagaaagagtgtggggtttcgtgggcacttggaaaccaatccgttttctaaggttggggtttggggttaaacatttccctctcagggagtgccaccagacaggaggggtgggtttcaactttctcttcagtttaagaaacccttccctggattgaaagtgagttaagggacaggtgtgttgagagacaggacaggcggaggaaaagggaggagcagcagagacgagagcagaggagcagagagagagagaaaactattgaattatttgtttttccagcctttaaaaaaggagcagagaacccgtgccctgtgcgtggccacaattggcggtatgaaccccggggggaggaacgtttatcgctagggtgagaagaacccgcagaacgcgagaaaagaccaaccctgtgtgatgaccctggggtggtagtgggaacccacctaagaagggggagacacaatctcttcacgtcggaaacacctttgcaatataaacgcgggggtccccaggaagcaggggtggcgg

SEQ ID NO: 684122 - DNA, 164 bp, Homo sapiens
  misc_feature (66)..(66): n is a, c, g, or t
ggcacgagaagatggcgggtgaaaaagttgagaagccagatactaaaagagaagaaaacccgaagnccaaggaaggttgatgtgggtggcaggtgaaaaagggtaacctcaaagctaaaaagcccaagaagggggaagccccattgcagcgcaacacctgtcct

SEQ ID NO: 684123 - DNA, 112 bp, Homo sapiens
tagtaaacagagagacggagtgtagagagagagagaacccgagaagcgagaagggttgtaatatgggaggggtataaacaaaggcctcaagatttctttatgtgccagaaag

SEQ ID NO: 684124 - DNA, 235 bp, Homo sapiens
ctgggaggctgaggcaggagagtcgcctgaacctgggagctggaggttgcagcaagctgagatcacgcaactacactccagcctgggcgacaagcgagactccatctcaaaaaataataataacatatttaatcatagggaccatttaaatgctctttcatttgtattaattgagtgctccacctctgacagtttgagcatggttggcccactatcctgatgctcctcctgctat

SEQ ID NO: 684125 - DNA, 93 bp, Homo sapiens
cccgaaaaaaaaaatttttttttttaaaaaaaccttttgttacataaggaagacttttttaaccaatggaataaattatggcctttttattga

SEQ ID NO: 684126 - DNA, 609 bp, Homo sapiens
  misc_feature (19)..(19): n is a, c, g, or t
  misc_feature (63)..(64): n is a, c, g, or t
  misc_feature (68)..(68): n is a, c, g, or t
  misc_feature (81)..(81): n is a, c, g, or t
  misc_feature (83)..(83): n is a, c, g, or t
  misc_feature (87)..(89): n is a, c, g, or t
  misc_feature (92)..(92): n is a, c, g, or t
  misc_feature (94)..(96): n is a, c, g, or t
  misc_feature (98)..(101): n is a, c, g, or t
  misc_feature (103)..(103): n is a, c, g, or t
  misc_feature (114)..(115): n is a, c, g, or t
  misc_feature (117)..(119): n is a, c, g, or t
  misc_feature (128)..(130): n is a, c, g, or t
  misc_feature (132)..(133): n is a, c, g, or t
  misc_feature (135)..(135): n is a, c, g, or t
  misc_feature (137)..(137): n is a, c, g, or t
  misc_feature (140)..(145): n is a, c, g, or t
  misc_feature (149)..(149): n is a, c, g, or t
  misc_feature (154)..(154): n is a, c, g, or t
  misc_feature (157)..(157): n is a, c, g, or t
  misc_feature (165)..(166): n is a, c, g, or t
  misc_feature (171)..(171): n is a, c, g, or t
  misc_feature (184)..(184): n is a, c, g, or t
  misc_feature (199)..(199): n is a, c, g, or t
  misc_feature (219)..(219): n is a, c, g, or t
  misc_feature (253)..(253): n is a, c, g, or t
  misc_feature (258)..(258): n is a, c, g, or t
  misc_feature (266)..(266): n is a, c, g, or t
  misc_feature (288)..(289): n is a, c, g, or t
  misc_feature (308)..(308): n is a, c, g, or t
  misc_feature (311)..(311): n is a, c, g, or t
  misc_feature (317)..(317): n is a, c, g, or t
  misc_feature (319)..(319): n is a, c, g, or t
  misc_feature (326)..(326): n is a, c, g, or t
  misc_feature (328)..(328): n is a, c, g, or t
  misc_feature (334)..(336): n is a, c, g, or t
  misc_feature (345)..(346): n is a, c, g, or t
  misc_feature (353)..(353): n is a, c, g, or t
  misc_feature (359)..(359): n is a, c, g, or t
  misc_feature (364)..(364): n is a, c, g, or t
  misc_feature (383)..(383): n is a, c, g, or t
  misc_feature (385)..(387): n is a, c, g, or t
  misc_feature (389)..(389): n is a, c, g, or t
  misc_feature (401)..(401): n is a, c, g, or t
  misc_feature (405)..(406): n is a, c, g, or t
  misc_feature (409)..(409): n is a, c, g, or t
  misc_feature (411)..(411): n is a, c, g, or t
  misc_feature (414)..(414): n is a, c, g, or t
  misc_feature (426)..(426): n is a, c, g, or t
  misc_feature (436)..(437): n is a, c, g, or t
  misc_feature (445)..(445): n is a, c, g, or t
  misc_feature (449)..(450): n is a, c, g, or t
  misc_feature (453)..(453): n is a, c, g, or t
  misc_feature (456)..(459): n is a, c, g, or t
  misc_feature (462)..(465): n is a, c, g, or t
  misc_feature (468)..(468): n is a, c, g, or t
  misc_feature (470)..(470): n is a, c, g, or t
  misc_feature (498)..(498): n is a, c, g, or t
  misc_feature (507)..(507): n is a, c, g, or t
  misc_feature (512)..(512): n is a, c, g, or t
  misc_feature (524)..(526): n is a, c, g, or t
  misc_feature (533)..(534): n is a, c, g, or t
  misc_feature (593)..(593): n is a, c, g, or t
gtttcttagtaatggaatngtggggaagaacaaaagcgggctctgggactcacattgctttgnnggangctcaagcttccnanaatnnnttntnnntnnnnanatttttgagtnntnnntttttgtannntnntnanagnnnnnnttgntttgnttnattaatanntgaangtatgctcgctcnttgcgtttatttttnagacaagtgatttggtattnctcattctttgtttttgagcttggggatttaacncggantttgtggntttgatggcttgttttgttgtnntggtatgggttgggttagnttngtttanangaataantncctctnnntcggctatnntgattanttgttnggganttgctcagtggttagaggngnnngngggtttgcatgntttnnttntnctnttgttgggggtntttttttggnntgatgatngtgnnacngcnnnnctnnnngcngncattttctttttcgcttttagaaggggnagttggtcnttggngtttttctgctnnncggttgnnttatggaatagtattagttttgcagatgctgggtattgatggtgaaggtggtgcagttnaaatgtttgctcttgc

SEQ ID NO: 684127 - DNA, 698 bp, Homo sapiens
  misc_feature (16)..(16): n is a, c, g, or t
ttcagcttgggctccntgctttgtcatgagctcaaatcagccttccagcgccataagtatgatcggatcagctatcagaaaatgtcatcgtccatcgaggtcttttgcaaaggctatccctccaattctcaacatacttgaacatgtgcggttactgcgagtttgtcgtctagtctggctactcttacatacgtcagctcttcagcaacctcttccgccggcagggcttctcctatgactacgtctttgactggtacatgctgaaattcggtgcagcccggaatcccgagtatgtgcaccgggatcggttagaacccgaactcgaggataggatggggcattatcaggggtccgcgactcgagccttgctccctggcccaccctcggtggccaatgccaaccggctcagcagtgccgcagagcctgtggcttgcactccagcctcctgcatccagccggctggcaatacttctcccagagcgatcttgcgggtcgcccgggacagcaaggtgagtatgagtctgcacaggggtgcgcccgccaacgtatcctcgtcagacctcactggtcgtcaaaaggtctcccggatcccagcctcacagacaagtgtgccatttggccatctcggtaagtgagtagagcccccattggaccagtgtttgcttagtgtcttcactgtattttcgttacaaaaaaaa

SEQ ID NO: 684128 - DNA, 108 bp, Homo sapiens
gctccgcggtgttgcgctcccgcgtgttgctctcgtcactctcgactgcggcgacggcgttatgggccgagctccacgcatcatttcaggctagttgattcggcaggt

SEQ ID NO: 684129 - DNA, 194 bp, Homo sapiens
atcccatacgcggtctgactggaggtacgatcggtatgcactgaagcagagccagtaaacctgagcgggatacagcccctactacaagacattgaagagctcggggacagatctagacgcacatatgaaaacaaccgggtcatactggagattgacaatgccaggctgcttgtggacgacttcaggctcaagta

SEQ ID NO: 684130 - DNA, 132 bp, Homo sapiens
ggcacgagcgagtgtgtggaactgtgaccttcatctttcagatggtgatctacatgggagttgtgctctatgctccgtcattggctctcaatgcagtgactggctttgatctgtggctgtccgtgctggccc

SEQ ID NO: 684131 - DNA, 872 bp, Homo sapiens
cgccgggggcctggtgcggtgttgtgcctgcccccggcctcgccgagtgcagtgcgcccgaaggccagtgcctgcgctcctgtccgcggcccggcgcccagggtgggctggggatgtgcctgcgcgcagtcgccgcactgctacacctgccggctgcctgtcgtttcgctgtcgccctgcttcctgtgccacctgctggcctgccattttttgttctgcgctggaatgcgccgctggtaggtgtgggaacccaagctgggatgagcctgctgggatttgctgtgccgcctgccatgccgtctgtccccgctgcgggtggccgtgtggtgttgctctgagcaaccatgaacctgtgagcatggatgtgcgcacaacattccctcagcaaactggggattcagctgtccgatcctttggaacaggggactcactgtgaagcttccaaggagccagcttcccgacaagcccaatgtttatgatttcaaaaccagcatatgaccagatgtacaatgatcttcttaggaaaggacaaagaactctatacacagaatgggattttacatatgctggacagaaataagagaatcaagccccggccatgaaagattccagaactgcaaagacctgtttgatctgatcctcacttgcgaagagagagtgtatgaccaggtggtggaagatctgaattccagagaacaggagacctgccagccttttgcacgttggtcaatgttggacatacagggacaagcacggagtgaggcccacccttgtgtggccgtttctcattctgtgagctctgccagttgtatccaggaccccggaccaccttgcgaacgagattcgcgagctgtttcgcgagtcgaggggac

SEQ ID NO: 684132 - DNA, 605 bp, Homo sapiens
atgacccctcatggggtcagacatggctcctgggtgtccacgcacactgtccactgggccagtgccaccaggatctgtccgtggccatgcgtgcacagagaggcgaagccatttgcctgaggagtcccagcagcggggatgagatcctgatgcaggactcacaggccacactccatcttgcccgctccctggggcagctgccgttgggctaaaaatgcagagagccctgagttcagatctgacctctgccgcatagcagccgtgtgaccttggacaagtcacttgtcccctctgtggagggggaggaccagggtccccgttccctggggctgcggtgaggtgcaagtctggagtgagtaaggggagccccgccaccccaagtcatgtattctggagctgtggtgagggttagatgtctcagaaaaggaagagatgagggggccttcgtgaggggcacacaggcttcggaagtgaggggtgagttcacatgcccgtgtcggttttgcaggagcaggctcacctccaaactcacccagttgtccacattcaatatctgaaggcttctgtatatcaatcagacctcaataaagtggttcaaaaacaga

SEQ ID NO: 684133 - DNA, 102 bp, Homo sapiens
cagagtcggtatttgggccctgacggcactggccccaacatcctcaccgacatcaccaacgggttgcagatacctcaagcgagaatcaatggacagctgtgt

SEQ ID NO: 684134 - DNA, 350 bp, Homo sapiens
ctgagttcagtatgctgttcccgtgtcctcaaccgatctcacgttgaatttaattcttaatgtttggggagggacctgatgggaggtgattggatcatgggggcacatttcccccatactgttgttgtgataatgagtgagctctcaggagatatgatggtttaaaagtggtggcacttcccctctcactctctctctctctctctgctgctctgccctggtaagacgtgcttgcttcccatttgccttccaccatgattgtaagtttcctgggacctcctagctatgcttcctgttaagcctgcagaactgtgagtcagttaaagttcttttcttcataaattacccag

SEQ ID NO: 684135 - DNA, 692 bp, Homo sapiens
atgacccctcatggggtcagacatggctcctgggtgtccacgcacactgtccactgggccagtgccaccaggatctgtccgtggccatgcgtgcacagagaggcgaagccatttgcctgaggagtcccagcagcggggatgagatcctgatgcaggactcacaggccacactccatcttgcccgctccctggggcagctgccgttgggctaaaaatgcagagagccctgagttcagatctgacctctgccgcatagcagccgtgtgaccttggacaagtcacttgtcccctctgtggagggggaggaccagggtccccgttccctggggctgcggtgaggtgcaagtctggagtgagtaaggggagccccgccaccccaagtcatgtattctggagctgtggtgagggttagatgtctcagaaaaggaagagatgagggggccttcgtgaggggcacacaggcttcggaagtgaggggtgagttcacatgcccgtgtcggttttgcaggagcaggctcacctccaaactcacccagttgtccacattcaatatctgaaggcttctgtatatcaatcagacctcaataaagtggttcaaaaacagaaaaagaaatgttacataaccttttttaaaaaatggaagagcaggccaaatccctactcccctggcagctgtgggtgcagaataagtg

SEQ ID NO: 684136 - DNA, 150 bp, Homo sapiens
catccatacggaaagtcagtagaaaggggtggtgagacgggagaacccaaggcgtctccggtctgactaccaaatgaaacctttagtgtaccaggtcaatgtttccacgcccttggtaatcgcccatgacaaacggtccttccccatctc

SEQ ID NO: 684137 - DNA, 291 bp, Homo sapiens
agattgcagtgagccgagatcgcaccgttgcactccagcctgggcaacaaagtgagactccatctcaaaaaaaaaaaaaaaaaaaaaaagaaagaaaacaaaagtgctagaaaagtagattttaagtgttcttaccacacacacacacaacaggataaataggctgggcacagtggctcttgcctgtagacccagcacactgggaggctgaggtgggaggattgtttgagatcaggaattcaagaccagcagggcaacatagtgagacactgtctcgcggaaaaaaaaaaa

SEQ ID NO: 684138 - DNA, 100 bp, Homo sapiens
gctgacttagaggatcccattgatttaacgtggtaggtatctggggctccgggtgaagaacctgtctggaagagctcgtctatgatgctggacgcgcggt

SEQ ID NO: 684139 - DNA, 965 bp, Homo sapiens
  misc_feature (1)..(1): n is a, c, g, or t
ntcctatagctggggttttctcccgggcgtcaacaagttttatccaggccggagactttcctgcgcttactacccgggatagctgtgcctcttgtgttaccccgccccttctcggtgtggttggcgccaggacacccgcccccagttatagatgggtaacccacgccccgttttatccccgcgggtctcgtgtggtcgctccagttctcaccacccccccacgtgtgtggagtcgctcccggacgccgtccgagtttgagagatctgtcttaaccccactgtcccctctgtacgccctccggcgataaatccctggctgttggctaacaggtctacactttggggaaaaacaccgagctgccggcccccccaaccttccggggcccacagtgggtaccgccccccccccccggcagccaccgcctggggggaacaacaggagcaacgccccgcttccacacataaagaggaccgcgggggtgcccaccacgaagacaaacaataacccacatctgtgtggtgggcccgcacccacacaaagaagagtcgttgtccccaacaaacagacacatgagaaaaaaacaaggatggagggtcatgttgacccacaacggcgagagtcccactatgcacatcagcggtggggcccgcccacctctcctctcttaattaatcctctccctaaatggtgataaaacaatcttcctcacaatgcgccaccctttcaataaccggtgggtcttccccgcgaacccccataacatccatacgacatcagttctttttcaagaacaccactatgagcgccacaaactatccaacttacaaagtgctcgtggtgtattctcgcctatgtgaattttgcgacttgtgttgtaatttttctacacatgaatcccccctggcccccctcagacccaaaaaaaaaaacccgcccacaaaacaaaaaaaacaaaacataaaaa

SEQ ID NO: 684140 - DNA, 311 bp, Homo sapiens
  misc_feature (41)..(41): n is a, c, g, or t
  misc_feature (68)..(68): n is a, c, g, or t
acattgatttcaataagtagagatgacgccagtgaggcagntcacgcctgtaatcccagcactttggnaagccaaggcagaattgcttgagcccaggagtttgagaccagcctggggaacatagtgagacccccatctctacaaaaatatatattttttaaattagatggacatggtggtgtgtgactgtagtcctagccacttgggaggctaaggcaggaggatcccttcagcccaggaattcaaggatgcagtgagatatgattgtgccactgcattccagcctgggcaacagagcaagaccctgtctt

SEQ ID NO: 684141 - DNA, 115 bp, Homo sapiens
aataaccccttttaatgccttggtgtaagtatacctctgaattttggttgatttaaatttcttttctgcttattttgtattttcatatgacatgaggaatgttaatatgcataac

SEQ ID NO: 684142 - DNA, 211 bp, Homo sapiens
tctttctttcgcacaggctggggtacagtggtacgatctcagctcacgtgcaacctctacgtccagagttcaagcggttctcctgctttagccttgccaggagctgggattgctggtgtgaaccaccacacctggctaatttggtgttgtaggtagagatgagagcttcttcatgttgggcaggctggtatggaactcacaacctgggctg

SEQ ID NO: 684143 - DNA, 223 bp, Homo sapiens
tctccccccccccccctttttttaggcccccccccccaggggccggttttggttttttttttgggggggtccaaaaaaagggggggggggggggggaaaaagggggtttttttttttttttcccccctcccggggggccggggggggggggggggggggggggggccccccccccccctttttgtttttttttttttttttatgggggggttttggtttttta

SEQ ID NO: 684144 - DNA, 155 bp, Homo sapiens
aggctgttggagtagcaagagaacagttgcccagactcagaattttaaaaaaaaaaatggagcatgtagtattatagtggccgatgtcttcactctaacttggttatcgagactaaaaccattccctcactagctcaaccatgctgaaagaaaat

SEQ ID NO: 684145 - DNA, 306 bp, Homo sapiens
  misc_feature (179)..(179): n is a, c, g, or t
atgcccttgtaatcctagcactttgggaacaaataattgttattgctaataatagcacttagggaggctgaggttggaggatcatttgaggtcacgagttcaagaccagcctggccaacatggtgaaaccccatctctactggaaatacaagaaaattagctgggcatggtggtacacncgtgtgatcccggctgctcgggaggctgaggcgggagaatcacttgggcctgggagacagaggttgcagtgagctgagatcgtgccactgcactccagcctgggcgacagagtgaggctctgtcttt

SEQ ID NO: 684146 - DNA, 450 bp, Homo sapiens
  misc_feature (8)..(8): n is a, c, g, or t
  misc_feature (10)..(10): n is a, c, g, or t
tgaaactncnttactattggtcactgggcttcaggaaagtaaccaaatagaagagaggaaatggaggcaagcacaatgttaggttaaaaccctgttctgggaatcccacctgttcccagaagccacaggtgcctacctagaacatcctaaaaacaaccattcaaaaacactggggcgcaaggcaccctaagccccacagtccatttttgtaataatgatgtgcaggagtggatgtgcatgtgcgatgcatgcaccttcccacaagcaataatattcatagaaaaaaataggaaggctatgcatcgggtcactattggttttcatcaaaagccagcaatgctgtcacaatgagaatcgtgtaatatatttctctgtacctcctgaatgcttgacaatgcatatctgttaactttataatcagcaaaaaatatatgtattcttcaaagtgga

SEQ ID NO: 684147 - DNA, 155 bp, Homo sapiens
ccgggtgtatcaaggtgcagtcacactaatcataacttatttgatacggtacgagcgctcatcagtatcactaggccgtagtctgtcacctcgatgtgaaacattcctgcacatctgtacccacgccttcttcaaagccatactatttatgtgct

SEQ ID NO: 684148 - DNA, 960 bp, Homo sapiens
  misc_feature (825)..(825): n is a, c, g, or t
ccacattgtccggctccctttccttggcccgccgaccgggctcgctatgatgcattcttttctgggcccgcgcctcatgatccggccgtctgcattgtccctctatttttggggtcccctcccgattccgcggtcactacgggaatctctggatttcaagtggacgcgctacatctctgccccggttgcaaccgtgcactgctctcctgtcagcgtctgtgcctcacacaccttcttgggccccccctttggagacccgcgcgccccagggtcccccttgtgccttgttcgcgtttctgtagctctctgtgtgctccttcttgtcccccccggttatgtcctcctgtgtcaccttccgtgacctctgggaccgtgcaactcccctggcctgaagctgcctttctgcgcgctttttaactggggtcgtctctttccggagcccccgcgtttcctgccccaatttccccctggaagggcccccgggccgaggttcgaccgcggctttggcagcggcagaccttttggccctttttcacaggtccggtgcgctctgctttccgcgtttcccgcgcccgatttcccgttcacgtgccctggcttagacgcgccggacacggacttgattggcgggacccgcgctgcccgagaaatgggtcggagcccattacgtgtggttttgcttccggcgagacccttcttgagagctgttgcagaagcccgctttccccggggccccctaggcggggcgcggggttgggacccacacgggaagccggggcacacctggctatccaccggcctcgtcaactcggtttaaccaccccngggcgggtcccgcgaagggaaggctgcgttttcctcccgctatcaagttcccgttcgctttcgcacctccgggccccggcggctggctaatgttttgtttgaaagatcggtggaactttttaagagagtatttta

SEQ ID NO: 684149 - DNA, 297 bp, Homo sapiens
aagtgtcttttatgcaatacacaatacaaagtcaattttgatggctgctatacaatacttaggaatctctgcaatactttactacaaataacactgcccaagaggtcagggaaatcagcctgaagaactgggtaccggttctatactttgtggaaattacagcctaggaatgttatacccggtacagatgtacacagtcacaacggcttatcgagctgtttgccgcgcttcttgaagtgtactggaatcagtgctctgcctgttaactttagtatcatgctgaaagacaagctcttc

SEQ ID NO: 684150 - DNA, 298 bp, Homo sapiens
gaggggtttctcaagcttccactcttaacaccgccatcttctacctctgcccttctccgacatcccactttctattgacgttctctctgagctacctaagtagtaagtgggatgtcggagagaacgtcaatagaaatccgacgttcacatctgccctgcagtcctgctggaatccctgaggccacagtggagtcctgcctgtgtcttcacctacagcacttgcccaagagctttgatcactttttctgtaatgagaatttgctaaatgttctgggaaactaatctagttaataaaatt

SEQ ID NO: 684151 - DNA, 964 bp, Homo sapiens
aaacgccatcttccaataattcgactaaatgactgaaccctaaggcaaagaagagaggcacccgatttatgttctctaggccttcagaagacatgcaccttgttctttgtgaccagatatattggcgagatctccattcaaagagaagcgtgatattgtccacatcacgggaatagcgcatactgtacaaaaaggaattgcccttaggatggtgttaccatgggaacagctggatccagtctacaatgttaccagtttatgcagtttggatcgtagacagtaagactaatacaaggtttgagaagcgtgcctgcggactttcctttggtccaaaggtaaggaagtaaaacacttgtcgcgcgttagtttgcacgtgatctactttcacatgtcgaccgtgccattacagtagtcccgtaatgattaaggactttcccttgggagacaacgttcgtttgtaccatgggcccaattttggagtcagacaccataaaaaacaagttcttgaacaggtggcggctccagaaaagcgtatcgtgtgtcggtgggggggaaacccaacaattgcgttgatgaaaccgttacttgtcgtgaccattaacggccattgggagggtagcttgagggagggcgccctccgtaggagaccgtatcgcaacgtttgacattgtggaaccgactaatattgagtgggcaccgtaccggggaacgactcacttgccccgtataaaagggcgtgggtgtaggcatcaaagggaagcttctgcacccaggaaaggtatgcaaagggtacaccggttgtcgttaaacactgacgcagttgcatgtaacaacgaattattcacttggtcggtttagttgtaaggggttgacattcagtaggtgaatgctcaagcgcattgtagagcttgcccatttgaaaatttcgtgacgaaactttggagaactactacggcggcctatt

SEQ ID NO: 684152 - DNA, 208 bp, Homo sapiens
tgatatggcaggtggtacagcggtggtcacgtgcgtgcccgaccaccgcattgcctcaatcatgtgagggccgcgcgtttagtgcgttgccttcgctggttgaatccgcacgcaaagcaagtcaacgctcaatctgcacccgcatcgaccgcgcatctggcaagcccaaagcttccgccgcggcgtaagagagatcgataattcggcc

SEQ ID NO: 684153 - DNA, 481 bp, Homo sapiens
ttatctgcttctgaaattgtagaatcttttctttgtcctctgtgtactgaaaatttacaatgatgtgcatggcatgggcctattttccttctttttttttttgggggtgaggggggcatcccctagggggctataattcaaaaacttctgttcttcaattcgggaattatggcttcagctatatcattaataagtttctgtacttccctgggagatcgtttggtcccaaatgtgaggcatccggcatggtactcttttttaaatcccgaatctgtgtcactttcaaaaccttcaggcccccctctcaaggtgatatcagaggagcagctggtcaatgacctcgagcccaaagagtccaagcttccaagggaatcttctctcttatggtgcctgggaggagcaagaaattctccaggttcaggacaccagatgtcaccgtagccatggtccctccagtaccggctctggaaagcttggaaca

SEQ ID NO: 684154 - DNA, 176 bp, Homo sapiens
aacaacggataattctttatatccagaactacttttatcttctgatatcatagaaacactgtcattgtaaacttcttgattgcatccattgcccagataaaggtcaagtgattgtcaaaaggaatctccttgtggtaacatacgattggggagttttggaagcaaaaggccaacat

SEQ ID NO: 684155 - DNA, 605 bp, Homo sapiens
ggattctgagctcgttatgtattctccctgtgacaaattcctgtatcctgctttctatcacattatgcttcatctcactgcagcatgctatgtttacccagtttattgaacacagtcctgaacaagcaatggagagatactagttctgacaaggtagccatttcatatattggcttctcaattgctcacttcttaggataagagttgggctaactcatcgattcccaggcttgtgcgcacattggaatcacctggagagctttaaaaaatgtggatagagcatccctcccctagagagtctatggtaattagcttggggtgtgtgggggtttaaagttctcttggtgattcaaacgtgcaggcaaggttgcgatcctctagactgaatctacttaacgctaggagtttaatagaccaggttcaatctccagccagcaatgacacctcaggcataatcacttcaccgttgtgagccaaattccattatgaaattaatgaagattaataatatctaccttgcgaatataaggatcatacaagatcatagcacaggacaggcactcaagcaaaggtaactattattatttctcctaaaacaacagttc

SEQ ID NO: 684156 - DNA, 462 bp, Homo sapiens
  misc_feature (16)..(16): n is a, c, g, or t
  misc_feature (32)..(32): n is a, c, g, or t
  misc_feature (59)..(59): n is a, c, g, or t
  misc_feature (69)..(69): n is a, c, g, or t
  misc_feature (327)..(327): n is a, c, g, or t
acttgaaaatttatcnggtattttttaaaaanccgttcctaaaatttttttgcattaancctttaaacncccttaaaaataactttgaaacccctaggagattaaccccaaacacatttaaagtttttgaaaatagtcaaagaaaatagaagataagctcagttttcggagaatgagattaacaaggagcgaaaaacttgaaacggaatccagcgcaaggccaagtttagcaaagtgagcgctgaaggactccagactcttcggaaaccttgggtgctccctggccaccgcaacttcctgccccgggcggctccaggctccgggtgncgctggcttacataccaatggagtatgcagggactgtacacgaaacgcagagggggagggaaaaggctggagttgctctgcctccctcctgaccgctgtccacacccgggcaagaaggtatgcagatcgcacccc

SEQ ID NO: 684157 - DNA, 170 bp, Homo sapiens
tgatctaagatccgagtatgctgacagcatttagaggcgagggagtggatcaccaagtcggagtccagagcagcctgaccaatatggagaaacccacctctactgaaaatacaaaattagctgggcatggtggtgcatgcctgtagtcccagctatttgggaggctgagg

SEQ ID NO: 684158 - DNA, 406 bp, Homo sapiens
  misc_feature (14)..(14): n is a, c, g, or t
  misc_feature (129)..(129): n is a, c, g, or t
  misc_feature (144)..(144): n is a, c, g, or t
  misc_feature (261)..(261): n is a, c, g, or t
  misc_feature (323)..(323): n is a, c, g, or t
  misc_feature (366)..(366): n is a, c, g, or t
  misc_feature (378)..(378): n is a, c, g, or t
cgcggcggggttanggggagcctggagcccgggagcgcgaccgcggaaggaggacggcggcgacaagatggcgtcgctcccgggacgacaggcggcttcacggcctggtgtcgggacccggctgagganactccccgagatgcnaagcctccccggcgtgcgcgccctccggagacgagcggacgtgcgctgcctccaggggctcgggctgcgagggtccggctaaacccaaggcgccgacgacaagccgctgctggagcnggggtgcactggacacaggaagtgacccatccatcgcacagaacaccaagtttcatgcagantcaaaaggcccccaatcagaattcttcgagaaatagggcaaantgaattttctanaattttctttaaaattttttttttcctt

SEQ ID NO: 684159 - DNA, 217 bp, Homo sapiens
gcgggcctttgaccaaattcgcatggccgccatttccgaaagcaacatcaacctttgcgggtcccactggggggtttccatcggggaaaacgggccctcccaaatggccctaaaaaaactggctttgtttcggtcagtccccacatcaactgtcttttacccaagtgatggcgttgctacaaaaaaggcagtggaactagcccccaatacaaagggt

SEQ ID NO: 684160 - DNA, 724 bp, Homo sapiens
tagggtagccaacagcctgcaagtcatctactagaatgttaaaatgttcccaaacaagcaaggtgtcatcgggtatcaagtgtggctgtgagtgcagcagccagaggtagcagcatcacctatttccacgccagtaacagctcccggggtgcctcaataccggcacccggcagaggctatgtagacaaaacagaatctgactcggtccctggaagctgcttctctgggggttgtcatggccatagctgccaaggagagcaggtgctgctgtgacgctggtagcgactagggcagcgctgtgttctggagcatctggcgacgagaaaccatggctggccctcggacacagaagcacatgggggtattgccagtctcagaccagggcacccctgggcactcttctactgggctggcctctaggtccatggaagcacagaacaatgggtcctttagaaatggtgttttggtttaacaccaggaagaggccgaccactgtggcggggccattctcatacctgggtgtcggggtgaaagaacgcccattgaaggaggggttaatcagagcaagaggaccagggttacccgggcacataacaaggcttaagaaatgacgccccaaagtccacgatgtttacctttaacctagaaccgtgttggcttcaaaaagggcactcctaggttcgggtgcacgatcttcgtgctaattaacccctctaatggggag

SEQ ID NO: 684161 - DNA, 632 bp, Homo sapiens
gcggaggtggcagccatctccttgctcggacatcagtggacggcctcagaccccttgtgaagtcccaagatcgtgccgtaaagagaaccgaaagaagttgcatccgggcaccagatcagaccgatatgtcaaaatgaagcgtaactaggcggaaagcctcaggaggcatagagcggacagggttcgttagaatgatctcaagggccacgatcatgtgatgcccagcagttggttatggaacgcgcatcacaaggacatccaagagtcgatcagtgcttgcccatgctggacattacctggtatagttcctggatccaacgaaccgtcaagtgagctagtgaagtgcctgcatgatgtgcacacaagatcgttacgtgtggccgaaggatacgtcgtcatcgaaatgtatttcgcgtacctaagttaatcgcgtcgacataggtccgatacgttggtagagaggacgctgacgcaacctaggaccatcgaagagtgcaccaagccctcaattgccgaaggctgcagacagtgaaaggaacacatgagtagggcaggctgcatgtggcatcgtttgtcgtgtttaaagtaacatgtaatagaactggcaaagacaaaaagtaacaaaaggaaac

SEQ ID NO: 684162 - DNA, 329 bp, Homo sapiens
ggggagggggggggcccccctcccctggttttcccaacccccttttaaagaaggttttcaaccaagggggggggggggccatttccccccctttttttccgggccccccccccaaggcccccccccccttaaaacccgggaggcccccctttttggggggtttttttgggggggggggaaacaaaccccccttttgcaaggggaagaaggcccccccggggttttattttttcccctccaaaaaggcccccgggggtttccgggataaaaaaggggaaaaaaaaccccccccccccccccccggaaatttgtttttttagggcaaccca

SEQ ID NO: 684163 - DNA, 356 bp, Homo sapiens
attttacctttatttgaaattctccacaacaaaaagtaaaataaataaataaaagatgtatgtctcttaaatattttataatgaacataagagctgtgagaagttctgggtagaagacccatttgtttgtatgagctcttccaaacttacagatcactgaactattcttttcaaggaacatctgtaaatttctctcctggacgctttgggaatggctatacattggtagaaccaatgtttttccatgtataattgtccatgataatttctgtcttatagcacataaaaaatccatctacatattgaaaaacatgaaggtaaaatgtggaaaatgtttaaaatataaatgtttaaat

SEQ ID NO: 684164 - DNA, 153 bp, Homo sapiens
ggtgatctagatgatcccggtgttcctttgtctacaaaaatacaaaaatagccgggcatgatggcggttgcctgtaataccagctacttgggaggctcaggcaggagaattgcttgaacccgggatgcggaggttgcagtgaggttgagacca

SEQ ID NO: 684165 - DNA, 292 bp, Homo sapiens
  misc_feature (30)..(30): n is a, c, g, or t
  misc_feature (84)..(85): n is a, c, g, or t
  misc_feature (116)..(116): n is a, c, g, or t
  misc_feature (146)..(146): n is a, c, g, or t
  misc_feature (180)..(180): n is a, c, g, or t
  misc_feature (235)..(235): n is a, c, g, or t
  misc_feature (242)..(242): n is a, c, g, or t
ccgggggttacaaaacccccttaatagagnctcccctatgaagttacaagaagtaaaccaaccatagggaagaatttgatgtgnnctttgaagccactgcttgtaagagaagacancgtgtaatttttgagttactgtatgacccncgttggaaatgtttaaagccttctgtaggcatgntgtggtggctcacacctgtaataccagcactttgggaggccgaggcgggaggatnacttgcncttaggagtttgagaccagcctgggcaacatggtgagactttgtctctac

SEQ ID NO: 684166 - DNA, 106 bp, Homo sapiens
cgaagcttgttgctgctttattgaaacttcctccctgtcgcacacaaagcaattacacaagggggaattgcctggtagctcttggtttgccttctccctctgtacc

SEQ ID NO: 684167 - DNA, 395 bp, Homo sapiens
cagcgctcgactgacaggaacgtagaatctattggtgagtattatgatgtggggcagcacatggaagcccatcatgcgtgcagggcctcgccatgtatgttctcacagggccacgcactgggcgatgtacttgaccccgatagccatctgggatgagctgcttttcagccaccatgtcttcaaattcatcagcattgaacttggtgaagccccacttctttgaggtgtggatcttctggcggccaggaaacttgaacttggccctgcgcagggcctcaatcacatgctccttgttctgcagcttggtgcggatggacatgataacttggccaatgtgaaccctggccacagtgccctggggctttccaaaggcacctcgcatgcctgtttggagc

SEQ ID NO: 684168 - DNA, 346 bp, Homo sapiens
gggatatcgtcgacccacgcgtccgtttttaaagaggaagtggggggtggatcacgaggtcaggagatcgagaccatcctggctaacatggtgaaaacccatctctactaaaaatagaaaaaaattagccaggtgtggtgatgggcacctgtagtcccagctacttgggaggctgaggcaggagaatggcaggaacctgggaggtggagcttgcagtgagccgagatcacgccactgcactccaacctgggcgtcagagcgagattccatctcaaaaaaagaaaaaaagagttaaagtgatgacggtcagaattcacagtgggtttctagttttctggagctatgt

SEQ ID NO: 684169 - DNA, 100 bp, Homo sapiens
aagatcatgccactgcactccagcctaggtgacagagcaagaccctgtctttaaaaaacaaacaaaccaagaaaaaaaaagatttccatgaatccagtgg

SEQ ID NO: 684170 - DNA, 142 bp, Homo sapiens
ctgtctctgtgtgtgtctgtgcacagtgtgtgtttactgtcacaaaggcacattttcagacccctactcctgtggtgacggacaccctgagggtccccatggcaggactggccttttcccatcaagtgggtccataatggga

SEQ ID NO: 684171 - DNA, 336 bp, Homo sapiens
aagaactgcagcattctccaaactaggatctcaccacaggctctcctactccaatctgtcttacaaccttagctggagttacctgccccaaaacaaacactgttccttttcttaaacatttttttggccaggcacggtagctcccacctttaatcccagcactttgggaggccgaggcgggcagatcgcaaggtcaggagatcgagaccatcctggctaacacggtgaaactccgtgtctactaaaaatacaaaaattagctgggcgtggtggcgggcgcctgtagtcccagctactcgggaggctgaggcaggagaaaggcatgaaccaggaggt

SEQ ID NO: 684172 - DNA, 1256 bp, Homo sapiens
  misc_feature (72)..(73): n is a, c, g, or t
  misc_feature (112)..(112): n is a, c, g, or t
  misc_feature (130)..(130): n is a, c, g, or t
  misc_feature (198)..(198): n is a, c, g, or t
  misc_feature (292)..(292): n is a, c, g, or t
  misc_feature (315)..(315): n is a, c, g, or t
  misc_feature (326)..(326): n is a, c, g, or t
  misc_feature (842)..(842): n is a, c, g, or t
  misc_feature (994)..(994): n is a, c, g, or t
  misc_feature (1142)..(1142): n is a, c, g, or t
  misc_feature (1190)..(1190): n is a, c, g, or t
  misc_feature (1198)..(1198): n is a, c, g, or t
  misc_feature (1206)..(1206): n is a, c, g, or t
  misc_feature (1222)..(1222): n is a, c, g, or t
ctggggcatctcggcctcaatacctgcatgagcacagtcatgtccaggccagggctgctggtcgaggtccgnncccatctcttccagcagaaagggagtaagcttgcagggnggctgggggacaagatcncaggatctcagcctctgctcatggatcagctctgagaccccgagtgagctgggggtgctctgtgcgcnttggtttccccagctgtcaagtaaagggattggatgaggaagtcttgtcaaggtggaatgatctcagatttggggcagcagtgaatgatcccgntccctgggccatgccagtggccnggcctcggctnaacacagccccaacactctggaatggggatgagggggcagtcagctcttgctcctagtaagagagatgcaacagggctctgtggctgagctgggtgccttgcctcacacctgtaatcccaacctttgagaggccaaggcaggaggattgctcgaggccgggaattttgagaatagcctggacaacatagccagaccccatgtctacaaaataataagaaaacacacagctatagtccaagctacttggcaggctgaggcaggaaggtcccttgtgtccgggaattggaggctgcattgagctataatcgcaccactgcactccagcttgggtgacaaagtgagaccctgtctctaaaagaaaaaaaaatcggcctgtgagcatgggcttgattttcaaacaggacccggagggtagggacagacagtgctgtcacccttaggtgctgaacactcagaaacgggccagcggcagcccttccctcacctgcagacaccagattgggcagaacagcacntggcacttgcagctcttgcagtgagggcagaacccagtgtcaacccttctgcctgtggaaggggctgctgaggcctgcggagaggccagggtggaggctcgtccccttgtccagcccttgggtggtctccaccaggtccccagcccaccagngcagggccccctgagcctgctgctgccacgggccctgtctctacccaggacgtccccccaccctcgcagtgtcagggaaatgatcatggtggcggtgacactccgcaggcagggctgcttgagagaagcttgagaagggtcacaattncaggcaggggcccgtgttgacaaagccctttttaccccgagagagttnaccagggnagtttaangagcagagccaaattnccgggagttcgagaaagttcttgggttgggttta

SEQ ID NO: 684173 - DNA, 191 bp, Homo sapiens
ggtcgtcgcgggacatgccgcaagcggtcgcacataccgacacagttccagatgtgggctggtccaacccaccagccagaccgaggagggtggatttaccggaccccgacggccccatgacagcggcaaaggtaccagggttgacgcctaggctgacgtcgacgatggcgtcgacccgctgctcaccctcg

SEQ ID NO: 684174 - DNA, 1141 bp, Homo sapiens
  misc_feature (1141)..(1141): n is a, c, g, or t
caccgatgcatacaccacatgaaacatcctatcatctagtaggctcattcattgtactcgtcaacagcagtaatattaattaatctgtcatgattttgagaagccgttctgcttcgaagcgaaaagtccttaatatgtaggaaggaaccctccatagataccatgcgtagatgactatactggatgccccctcgacccctaccacacattcgaacgaatcccgctatagcataaaatctagacaagaaaaggacggaatcgaaccgccctcaaagtctaggtattctaagcctcgaacccccgatggtcctccatggacttgtcttcaggagaacaagaacaaaacaaggaggggtgcagacatcgtagaagttttcgccctactggaggggctcacaatggtgtttacggctgtaccccaggttttctctgttgtgttacgcaacgtggggttgtcccctatataagtatggtaggtcactgtgctctttgtatacatatgcgctaacagggccaattggcggacacggcccacgatttctgacaaacacaatcgctcaacgttgggacgtggggggataaacacgatctggctctaacaatctgggggacgatgatcctctattctgggtgtggagaacacgggtggaacacccctgtaataatctaattgtcctctgtgcgccgcgctgcgtgggaaccgcaagttagcaccctgttgggggatccggagataggatcatcaacctcgtattacccaagaagaaggtatttctatagaaaaggacgcgctctaagaaaagggtggcataaatacgtctttttttacaagccatattttatatctccaagacagaggtggtctcaatataaagggcgggtggtggttgttgtacaccattggtatagatccctcgtgggcccaattttagttgttggtcctcttagtggacgaagggtgtttttgggaaacaccactggtgtaatatggggtcatttgttaacctagtggggaacgtgatatggtggcaacatttttaagagtagttggacaaacccaactaggtgtgatttattcattgttatgcccaggacaagtggaaggaacgcgtgaaatggtgtggtgtggacatattataan

SEQ ID NO: 684175 - DNA, 350 bp, Homo sapiens
aggggcctaaaaacctttttctggggatgggtttttttcacaggtcaaaggtttaaaaaaaggggccgccccccctcctttcccctattaaaaaaaggttgccaaaaaattttttttttttttttttggcccaatttttggttgggctgggggccccacccccaaagcccttgggggttttgtttttttttccccctttttttcccaaaaaaaaattttggggccccctggaaataaaacataatggttttttgggggaaaaagaggcctggggtgaggaaacccccctagggatttttttcttccttttcccaggggcaatttggaaaggggggtcttattttctcttc

SEQ ID NO: 684176 - DNA, 232 bp, Homo sapiens
gctagactctagagatcccctacagaaatagacaactatgtagcatgggcatgatggacagcaatggttgtatcaactatcaagagcgcgtccgcatagtgctgaatggctgaggaccctcccagtctccccagagtccgtgcctttccctgttgtgaatattgtatctaacctatagtttccctatgctttcttgtctctgctacttccccatctcgtctcttctcttgta

SEQ ID NO: 684177 - DNA, 369 bp, Homo sapiens
aaagaaaaatagaagatcataggcagggagtagacagaccatcgtccatatccagtaccagtgcactgagctatcaccgtgactgaaggccaaaccaacgagcagtctctccgcataggactgggcccatctatagcagcatcaggagacttagctaccatgactgcatttctgtaattcggaatatcttcctggatatactagaagcaggaaaggtgaggctctaaaggtatgtacacaggaaaagctgaaaaagcctatgtataaccttttgatgaagaaccatagtgataatgtgagttaaacctgctatcgccagcatggatgctagcagcttgaacacaatggaacccctctacctcatcttgc

SEQ ID NO: 684178 - DNA, 267 bp, Homo sapiens
aagttaatggttttttctgggcagaaattaaatttttttttccgcattttgccccgggattcttcccgtgggggccccgctttttaaaaacaaaacttttctcaaacattcatcattagacaactggggtttttgctggttttttaacccccccaaatgggtaggctgttgaacattccccattcaaaagtttttttggggggggggaaatggggggtcttcaatgtttttttttaaaaaaaaaaaaaaaagttcttgacttttcca

SEQ ID NO: 684179 - DNA, 125 bp, Homo sapiens
gattccattgatcctcatcgtcccgcaacatccactcgtggtcctgatacgcatcgattctgctagcctggccgatccatcttggcagtctaatagttgctttcctgtgatgaagtgtgcccatg

SEQ ID NO: 684180 - DNA, 134 bp, Homo sapiens
gcagtcatcattcagattaggaaattctgagaaatctagctgaccatcactgttggtgtacagatttcttcatcatgcgggtcatggacaccagggtccttctggcttctttgtgaaggcagctagttctgtat

SEQ ID NO: 684181 - DNA, 703 bp, Homo sapiens
gatatgagctgaaaaagtggctgagcctaagcgtgacaggtgtcaggtgccagtctcaggagtaggcaattgtcctgcatgcagtgaaaagccagaagatggaaggaaggacaggatgcaaatgagttctcggaacgatccacctggtggctgggtcagggagcaggcatggtgacttcagacctcatggtacgttagaggctaatgtgaagcccatgtgaagctgttggtttaaactgggtcgatatcagtggcacacatttactgaccatgtgtccagccctgtgtgaagtactgtagtaaattgctccaatggaaactcacaataaccacagaaggccagtaacagcattgtcgttattttatcatgacgcaactgaggcttagggcagacagctggtgggtggtgggactgggatttgagcccactggtgtcccaggcccggagcttggcttcttccattgtcttaccacagcctgcactcacaggagagtgactcataagttacaataccatctgctgaccatctgctctcacactagaaggaaagtctacttgggaagacaatttaggatccgaatttggtagttgaggatggagctaggaaaaagcggatacaggaggtagccaagttctgcttggacctgcagggagtgaggctggccgggcttccaggtggaaatgcccaggtgaaacagggcg

SEQ ID NO: 684182 - DNA, 113 bp, Homo sapiens
gcctattcaagtatcaataggttatttaggatgaaagttttaaaactaagtcatcagtaagctgctgccaccatacgtggactacgtcggataccggagctcgtaattcgcta

SEQ ID NO: 684183 - DNA, 129 bp, Homo sapiens
gaggatccccaacctaacagcgcctggttggtagaagggggctagggtattttaatcttagagcgaaagcctataatcactggcgcccgctcataaggggatggccagggctaggttaatacgatagtt

SEQ ID NO: 684184 - DNA, 108 bp, Homo sapiens
tggccaagttggactttgatcctttgggcagatgtcccattgctccaatgggccatctggaccaaaggtggggtctgtacacttgtttataataaatgcaatagtatg

SEQ ID NO: 684185 - DNA, 418 bp, Homo sapiens
cccagacctactgcaccttgctaccatacaaccttagtcaaaccatttacccacatacatgatacgcgcaagaagatgcaaactggcgccataagtatagtgccgcatgggaacgatgatcgcttataacacaagcataatatatcaaggactaacccctataccttctcgatattgacattaactagaaacttctttgcaaggagagccaaagctaagacaccccgagaccagtcgagctagctatgaacagctcatagagcacacccgtctatgtatcataagtattggaacatggataggtacaggctaccctaccgagactggtgatagctggttgtgcaatatataatgttaggtcaggtatagagtagcccacagaaccctatagattcccttgtcaatttaactgttgtgc

SEQ ID NO: 684186 - DNA, 1609 bp, Homo sapiens
ggccatcatcctggccaagtctctccagtcgtccccgatgcggcacgaggctactggggagaacaatgatcggtacagccctcgacactgtcccgttgtcaacggtgactaggcctgctgcggcttcttgtgtcgtggtacggcctcatctcgctgccacccagggcgtcactggtgctatcgtcgtctcgtcgaccgtgctgcctaagcaagtctgctcatgatggccatggctatgtcgatggacttgacgtgactcaccatcaggcccggtggtctgtacttgcgcacccgtgggtctagacttgcgccagaggtctcatcctttgactggccagttctctaaaagcctatgcagacctacctgtagccaccgaactctatggcaacggcaggactaggtaattccactcaagtctccccatcatcgagcgagttcaactagaaccaacgctgcgttcaagtatcgcgactagcccaggagttctcacgtgcgaaacgggaactccagtgtcttccaagcttgttgggactaagcacactagttagcgcggtttctatattagcgaatgcaaattatattaccacggtgacatttgaaagcgtttgagactgattgaatgaaacacacggggtggaggctccgtattgaaaagatgttaaccgcttcgatggcgtggcccacaaagcgttataaaactgcatgtctcacgcaaacgtttgatattgaggtcacaaacaaagaggaggtgccccaccataaaacacgtcgagcggtcgggaaatgaaacaaagagagcagaatgcgtaagaagaggccaatgccgggtgtgtagccacacacgcgttctggcgaactcgaggcggaaaacccactgggtagaaactttgcgagagcactcacgttgcaattagcgcaacggcgaaccccgttaacccatccatcagcagagacgcccgacgcaacattgtcaatatcgggcgacagcacaagctcaaaagcctgaaaccgagcagaacatttccacaaaccgttcaaacagccgcaatagctctattacgacacatttttgtaacgtggcgtgcacacacacgttggtcgaaacacaaaactacaccataacgcacttatgctcgtatttacagcacctgtggaggttcaccacgagaatatagtacatgtttccgcgagaaacaattgtttcttaaccaggagcgatgatatggatgatacacactcatccgcgaccagatatgtcgaccattccagaacgagccctcccaccaccaagaactctaacaacccaaaccctcaggatagaacacaaaagagggcaaacaatgatccacgtaagtagaaacgaacacacgctgaaagtacacttgactacgcaaaacgatccgacaacactaacgaaccgaggaggcacataaccaacccagcacacgagcatggaacagtaagcaaggcaacaaaacaacgaagcaaagcgtcggataagaacatatcagaacaaagcaaacacgtgacacagtagctagtacgacaaaaacaacactacaaaacaacacgtacgatcatagaacgagatcaacacaccaaccacac

SEQ ID NO: 684187 - DNA, 819 bp, Homo sapiens
  misc_feature (819)..(819): n is a, c, g, or t
gcgagtctgagtttttagttcaggggattcacgtaaagacggggcttcaccggtaagccaggagggtctcaatctccgtgacctcgggatcggcccgcctcggcctcccaaagggcggggatcccaggcgtgagccaccgcgcccagccccatttaatttttaacttaaaatgcctgccaaggagcagcctcaagcccagagaagactgaggctacggggaaacttcccttgctgcaggctgttgtaacactttaggggccccaggtctccactgccaagcaggattgtggcacattgagcacccacccacaaagcaccatcaggcagcacccagtgggctccacacagcccagtctctgtcccttcccttaggtaaagatcacacctgaagtcttcaagtcccacagaaaccaagtggggggtggtttccattcctcttacaggcagccatggcccatggttgaaaggccgggctggaggcccaggaaactcggtatactgatgtggccacccttattcccacttggggagcaccaggagccctggagccctttccaacccaatcccatctcgcaggagagcagggtctggggatcctgcactcaccgtctggtcacagagacacctcacacgcggggtcccactgttgcctttggaaaaaagagccgaatatgagtggacggacaacagtatattaaggggtggctcgaactcacaaaacggcaagtgtgtaccctggatcttgcccagttgccagttcccccacacaggattgtgtcctcatttctctgacaccccggtcactcgggaaagtacgn

SEQ ID NO: 684188 - DNA, 409 bp, Homo sapiens
taggtgactctgaggatcctattacagcgcagggagggtctggggctcctgttctagcctgcctgtccctgctttctttgctggctcatggcctggtgtctctgcagtgtatgactgccgtcccactacatgcagcctcctacagaccttaggacgggcttcatgatcttgtgttcacctgcccctccctgtcctcctcctcttccccaaactttgttgatgcctcaccttggcttagactccattctcacagcatatatgtttatggcaaccgtttattgacatacaattcacataccatgccacctgcctctttaaagcacacaggtcagtcatttataacatgttcacagagttgtacagtcaccaccagtcaattttaggacattttcatcacctcagaaagaaa

SEQ ID NO: 684189 - DNA, 327 bp, Homo sapiens
  misc_feature (16)..(16): n is a, c, g, or t
ggggttgtttttgggngggaatggttcttccaagtttgggcccttttgttcctcaagaaaaagttcccttgttttccttttttgggaggtttctttagggaaaaaaatttaaaaaaaaaccaaaccaaagttttttgccatttttgggtggagggtttttaattttcttttttcattttagggaaaaggttagcccccatttttttttcttagggccccccccccccccccccagggttttccttttctttaggggcattaccccagggcccttattgaggaaacaaaccccaggttttttcccctttttaaaaaaaggggttttta

SEQ ID NO: 684190 - DNA, 228 bp, Homo sapiens
aatgatgtggcgtttcatgagtatttcgttttcaattagggagatagttcggtatccggattaggattgttgtgaagtatagtacggatgctactctgtccaatgactcggttagaaagggttgcttactgtgttgtcctccgacttcaggtttcagaatgatggaggctctcgcggtctaccgcagctcatctacacacgctgatttgaacctcattgaaagaaccg

SEQ ID NO: 684191 - DNA, 668 bp, Homo sapiens
ggcgtacggggaggcggggtcagtggcttctggtgctctagggtgagctctgcccggtgcaggatggcgggaggggtaagctcatcgcagtgatcggagacgagacacggtgactgtttcctggctgcggcataggggagcttaacaagaacggccatcccaatttccctggtggtgtggagaaggatacaaccatcaatgagatcgaagacactttccggcaatttctaaaccgggatgacattggattcaatcctcatcaaccagtaccatcgcagagatggtgcggcatgcctcgtgacgcccaccagcagtccatcccctgtgtccgtgagatcccctccaaggagcacccatatgacgccgcaaaggactccatcctgcgcagggccaggggcattgttcatgccgaagacctgcgctaggggactctcatagccctcagcccttcctcgtttccaggcctctcccgaggcttgcaatcaagcttctttacttttggagctctgatatccaattccttgtcttcccattcaataggaggctaggtaaggcgcaacaaggtgcggggctctggtgtaggaaaaggaagctgacattttcttcaattactcttcctgtgctgtacacaggtgtccttgtgatgtaataaagcatatctgtctctc

SEQ ID NO: 684192 - DNA, 232 bp, Homo sapiens
  misc_feature (4)..(4): n is a, c, g, or t
  misc_feature (8)..(9): n is a, c, g, or t
  misc_feature (11)..(11): n is a, c, g, or t
  misc_feature (18)..(18): n is a, c, g, or t
  misc_feature (21)..(21): n is a, c, g, or t
agcngctnnantatgttnatngtatactgaagaaagagttatgaccacattatttcaatgtcatggctttctgaaggaagttatcttcttatttattttctgccactgaattctagattaccagagtggttgctcctggggatgtcttgctggtctgtccctccggaagaatgatgatgcttcctgcaggctggtatggtgaaagtaaagtcttcatagttcacatcattat

SEQ ID NO: 684193 - DNA, 331 bp, Homo sapiens
ttttttttttctgggagatttctttccttcctccctttctttacttcataataaaattgctccattgaagctgactagaaacaacgcaagcatcaccaacagcaaatatttctgttctttgctttctctgagaggacaggcgactagtcagggtgaggaagatggtggaggtaaatcagtttcaaaggtgggtgtgggaagccagcacacatgctgcttaacgtttagaacacacagcctggccggcgagaagctcaagtggaacgcagacaggtagcaattatgaatgtaccgtggtagaactgtctttgcagagaatggcctcttgctt

SEQ ID NO: 684194 - DNA, 713 bp, Homo sapiens
tcctcttagcgttcacccccgaatattgccatgcttggggcttttggagctgatgattgggacccctgaacatgttacgtcccagtgcaccagattccccatgccagtctgagaccgatgtggcgggtcccaatcgtcctgcgtgccctaaagatctccctccgaagatgtctatccacaccccgtgtggctatgatgcccggcccaaaccccggaagttggacccacccagattgtcatcttaccaccaaagagctgtgtgcccccacttttgaaaaacatggttgcccaggacccatttgaacccatcccttgctggtattttcataggccattgccattgctgccagaataatttgggcataataccctggccccacaaatttggttcagacgatatcgaagactgtcagggcgagactggtagaccccctgcaaccgctgctgcaagaacactggcaccagaccccgctttcgggaccctccggcgtgccgaactgatcttcgagctgccatggaccttcatccaccagatagccagcctgccagtctcgcctaaatggagctgccctttaggggagtgtaaaactggggaaatctgctccctgacagaatttaaaaaaaaaataacccgtatgaagtcgttgccccctgaatctctactgtagccctgaatttatggaccgttagatgcttaccccaaaaaaaaaaaa

SEQ ID NO: 684195 - DNA, 1553 bp, Homo sapiens
  misc_feature (1121)..(1121): n is a, c, g, or t
cacgacaccaccaaggtatgtggttgtttttattataacacacccgcgcgctctcctcccctctctccgcggggggggtatatgcacccccgccctggttaagtgatgtaccctcccggcgttgagcgaccacgcaatccaaaagggaggttgttattggcggcccaaaccgatctaattgagtagtgtgcgaaccgacccgattggtggtggttgttgctccccctcctggttatgcagaagttataattcagggggggggaagccacccctcccgcgggtgttaatattgtgaacaatgattttgggggggtcttgcctacccccacccacacggaagtaggtggtgggttttttttatacaaacaaccaccttcgtgtttgttccttcttccgttcataattaatccatgtcttgtttgtgaagaaccacgccaccacccagcctgttgggataaagaaacatttttgggaagaacctcccttcgtgctgccccccccgccttgcgtaagaaaaggagtaggtgcccccgccggcgccaccaccttcggaatgatcctccccatccgtgctctacatcagaatcctcgcaagcaggataaatgtagcccccccctgtcattttgtgggagacgccctttgttaaaaaattttgttaatatatgataacatacgtccctacacccctacttgttgatgacctccttctttaccaccaccacaacacctccccaccaacaccaggtgggttgctcctcctcatataaccacttcatctcccccactacaacacttccttcgcgccaccgatgttataataaaaaaagatttttgtcttcggcgcttttcgtgggggggctgcggagcaactcttcttcgcggagagccacacagcagatcatctcttcacatcacctccttctcttcgcagctgcacaccgcgtgaacaacagcatcgtgcttataagagaacatcctcgtatcaccacacaccagcgtcttcatcacacagctgctgagaacacatattctctatatatacgtccacacatgtagagtattcccacacatagacactcgtgtagacacacaccggcggagacacacacgggtttatacnccctcatagaagagatatacacagcgcgcgcgcacacataccatatatttctatagagaggtctcacatatatcacaccacacatatagggggtttttatacgcagcacctctcgagatgttgtgtgagatccacgcgagacactctcccgcagatgtggtgccacacccgctctatattataaagagtttttgctcttgtgtttcacaccgcagttataaagtcctaacgtggagatttgaggttcacagagcccggaggtaaatcccaggtctcggtttcttatatttatcttccaaattctcctccacctgtaccgaaaaggacacacaagagagaaaataaaggcctaacttcaccaagccccttcccccctaaatgataatcatttccacttagtatcataccccccccccccccaggaccgggttt

SEQ ID NO: 684196 - DNA, 953 bp, Homo sapiens
tggaacattccttggaccaggtgttgtattgcaggaccccttcccccagcagccaagccccctcttctctctcgctggtatcggcgcgtccaggatgtgtgtccgtagaggaagggacagaaaaattgtggcagtttaactatatatcgctcgtttttaacttcacaaataaatgataacaaaacctcccagtctgagggtgccagtctgtctacccccccctttacttccctcccgtgtagttagaagcggatgttgttctttatagatgtagtttaaaaagcctgataatggtgattgaaatttacaaacctgttgtgtaaacaactttttaaggaaacatataaaatcgtttcatcagcgcgcaaggggccttaccgtaacgcggcaccaaccccccattcacgcacgcgtaccaccacaacgggcctaccggttttacaaacaacaacgcccaccacacagggcgccaccgcaactaacaatatcccactgcagcgaccacaggtacaacctaacccaggccatccgtgtacaagcagctcgctcccgcaaaagcgaggcacgacataaaaaacccaagcccaggtggaccgacgtataaccacccccggcacggacaacacctgacgacacgtggcgacaatagagaagaggaacaccacaaccatgcggcgctgggcacaacgggcaacactccgcacacagatatagcgcccccaggcgcaagtccacaacacgcgtaaggcgaaaacacggcaagtgcggcaccaacagcagacgcccaaatgcaagttatacagagcgagaaaacgaacccccacaccatacggaggatgaccaggcatagaggcacagagctgcgaatgcgacacgctacacacagccaaacgccagcgcacaacaacaaagcaaacagacgcgagaaccgtacgaacaatccacgtgatcat

SEQ ID NO: 684197 - DNA, 137 bp, Homo sapiens
cgtgtcagcttctctgtgctgtcacctcctctgtgctgtccacctcctctgtgctgtccatgtgctgtccacctcctctgtgctgtccatctcctctgtgctgtccacctcctctgtgctgtccacctcctctgtgc

SEQ ID NO: 684198 - DNA, 856 bp, Homo sapiens
aatgacaggctgtacggtctggaattacggatggaggttgcagtgagccgagatcatgccactgcattccagcctggtcgaaagagctaaactccgtctctcaaaaaaataaaagaaaaaaaaaagttccagtcatgtaattatttaacagtcacgtgacctgtttatggaactcccaatgggccactaaaagcacttgcagctagtgtgatatcatcggagtgtttgaggtccccgtcttgcattgtgactgtcggaaactactgcaccgggggggatggtgcatttttctgagttaaagcaggagtcgggagtccccaaaggggaacacaagaacaccttgaatcctggcataatcttgtgtgccctcttgtgggccatcagttgtgttccacagggatttgaaaaccttgggaaggtaaaattgctcatctcatctgaagaaagttgtcctgccattagataaaacggtggacgcgggagaactagttcaagccactgggacttgacattggcacagtcgccttgaaccaacctagggatcaccatatcgcaaaatgtgtagacgctgtgggccacggccctggggggcaacacttatagagaccatgacttagtcattcccctgcaagttgtgcacggaaacatgtgttgaccccaataaaagccccacagactttggagtgcatccgattgaccagaagaagggtctcccgagagagccaggacagacgatttgcattacacacctgtgacaaaggatttagacacaggacgcagagcgagaaaacagagagaatacccaggataaaagaggaggaagcgcagaatgggaggaacaacacaatatgcctcg

SEQ ID NO: 684199 - DNA, 216 bp, Homo sapiens
ggacgtccagctagatctcctaggcggcgccggcgtccttaaaaaaaaaaaaaaaaaattgaaaaatttgaaaaataaacgtataatttttttaacacgtaaggttattaattttagtaaacttgttttttttttttaccgtgagactaatttgacgtaatgtcggacgcctgtggaacccggtcgaaccaaaatgagatctaaagtgacagcagg

SEQ ID NO: 684200 - DNA, 559 bp, Homo sapiens
tccccgggccagtatgtaatgtgtattggggtagggttagtgatgggaagtctgcagttttaacaaccaggcgagaccagactatgctacaggtgggcatgtgcagccatcagagacccctgagtgagaatgaaaagtgggtgagctaaatgacatggtacataaaagattaaccttggtatgctctcttccacttcttgccttccatgtggcctaataaattagagagcacaaagaaatagtttcatctccgcaaatatgaaagaacattgtgacttctgctacccatcatataacttcagtcctctttacatattcaaattggtttcagggaacacttcagatgtgggtggatgtttaccccaagagtatggggccaccaggccctcctttcaacatcaaagcccggaaagcgaggaaatactacctgggtgtgatcatctggaacaacaaggacgtaatcttggaagagaaaatgctcacaggcgaggaaatgagtgacatctacgtcaaaggctggatacctgggaatgaagaagaaaaacagaaaacagatgtc

SEQ ID NO: 684201 - DNA, 110 bp, Homo sapiens
gtgatagcctgcacgtcgtgcgcatccacccgcccgcctgtcatcctgcttccataacggccgccttccatgggcccgacgtgggctgctaccaggacgatttcctagat

SEQ ID NO: 684202 - DNA, 117 bp, Homo sapiens
tcgacgttttatcaaaggccccctctctatgctcatgctagttttgctccttctgtgtctttttctgaaccatatccatgttgctgacttttccaaatccaggttttcactcctcac

SEQ ID NO: 684203 - DNA, 1000 bp, Homo sapiens
gctagccgtccgcgttaatggccgaggcgacactggttgtgctgtagtggcggagaggaacgtggtagtgctatggaggaatcatcggaatccttcaccatggcatccgagcccggccagcgtcgagcgaggcaatgatcctctcactctccaggacactggccgaagctcgcggcgtactgatggccctcacctccagccctggcgtgaccttccaccattgaggatgagtccgaggggctcctaggcacagaggggcccctgcaggtaaagaagaggatggacgaggagctcatcggagatggcatggaaagggactaccgcgaccatcccagagactggacgcctatgaggccgagggactgggctctggatgatgaggacgtagaggagctgacggccagggcagagggcaggcacggagagcggagccatgcggcagggtgaccgcgaggcgggccggggcctgggcccgcatgcgccaggggctcctgatatgacatccatgacgcgaggacgagcgagcgccctgcgccgccaagcgccggcacgccgcagcgggccacgcagtgacagcgaggaggaccacgcacatgatgagaccatcgagcaacctggcggatctcgaccaggaccactctgatgggcgagtggcgagaggcatggaaggggcccccggcgtggcaggatcacacatcggtctcactacacgtaccctggcgcagtcacgatcggcacagccaagggcccacaatggcccgaacaggggcaggcgcctcaagccgagactgatgcaagagaagaaaccgagccacaaccccggcggcgaaccgaaagcgccaactcgcggagccacaagccagcgcaccaggcgggcctaagtccgagcctgcagcacccgggcacgcctctctcccgcaccacggcacgaggggggcccggcgcgcgcgacagggcacggaccccagcaggacggcacaaaacccacacagtcccgctc

SEQ ID NO: 684204 - DNA, 278 bp, Homo sapiens
cttagcaggatgcttatgctcagtgatctcgggcggaatgtgtttccggattttgtgatgttggcggttagtggggtcttcaactcggggtgggcagcagtgcaggtgaaggtctccccatggttccaatgggttggggaacagcaggcaggacactggacacgctgtagcagccacagaggtcacgctcaggtggtccttgaacatgcgcttcttcccactttgagtggcgtccatggttgaaggttggcaccatgaagggcattctcctcatggcc

SEQ ID NO: 684205 - DNA, 1236 bp, Homo sapiens
acacctactaccctatacctactactagctactttacctacctgttttctacttccctacctccccctggtcctaccgcgtctcctacctactccggcgctagacgctcgcgtaggggccctggcgtacagacgcgcgggggcggggcgagtagcggcgcggggtataagtaagagggtagcaggagtgctgtgtagcttacccctatctaccaccggcggaatagtagctgacgagtagcggagtgtagtagcctaccagggctacggaacacacatattatataatctaaacacacaatccaaacacaacacaatctaaacacaacaatctatttcacaaaaaaccccgaaacaacacaatattcaccaaaaaacatccgacgtcataccccacgacccggcagcactataatcatacatatcatctattactaaacacatactatataaaatccaaaacataaacaccggggtgacaagccagaccggagaacacggaccgacgaccacagacacacgggagacacccgaagcagaccaggcttacacaagaggaaacgtgcaaagcaccgaaatgacacaacacacaagaagaggcacaataacacacggctaggccacctaggcacgcacccaagaacaaaccaccgagagcaaaaacactaacaagaagtacacacacaagaccagggacaaagaccacaaggaacagcaccaaagcatagagaccacagtaggacgaacaccgaaaacacaccccggaataaacgcaaccgagaacaacgacaaatgacaagaaaagaaacaaacacaaaaaagacacacgacgaacagcaaccaaaagaaggaaaccaccaaaccaagaaagaccaaaaaaacaaccgacagcacaaaacaaaaaaacaaaacaaaaaccaccagcacacaagacacccgcgaacaacgcgaaaacacacgcgaagacacgacgaacgagacagcacaagcaacacaagacaccagacgccaacacgaccccgcagagcaacacccacaacaaggcagaccacacagccccaaaaaacaaaacaacaaagaagagaaagacaaaacaggacagcacaacacaaaacaggaaaacccaaaaccaaacgcaccaaaccaaaacccaggagcaacagaagccagcagacacaagaaccaaacgcgaacagaaaacacacacacaaaaccagcgacacgaaagacagcacaa

SEQ ID NO: 684206 - DNA, 252 bp, Homo sapiens
agtttacgctccatcctggtgctcgtatggtggccagccccagatgaccactgaggtgccggtactggtgatggtgacacccatcaacgagttctccccagacctgtgcccctcgcaacgttccgggttcaggaggatgcggcgcccaacactctactgggctccgtggtgggcacggatatggattaccctcatgacaacattgagtactacacctctggtggtcctaccacctttgctgtggaccgtctc

SEQ ID NO: 684207 - DNA, 334 bp, Homo sapiens
ctatacaagcaggacataatcctgtctgtatcaggatatctgatgaccagtcaaaaatcacagtaatggagtaactgatatttgagctcaggatttacgatcagatggggccatcaacaggtcccattcagcacttccctgggtgggcacaatctaagccatgctgatgtgtctgccccattattggtgtcatttctgcagtatttgtaccagcagcctcctgtactggatttggggtgcggggtggctgaggttctcgcccagagccttctctagcaggaggattccgagcagatcatgactcagctgcagtcgctgatccctcaggcacgtg

SEQ ID NO: 684208 - DNA, 654 bp, Homo sapiens
  misc_feature (245)..(245): n is a, c, g, or t
gtagagacagggtttcaccttggtggtcaggctggtctccatctgacctcgtgatccgccccccttggcgtctccacgtgctgggatgacaggcgtgagccaccgcgtccagccaaataaacctctctttaaaatacatcacccagcctggggaatccctttgtagcaacacaaaacagactaagacgagacggaaattcatttccctccatttcccacatctagaaaaggctgactttcttcantggtggttgctgtcactcaggcctgctgttgactcctcatatctcactggactgtgactctcctgcctccctctcataaggacaattattattattgttatttgggatggagtctcgctctgtcattcaggctggagtgcagtggcacgatctcggctcgctgcaacctccacctcccgggttcaggcagttctcatgcctcagcctctcgagtggctgggatgacaggcacctgccaccacacctggctaacttttgtattttggtagagatggggtttcaccatgttgacctgaccacaggtgatccgcctgcctcaacctctcaaagtgctgggattacaggtgtgaaccaccgcacctgttccttataaggaccaattgtaattacatgtcaggccacggggacc

SEQ ID NO: 684209 - DNA, 384 bp, Homo sapiens
ttttttttggagacagagtctcacttctgccacccaggcgggagttgcacggccagtgatcacggctcacggcaattctcaacctccggggctcgggtgatcctcccacctcagcctaccaggtagctgggactacgggcacacaccaccacacacagctaactttggtaattttagtagagatagggtttgggcacgttgcccaggcgtggtcgtggaatctccgtgggctcaagttgatccgcccaccttggggtcccaaaggtgcggggattacaggtgtgagccacgtgcgccgtggcttaatttttttgggggtgttttaagtacagatgggagtttcgccatgtgggccaggcgtggtctgaactcctgacctcaagt

SEQ ID NO: 684210 - DNA, 103 bp, Homo sapiens
atgtagaaactggatgcaggtagagcattttggtcaccacagaatgggcatttcacaagacctattagatgatgaccagaattttccacacaactgacaaatg

SEQ ID NO: 684211 - DNA, 144 bp, Homo sapiens
tggacatcacagagagggcacagaggaggacagaggagggcagatctgggcaagggggctaccccatttgagggtcctgcttaggaagacgaggggccagcttcctcccctcctctgtgctgaccacctcctctgtcctgtcca

SEQ ID NO: 684212 - DNA, 102 bp, Homo sapiens
aatagcgtacatgtataatgatgcttcacgatttgtcacggataaggttgcactgctggaaggctagcccaagcagtcactaatggtcccctccatctttgt

SEQ ID NO: 684213 - DNA, 1065 bp, Homo sapiens
gattgctgtgctgagacactggctacgtgcgactgtggggagcggctgcggtgctgggtgctgcgtgatggccgatgctggccgccgcggggggcgggttcccacatgcagcagtgagcgtggttgctcctgaggccagcgagacctgcagacgccatctcctcctatgtggcaactgtgggagcctgagggcccgtgcaaatttttttgtgccaatggcaggagggtctctgggaagcgacgcaggccgcaggaggaggcgcgcaattactcgagagggtgagccgaagggaccgccttcccggaagcggggcagtgagcgacggaaaaggaacatgtgaagtccccggcgcaggtgccgccagccagaggggcgccaaagcaggccggtgggaccaccccggcgcggacaaagtgacccccggggaaccgcaatataaaacagtggagggcgatcaaatggacacccgcaattgaagggaaaaacaccccacggaaatggtggggtacataccgtgcacgaccctaggcacagagctatccagttcgtgcactaatcaaacccgggagccaagaaaccacggtggatgcacacccaggagagccttttttagttccaaagaacattgacatcgggaaggcgcttataaacaaaagtctacacgcaacacgtgattgtgggatatagtgaagcgccgtggccgttcgagaaagaacatgatgaacacacgacgaagtcgaggaacacatacggacaccccaagaacgcaccttacacagtaggttacggaggaaaggaatcgccttaaatgagacttagacaagacggaacgcgaaggaaatatgccaaagcagcggacaccacacagctggcgacgagcatccacgggcgacagatggaatgagggcacgcacgcgcaaggacaagcgcgccgagtggtgagaagattggaccaacagacatcaaaaagaacgccaacagacacaaacggtgggaggcggaacgacgaatagccaagcgaacccgaccgaagaaattcgccacgaaatgtggaagagacagtg

SEQ ID NO: 684214 - DNA, 412 bp, Homo sapiens
  misc_feature (55)..(55): n is a, c, g, or t
  misc_feature (82)..(82): n is a, c, g, or t
gatgaatctgcatatggttgcaggtagagccaaaataatttcctgacggaaaggnagagaagactcaaaagctttggatctnaacaaactcgaaggataaagttgccatcaactaagatggagaagaatgtaaatggatcggctgggcatggtggctctagtttttgacatgtagagtttacaatgtctatgtgaggctgggcatggtgactcaagcctgtaatcccagcactttgggaggccaaggtgggtggatcacctgaggtcaggagttcaagaccagcctggccaacatggcgaaaccccatctccattaaaaatacaaacattagctgggtgtggtggcacccgcctgtggttccaactactcaagaggctgaggcaggagaatcgcttgaacccgggagatgga

SEQ ID NO: 684215 - DNA, 256 bp, Homo sapiens
cgtgcttattaggatgatctagggtaatctttatagatagtatagactcacgtactaaggcatgagcttactggagtctctacagaatactctgggtattcaacaaccacgggctcttcattctatggaattgttcactttataacccccctgacattgatcttatcctgctatatttcacttggctgcttggagtttcaccctatgcagcacagattcctattcaaagcctcatgagtattcttatgccaatccg

SEQ ID NO: 684216 - DNA, 1048 bp, Homo sapiens
  misc_feature (6)..(6): n is a, c, g, or t
  misc_feature (14)..(14): n is a, c, g, or t
  misc_feature (88)..(88): n is a, c, g, or t
  misc_feature (100)..(100): n is a, c, g, or t
  misc_feature (107)..(107): n is a, c, g, or t
  misc_feature (169)..(169): n is a, c, g, or t
  misc_feature (324)..(324): n is a, c, g, or t
  misc_feature (326)..(326): n is a, c, g, or t
  misc_feature (348)..(348): n is a, c, g, or t
  misc_feature (380)..(380): n is a, c, g, or t
cgtttncgactatnattcgaactggtccggaagccccttctgacccccatcggcaccgtccacaccgacctgccttcccagcttcagntccgggacaaancccagcngcacagcaaaaaccaggcgttgaactccaccaacggggagctgaatgcggacgaccccacgnccggccactccaacgccccgatcacagcgcctgccagaggtggaggtggccggatgaaaccaaatgctgctgtttcttcaagaggagaaagagaaaatgctgcagcgacacaagtgaccctgggcgcgtgcagccccctgaatcttctccgtgcnanccttggggcgcgaccttgtgcngagcctcggggcccacccacgagcgcccaggncagacgcctgctggaagccagaacgcagactgcgagggcctggcctggctcaggcggccccgacccccgggacgtggggtcacttccttcatgtaagactttggccgaaatttctacacctgtgtctagtcctcccctccaagagcattaactatttaaaacaaggaaaagaggaaaaaaaaaacagaggcccgcccttaccccactccttgccccatccgtttctttgctgaagtgagtagtgtgatcctggaggccccgcgcggcgtgacagcggcccgaacagccggccaaggttacgtatgtaaggtccgagcattgtctccctcgatccagaggccgtttgctcgacggcgagggcagcccggccgggatggggtgctgtggagctgtcttgccaggccctcctgggagggggacaggcattgttgccaggggtgacggctgttgcccaggtctccccgaaaccaaaaggggaccgagcagaggagtaggaggacagtgagatgaagccggatcccccgaaacaagaatgctgcaccacaagctcgggcgccgctgggcacggctgctgccagctcttcccacctggccctggcacggggcggtggggcgccaggcggatgctctcgagccttgtccggaggcggcccgggctgaccgagtgg

SEQ ID NO: 684217 - DNA, 763 bp, Homo sapiens
ttgggtgaggaagcacggattcgccaatgtgtcgactttgggacccagtttcgaggattttcactgtgttcgccgccgttgcggatggagtacggcggctagccaacttcgtcatgaacgagccaccgtttagtggctgcccacgaccgcagcgattcgttgtagtcctggggagtgcaggatccacgtttctctgaccaagtggtaggagcttgcgagagcacagttcgccccgttgatgtgagggacagtagctaggcatgatggaatgactccagtgctgatctccctatcatgccacaccggtacctcaccccctagtcactcatatacggagcctgagacatggcctccaggatgaggatgggcggtggcaatgacaccctgcaggggaaaggactagccccgccatgcacacatatgacaggcgatggatgccgccaccatgagctaggtgcgagtaactcggtttttcttgggtggtctgatgacatggatgcagcacagactcagccttggctctggagcacatgcttactgcgtggcctcagtttaccttccccagatcctagattctggatgtgaggaagagatccctcttcagaaggggctggccttctgagcagcagaattagttccaacgcaggtggcccccgaaccacatgcctcacttttctgtgccttcctgagggggttgggaccggggaggaaacccaaccctctcctgtgtgttctgttatattacgaccgagtgcatagcacc

SEQ ID NO: 684218 - DNA, 119 bp, Homo sapiens
actctctccggatgcgacatttggctgccgccatcttattacctttcccttcggattctcctatactcttcttcttactggagatcactgttaccacacttgcccctcctgaccaatgc

SEQ ID NO: 684219 - DNA, 617 bp, Homo sapiens
agcattcctgaagctgactgaattcggaccgagacggctcgctccgtggcctaacctgtgctcgagctactctcgctttctggcctgtaggctatccagcgcactccaaagattcaggtttactcacgtgatccagccatgaacggaaggccaaatttcctgaattgctatgaccctgggtttaatccatccgacattgaactggccttactgaagaatggctagggaattgaggactacactgaattcacccccactgaacaagatgagtatgcctgccgtgtgaaccatgtgactttgccacagcccatgatagttaactgggaccgagacagtgaagcagcatcatggagcgtagaagatgccgcattcggattgtacgaattccaaattctgctagcttgctttttaatactgacatgcttatacacttacactttatgcaccttgcgagttatagcaatgtgaacatggacaggatctcgtttagtaacctactttgagagctgactccatgttggatgcatctgagcagcttgctgcacagcgagctctaggaggcctggacacttatagccggcagcacagacttctcttatccaccatgcatgttgacc

SEQ ID NO: 684220 - DNA, 190 bp, Homo sapiens
  misc_feature (2)..(2): n is a, c, g, or t
  misc_feature (131)..(131): n is a, c, g, or t
gnggcgtcgagggtagtgacccgtccgtactggtgttattaccagattccccgaccaactccagcagcggcaggacagccggccgcttcccgagaggttccggctcgtacccgtccagatcctcttggggngacatgatgcgtcagcgccgggcttccatctcctcaagcggcgcgcggcggggggcgcg

SEQ ID NO: 684221 - DNA, 129 bp, Homo sapiens
ctgggtaacatggccagaccccatctctatttatatatatatatataaaaccttagggggtttttatcttcccctaaaagaggccgttatatttgcagcagccttaaatttctttttaaggggattggg

SEQ ID NO: 684222 - DNA, 451 bp, Homo sapiens
tcaccgtgtcccaagagaccctctgttgacaagtacaacgtgagcggcaccaatgggacctgcctgcttgccagcattgtgtgctgcagctgaacctcacctattagaggaatgacaacacgaccgtgtgacaatgcttctcaacatcaaacccaacaagaactcgtgccagcgggagctgtggtgcccacctggtgactctggagcttgcacagtgagggcaccacctgccctgctcttccagttcgggatgaatgcaagttctagccggtttttcctacaaggaatccagttgaatacaattcttcctgacgccagagaaccttgctttaaagcttgcaaagggtccctgcgagcgcttgaggccacagtcgtgcaattcctacaagttgcaacgcggagtgagcacgtccgtgtcacgaagtgcgttttcagtcaatatattccaagt

SEQ ID NO: 684223 - DNA, 453 bp, Homo sapiens
cgtctcttagaggatcccctttgatgcccctgactgccgtcctgtgctgggagagggactgagagcagacgcttcgcggaggccccgagcgacatccgagccactgtgcatctctccaggtgtggtggacgcacactcttcgccttcaacctccacgacaatgaccctgtagaaggcagttgccacctataagtcaataacgtgtctcaaaccccgaggactgctgggcccaggctgtgtatctacagtcgctgtaccgtcgtccacatcctcgataggagacatccagatgaggcccacggagcatgtaagctagtgactgtgggagctcctccttccctccccagccttcatggcctgcctcctgcctctggattttaccgtgttgatttctgtgatcacgggataccacttctctgtcacaccccgaccaggtcctagaatatgagtatg

SEQ ID NO: 684224 - DNA, 142 bp, Homo sapiens
ttctgagatccagtgagtcagtcgaatctcaatcatccaaaatgatctccctttattcatgtcacacctaccagatcatattgatataagaagcagggtttccatggtcttggagagctccaactcctctctatttcgcaga

SEQ ID NO: 684225 - DNA, 555 bp, Homo sapiens
tgtggggaaaaggggggagatgatcgaagtaataaaaaagcggtgcgtggtaatcatataattaatcttttttttcttctctttctctgtctctgttaaaaaaaaaagggggggggggggggagtgtgggtggtatgttgtgtgtgtgtgtgcagcaaaaaaaaaataaaaaaaaaaaggagaaaaaaaaaaaacaagaggggggcggcgcgcgccaacataaatacatcatctcgccgcgggggggcgcgccaccagtatgcgcgcgcacccacccccccttgttgtgtgaaagaagggcgcgcgccccacaagaggagaggggcgtgttttcacaaccagaggaggggggcgggcagcgctgttgtatacaacacacgcgcgagagagagagagagagaaaataacagacctccgcgcgcaggagcgagatagtgtgagagagaggagaacagcaccactcgcagcggggagggggggaggagaacaacatacgaggagagaacccaccacccaacaaaaatatatacaccaccgcaccgggggggaaacatt

SEQ ID NO: 684226 - DNA, 111 bp, Homo sapiens
tactcaggaggctgaggtgggatttcatttgagccaggagtatgagtcagcctgggctggataccaagaccccatctcaaacataaattaataaataaaacaggtatacta

SEQ ID NO: 684227 - DNA, 157 bp, Homo sapiens
ggccaagtggaggaagaagcgaatccaaggctgaagcgcaaaagaggaaagatgaggcagaggtccaagtaaaccgctagcttgttgcaccctgggggccccaggggcggaaacatggggttcccaacgttggggattacttggtccaaattttggg

SEQ ID NO: 684228 - DNA, 109 bp, Homo sapiens
gcaaatggaaatatgaaaggcccgatggctccccagtatttattgccttaagatcctctaaaaagaaaagtgtgcagtacgacgatgtaccagattacaagtcagattg

SEQ ID NO: 684229 - DNA, 422 bp, Homo sapiens
  misc_feature (4)..(4): n is a, c, g, or t
  misc_feature (417)..(417): n is a, c, g, or t
  misc_feature (420)..(421): n is a, c, g, or t
caanctggcctagctggtccggacaccttttgtacctagtttttcagggcagacacatatccctgctgttcaagtgagaaccccctgcaactttcccaaagagcctgcctttgtgatatatatcaagaggtctgggcccaggcatggtggctcacacctgtaatccccagcactttgggaggccaaggagggtggatcacttgaggtcaggagtttgagaccgacgtggccaacatggtgaaaccctgtctctactaaaaatacaaaattagctgaacgtagtggagtgcacctataatcccagttacttaggaggctgaggcaggagaattgcttgaacatgtgaggcagaggttgcaatgagccaagaacgtgccactatactccagcctgggggacagagccaaactccatctnaannt

SEQ ID NO: 684230 - DNA, 651 bp, Homo sapiens
  misc_feature (235)..(235): n is a, c, g, or t
  misc_feature (242)..(242): n is a, c, g, or t
agggttatttggtcccaatccagtgtgggacggcaaccagggtttcccccaaaagcaggtgttcttgaccctgcccgggccccgcccgccctaaggtaaggggcatccttgtccacccccaggagactgggagaaaaaaaaagaaatcccgttcgtggttgccttggggacgcacatctgagcgttctccacttggtttttgtaaaaaaaggagagaaggatattcctgggttgnttgatanccaggcgcctccccgccggggccccaaaaaaggtagcagaatccgccaacttttcattttctttaaagaagatgagggccgcccggatgtggtaagaaagccctttaataaagagggtaagaaccctgggccccaggccccccagattcggggttttgttaccccccgggtcctgcggcccaaacgggggggttttgtttttaaaaacccggggccccagaaaaattaaaaagggggcgccgaatttggtttaccttttggcccagagaatgagggggggtaaggaaaggcccccgggcccaattgggaagagacgccgcctttccccttgggggggttttccttttaggtttgaaccccgcccgaaaaaagattttttggggacccaataaaaaaggcccggctttga

SEQ ID NO: 684231 - DNA, 127 bp, Homo sapiens
tgccgggtccagattaattggttctgctcctggtaacgtttgtatatccatggatgacttgcttgcggtaatgacatgaagacagttccatgtcataccttattaaaggtatggagagtcggcttga

SEQ ID NO: 684232 - DNA, 652 bp, Homo sapiens
ctctagtccaagtaaaccaggggcacaatgcactgtggaaagcctgagggacctctgaccttgaaagctggctattattgaaagtttgcgcctatgtgatagtctgaaatatggcctcatgggatgagaaaggtctgacggaccactagacggatacccataaaaggtctgtgctgagggggattaggcaaagaggacagactctggcattggagatagaggaaggccactgcatcctgcctgccactgggaactgaatgactcggataaaacacgattgtacatgtgttcaattctgagatgggagaaaaaccgacctatggtggcaggcgagacatggttacagtaatactgccttgatagtctttactccactgagatgttagggtggagagaaacgtacatttgcttacatgcaggttcagcatagtaccttaccttgaacttgattatgacagagattctaatgctcacatgtttgatgctgaaccttctaatattaaccttgccctcgtactgacatccgtttttgttgaaatattaaagatggaattcagttcacctggtgcttcgagcaggggcccgttcccgaattggccttatagggagtccgtttacaattcacttgccggcgtttaaccgttgtgctggt

SEQ ID NO: 684233 - DNA, 744 bp, Homo sapiens
gaagaggatggttctagctgttttgatgttcaacaagctctttcttcatcagaatcagattcatgcagtagttgcagttcagacatcataagagatcttctataagaagaggaagcctgggaagcatcacataaaaacgatcttcaagacacagaaataagtccaagacagagtgcgccgcacaagagccgctgtaagtgctgagattgagccaagaaacaagcgtaatacgaattaatgtgggcttttgctgacttttcaaatgcattgattagaataccgaacttgtaggttgccacagatagattgtctatttataaatgcccaaggaaagatgctaaattctaaatattacggctagctgatattcattcttttctgctttttcagaggggaaaaatgttacgaaatatgcttacttggtcaggtgcctcctgcctctcatctgtctgtaagaatactgacatttcacacaggtgccagctttgcataggaggtagactctttggcactttggcacatggatttggtttggtttggtttgggttgtaattaaatttcacaatgtccttaggccatactacttctgttacatggagaattcagcctcactatatggaaggcgggatgtcaggtcaatccatggtgtcgagtaaggtccatgcacgccaccccatgcctgtgttcagggtcatgatggtttgcctaggctatggtcctggctgtacacctgcgcttcctttt

SEQ ID NO: 684234 - DNA, 267 bp, Homo sapiens
gttttaggtttttagcagcctgaagccatggtttttggtttgtctctagtgataaggtggaaaacccggatgaggaagggctttactgccaacagaaacagaaactaagcacccacgactgtattcgtaccttggacacccgctctatactctagcccttgagagatactcaaggtctcaaggtctgaatcctgcaacacttgcatgctctctgctatcttctgctagtagcctaacgcgagctactctggatcgactagcgtacta

SEQ ID NO: 684235 - DNA, 657 bp, Homo sapiens
tctgtggtaaaggtcacacgttccaaggataacatctgtgtccctgccccgtgtggttgaccacaaaaggtagtgaggggctgtgcgctttagtgtattttggccccaaagacgcccctttcccaaggccctcgtgatgccccaccaagttaccgatattcaccgttagtgggtcttgtatacgcactgcgtttgtgcaaaagtgccccaatagcgctggggagcactattagaggaatagaccttagaactcttttagattggattagacccagttgggaataatcccattggatagaaatattttagatttttagggaaaattggtttgatatttcttagagtctttattgactatttaggttatagtgagcttgggccaatctgcgttaatactttgagtctagttttcttctccaaaatgaggaccattaggcgtaaatgatttccgagtttcccagctagtcctagagttcttatatttctacaatagttgaattattttatcatgctgttgctggggaatatgactaacccttttgaagctactaattttatgttgagctttataagtccataattgttatcttcagaaaatattatttgacctacagtatgtcccaatccaatttaattaaatcgctttattacagggga

SEQ ID NO: 684236 - DNA, 592 bp, Homo sapiens
  misc_feature (104)..(104): n is a, c, g, or t
  misc_feature (238)..(238): n is a, c, g, or t
  misc_feature (385)..(385): n is a, c, g, or t
  misc_feature (451)..(451): n is a, c, g, or t
  misc_feature (456)..(456): n is a, c, g, or t
  misc_feature (460)..(460): n is a, c, g, or t
  misc_feature (498)..(498): n is a, c, g, or t
  misc_feature (509)..(509): n is a, c, g, or t
  misc_feature (512)..(512): n is a, c, g, or t
agcgcgagagggtgtaagctaagaacgtcttgaagtcttaagttttaaaaatgaagagtgtgtgggaggatgaggggctcaagggtaagattagcgaggctganaagaagaaggtgctggacaagtgtaaagaggttattttgtggttggatgtcaatatcttggttgagaaggacgagtttgagtataagaggaaggagctggagtaggtgtgtaatttattattagtggactgtantagggtgttggtggttttgggtttgggggttttggggcttagggttttaagggagggtttgggttaggccccaccattgaggaggtagattaggggccttttcaagattgctgtttttgttttggaggtttaagactttgcatttcntagtatttctgtttgtcagttctcaatttcctgtgtttgcaatgttgaaattttttggtgaagtantgaanttgntttttttccggtttttacatgcagagatgaatttatantgccattttangantattttttctttttaatacacttaactcaggccattttttaagttggttacttcaaagtaaataaactttaaaattcaaa

SEQ ID NO: 684237 - DNA, 1022 bp, Homo sapiens
ggctcacaataggataaaggtgtaacatatgattacattgatctgctcaggaaatattattgagcagtatactgtgtcctagagcatcacttatagttcttgagtggtgagtagtaaagaatagacagacaaaatagatagtaccctggtggagttgccatgctagtggggacagaataaacaaaatgaatgggcgaaatgtatatagaagtattggaaggaagtacatgctggtgagagataataagcgtgggagggaaacagggagtgctgggggagaaggagctaagagtctcagtaccaggagttaggcaggctgagctggagattagaacgcccagactgcatgcaggggctcatggcctgtgtatcccagtagctttgggaggccgagagtgaggcggatcaccatgaggtcaggaggtatgagagctaccctggtcaaacatggtgaaactccagtctctactaaaagattagcatgaaatgagaaaaaattagtcggggctatgagtgatcgggtaaccgtggtaatccttaatgtgattggaaaaaggttggatccatggtagacatggttttgaaactcggtaaggtagtgagaggtgcaggaaagttgtagatcacgcgcgagaggggaacatgcaaggcctggggacacacgaaaggggaaagctcctggcgatccagatacacgaacaagtggccgaaacaactaatcaataatgggcgctcgcgatggacctgacggactacagagaaatagaccacctcattggtggagcattgaaaaatgaaaacatcctgagcgggaacaagacacgtataaagggtgttcagcggagccaggacaggaagacaggaggaaagggggacaaccccatgtgatcccaccagggaggagtcgcagagaaagcgggacacacgagagagaagaccacggggaggcagggcacagacattagccacacgctgggcggccgcacctgaaataaccgcagtgtactagccgcggagggtga

SEQ ID NO: 684238 - DNA, 391 bp, Homo sapiens
  misc_feature (1)..(1): n is a, c, g, or t
  misc_feature (3)..(5): n is a, c, g, or t
  misc_feature (35)..(35): n is a, c, g, or t
  misc_feature (251)..(251): n is a, c, g, or t
nannngaaaaaaaaaaagggggccacccctgcttnaggatttttgaggtggcggggagacagacaataaaccagcaacgaatgaataaaggccaacgtgcttggtagttgaaaactgctttaacacaactgagctcaggaaaatacacctgtgtagagagtcaaagcgctgaggctaccttccactgggcacaatgggccatttcaacagggacggcgcaatgttggcctcatgcctgactgccacacacnctcagaatcaggtgtctgaaaagtggcagtgacgaaagaagagactctccccgccgaagccccagtgcatggaaagaaggaagaaaacaaactcctaaatggcaccataaacatcagaaggaagggttctagtgtgccta

SEQ ID NO: 684239 - DNA, 634 bp, Homo sapiens
ggctctcggatgcaggagcctgggcccaaacagcagcttccggagtcggaaggagctgaggaagaagactgactgaaggagcttgcgaattttccgcctcgagaaccggacccagcagcaagcaggacgggcggcgctctgctactggtcccgttaagccagagtagcccaagccctgaagtcactgctcatccggaatggaaatcccgccgaccaagtacccagcctccaggcggccttggtggcacagaactactatcaactaccagcaggggaccccgcacaggctgtcgaggtgcagcaaggtcaaacaagccagcatggaaggatatccaggaagaggcacataagtatcaccttacattcgctgttgacagcaaattatccacaacaccagagttaacggttgaactgtgcaacagcctgaagtactttacccttcaacgggacaagaaattgcaccagaagtcaacttcacatttgacaggagaaactgggacaagaatccagatgaccgaagcaaacacattttatcagagactaagtccatgagggcccgctagaagcacacaatatccacgacattcgggactgttctccagaatggcgccgtccacattagccggttgctggc

SEQ ID NO: 684240 - DNA, 458 bp, Homo sapiens
taggtttgagggggaatgctggaaattgtaatgggtttggaaacttgtcatataagtaatgctagggtgagtggtaggaattttttacataaggaggtgtataaagtggggtcgtacgcgagaatcggggggtatagcttgtcagaatttcataaagaacagggatggttaagaagtagggtctgtggtgacaaaatatgtttgtgtaagagtacaagggagaaatctcgcgtcatatgttgtacctagagaaaaatgtgtaaggtcggaagaaggggatggttcgacttaactaactaccctcgctcaggccgatataaccgcgcatattcgacacgactatacgcgcgccgaactgttgccccctcacgagcgatcattccaaattgttacgacacgcgctcgcacattacattcggaaagcaccccgttccggccaaggctccaaaaggaggaac

SEQ ID NO: 684241 - DNA, 868 bp, Homo sapiens
  misc_feature (32)..(32): n is a, c, g, or t
  misc_feature (39)..(39): n is a, c, g, or t
  misc_feature (49)..(49): n is a, c, g, or t
  misc_feature (77)..(77): n is a, c, g, or t
  misc_feature (124)..(124): n is a, c, g, or t
  misc_feature (142)..(142): n is a, c, g, or t
gtatcccaaatctatgcatcaactgcacgtgntacctantgagacactnatatgccaaagatgactatgagcttatngacgtgctggtaaacaatgccaaaactcatggagatacaagagcatnggaactgaatcagagatngtcctcacaataacattggattattttatagtaaggaagcaaagaaaaagctgtaagaatgaagcaatgaatcaagacttctacccaaaacaacatttttttaaactatatttattccttttctaaaggaatctagagaagttgaagtttttaagttaggaatgcaattttctgttaactccaaacctgattttaatctgaaaaaaaaaaatttaatttgggaaaaccagaatgaaaggaaaaccattattgcctgtggttgcttaacattatttgtaaaccattattttctgcatcttgcatggtgcacaatagaatatcttttactgtaatcccttacaataaagccttaatagccattttctatgtaatatgcaaaagtagattagcacaatgcacaattttcttttgttaaaaatcaaattcaaagatttaattcttgctatgaattctaaagttcggcaaaccaattcatcataaaatccaaataatcttgtaacctatttatctagtgattcatctccaattctgttgaaaaagcataatataaatgttgatgagactagactctaatggatatgtttatataattccaaacactcaggtgtgtgaatgcatttaaaaacattaatggaaaataatgctgataatatttaattgatcatgcaattccttcaattatgatggaaagacttgaactttctgaaataaaacaaaaatacagca

SEQ ID NO: 684242 - DNA, 151 bp, Homo sapiens
  misc_feature (90)..(90): n is a, c, g, or t
ctagaggactcggtcatcccctcgttctggtctcttctgttctttccctatttggaaaaattctggaaaaggaaagaagggatggagaanactgggaccagggatcccaaattctctagaacagaaactctaggggggagaaagagaatga

SEQ ID NO: 684243 - DNA, 914 bp, Homo sapiens
  misc_feature (32)..(32): n is a, c, g, or t
  misc_feature (39)..(39): n is a, c, g, or t
  misc_feature (49)..(49): n is a, c, g, or t
  misc_feature (77)..(77): n is a, c, g, or t
  misc_feature (124)..(124): n is a, c, g, or t
  misc_feature (142)..(142): n is a, c, g, or t
gtatcccaaatctatgcatcaactgcacgtgntacctantgagacactnatatgccaaagatgactatgagcttatngacgtgctggtaaacaatgccaaaactcatggagatacaagagcatnggaactgaatcagagatngtcctcacaataacattggattattttatagtaaggaagcaaagaaaaagctgtaagaatgaagcaatgaatcaagacttctacccaaaacaacatttttttaaactatatttattccttttctaaaggaatctagagaagttgaagtttttaagttaggaatgcaattttctgttaactccaaacctgattttaatctgaaaaaaaaaaatttaatttgggaaaaccagaatgaaaggaaaaccattattgcctgtggttgcttaacattatttgtaaaccattattttctgcatcttgcatggtgcacaatagaatatcttttactgtaatcccttacaataaagccttaatagccattttctatgtaatatgcaaaagtagattagcacaatgcacaattttcttttgttaaaaatcaaattcaaagatttaattcttgctatgaattctaaagttcggcaaaccaattcatcataaaatccaaataatcttgtaacctatttatctagtgattcatctccaattctgttgaaaaagcataatataaatgttgatgagactagactctaatggatatgtttatataattccaaacactcaggtgtgtgaatgcatttaaaaacattaatggaaaataatgctgataatatttaattgatcatgcaattccttcaattatgatggaaagacttgaactttctgaaataaaacaaaaatacagcaaaagtagtagtcgacacaaaagtcgacgcgggcgagaattaggtgg

SEQ ID NO: 684244 - DNA, 234 bp, Homo sapiens
  misc_feature (11)..(11): n is a, c, g, or t
  misc_feature (44)..(44): n is a, c, g, or t
  misc_feature (94)..(94): n is a, c, g, or t
  misc_feature (119)..(119): n is a, c, g, or t
  misc_feature (138)..(138): n is a, c, g, or t
ccctatcccanacctgcctgtcacgttccctcccctttccccancgcactgttgagggcagcctctccagctctcttgtttatgcaaagccgancgcctgggaggctcggtaggaggantcttccagggcccgcccgnccctgtgggtccgccctccccccgcggggctccctggggctgtggccgaaaggtttctgatctccgtgtgtgcatttgactgtgctgggttggaat

SEQ ID NO: 684245 - DNA, 415 bp, Homo sapiens
caggtttcattgcctgattcagggtgtcttgattagcacacaccgtgcttggttctaatatgccatctgctgttctccgttggctctctccccccaccgttttgggtaacgaaacagaggaacaggctctctgaccgttcctcacggcaggttaatgggcacctgtgttctgatttattgcgctcgctgccttccctggccccgtgttaggtagggaaatcggcacggaaggtggcacggcaggagtgacctttcgctaatcaccacacctcagttactactggcgcagctcattagaagaaggaatccttcaacgagctggctttcaaatacagtcacactttgattttctccagaacaaagattccactttcacataaaagcttctgatgcatgattctgtcaactggggcac

SEQ ID NO: 684246 - DNA, 199 bp, Homo sapiens
agacaaaactaacaaaaactgagatcaacacttctgtcctaacatatgtgtgaatgtagtacgggcgggactaagtcattttacacatgcttagggatattttcacttattgacacctaataaaggcagcaagtctgaaactaacaaataatcattaatgtttctccagacacactctactctcccccttcctcccccc

SEQ ID NO: 684247 - DNA, 883 bp, Homo sapiens
gagcctagatggagcggatcagtctccagcgccgggtcccgggagggccagtgggtgtggatggcctgttgcgcagtttgccgttagggctaagcgttatgaaaggacatgaacacctggcacaggatcaacaggaaggtcgcgcgattgctgtattcaaagtacacgtagctagtacgagaattaaaatgtctcatcattgaggctgaccgtgcctagctcgtgcgtgtgtcaccttcggtctcatgggctgccggaaatgagagttgtcacattcttgaatactctttttggatgccaacggacattatgtcctcagaatgccacgtttcttatgtatggggcttatgattatgatacttgatttcatgtcgactacgacaattgaatgactgagtggggagtttaccctgtggggtggtagtgtggtgttaggttgaacgtgtagtgctccaatgtagccgttgtctagggtgaacatggtttctttactggagtatcttattctcggggtgacgagtagctggtctatttcgtacacataatgcctcggggttcaatctggtggtggtttatgggtccacttatatggaatttgatgggtagatatacgcgatcgttctagggagggttttaaacgagagcacatatttacaaaaattgagacgggttgaaccctttggtttgaatgaccgagtcgaggagaattgacttgcaatcgtgatggtccagggatgacgtttgataacttgttgtgggtgttgatgataggatgggccggcgctaataggtctattctatagcatattctggtcccaagaagggaaagggaggcgaaaggggaaaaatggagaagatattggtctggagtcacacaaagggg

SEQ ID NO: 684248 - DNA, 622 bp, Homo sapiens
tcctttactgccatcttgcgtccccgcgtgtgtgcgcctaatctcaggtggtccacccgagaccccttgagcaccaaccctagtcccccgcgcggtcccttattcgcgtccgacaatgatgaatagaaacaatcgatgaaccaggaaaagactcgccgaactgctaggcacaagtgcgcattgtgtgggaaaggaactgctcgcagaaagaagaaggtggttcatagaacagaccactagcatgatgcacaagagaatacttcagtgctccttcaaagaagttaggggtcaacaatcatctctggtattagagagaggtgaatagtgtttagcaagaccataggacagcagtgatccactttatagaaccctaacgttcaggcatctctggcagtgaagactttcaccattacaggccatgctgagacaaagcagctgacagaaatgctacccagcatcttaaaccagcttggtgcggactagtctgactagtttaaggagactggccgtggctctgcacaaacaatctgtggatggaaaagcaccattgctactggacgaggatgatgatgatgaagttccatgatcttgtggagaacttttgatgagcgttccagaatga

SEQ ID NO: 684249 - DNA, 651 bp, Homo sapiens
  misc_feature (78)..(78): n is a, c, g, or t
ggacccctagttccctggtattcttcaaccccggccccacccagggagcgggggggggcggcccggtgtggcgccttnttttttcctctcccaggacagcgccccccagggtaatctgccccttgctgaatcagttccccctccttgaaaggaaaggagcaaaacggccttttgggatcccagggtggatgaaaaggtgaaaaaatcaggggattaaggacttgggtgggtgggcatctctcaggagccccatctccgggcgtgtctacctcctgggcagggttttgggaccctctgtgggtgacgcacaccctgggatggggctagtaaagccttcaggcgccttcgggcgtggactctggcgccctctagtggacaggagaaggaaccccttccaggaacctgtggactaggggggcagggacttccctttgcaagggggaacagacccctggaaaaccctgtccctttcagagctcggtggctcccagcgtgtcctgccccggtttgcggacgaaagaaatcccggccccccagcatccccccctcccctgcagggtggggggtgggcatgctgcctcttaaccctttgtatttattccccccccttttgcagggccccgggcgggctgaaattaaagattttttaga

SEQ ID NO: 684250 - DNA, 1038 bp, Homo sapiens
caacctcctactcctcattgtacccattctaatcgcaacggcattcctaatgttatcgaacgaggaaaattcgtaggctatatacaactacgcgaagggcccaaacgtgtaggcccctacgggctactactaacccttcgctgacgccataaaatcgtcaccagagagcccctaaaacccgtcagatctaccatcaccctctacatcaccggcccgaacttagctctcacccaatcgctcttctactaatgaaaccccgcttactgtatacaccaaatccccggggatcgatccctcaggcataagggcgtaccataatttaattcgagccagcgtgataggcctggtcggtcaacgtccaagacactcttgagtccacgggtgatgcatctgctcaaggatacgtcttgatcggcgtgttagtagaagtagaatccaaagcgcgataatgaagtagcgctagtacagaataatactagtagagagagtaataagtggaatcactctcatagtacggacataacatatgatagaaaacaaaagaagaaacgtcgtgtatagctcatgacaataatgaactatgaatatcatatgtataatttgaaaatcactcagcagacgaatgacgcaaactattagactattggaagaaggagagtcagaataagtcacatgatacatattcgatttgggatgaaggggcctagataaaacatttgaagtgcgaattaacaagccttattttaagagaagcatagagtaataatagtcctagtgaaactataggacatggccctggggacggtaaaatagtgggcctggcaattttaccggcggcgaaaaataagtgagaaccggtaggaggaggtgcaacgacattaaagtggcacacggaagagaataagggtcatacaagagacgaatagcccagacaagagaaaaaaacaaaacacgagggggataacaggagacagaaagtaagataaacagatagagatatggaggaacaagacaggaaaaaataatagggagttggga

SEQ ID NO: 684251 - DNA, 679 bp, Homo sapiens
ccagtcaaaggccttgggtgagcccatttagggtttaacccgtaccattttggttgaaaactgtggggtgccactttttaaaatgggctcaaccaaaaaccccagttaaggcacctggcaagagtccaagtaggtgctttcggtacgtcccctagagccctgtgaaataagtgccctatatgtatgtcccaattgtaaatatatctacccgagtctagacgagcatttttttgtataattggatctcctaaccctgtcatcccaagataaagtgtatcgcttcttaaaaaaagacagtgtattagcaaataaagcagcatgcaaagtccactttttaatatctcgttctgtcactttttatcataaaagatggcgatatcactccttccggcgcccatgtatgtcagtaccccatgtatctgcgctaagtatataggaattggtttcacgcgtgaggcaattagacgctttgcaagatggcataacctgtctcccctggacttaagcgtctgtgtctaattcacagtgctcttttgtcctccctgtatgcaggttccttcccagaggagcctccagttctcatgggtggcagtcagtctctcttctctccagcttgagtatacatcttttctggaccagttatttcttccaagcactaatgtctaaaggcagttttcta

SEQ ID NO: 684252 - DNA, 142 bp, Homo sapiens
gggtacgctgcctcgctgcccctcagtatacatacttaagtgattgcaatctagtgactccagtggaagtcttcatctctgactcgcttagagtagatgacacgtttggcatctatcaatcctgtgatactccccaaggagt

SEQ ID NO: 684253 - DNA, 311 bp, Homo sapiens
  misc_feature (96)..(96): n is a, c, g, or t
agcgttcagggtgggagagcttatcacaggcctcgaaatgtttctgtgtgtctctttgtcttgcttatctggaagggagagttttgtgtctgttcnccatacatcttcctgcaactgcaggcatagcccccacgtctgcttttagctttcctatcttggtgcacctaaagggaaacgaatgtgcttattaggacccactgttctactggggcacatggtatgagtgtgaagtttggtgcttacccaagagactttcccctctctgtctgtgcccagctgtgttatctgtgttttactatctgcactagttc

SEQ ID NO: 684254 - DNA, 167 bp, Homo sapiens
ggtccgccggggcttcgagttgccctcatttacataaatattactagcatttgccatctcacttctgaggaatactagtatatcgctcacacctcatatcccccctagtatgcctagaaggagtaatagtatcgctgttcattatagcaagtcgaaagccccaagcg

SEQ ID NO: 684255 - DNA, 327 bp, Homo sapiens
aaaaaaagggtttttttttgggcggggccttctttttccttttttggccccaaaattttccttcccaaaaaaaagtttttttcaaaaaccgttttttttccaactttcccttttttttgggggtcacaatggggccttccttaaagggggggggggcccccggcggggtcctttgggccttccccaaagtccagggggatttttggaatggggggattgggcccaaaaaggtttagggggccccctttccccaaaggatcccccccccccccttggggggggggggcccaaaaaaaaccccccccaaaaaagggttttttttcccca

SEQ ID NO: 684256 - DNA, 118 bp, Homo sapiens
atccacgcatggtcggagagtatgcctagcaggcaccttcagagagttacaggacatggctgaaccccccaccctggaccagtaaaggtagcttgcacgaagctactgtcgtgctctc

SEQ ID NO: 684257 - DNA, 571 bp, Homo sapiens
gaattcggcacgagggcaataaatacttttttcacaaggcgaaaatccaagagatggatgcagccagcgtaattaattgcacccagttacaggagatcagcaagtttgtgagattcacatgctgctgtaccatatggttgcccagtgggcgaaaaatttgattaatgttttgaagtagatttttttcagcaaatattgcagccccagatgaggtgggggttgtcccccccttttactttctagtattgttagacttagctgaaggaaacaatcctctgatttaaagcttaataatactgtgattcagtgaaaacttaacatgcgataaaaattacatttctctcatctcttgtggatacagaaaaataatacatgatgtcttcgtttgtaattaaggaaaatgtgatcgttggattctaaaacttgattcttgatttttttttcccctaagaaatggaactgtggttttcactgatgcacttttggtatgatttataagtagtatatttgggcagactcttcatactcaaagcagtaaaaaataaaataaaataaaatacaatgaaaaaaa

SEQ ID NO: 684258 - DNA, 204 bp, Homo sapiens
atttcactcttactctcttatcttctctctctttctctctctctcttttctgtcttactcttctcttcttcttttcttattctttatctttattcttacaggatcttaccctgtcacccaggctagagtacagtggcacattcacagctcactgcagcctcaacctcctgggctcaagcaatcctccttgtctcagcctaccat

SEQ ID NO: 684259 - DNA, 503 bp, Homo sapiens
tttctttcttaggacaatggactcctcctacaagtatatggttccgaccatggccaaggataaggtggtatagtgtctcaccgtgcagtgctgtgtaatcctcctatagacagaatagaacatgacgtttcctggtagtggatatatattttctcacaagtcgctctcgcctagtagtaccactttaggtgtatctctcgtaccaggtactctccccatccactggggagtgattatacggactgcgcaagaacttatagcctcgatatttaaacagacgtacatgattccattttcctatgtagctgtaccacccacctcgtattattgcaaattgacccattttgcgtgccacgtcatctagggactctcgactctggtttcagacatgattgtggcgcgcggggacaaaaacaaaaaacatgccaaatgagcacacaagagagacaagaacaacaataaaacacaaagagaaacaaagaaaaacaaagacagagaagaca

SEQ ID NO: 684260 - DNA, 605 bp, Homo sapiens
tgctttacagaagctttttagttgaattaagtcccatctatttatctttgtttttgttgcatttgcttttgggttcttggtcatgaagtctttgtgtaagccattgtctcaaagggtttttctgatgttatcttctagaatttttatggtttcagtcttagatttaagtgtttgatccatcttgagttgatttttgtttaagatgagagatgaggatccagtttcattctcctacatgtggcttgccaattatcccagcaccatttgttaaataaggtgtcctttccccactttatctttttgtttgctttgttgaagatcagttggctgtaagtatttgactttatttttgggttctttattctgttccattggtctatgtgcttatttttataccagtaccatgctgttttggtgactatggcctggtagtatagtttgaagttgggtaatgtgattcctccagatttgttctttttgcttaagtcttgctttggttatgtgggcagttttttggttccatatgaattttaggattttttttctagttctgtgaagaatgatggtggtgttttgatgggaattgcattgaatttgtagaattg

SEQ ID NO: 684261 - DNA, 363 bp, Homo sapiens
  misc_feature (296)..(296): n is a, c, g, or t
  misc_feature (324)..(324): n is a, c, g, or t
aatagagtctcattcttgtcacccagactggagtgcgatggcacgatcttggctcactgcaaccctccctcccgggttccagcgattctcctgcctcagcctcccaagtagctgggattacaggcgcacgccaccatgcccagctaatttttgtatttttagtagatgtggggtttcaccatgttggccagactggtctcggactcctgacctcaggcgatccgcctgtctaagccttccaaagtgctggggattactggcaggaaccaccaggcccagccaaccagcatttcttnaaggtggaaaatacatggtgttaatttnataattttgagtgtagacccagttccagctgctataact

SEQ ID NO: 684262 - DNA, 420 bp, Homo sapiens
  misc_feature (15)..(15): n is a, c, g, or t
  misc_feature (23)..(23): n is a, c, g, or t
  misc_feature (42)..(42): n is a, c, g, or t
ctcgtatccccctgnccctgttnaccaattctccctttcctnattgttcctcataatttgtccctgccttaaaactccctaggttcctaagggacaccccctgcattgcttgccctttccctttgcctagacacccagagagaggctaaaaagtgaaatgtgcccctggtgcagtggctcatgcctgtaatccccaacactttgggaggccaaggcaggcagatcacttgaggtcaggagttcaaggccagcttggacaacacgacggaatcctgtctctactaaaaatacagaaattagccaggcatgatgacccatgcctgtagtcccaactacttgggaggtaggaggatgcttgagcccgggaggtcaaggctgcagtgagctgagattgtaccagtactccagtctgggtgacaa

SEQ ID NO: 684263 - DNA, 381 bp, Homo sapiens
taagcattatattcaggatatactgtatatggacattattctcataattttatgggttccttcatagttagaaccaaataacttattcactcatctccttcaaaatagctcatatgcaagttgacacttcttaatgatactgagataatcctctaatgatattatcccaaatcctcattaccaatctcagggcatggacaacatctaaaacatttcaattcatcatcaattcacccaagcacaatcaaattcgttttcatcaggtcgttattcttattctcagtctatttatttttttcaaaacatcaaactatttatcttccagcaatcagtttattttcttttttctttggagcacaagggtcttggcattcaattggc

SEQ ID NO: 684264 - DNA, 129 bp, Homo sapiens
aaattactatcgataattataatacaaaggtccattcagtgcagcatatacataatgtaatttagtctaacacagttgaccctatttatttggacacttccatttgtttaaaacatacacattggaaaa

SEQ ID NO: 684265 - DNA, 288 bp, Homo sapiens
gcctgtttcaccccggggccaagtgggggcttcccttttggtttcctcccggggtccccaatgttttaaggggggggcccccttttgggtcccttcttttgccttcccttgaagccccccacgccaaacattgaatgtcccttgggcctgccgcctgggtcccccttggggccggggtttgactcaattcggctcttttaaggttaaaatttcgggcaaaatcccaggttggggttttgtttttacccttgtaagggttgcattcccaataaagcattaaaagtttta

SEQ ID NO: 684266 - DNA, 349 bp, Homo sapiens
  misc_feature (25)..(25): n is a, c, g, or t
  misc_feature (40)..(40): n is a, c, g, or t
  misc_feature (196)..(196): n is a, c, g, or t
  misc_feature (201)..(201): n is a, c, g, or t
  misc_feature (304)..(304): n is a, c, g, or t
  misc_feature (313)..(313): n is a, c, g, or t
ggccgcgtcggatacgggctgcaanaagacgacagaaganccccttctggggcctggagccagctctaaaaacataatcatatggaattattggaagatggtggagagtaaggcttgttcagtctaggagagtttagacaataccttcacctctgggaagaaccctggctaggtatgtggaggaactctagcaganggaanggggccccctgggcagatggggtttccctccaggatggggcatttggcagttgcctgggggctccttctactgggccatacccacttgccctggacagtgtcnaaggctgantgttggtggggtggtcaaccatctctttctgggggg

SEQ ID NO: 684267 - DNA, 314 bp, Homo sapiens
actacgtcgcatatgtttattctacatggtatagctattcatttatccacaaacaatatcactactatatgccaaatgcaggatactatgaatgagtgtaacaaaattcccatctatctggagcttacacccttatgggaagaaagagtatatatacattaaaaccagctgagatattttcgggtcgctgataagacctatgaagaatataagagatttacaagctgcaagagtgaaggagttgagtaggacgctgctttcatgagaaagggcagtagaatgtgctttacgttatataatatgctacagatagt

SEQ ID NO: 684268 - DNA, 613 bp, Homo sapiens
  misc_feature (102)..(102): n is a, c, g, or t
  misc_feature (432)..(432): n is a, c, g, or t
  misc_feature (459)..(459): n is a, c, g, or t
gtggtctgaggctgcgtgtctcaccggttgaggatcgtcgagaatatgtccggggctgaggtacttcgttggcatgatagtactgggcatcgcgtagggcancgacacgccctgtgtgacactattcgcgctctagcgcatgagaaggtgaactcgtgcaatacgtgctactccgatagggcgcactcggacataaatgctcacgttgtacagcccattcgctcgtagcctgttggatggggctccgtcgcgaaagctagattaattctcgtttaccccaagcaactatgaacatgcgggaatccgcaaaattaccattgtggaaaccaaaaaaggggcaactccggttttttgggttcaaagagacgcatttggcacgttcgtacacaaaggaattgttcatcatcacatgattgtggttgggtaagaggnctggtggtatcctgttggagctgatgntggaaatactggttgcatgactacaaacgtgcggatactgtgtatgtgatgcatgctgtagaactgcgagtattggaaacgttgtatcataccgcagacgagggttaaagaaacaaaagggtttcctttggggaattcccgtttaatttccaat

SEQ ID NO: 684269 - DNA, 800 bp, Homo sapiens
  misc_feature (800)..(800): n is a, c, g, or t
ggactggaagcggtggctgctaagctcgcggggctcaaggacgagctgctgtgctccatctgcctgagcatctaccaggacccgtgtgagcctgtggctgcgagcactacttctgccgccgctgcatcacggagcactgggtgcggcagggaggcgcagggcgccctgctgactgccccgagtgcctggcgcactgttcgccgagcccgccgctggctgcccagcctcaagctggccaacatcgtggagctggctacagctccttcccgctggactgccatcctcaactgctggccgccgtgcctgcgcgaccctgccaaggcgcacgagaagggtcaatgctcttctgcctcactgggagccctgctgctgcttctctcgctatccttacttgcagacagagccttgcacttgcgacggacgcaggcatcatgtgtcacctggcatcgacgactgccttcgacgacgcttgcaggacgggaggctgaatggaaccaaacttcacgggcccttcaaagaccagctggaggcgggggaaacaacatcctgaagacgcgcttgccacgccttgactccacagggcggagcgaaaaccttgggctgcagaaggaacgcacaaggttcgtttccccgccacagggaagacccttggccgcggacccaccttattcggggcgaaggggccctatcagacagccgggccttggccacccggccttgcttgccgtttgacactgcccccgaaacgtgcccagtgctagaaggcgacggcctgggagggctcggaccactggcccggn

SEQ ID NO: 684270 - DNA, 418 bp, Homo sapiens
  misc_feature (18)..(18): n is a, c, g, or t
  misc_feature (373)..(373): n is a, c, g, or t
  misc_feature (399)..(399): n is a, c, g, or t
cacatgtgggcatattcntttccataccttcttgtctgttttaacaagctaaccccagtcacagtagcagagagagggtccatcctaacttagctgaccaggctggattcctaatcataaaaccaaaaaaggaagaacctaaccatttctctctttcagctatgtgttccaagattactgaagcaggattctggccttcctgataagaacatgaccagatccagctggtttgcaacaagatgaacttcagtgctgagctttcaccaagtttttctcactacaatctcattgtaatactaaaatctccacccaagatggaggttatctgccattttctgtacatgtgttaccagaaaggggtcctgatccaggnccccaaaagagggttcttgggatctngacggcaacagagagttcg

SEQ ID NO: 684271 - DNA, 156 bp, Homo sapiens
ctactggacattctcctgaaagaaccaacttcttcttcctgttttaagaagaagttggttctttcacgagaaggtccaggtttcccgacggtccagcgtatgccagtatggtccaggtatgccagaaggtccaggttgccagaaggtccaggtatg

SEQ ID NO: 684272 - DNA, 120 bp, Homo sapiens
atgactccagtcgacgggcgcctgcctggatgcggacactgcacaccaccgcgtcaactggctgtcacctcatcccccagacgctgagtccacctcaagcgcaccgtgtgatgaatatcg

SEQ ID NO: 684273 - DNA, 172 bp, Homo sapiens
cacacaagcgctagtggctcataaggagtacctacttgggccattgtccacagcagaatgtgatgcttgggacagcggccttaatcctctggtatgtaatgtatatctaggtatgttctatacataggaacattgaagtcgactactccataacgacccgtcttccctatta

SEQ ID NO: 684274 - DNA, 491 bp, Homo sapiens
caacatgagacttcaaatttgccctcgtgtggaaaagagatcttggaaaatccactcttgaattgacacacatcatttgcacttacagtccattggctagaactagtcatgtggctcaaacctaacctcagggaggctgggagaaataaaggagggcatgtaattctctgtggatatcactctcattatcacatttgctccatcccttgtcagacattaaatcaacaaacactttgaaaattgcaatgttaaaaaaaaaaaaagaaagaaaaaacatttctcaatcctgtcacctcattaagttaaaatccctagttattccctttattgcagtgctgctcctcataagagacaagtccagacaatctttctctccttgctctatctctatacgctgctgaatcctatggactggacttatctgacttctaccttcaaatctaaagaatatgattgttgaagatttacaagactttttatatttaaaaaaa

SEQ ID NO: 684275 - DNA, 303 bp, Homo sapiens
gccccaaccctgtggtccctctccccaattttgtaaccctgtaccaggtggtgactgtttaactctttggggtctgtgctcaaaagactgccttctccagtgcccagggtatgagtgtgtgccctgtgcccttgtccctccctccccccatgttggaggtagcccttttcctcgcccccctgggagggacccatccttttcccttgctttcctggggacccctaaacccaactctgttgttgtgaaaaatccagtgaaaaattttgccgaaaaataaaccggaaccaattcccccaaatccca

SEQ ID NO: 684276 - DNA, 212 bp, Homo sapiens
gagagatccgtcctggaagattggactctccgtgtcttagtttaggctgtacttcccatctctcgtgcctaccgtcccacatgctcacacattgtacctttcaaatcctttcagcattttgggaagcccaggcgggcagattacctgaggtctggagtgtgagaccagtctggccaacatagcgaaaccctgtctctactaaaaatacaaaa

SEQ ID NO: 684277 - DNA, 191 bp, Homo sapiens
tgctgggattacaggcatgagccaccgtgcctggccccgttagttccaactttaagtcatttccttgctccctgtatcgattcataggctgttataagcagccaggccacatcttaactgcttcactgcttagaaatttcttctaccagaaacctgtgttatcactcttaagttcaaacttccatagatcc

SEQ ID NO: 684278 - DNA, 694 bp, Homo sapiens
  misc_feature (40)..(40): n is a, c, g, or t
  misc_feature (90)..(91): n is a, c, g, or t
  misc_feature (181)..(182): n is a, c, g, or t
  misc_feature (184)..(184): n is a, c, g, or t
  misc_feature (233)..(233): n is a, c, g, or t
  misc_feature (238)..(238): n is a, c, g, or t
  misc_feature (262)..(262): n is a, c, g, or t
  misc_feature (269)..(269): n is a, c, g, or t
  misc_feature (294)..(295): n is a, c, g, or t
  misc_feature (315)..(315): n is a, c, g, or t
  misc_feature (356)..(356): n is a, c, g, or t
  misc_feature (365)..(365): n is a, c, g, or t
  misc_feature (399)..(402): n is a, c, g, or t
  misc_feature (480)..(481): n is a, c, g, or t
  misc_feature (483)..(483): n is a, c, g, or t
  misc_feature (494)..(494): n is a, c, g, or t
  misc_feature (499)..(499): n is a, c, g, or t
  misc_feature (509)..(509): n is a, c, g, or t
  misc_feature (511)..(511): n is a, c, g, or t
  misc_feature (535)..(535): n is a, c, g, or t
  misc_feature (544)..(544): n is a, c, g, or t
  misc_feature (563)..(563): n is a, c, g, or t
  misc_feature (577)..(577): n is a, c, g, or t
  misc_feature (584)..(584): n is a, c, g, or t
  misc_feature (595)..(597): n is a, c, g, or t
  misc_feature (618)..(619): n is a, c, g, or t
  misc_feature (624)..(624): n is a, c, g, or t
  misc_feature (652)..(652): n is a, c, g, or t
ttattagacacctgatagttcctagccttagacataactngcagcatcagccactctgctgcactttagatcacattagtcagggctagnncccagccccatttacacggcatctgatgaatggttagctgtggcagttctaccataatgccattttgctccaaagaaatccagttaaccnncngcccatggcccagtagtttcacctctgttgcccccagaatagctttggnatggngaaggaacagctgtcttgatgtgnggcattnaagaaaaatgggatagactaatttnnctttaggcttggctgtgtanaaaaaatttggggtgagagtgtaattgtgggatggggaggnatgggtttnataaatagcttttctattgacttttagggaggannnnatttgccttagtgggtgtttaaaaattatagaaatggtgttatatagtgtggggaaatattaattaaaagattttctnnanatgaaattgtntttanaagttggttnanaaattttttaattgtaagatagtnagagatttnagttttttttttatagggnaaggagagtttgtntattgtnatggagttttnnnatttatgtgggaaaagatgtnntgggntataaagataaatggaggtatagaaggnaaaatgtttaaagatgataaaaaggttataaaagataatggg

SEQ ID NO: 684279 - DNA, 774 bp, Homo sapiens
taatggtgttgtcgtgcagggtcctacgccccacggaatctcgctgattgctagcacagcagttctgaaatcaaatctgcaaggcggcaccaaggtctgggggaggggcgcccgccatttgcccaggctttgctttaggttaaacaaagcagccgggaagctcgaacgtggggtggagcccaccacagctcaaggaggccgtgccgtgcctcttgtaggcctccaccttcgtgggggcagggcacagacaaacaaaaagaccagcagtataaccctctgtgtcaggactttaagtgtgtctcccgtgttcgtgacagcctttgtgaagaaaaagcgaggtggttctcctccccgaggcagcgcaagcgtgtgaagacactcttgagaacagcgggcaaaaccgtggccctccctcaaagtgtggggtctcccgtgatacacccctgtgatacaccccgcgagagacagagaccaatacactgtgtggagagaggcgacccccgcccaagacgagggggcccaacccacgtgataacaaactctctcaaccagcgggcgcgagggtggttttattttccccaacccgaagaaacaccgttgttgccaggcctgtagaaagagggggctccccgctgtagctctcgtggtgtttataagacaagacggggacaaaactttataaccaacaaccgagagaaaagagggtgaccaattttctcaacacaccgcgcaaaaaacaccccccatcttcgttgggttacccctttacatacc

SEQ ID NO: 684280 - DNA, 684 bp, Homo sapiens
  misc_feature (47)..(47): n is a, c, g, or t
  misc_feature (55)..(55): n is a, c, g, or t
  misc_feature (75)..(76): n is a, c, g, or t
  misc_feature (79)..(79): n is a, c, g, or t
  misc_feature (82)..(82): n is a, c, g, or t
  misc_feature (86)..(86): n is a, c, g, or t
  misc_feature (109)..(109): n is a, c, g, or t
  misc_feature (119)..(119): n is a, c, g, or t
  misc_feature (136)..(137): n is a, c, g, or t
  misc_feature (150)..(150): n is a, c, g, or t
  misc_feature (199)..(199): n is a, c, g, or t
  misc_feature (213)..(213): n is a, c, g, or t
  misc_feature (557)..(557): n is a, c, g, or t
acaccccccaccccctccgtctccaacttaaaaaaaggcaagcccgnacaaaaanaacaaaaaccccaaaaaaannagnagnaagncaaaaaaaaaaaccagtacaaanaaaaaaaaanaaaaaaaaaaaaaaccnnaaaccaaaccgcnaaaaaaaaaaagaaaaaacaaaaaaaaatataccagggggaggcccccnccccaccccaaaanaaaaaaaaaaaccaccaaaaaagacccaaaaaaaaaacgcccctcccacacccccccacaccccacaagcacacaaacccacaccaccccaacaccccaaaaccaccccccccccccctcacccccaaaaccaacaccccaccgccgcctcacacaccccccccacccccccccccaccacaccaccaccaccccccacccccccccgcagcatccccacccccgccccccccccacacacccccgcaccacccaccgcacaatctcccccgaatacaccccccccccacccccccccccccaccacccccaccccccccccctcccacccccgccccacaacnaacaaccccccacccccccaacccccccccaccccgcccacccccccacaacactccccccccccccctcccccccccacccccccccccccccctccccctcccaacaacccaccacacacaacaa

SEQ ID NO: 684281 - DNA, 343 bp, Homo sapiens
acccctactttaaggagttctagatatgtgagatactaccttaccctttcagacagttccatgtgagtatgttaaccatacttcttagtcaaaaataaagagaagcctccgggtctttgtgggaacaaagttacaaattaattgaaatccatactcttcctaagcagcttggacctactactgtcccacatgtaagtatgcaaaactacattttgccaagaattaactcatgagaaccattgaacttgtattgaaagtcaccttaacagtggtattgtgctctgtaaaactggaatcttttcccacaagatgcatgtaaataagagatctcaaaaatagaaag

SEQ ID NO: 684282 - DNA, 918 bp, Homo sapiens
cccgtggaaacacatatgagccgcaaggtgaataaactaaaaacgaagtaaaagagacacgatatcaacataagaccatcaggaacccacacacaccaacacaattttacacacagacaagaacagcaagagacaaagaaaacagaaaatgagctgccgcacagagcaagaacaacaaggagcaagaggacaaaaacagagcagaagaggggagagagagacgagtcaaggagacgacaacgcatcacacgcaacgaaacgggtagaggaaacagagacagggagcagcgaaggagccgggaaggagaggagatgagaacgaaacagacgagcaacagagcagagctgagaaacctgcagtatagaaacatgagatgtatacgaagcaccatggaaacgggaacgaatagcaaggcggtagggaagaccgggcagaaggacgaagcagacaaacataaacataacacgatagaagaagtagaaagaggaagaagacagagacagtataatgcagcggagacaaaccacaggagcatagagaacgtgcaaaggaatgaagaagagagcacatagacaacgagagaaggaatcagagaggacgaagcaagtaaacagctggagccacccgaacgtcacaacaagactgccacgacggagcgcgacgcaaggacacagagtcagacagcaacacaggacgtcaatacacgatggtagaaaaggcgtacaggacagcagaggtgacaaccgagagtaatggcgacgcagagacttgagggaccgaatgaaggacgcacgagagcgaggcaacacaaggcagatgcgagagcgcgagacaaactgaccgacccagagcagaacagaggaaaaacatacaaaacaaaactggaatagagacggaatgcggatgtgaggacacac

SEQ ID NO: 684283 - DNA, 170 bp, Homo sapiens
cttgcgtactcatattctggatcctggacagaaacccatgcatgtcaatgctccaacttacaaattatggcatttagatccagatacctgaatatgagatcctgagtactacttacaacgacctggtgaatggtggaacggtggctcccatggacctcctactaatcacc

SEQ ID NO: 684284 - DNA, 225 bp, Homo sapiens
cccattggatagcggataggggccagaactacatctgggctgcgcgcttgcgtttcgcttcctggccctcgtatcctgggacatccctggggctagagccctggacactggattggccaggcacgcctaccatgggctggctgcactgggagcgcttcatgtgcacccttgcctgccaggaagcgccagcttcctgcatcagtgagaagctcttcatggacgctg

SEQ ID NO: 684285 - DNA, 440 bp, Homo sapiens
ctcgagaaagggggaagcggcagacggaacttaagctgcaagatttgaacagatgaaacaagataagatctaccagataccagggtgttcaatcttgtatgtgataaatcttggatgatggtattgatgatgaacgtctccggagagagaaaactccagtgggtacaatcactagtgcaaaggttatgatggagggtggtcgcagcaaagggtttggtttggtatgtttctcctccccagaagaagccactaaagcagttacagaaatgaacggtagaattgtggccacaaagccattgtatgtagctttagctcagcgcaaagaagagcgccaggctcacctcactaaccagtatatgcagagaatggcaagtgtacgagctgttcccaaccctgtaatcaagccctagcagccagcacctccttcaggttacttcatg

SEQ ID NO: 684286 - DNA, 225 bp, Homo sapiens
  misc_feature (45)..(45): n is a, c, g, or t
  misc_feature (71)..(71): n is a, c, g, or t
  misc_feature (121)..(121): n is a, c, g, or t
  misc_feature (185)..(185): n is a, c, g, or t
  misc_feature (195)..(195): n is a, c, g, or t
cagttgtgaagttttgtaaaatggtcacccaacttaaaactaggnaattacgaagaagagaaaattgcccngtatctgttaaggtctgcctgtagatctgctgtagggcttgtcaccattngaagcaaggtcctacttcagtggcagatcttgtggcctttgagtggctgaagaccaccaccctncacagggctngggccatgcacaggcatccttccctacctt

SEQ ID NO: 684287 - DNA, 870 bp, Homo sapiens
catcaatcgcccacatcacgtcgagacgtaaattatggcgtgaatcatccgtaccttcacgccaatggcgccggttcagtattctattatgctgcctcttctctactacatcgggcgaggcctatattacggatcatttctgctacgtcagaaacctgagaacatccggcattatcctccgtgcattgcaacgtatagcaacgagccttcataggcttatgtccatccgcggttgagggccaaatatcgattctgaggggccacagtaatgacgaacttacttatccggcatcccatacgattgtgacagacctagttcaatgaagctgaggaggctacatcagtagaccagtcccacccgtcacacgattgtttacctttcgactacatcgttgcccttcgaatgtatgagccctagcagcactcgacctcctagtacttgcacgaaacgggatcaaacaaacccgctaggagatcacctcccatgcggagtaaaatcaccgttccacccttactacacaatcaaagacgccgctggggttagttctctatccttctctccttaatgacagtttagcactgattgctcgagcagagctcctaggcgacccgagacgaattataccctagtccaaccccttaaacacgcccgtccccagatcgaagcccgagtgatatttgcctattgcgcctacacgattctccgatccgtcctaacaaactaggaggcgtcccttgccctattatatgcatcctacatctgagaagtaatcccatctccatatttgccaaaaaaaggataatatttcgccagtaaagccatactttaattgatctagcgagactcctgattcttacctgaattggggc

SEQ ID NO: 684288 - DNA, 890 bp, Homo sapiens
ggggcggcgcggagccttgggcccggctgctgcccggcggctggccccggcgcggtgcgggctgttctgctggctgccccgtgtgagctgcatgggtgcccctgggcggctggcgaggcctggacgaggggcgcggtcacgggtacacctgtgcaaccccggctgcccctcaggatgccaaagggctgcgccggcgtgaccaccggcgtggtgccactctgctgccgcgctgcgacgactgagtgccgaaaagcgtgcaggggccttccgacgtctctcggcagcctgcatccactttgctgtggtgccccgtccaccgttcgttgggcccccgatgtgtgggacacagaggcgacgctgggccctgggagtgcatgcttgacgcctggctggccaactgggtgcacatgcgtcgtgcttaccacgccccattgcttgacattgccccaggtcctttggtcacggcgactgccgaacttacctggacgggaggacacctgatacgtgcgacgtgtgttgccccgtaggagaccgggccccctccatccgtgccaggttcatgttgcccaacttgtaccccggaggcgtgtcagggtcccaggctgcgctctccctgggtctcacgggatttcactggtgaccgcccatgtgacccttgaacctttggcgctggcccaaccagcattgatagcccaaggagcaggtcccttatgagcgcctttcctggcagggacgagctggggaaccttgtctccctatagcaactggacttcggcctgggcccccaccatagtaaaacgtctcatgttacaccttgttcaccgattgccaccctctcccgtgttcttacccgcggacattggcaccaggaaccgctgcagggtaccccc

SEQ ID NO: 684289 - DNA, 360 bp, Homo sapiens
cagcgagccgagatcctgccactgtctcaaaaataaataaaaataaataaataataaagcctatagaagcagtctttctgcagccccaggtcctgctcactcatgtcctcatccagaaaacattctggagcagccacttcgtgtctgcacggtgcaggcaggggtgcagctagggtgcaggtgtgcaaggcatccacaccccgcaggatggtgcagacacagacgtcagccacttccccacgggccacctgcatgactgctcatggcaggctcctaaactggagtctcttctccgcaaaaattgcatgtgcctgcctagatcttaacaggaaaaataataaaacttgctggtcaaagtta

SEQ ID NO: 684290 - DNA, 100 bp, Homo sapiens
catcatgcgttcctggactctcctatagtttgaccaatcagttgacccataaaggttatggtctctcagcgttctcaattatttccacaactagactact

SEQ ID NO: 684291 - DNA, 431 bp, Homo sapiens
  misc_feature (39)..(40): n is a, c, g, or t
acaaatattccatgttctcacttagatgtgggagctaannaattaatctcatggaggtagtgagtagaataataattaccagaggctgggaagggtaggggacagagcagagggcagcaggttggttagcaaatacaaaaatacagttagacagaaggaataagttctagtgtttgatagcacagtagagtgactacagttaacactagtttattgtatatttcaaaatagctacaggagaagatgtgaaatgttcccaacacaaagaaatgataaacatttgaggtgatggatatcccaactaccctgatttgctcattacacactgtatgcatgtatcgaattatcacagggaacccataattatgcatagctattatgtatcaattcaaaaatcagtgaaacaactgaaacatgaatcttaaaccaaa

SEQ ID NO: 684292 - DNA, 297 bp, Homo sapiens
  misc_feature (46)..(46): n is a, c, g, or t
  misc_feature (157)..(157): n is a, c, g, or t
ccctagcacccttcctgtacccctagcaaccttcctgtacccctancaaccttcctgtacccctagcaaccttcctgtacccctagcaaccttcctgtacccctagcaaccttcctgtacccctagcaaccttcctgtacccctagcaaccttcctntacccctagcaaccttcctgtacccctagcaaccttccttgatgctgccaaacatgcccataagttttgtaacacagaagatgaggagactatgtatctgcggagacctgaaggcattgaacgacagtcaggaaggtggc

SEQ ID NO: 684293 - DNA, 263 bp, Homo sapiens
  misc_feature (46)..(46): n is a, c, g, or t
  misc_feature (157)..(157): n is a, c, g, or t
ccctagcacccttcctgtacccctagcaaccttcctgtacccctancaaccttcctgtacccctagcaaccttcctgtacccctagcaaccttcctgtacccctagcaaccttcctgtacccctagcaaccttcctgtacccctagcaaccttcctntacccctagcaaccttcctgtacccctagcaaccttcctgtacccctagcaaccttcctgtacccctagcaatcttcctgtacacactggaaacgtccttagcacc

SEQ ID NO: 684294 - DNA, 268 bp, Homo sapiens
  misc_feature (46)..(46): n is a, c, g, or t
  misc_feature (157)..(157): n is a, c, g, or t
ccctagcacccttcctgtacccctagcaaccttcctgtacccctancaaccttcctgtacccctagcaaccttcctgtacccctagcaaccttcctgtacccctagcaaccttcctgtacccctagcaaccttcctgtacccctagcaaccttcctntacccctagcaaccttcctgtacccctagcaaccttccttacttcttcttcttcatcgtcctcttcagcctcctcggtgtcatcctcatctcccctagcaacttcctgtac

SEQ ID NO: 684295 - DNA, 188 bp, Homo sapiens
cactttagtgtacaaaggttaatacccagcgaaaattactcttgagcgaggtctacagatgagtaggtcaaaactgcaggatatggatttttgtcagggttgcgggatagatagagccagaagcggggtgggagcgaggcattcacaaatcagcataggcggcgatccattgcaacacggtctctcaa

SEQ ID NO: 684296 - DNA, 786 bp, Homo sapiens
gcctcatttgtacctcattgtaaccagtgcatgagatcttacatggacgttcctgaatgactaagcagttacgaggtcattctaggactatatacaatgacgctgaggccgctgcgtatattggtgcaccaaggtgtcttatatgcctctcgtctgatatccttgaaacactctacaccaaagatgccctcattggtctggcacatctgcctatccactctatctgtgcactaacctgtattctgttccatcagtctcctccaatcggtcgacggactagcatcacatagtggggactctcatgctctcttatgactgatgtcatctgaacaaatgtagatccatagtcttcttaatatacgcagaatatttcttaagacccaatgctccacataatgtatgtggacaacgagggcccaaaagtcaacggcaaagcaacgtgcttatgggctggggagttccatgggcacaagtcacagggtggggagcattaatttagtcggcccatctttttgtaacattgaaatgcctctttcccccatggcgtgggtaacagaggttgatggcctcgccgtggcggggcattcttaaaggaacctaatggacacaatggttcagtggcctaccctgacagtggacttggtactccttcacgcagggtgggcggcacaatacttcctttgaaagttttcaaagtgcctgatcctggtggtacaacggtttgaacgcagggtccatccccactgggtatggtgtgggcctccaactacctgacaggatttagcc

SEQ ID NO: 684297 - DNA, 197 bp, Homo sapiens
gtgcgcggtgaccttgttcagcggtggtttttctcgcatgatgatgaccgcttgaaactcaccgtctacttccctcgcatcgccgtggataataaattcgccaatatcaaattccgtcacgtatggctttcccttcaaggtaactgcgttgatgaaacctgacccgcggggggcaaacttccatgggggtgtgcttt

SEQ ID NO: 684298 - DNA, 281 bp, Homo sapiens
catcattccatactaacttttacaaatagctagtcaagtaaaaatttacctgttctaaagatgaggccaggcacggtggctcatgcccgttatcccagcactttgagagcgtaaggtgggaggatcgcttgagcccaggaggtggaggctgcagtgagccgcgattgcaccactgcactccagcctgggtgacagagcaagactctgtctcagaagaactagttttctttttttaatagtttttgggaactatacttttgaaatgtcccgtcgaaaagctt

SEQ ID NO: 684299 - DNA, 364 bp, Homo sapiens
aatccctcacacaggcgaatgcccctctggaatagagcttccagaagaaaactcagccagcaatatttgccgttctacagcctccactggtgatacccaggcacacagggtctgaagtgcacttccagcaaactccaacagacttgcagactggagataaaagccagccctctaggaagtatctcaatatcttcagagccactttcaagttcctcaataaggtgccagttctcaggttaacgtggctccacttctcgagaggcattcaccctttctctaaacgccaggacacatctccccgactaagcacaggccgacccacagcaggaacagcgccacgagcttccacatggtctaggggtgc

SEQ ID NO: 684300 - DNA, 167 bp, Homo sapiens
acgaaaagtggaagcaggacgtgggcaacgtcttccacgacacaggcgctgacaccgccgaggaggctaggtcggaagcgcaagaacggctcacaaaacatctgatggacaagggatggtccagggagcagcccgagcgttgggttgaggcccgctggaaggacgcg

SEQ ID NO: 684301 - DNA, 339 bp, Homo sapiens
  misc_feature (184)..(184): n is a, c, g, or t
gacccccttccaccagcctcggcctcccaaagtgctgggattacaggtgtgagccaccatgcccagccctaatgtagtatttttaaatgatatgattatacaacaactttctttaaaatctaagttcacaaaaattggtcagtacatcatctcgttttatctcatattgactatatattaccangtgtgtaagaacacattctacaccagtattatcataccgtgacagaacagttgaggcctgtattataactgggatattggggtagcatccatgttaaagtatcagtagcagctgtggatgtatcacaagaaaatattttattcaagttcccaaaa

SEQ ID NO: 684302 - DNA, 272 bp, Homo sapiens
tccgaggtccttcgatgcctacgcccggctaattttttgtatttttagtagagatggggtttcactgtttttagccgggttggtggcgatctcctgacctcgtgatccgcccgcctcggcctcccaaagtgctgggattacaggcgtgagccaccgcgcccggcccacagcctactcttatgtcttctgttacaaccttcatgcagtaactgccacatctatatctttgcctctcagctccagtaccagaattcctattggacctagtgcat

SEQ ID NO: 684303 - DNA, 479 bp, Homo sapiens
gcctccagagctatctttgcttgaaagaatgaaacttcaggaatgaaagtttgcacataaagcaagcccatgagaaagacatttcgggaaaactagaatcctgttaagttatgggatttttttcaagccacatggttgataagtagtctgaccaggatcctggagcaacacaaggaagacaaggacccttgaagacaaggcagccttgaaaccaaatgaagccctgggccagtgagcatggcaagaggaagactgttaattgcgagaaagctgggtcttgaagatgattccatatcaacatacagggagttccaccactgaatggtctatcggttgggaatgccatcatttattttcaccagtggggaagaattggtattaatatcaaaaccacagtactgtcatacccagctataatttgcaatgtttatatgcctgtacgaatgaataattaacagttaaatgaatcaatatatata

SEQ ID NO: 684304 - DNA, 116 bp, Homo sapiens
gtacctcgtgacgagtgatgacatgatgctggtgctttccctggtggcaccctcagtcttgttgcatcactctggttggttggcttctgtccccgagaacctttgttcctctgggt

SEQ ID NO: 684305 - DNA, 736 bp, Homo sapiens
cctatctttaaaaggaatttaaattttgttgtatatacagtgaactaaatcagtacaagtttggggtgaaaaggaaatttttaatccatctcaaatccctaccttatataatataaccaaatacatttgagatggattatactaacggtagggatttgatttatatttcgaagaatttaccacattggttcagtactgtgaaaccaccatttcccctctgattagtaactgctatttttagtagaatattaaattcttatgtgtcttgtgtgtcttaggccaatttctgggccttctgggttttttctacactgtcaataattatcgctttaattggtgttaatatttggtagtacacaggttctcccttgttcttttaaattttgtgaaatataacttacaaatcagtacttaaaacagagcttaatgggtaaagcaacagctgtgtaatcacaaactagatgcagaggaggtcttgccagcactccaaaatctctgtgtgtcccctcttgacactcactgtttcccccaggagctaactatcctgacgtatggtaattctcccgtctgtccttttacagaattgatttgtaccagttgatgtgtataagcaatagtggtttaccattttggctgcactttgtgactttatatagaaatactagaagtaatacttaaaagaaacagaatgaattctggcaaacaaaaaaaaaaaagggggggcatcaaaaaaatc

SEQ ID NO: 684306 - DNA, 449 bp, Homo sapiens
tgacggttggttaccatcatttcccagaaaccagggttttaaagaagacggtggtggatggtggtttaatagatgtcatgcagccattccaaacggcagatcctactggggtggccagtccacctgggacatggcaaagcttggcccagatgatggtgtagtatggatgaattgaaaggggtcatggtcctcattgaagaagatgagtttgaagatcaggccttttttccaacagcattagtcccaattacgtaaattttggctcttctgtttgtgacaacattttggtccattatgttattggaattttctttcatacattatattcctttaaaactttcaagcagacgtaagtgtgactttttgaaaaaagtttaggataaattccattaaattagcacatgatttcctttggtttccttcatttctctggctaaccaagaagtacc

SEQ ID NO: 684307 - DNA, 310 bp, Homo sapiens
tattcatcggcacccgtattgaattcaacacaccacaatactatgtcgctattcatcggcaccggggttggtgtaaactaggcgtacgtgaagtagaggttaaggagggtgatggtgccgataatagcgacatattattgtggtgtgttgaattcgctattcatcggcacctgccacagaggctggctagtttttgtatttttagtatagacggggtttcatcaggttggccaggctggtcttgcaactcctgacctcatgatccagccgccttggcctccgctagtgctgggcttggtgccgatcaata

SEQ ID NO: 684308 - DNA, 161 bp, Homo sapiens
tgatctcctttttccctgcattataaaacaaccataaaaggaacgcagctaactcacactaatacaacataatgcatgtaatgttaaaagcgattgtcttaccctcagtaccattctactttttgcaacctattgtatttcctagaataactcactgacaa

SEQ ID NO: 684309 - DNA, 932 bp, Homo sapiens
tacaaatcttactggaagggtgttcagaaattaaaatctgtgtttgctaagacttcattctgttgggggttttaagaagtaatatattttatgttacatatattacttcttaaaaccccaaagaatgaggttctttatgtaccataaaatatatgtaaacgattgcagtttttttggacgtttttccatgcatcagtaagttgtctgacagtagccaaatgtaacttgcagaaaattattgaaaattatatcagaataatagcaatcaggccttggatgttctttattaaactcttttcaggcagtaaattttaaaaaaattgtcattttctaaagtccttttgctaaaatgttgactatggaaaacaaaaaaaggaattttttagtctgctgctattattaacatttattatctgtatcttttggtcaggaaatgacttcacctattttttccataagcagacctttaacagagtcacttaattgggctgcttaacagatgttctgggagaaaattataatatttagtatttgtccaaatatccaaaagtattttgacagtttcttttttaagatagttctaaagcttaacctgggtagaggtgtttgtaccaattatatataggcaggctgatctagcaagcatgccatagagatcacaatcaacagtgtggggaagtcaccgcagtggaagtggatgccccccttatttgaagcttaacccaatgtcttgcattaagcggttctgcgctctcggtcagcacaaacaaagaagggagcgtgtcgcttcactaccatctccgttgaacaaaagagcttctcacaacgcacaacaaatggtgttttattacaaaatgccgcgggaactttaaacagagttggccgtcacacactcaccacaacacaggcgcggggcaacacatacatgcata

SEQ ID NO: 684310 - DNA, 332 bp, Homo sapiens
tacaaattggcttttttttttgcccctttttgaagtttgaacttttaaccattttttggactgggggttttttttctttagtttgttaaatttttcccccttttttgtccccaggggtttttccaaaatttttggttttaccttgaagctcctttggctttcccaatttaaacttgggtttttttagcttttttactttttttacgaaaactttttggggggggttaattgattgggaagccttttttatggtttttccaatggtttttggaattaattttttggccacccggcccgaaattttgtaggaggtttccccccgggaatttcgg

SEQ ID NO: 684311 - DNA, 357 bp, Homo sapiens
tctccaggattactcgaatcgacggtttctcttacatattagcaggtcatgttggtgactcctaaataccttctcagagtctgggacaatctgcagagacacccttggagcacagtgcagcagcttcccataccctgcattcagattgctaagttctgggtgacagaggatttgtatgcggaactattgaagggagaaatgatgtgtgctctgtaactttcttcaaaatggttcaggaaaaaatatatatacctgtgcagatgaagcaaatatggcaaatgttaacatctattatatctcagccattgatgtatgggtattgacagttatatacttacaatagtgctcaatagttga

SEQ ID NO: 684312 - DNA, 589 bp, Homo sapiens
gcacgagctactagtgggcccaacgcacaagacgctgatgcagcttatgtccaactaacactgatactgataaaattgatccataaaaatccaaatacgtggcatgccagacaaccatctggtataacagaaattccaaccacaactcagaatattatccagctaaggactattatggaactagtggaatgtgatattaaaaaactgtagcagctaagatcttatccacatgattgcctacattgtgctctccctacttatctcattgcctacttcatgcttgccacctttctgggaaaacactgcacgcaacgtaagaaagagcagcgctgtggcacaaacaggcgtgtggctacaaatctcatatccttgcagaatcattgagccctgctttacagtgaggcaggttgaagggcctttcggaagacatggccgagtgtcaaggtaaccctctaagctgtaatccctggcatgaactcaaagctcgtgggtacaatcttggtccaagacttgaactttaaggcctaatgaatactccacaaatgttttaaggtcaacctttttttgagggtaaactcgttcaaaaata

SEQ ID NO: 684313 - DNA, 119 bp, Homo sapiens
agctggtccctcattcttatacttcataccgggaactgagaagtgttgagaagataaagcgttgaggaagtataaagcgttgaggatgtataaagcgttggggaagtataaagcgttgg

SEQ ID NO: 684314 - DNA, 166 bp, Homo sapiens
tccatgcacgctggttatgttcctaaagccatgtcgaagcccatcgctgggtcatagtacttgctgcagtactcttaaaactaggcggctatgtataatacgcctcaactcattctcaacccctgacaaagacataaacgagcgtggcaatgggtacgagctcgaa

SEQ ID NO: 684315 - DNA, 184 bp, Homo sapiens
ccgtgctaggctaagcacttgacattacctcgtttattccttacaacaacactgaaccatagcaataattttataaacaagatactgagacataaagaaattaaccaccttgtttgacaaacagtaagtaatacagctgaaattttaacctggctatccttctccaaaggccgtatttttaaca

SEQ ID NO: 684316 - DNA, 246 bp, Homo sapiens
ggggtcccttttcaagcccttattaaatggggcataatgattttgcttaatccccaatcctgagaggggggcgatccctgtggtgatgaggaaaccgaggcttgggggttaatggcttgcctagattccccctgctagccaaggaatgaactggaatttcccccctgccccgggcggcttttcccattttttacccagccttttcaagatccccgccaattttaaaattaaatgattttatgttta

SEQ ID NO: 684317 - DNA, 788 bp, Homo sapiens
  misc_feature (634)..(634): n is a, c, g, or t
  misc_feature (669)..(669): n is a, c, g, or t
  misc_feature (684)..(684): n is a, c, g, or t
  misc_feature (696)..(696): n is a, c, g, or t
  misc_feature (706)..(706): n is a, c, g, or t
  misc_feature (726)..(726): n is a, c, g, or t
  misc_feature (754)..(754): n is a, c, g, or t
  misc_feature (766)..(766): n is a, c, g, or t
  misc_feature (785)..(785): n is a, c, g, or t
aacactcctcgtccccattctaatcgccatagccttcctaacattagtagaacgcaaaatcttagggtacatacaactacgaaaaggccctaacattgttggtccatacggcattttacaaccatttgcagacgccataaaattatttataaaagaaccaatacgccctttaacaacctctatatccttatttattattgcacctaccctatcactcacactagcattaagtctatgagttcccctaccaataccacacccattaattaatttaaacctagggattttatttattttagcaacatctagcctatcagtttactccattctatgatcaggatgagcctcaaactccaaatactcactattcggagctttacgagccgtagcccaaacaatttcatatgaagtaaccatagctattatccttttatcagttctattaataaatggatcctactctctacaaacacttattacaacccaagaacacatatgattacttctgccagcctgacccatagccataatatgatttatctcaaccctagcagaaacaaaccgggcccccttcgacctgacagaaggagaatcagaattagtatcagggtttaacgtagaatacgcagccggnccattcgcgttattctttattagcagagtacactnacattattctaattnaacgcccttacnactattatcntcctaggacccctatactanatcattttaccaggactctacttcactnactttcatattngagctctactactatcatnaca

SEQ ID NO: 684318 - DNA, 401 bp, Homo sapiens
caataccttttcggtagcagaagtgggataatgaagcctaatagctgagcgagagagaagagataagtcagcaagcgcaatagcaggcaggatggttgctgtggcacatgcatgtcatcccagaactttgacaggccaagttgggcagatgacttgcggtccggggttccacgaccagcctggccaacatggtgaaacctggtctctactaaaaatacaaaattagctgggcctggtggcaagtgtctgtaatcccagctactcaggaagctgaggagggggaatcacttgaacctgggaggcgcaggttgcaatgagcccagatagcgcagatagactccagcctggatgacagagcaagactccatctcaaaaacacatcaaacggaaagtagcaagtt

SEQ ID NO: 684319 - DNA, 176 bp, Homo sapiens
atctagagggctataatttttggtatttctagtagagacggtttcctatgttggcaagctgtcttgaactcctgacctcatgatctgcccacctcggctcccccagtgctgagatatacaggcttgagcgcctgttctttggcgcctatttatttatttataaatttatttattta

SEQ ID NO: 684320 - DNA, 638 bp, Homo sapiens
atgattcctcaagctatccatatatccactgcagattatacaaaaagagtgtttcaaaactgctgtatcaaaagaaaggttcaactctgtgagttcacacatcagaaagaagtttctgagaatgcttctgtctagtttttatgtgaggatatttcgtttttcaccataggcctcaaagcgctccaagtgtccactaccagatacaacgaaaagagtgtttccaaactgctctatgaaaaggaatgtttaactcagtgagtcggatgcaagcatcacaaagaagtttcggagaatgcttctgtctagtttttatgtgacgttattcccgtttccaacgaaatactcaaagctgtcctaatatccacttataaagtctacaagaacagtgtttcaaaactgctgtatcaaaggaaatgtttaactctgtgagttgagtacacgcatcacaaagtagtttctgaaaatgcttctatccactttttatgtgaagatatttcgtttttcactaaaggtctcaaatcgctccaaatgtccacatgcagatttcacaaaaagagtgtttcaaaactgctctatgaaagggaatgttcaagtctctgagttgaatgcaacataaaaagaagctttgagaatgttct

SEQ ID NO: 684321 - DNA, 809 bp, Homo sapiens
tttgcagagaaaggaaatctcgctcttccgaaagtcctgcgcatgggcggagagaggaaagggcctaggtactgtgacaggggtcgcacagtcgggcgaaacagtgccgggacggggagccatggcttcctagtgcgcccggtcactgactccgtccggcagctttcctcgtgcgctctgcaggctccttggttcgttggagaacagccggctgccttgttcagggcctgagtggggctggggcgcaaggtgcaagctgataatgccctgagatggagccagcagcctctggtggagttcggtcgggatgtgggggtagtcaaggaaagaagcagaagggaagtagcctcgctctgaaaagatggcagaagcagtgtatccatgccccaacagaggaaacagaacgagtgtatgaggacttacgagtctccattgccaagtcccttgtgggtcaggaccatggtcctctgaaagaatgcaagatattccggtgctgataatgattaatgaaccaatgtgattgtgaggaatgcgggaggacattggagcgagctcgtatggggaaaggttatctaggaaaaggtattctatcaagaagccgtccaagcttcgcaatttcagatcctaaactgggggctaaatggacaagatctgaagactaacatgcctatcatcacatcaaagaggtatcagcatagtgtagagtgggcagcagagctgatgcgtagacaggggcaggatgagagtacagtgcgcagaatcctcagggattacacgaaaacgattgagcatcctcctgtgaaagggaa

SEQ ID NO: 684322 - DNA, 986 bp, Homo sapiens
gccctgtaccgcgtatcctgaaaactggagggccttcacgggtctcatcgctgcgcagtacagcgggactcaggtccgcgtgttctccgcgacactcgccagttccattattggtgccaaagcaaccgcacccctgaattgctccgaaaatttgcctgaccagagacgagagtgtcggccagactatgtgatgggtgatgatggattcatgtgttgtttggagtagcatagatgcccatggccctacgtacatgtgcagcacactgtagagaagctgctggggtgaagtagtcccagttcagtgactagcgagaccaagttgtggatgcatgtaggagatgagcattcgcatgattcccagattatcaccgtgcccctcaggctactacctgggatgttcgcccaccatttgaggacaatcgatgccaccaactaactaaatcaggccaacttgcaagaaatgctgaagtgaggaagtgaggcgaatgctgggggctgcgtggatgccgttatactatgagagacgaggactttgggctggtgggcgaacgagtgacattggggtgacatcacagttgtctgcaccctgttgtggctctatgagcaggttctagagccttctttccggcaggctttcccaataccaaacgtggttcctcacctgcattaaccagccccagttccgggctgtctggggggaagtgaaactcgtgtgagcaagatggcccagttcgatgcgaacaaacgttgggcgaaaagccaacctaaacatggatacactcgagcggaaagagaaggggttcacgggagagaagccggaaggccaggctgagcggacggaggagaacaaggggggtgccccggctctgaggaggaaatggtgaatgttgagccggcgctggctggtggccacaggccaggacccttggtccctgcccaacagggcctctgggtggcggattaaggcaagtacccaggggccatct

SEQ ID NO: 684323 - DNA, 354 bp, Homo sapiens
agtgcagtgagctgagatcatgctactgcactccagcctgagcaacagaacaagactctgtctcaaaaaaaaaaaaaaaaaaagaaaaaggaaaaaagaaaattgaaccaggaattgctaacattttcacttttctctgcatgttccagaagcctttgtgaagtgatttttttttttctatttcattattttaggatgatagtacacttaaaaaaaaaacaacttgtattttaagttcaggggtatatatgcagttttgttacataggtaaacttgtgtcatgtggggttgttgtatagattattccctcacccaggtattaagtctagtcccattagttgtttttcctgattg

SEQ ID NO: 684324 - DNA, 779 bp, Homo sapiens
gtacgcgcctggcagaaggtgctagcgtagtgtgtttctctgcttcatgagtgcccgccggcctttgcagctgctggaagacccatttatctcatgcttctatgtatctttgtgtgacctgcatgtgtgaagagaagcagtggtgacggtttggtatccccacctaagagcacgtcccactttcccctgatggccagccgtcaggccccatggacaggggcgtctatggaagccagaggtttatcggcgtcaggggcagggaaagggctgcaggatccccagggggctgcctggaggtcggtctcactgacatcatggcctgaccccagcaatcaggacatggtcccacagatgtcggccctctggtccgctgtgtcttactcaccatcgttggctgattctccacaaacagaggacagacgttgaaagatacccacgtccagttacttcagcagactcaactatcatggacattcaggtcccgacacgagccccagatgcaggtctaaacagaactccagaccactctccgaccccaaactggcctggtgatagaaaaccaataaccctcagatcccagatccatgcaactggaaggaacgggatgggcctctagtgacaagatccagaagacacaacaatgagcaccaaagtcatgtgattccgattgattgaaaccactgaagctcatctgagagagcattccccaatgcacagacgtacagaagaacccccagacctcaggcatcatgtttcatgagttacccttatactataga

SEQ ID NO: 684325 - DNA, 917 bp, Homo sapiens
  misc_feature (917)..(917): n is a, c, g, or t
gagcgggggccctcctcggacctgtaggcgggcgagcgagccagcggacaaggactgcgtggtgaggctgagctagcgagcggccggcagtggggggctgccctgggctgctgagcctgttgagccctagcctgcgctgccgcctgtcggccgtctgtggtggccggaatggctgcaaggcctggagttgggcgctggggcgctcggcggcctgggcttgcctgggtagagtcctgttccccggcccctcgcttttgcggggccttgcgggcccggtgccggctttgcttgccccgggggtgggccccagaagcggggcgggtcctggccttgtggccccatgggaataccagctgcctctgggcgtgtgagggctaccctttttgcggccgttgaccgcccaggcgttcagaccgggggtaaccggcgggttttttcccctgatgcggtggtgttggcctggaattccttcccgagaaggctccgcctgggttgtggttcaccacgcgcgtgggaccagtggggcgtgatctcgcgtcgcaaaggtaaattccaacgtgcccgttgtggcagcatccttgggagagaagtgccccggcaagtgaggtgcccttgggcgacaggacagcacgaactgggtattttggctcacggtgggtgttgaccttcgtgtgtgggcccctacagagggggtggtcggtcggagtaccgagagaagcgttccaacgtcaggacttttaggcgcagaagcgagcttagttatttattcagcccaaaagtcgtttcaagacgccccgggggggttatggagccttaagagacgacttgggggacaattacacgatatgctgagccctgggcgagagcagtatacttgtcgctagaacggagactttcaacgggtagagagcccgaan

SEQ ID NO: 684326 - DNA, 281 bp, Homo sapiens
tcagcctttcctcggtgtgtggaactttccacatacgtttgccaggaggatcttccctccaccccacaggcatggatcagtgtggtctgatgccacaactgtgtggggtccctctcatccccagatggtgctgaggttgaagccctttgatttgggagcagtatgagtgtagtaaaagactgtgggcgtgggggtggagggctcgtccttcataacagtcagtaagaaaacgtcttgccacctttaaaaaaatagagagacaacagcaacgttggcggccg

SEQ ID NO: 684327 - DNA, 545 bp, Homo sapiens
taaattcgcggcccgtcgacattttggaagtatgattcaacaggcttaatttttttcataccctttaaataagattgccaggtttcattccttcattcaacaaatatttgttgaatggttccagtcagctttaaagatgcttagaatattgctatgaacagataggggtagatagaaaataaaccagtaaactggtgtaacaggatttaagtgaaactgactaggtttatatgaagtggtgatagcataaatatcacataccaaagtaaggcagacgtcccatatgtagaatttacagaggagatttcaaaggagctcgttccatgtattttgcacccctcagataggtaatgggttaacatgtagaaagggaacagaattttgcataaataattctttagaaagagctgtaggctgggctcggtggctcacgcctgtaatctgaacactttgggaggccgaggtgggtggatcacctgaggtcggcaattcaggaccagcctggccaccatggcgaaatcccgtctctacttaaaatacaagaa

SEQ ID NO: 684328 - DNA, 372 bp, Homo sapiens
  misc_feature (261)..(261): n is a, c, g, or t
  misc_feature (317)..(317): n is a, c, g, or t
  misc_feature (368)..(368): n is a, c, g, or t
ctcaaaacccaatgagatgccttcttataccagttaaaatgggtattattaaaaagtcaaaaatcaacagatgccggcaaggctgtagagaaaagggaatgcttatacaccgttggtgggaatgtaaattagtttagcccctgtggaaagcagtttgcagatttctcaaagaacttgaaacagaactaccatttgacctagcaatcctattactggtatgcatccaaaagaaagtaagttgctctactaaaaagacatatntactcatatgttcatcacaatgctattcataatagtaaagacatggagtcatctangtgcccatcaaaagcagattagaaaaagagaatggggtattatacaccatngaat

SEQ ID NO: 684329 - DNA, 316 bp, Homo sapiens
  misc_feature (79)..(79): n is a, c, g, or t
gcccaggctggacttgaactactgggctcaagcaatcctcctgctttgccctcccaaagtgctgggattacaggcgtgnacccgccgccccggccccccccaattactcttaaaggtaacatcactattgtgaacctaagatcagctttttgagatgccttttcaggtgtaatggttaatactgagtgtcagcttgattggattgaaggctacaaagtattgatcctgggtgtgtctgtgagggtgttgcaaaagagattacctggggaaggcagatgcacagttaatctggtgggcacattctattcagatccca

SEQ ID NO: 684330 - DNA, 318 bp, Homo sapiens
ataaacagcagtgaccaagtgccatgacataggtgttccgtatgcattagcctcgtatacttgctttccttttttgttgtgttttttggagacagggtcgtgctctgtcgcccaggctggagtgcagtggtgcgatctcggcttactgcaagctctgcctcgcaggttcacgccgttctcctgcctcagcctccccagtagctgggattacaggcacgtgccaccacgcccagctgatttttttgtatttttagtagagacggggtttcacagtgttagccaggatgggctcgatctcctgacctcgtgatccacccg

SEQ ID NO: 684331 - DNA, 278 bp, Homo sapiens
gaattcggcacgagcgaaatctttcgctccctacacaccctggttggacagcttgacctcagagatgatgtgggtggaaaatttacaatccggttgggaacaaggctcccagagcctctctggcattcagccttgcattgctctttgagtgcacttgaacacacacatttttatattaacaggcctttttttgagcaaaacttcagtctccaattaagagaggagattacaactgctgttgaagagatagggaggaacagacatggggcacacaaatg

SEQ ID NO: 684332 - DNA, 828 bp, Homo sapiens
tacttggagtcaccgcagcttaaagagcagaaggtctccggtcagtatgtgaggcctcattcgggaatgccttataaattgatcaagggtttttgggcttatgattgcactgtttaccgcactactgagccctgtgtgctggaaagaagagcggtgcacatgttgatcccaccaagatattttgatggctcgtaaaaggcagaaagtaagtggaagacttctgagtgacggatatggcacattccagtaggtctctgtgggacatgttgccaaagttttctcccggtggaagttgcattttgagtttgtcttttgggttttctggagggtgtaagaatcagaccatagggtagggacaggataactgtttgaagttcatttgtcaacttggtgttgaaaagcataggtggtactctgactgatgtgggatgacctgatatgtgcaaagttgcattattatgaaattcgagtatcagtgtctatcaagagagatcagcttatatggagtgttgttaaggcatatacagtgaacagtttcttgaaacagatgtatgtccttgtattggggttagaatgtaattggaaaaccatttggattaattagaggtctgtctgaaggagttgaagctttatttatgaacccatccacgggtgctgatcaaggccctgaagaatttgcagaggggttagtgattggagtgagaagcctctttggacacacagtaggtggtgcagcaggagttgtatctctgaatcatcggttccgttgggaaaaggtttggcagcaattacccactagcaggaataattagcaaagggacctagaaa

SEQ ID NO: 684333 - DNA, 205 bp, Homo sapiens
tgaaatttttttttgggtttattggggggggtccttgaaaaaaaaaaaaaatttttttttttggtccggggggggggttcccccggagaaaaaacctttttttccctttaaaataacttggggtggaacccccctttttttttttataaaaaaaaggaatttatgggttcagaaatggctaataaatgaaaacccttttaaggga

SEQ ID NO: 684334 - DNA, 107 bp, Homo sapiens
tcggagttgtaggtagcttccctacacttgggacatctcccaagcatccatatcattcattgtctcaagtccagcatcttgcaaccattgtatcagatatatttatc

SEQ ID NO: 684335 - DNA, 231 bp, Homo sapiens
gctttgcatttgtgagctgagcacagcagggaggggtaatgcagatgcaagtgcaccaagtagaagcaggacactgagcctgaataagggaggagagagactgagagtggggaaggaagaagtagtttactttggactaaagaatatattgggcgaagaatagagggggagcttgcaggaaccagcaatgagaaggccaggaaaagaaagagctgaaaatggagaaaacca

SEQ ID NO: 684336 - DNA, 127 bp, Homo sapiens
caggaggaggaggaggaggaggccaggtcctggtggagcctttgcccagcccagtcctttttgcctcctccgggctgaagctgtttgtcaggattcccctcgggctaaagaggaaaaataaagatgt

SEQ ID NO: 684337 - DNA, 1599 bp, Homo sapiens
  misc_feature (266)..(266): n is a, c, g, or t
  misc_feature (436)..(436): n is a, c, g, or t
  misc_feature (859)..(859): n is a, c, g, or t
accccttaaaagccaaatctgggacaggaaaagactcactatcatgcatctgtcgtcagttggacgcgtagattcgggcaagtccatccactactggccatgtgatctagtaacattgacggtggcattcgtaccaatgagaacccatgtgatgaatatttgtatgatacggacgtgctgcatgagtatgggcaacacgggctcgcttcaacgtatgtcctgtgcgtgtcttgtgcatacacatgcgtgatacaggcatgcatgcnggtgaatcgtcgcgctcatctactcgatgtgcatatcgtcgcgtctgttgggaaagttctgaggactcaagcattatgtacttcatgtgacctatcattgtgatgctccgctagggagggacaagaggtagctcttgatcaatacagatcgaatggcatgtgacaggggnaaccaattcatcgatgtgactcgtagcttgcttggccttggtcccgtagtactctcgttgtggacttggactagggttcgattagtgctggtacaattctagacatgcctgggataatcatccaaagtaattggtgcacagaaccactgaggaaagtagctgctctcttgtcatggcggttatcaacaaactaggggctgttgacatagcaaagcgtatagcttggttccgcgtagcttatagcatagaactagggagtttgccaccatttgaagctcaacctcctaccaatgcaccaggcaaaggtcagattatggcacggggaacatacttcgctttccatagggatacgctccacgtccaccatttaaccgctgttaagacggacacatactctgtggggcttagcaaagggcgcctggnagaacaaggttatgtccaaattttgggtggacccgaaatttaggcgtgggtgtctggggacctcggggttggcagcaaaaccgattgtctcggggtagtcccaagggtggcgttgaaacaattgagccctttgggcgttgcatacgaggggcaattcggggcaagagaaggttccatcgcaccggtttaaacacgggacaattggggccttatagtgggctccggaaggtgtgggaaaaccccgagggggccctgacgcttagtagcaaagaggagcttttcctgggagcaaccattgcggactttcccgttgaataccaccatcccaaaaggcttccgaggttccaacaacctggtgatagagactaagtcgccccctttggttgacgagaccatcgtggggcttccttttcaccacacagggcagactggcgtcactcaaccgagacaacgtggggcgtgcgagccaacttggggggtagaccctgggatttcccctgtatttgttgcacccgcatgattgtggttcagaaccgcgtggtgtgtacgttcttccatcataagaaacccgggtgctctagtgatgtgaggaagttcaccacccattgggtgcgttcccacagcaatgcacatcgatttccaaccacgtggacaagagactaagaacagtctgggtggccatgatcgatgcgaccacatgccatcagagccttcggtaagagacaagaaggaatctttca

SEQ ID NO: 684338 - DNA, 268 bp, Homo sapiens
ctttcataatcctattatacgatcatatcaatgcatagtgcattgccccttagggatatatttgcgaacaaattctggatgtatgtgacgtggtacttctggtttcggaatgatatccttagattataaagatcataccaaaaacaaatttcgtttgccattggaatagatatataataatttgacattaggactgatctactcattcataatacattaaaatagtgttcctagaaaatttagtacactaatataagtaatgttttta

SEQ ID NO: 684339 - DNA, 432 bp, Homo sapiens
tgatcagacagatcattaatctagatataacagtcgaatctgtcaaagaccatgttggataatccagtctgttaaatatgacctaactgctttgtttgtttagatactactcaaattcttaggtatgcaccagaattctgttcttttcttcagaatatgccagacaggaatgcgtggagagattcccgtcatttaaccctgcgacttatggcaaagacactgcgacgatttggtgccttctaacgaagattgtcatattctgtcctgtgtgtgactgtttttctgcccttaaattatataaaagtacttagtcttctctccttggctgagtttcaagcactttgtaaataaaaatattcatgagttgccttaattttacatttaataatcatcaggttatctctacagagagacatacccagagcaggtttc

SEQ ID NO: 684340 - DNA, 162 bp, Homo sapiens
taacttggcttgcatttgtgaaggggccgactatccgaacacaatttgaatcctatgtgcaccattcagggcccttagggtaggaggcaccagggttcaagaaggaacttgcgtagtagtaggatctgaagttggggcggctccttttccgtactatccatt

SEQ ID NO: 684341 - DNA, 407 bp, Homo sapiens
  misc_feature (123)..(123): n is a, c, g, or t
agaggatccagagtgagctatcagctataatacactggacatagagctgacgacagtgtgtgttgctgcaccggctgatagtcgttctttttctgaatgtgcccagggctgaagcgcagtgcnctttgtcaccagctgctgtgctgagtttgcaaaggcactgatgtgacacctgcccgcatgtctgtttgcttctttcaggggaaacttttgatacattggcagtcgaggatggctacgatatcgagaagtgcagtttcccgtgcagttagaagaatgttgactcatctgtggagctgggacaggtggccttaagaacttcattagaggtttggatgcacacagatcctgtttctcagacaaactgagtctgtacggaaccaggtggaggatctccctggccacat

SEQ ID NO: 684342 - DNA, 300 bp, Homo sapiens
tgttttatactccggaactatgtataagctgtagctcaagcatatcaccgtgaggtcaggatatccagaacatcctggtcaacatggtgaaacccggtctctactaaaaacacaaaaattagctcgaggtggtgactcgtgcctgtaatcccagctactcgggaggctgaggcaggacaattgcttgaatccaggaggcagaggttgcagtgagccaagattgcgccactgcactccagcctgggtaacagagtgagactccatctcaaaaaacaacaacaattaacgaccgtatccgca

SEQ ID NO: 684343 - DNA, 336 bp, Homo sapiens
gggagacatatctgtgtttttgcacacacaaagagcactccagcgtcgagcccactttttcaaggttcagaacctgtgacaagctgtgaagcatatgaagaagacagggagacattcatggacaaattcatttatgtgatagcgagagggcgttcctttctgtgtgcacctacaaatcttctttgggctggtcgctatgactaattccatcttggtgcaaagcgggaaatgcaggtggatgctttccaacaaaggcggcgaccggttccaaaggatttagaggaaggcgcttggttaatacatgcatgtgcgcggatggaggttaccggttatttt

SEQ ID NO: 684344 - DNA, 866 bp, Homo sapiens
ctcattaagcatggagacacacacacaggagctacagctacagtatggcgaggacaaaggtaaacttacgtaagtctcatcggaattacaacagggaaatggagcttcaatgaggacttgcagtccttagcttggttaggttaaggatgatagaatttctctgccagtgcagtaagagttgaaagccggtcagttacactaagtaagtaggagggaatgaaagtgtctcgaggtgaatggtggatataatttccctcttctgattatttattactgtgatgtggttcctaagcacaaactgggaagagatagaattcatctatactgtcttttttcttggagagaaccgtttaaaaaattacaagatatatttaaaggaagtaagccagataaggagtagcacgatgtgctatttgttaacacaataacagttcaagagttaaagtgtagataaatgagagttacaaagtttcatcagaaagtttacatatcttgagtcaaatatattgtttatatgtgtatgggcatataatggaaataatacttggaggcaacagaagcgtattattaactactgcaagctaagccgagcttagaaatgcctttggttttaaaggggcttggcagaaagagaacagaaacaagcgattatttcaacatctaatcaaccaagtcagaatcctgtgtttggatagacaagagtatacgaaagtatatcgatactgtacaagtaggcctctctcgctatttactatcttataggtaattcaggctctaattagctgagggaatgaaacacgcagaaatcactgagtcctaagaagttccttaactaagcgagactagttacaagtcagcagcataga

SEQ ID NO: 684345 - DNA, 371 bp, Homo sapiens
tcctggaaccccgacgtcgctcggaactgcccaggatgaggctctgtcactctctgccagcgccaggaggagttcgtaggcttcgatgcactgctcgctgtactgcaaggccagcctcagcgctgtggcattggattcgtattttcccaccagcatgctcatcctctcggcattgcttttacattcctccaaggttatggtcaggaggtcattttgggatttgaggtgctcaatccggctattcagccgttctgtttccacctcaaactctctaatcttgctttctgagatggcagatccgtgtgagtagagtgtttggaaaatctcttggatattggagcagtcctgaagtgagtgggccaggtgttcag

SEQ ID NO: 684346 - DNA, 189 bp, Homo sapiens
cacatacaccggcccgcggccgccgtgccacgcgtcttcatcgtggcccgcgaggcgctcattgcattcggatcgcttgaaatagggcagcacgtcttcccacgcccagccgtcgcagcctgacgcggcccagccgtcgtagtcggacggcacaccacggatatagatcatgccgttgatcgacgggct

SEQ ID NO: 684347 - DNA, 423 bp, Homo sapiens
cgtctcattcaatagctcagaagtgtcatccttggtcctgcgtagctatcaaactcgctggccttgaatccgtaggtggactacaggcataaagctattagcaaggaacattcttcgttgtcctaggcccatggtgttaataatggggtccattagtacatgttcagacgttggtccatgtatcccagatgactcagaagccatttgttggataggcacttggtcatacggccgaatagtttcccatgccttggtctcagtgctagaagtctggcattgatgtcctactccatagagtcctacatgacggtgatacgatagggtttatagatgtcttgagctaggccatgtgcctcgagcgcagttatgtcaccgccaagcaccagccgagagtgcttggccccagtgtgcatcaagcacccg

SEQ ID NO: 684348 - DNA, 99 bp, Homo sapiens
ggacgcagggggctggcgggaacgtgaagctccgcggtgctgatggggccgttgggcggcggtagctgttgctgttgggggaccccctcattcctgccg

SEQ ID NO: 684349 - DNA, 372 bp, Homo sapiens
gtgaggtatctagaggatcttgtgagaagctggaggggtgggtcaggaagcacagtgggggacagtttctggcatgtcggggacttggctccagagcatcgtgctcgtgtgaagtctctcaatgtggggagggagagctctaggtcactgtctcctgggaccagcacagtgcccagtggaacagaggcctccttgagctgttccttgtcgtagggcagggcctcatagtcgtgcatgctgacgcgactcacctggatgcgcaactgctctggcaccggttgctggtcgctgtgcaggggggcggcgctccggggattggccttctgcaccatgggggcctggttggggcagggcgatgcgggatgcgtgagg

SEQ ID NO: 684350 - DNA, 154 bp, Homo sapiens
ataacaggctcagatggactccggtgacgggctcacccacactgtgcccatctacgaggggtatgccctccacccatgccatcctgcgatctggacgctggctggtccgggacctgatctgactacctcattgaagatcctcaccgcagcgcgg

SEQ ID NO: 684351 - DNA, 411 bp, Homo sapiens
gtttaaatagctatgtttcatgctcactgaagttttttttttgatacagggtctcactttgtagcccaggctggagtgcagtgtcatgatcacagctcactgctgcctcaacctgctgggctcaggtgatcctccaacttcagcctccccagtagctgggaccacaggctagcaccaccacacctagctaatttttgctggattcttttttttgtagtgatggggttttgccatgctgcccaggctggtctcaaactcctgggctcaagcaatccagctgcctgggcttcccgtcctgggattacaggcgtgagccaccatactagggcttgaagtatttgcaattgctaacgcctatatgattcacttcacagctggagctgggcctagtggctcataccctggggcccg

SEQ ID NO: 684352 - DNA, 239 bp, Homo sapiens
ctaagagttggtggtgcaggttccagaagtttaaaagtgatgctgtgagcaggagccccttccatttgatgctgctgtgtgcagtggaggggctgagagggttcccatgtgtctctgctgcttgtgtgttctcctcatgtggagagtaagcctaggatccatgaaactcttctgagcactgggtgtacagcgtgtgctagtccttgcctcatttcttgtgcttgagcctcgttcccagt

SEQ ID NO: 684353 - DNA, 136 bp, Homo sapiens
caacgctggcaaccttatccggtctcttacttggaaaaccccttgccgtacatggaccagcagactggcaacctcaagaaggccctgctcctccagggctccaacgagatcgagatccgcaccgtgcttatctcat

SEQ ID NO: 684354 - DNA, 980 bp, Homo sapiens
tcccttgacgcgcttgttcgccgttttacctcaatgcgtctccctggtagcccctctttttcgacgcccactctttccatctcaatatgttccgcgcgcccaaatttccgtttccgccttcccgcgggctattttcttctttaagcgacgtatcccttttgggtccccagttgcccccctggccgctcctccgcttgtcccataagtagggccccccctgtgcttcccgcaataatcgcgcgtctctttgtggccacaattacggctttgtgcgagtggtttccccagccccgcccttatctcgacggcttcctcccgtatctctcgcctcgcgggtcagcacatcttcgtcgccacgccccgggcgcccacaatatacgatggcacgtgaggccgctcacatgtttcttgcagcacatcatcccccccttctcccttatgctcccattgataccccagtgctgtggtctccacaaccaagtgctactcactccagagatccacgctgcccttgttggactaatgaagtattaacaacggggtgcaccacacacaatggggggccttccaagatcgagtaactcacacctgggatactccttcctccgagatatcgtgcatagtatctactccaacttgtagaaaagtggtgtccaaccccagggctggtggtgagagaaatagcgcttgatctcttttatgcagatagcgagatacatagaccaaatccttgcgacgatcaaggcggcttgcagtggagaaacaactgctcgcctctccggtccacataacgacccggtgacgaccgcccttgcaatgggtaaaatcatgtccatgccgttcaatggccctcccctctttttgctccccggtcgcaagccaccaccgttgcagtggctgtttcactggggatgcaaacgagcgccttttagtttccccctcccaataaacacccttttaacaacgccattcatgacaaa

SEQ ID NO: 684355 - DNA, 271 bp, Homo sapiens
agagtgaaactctgtctcacaaaaaaaaaaaaggaaaaagaaaagggagtaaaacccggggggcctctctgtatgagggtaatggagaattaccactctctggtatatggtgtaaggcactgggatggtacagagcatgttttctgtaccataggacccagcaaacaggtaagatcatgtcccaggtaagcacttctggcccagttttagggatggtcatcctcacacatgaaagagcccattgactgatgaggtcataatactcatggat

SEQ ID NO: 684356 - DNA, 510 bp, Homo sapiens
ccccacagaagcaccccagttatccctctggaagaagcttgtcttataagcaggaccatcggcagagaaacacagcagctccgtatctgtgctgtggcggctggccatccaggtatctgcagccccgtgaggtggaagaagctggcatatacctgggagtccacggaggcaacatgtcgacgccatcgagcaacagtggacaggtaccaccttgcctctcctcgccctaagcaagcactgagcgtgagggatgatacacctgaaatgtgttcagtatcctgtgcttctggtgaaaggggcctgtgcaaacccaacagcctggtcccacactgttccaacacacctggtgctctgtccctcctccaggcctctgcacagggtgcacacttcctgcctctcccccattgatagtggcatttcacaattgcttcaccaatcagcccaaagtggataccgcagtgtttataacctaaaaattaaaaccatacttgggtaaaaaggaaggagggc

SEQ ID NO: 684357 - DNA, 152 bp, Homo sapiens
tgaaaacattaagctaaataagtgaatatctccagcctccctctctgagcccctccctaccttctcatccattaaaacagcactccatttcattacaatatctacctagtgtataagacatacatgtatatataaagtaatatgatatatga

SEQ ID NO: 684358 - DNA, 186 bp, Homo sapiens
cttagaggatcccaagctccacagatagctgagccccagagagagctctacgtacaagtacaggccagctcaggcccaatcgccagctctcccgctctgatctgcactctaacatcgatctgtgctctgggaagacagaatagctctgcatgaactatatcactaaaactgtcttgttgggagctt

SEQ ID NO: 684359 - DNA, 311 bp, Homo sapiens
  misc_feature (284)..(284): n is a, c, g, or t
tcttccgtgcccaggccccgtcggcgtggcaagaggatctcaaactcagtgtccagatccaagtcagtgctgcagtagtctttgggtaggttgatctcacctttaaacgacagggttatgcttaagcagagaggagttccaactcctcacagaatctaggcgtggggaggagggatgcagaagccatcagctccacacacagccgggagccgggtctcggttctgccccatctcatctgctgatagagtttcaaatgctttcagctcccttttgatgccatatntagggacggaagatcaggggattctca

SEQ ID NO: 684360 - DNA, 1156 bp, Homo sapiens
  misc_feature (905)..(905): n is a, c, g, or t
agcggaagaatcctatacgagatggaaatggacatgccgacgtttatggccaagatgtttgcagactcctgtgagcagtgggaaacaaatggaccaacttctttggcaagtggacattttactggctcaaatgtagaagacagaagtagctcacggtcctggcgggaatggcaggacatccaagcccgttcaggaactatggagatgggactccctatgaccacattgaccagcagggaccttgggtcacatgacaagtctctctccacctgtttgtcaattccatgaatacataagtaataatatgaaacggggctcatactcatctgatggagacgatgaatcaagacgttacagggtggaccaacagcagagtctccttggaggtgacagtggcataatgggcaaacccaggaacgcctcttcgcctcgaaacgaagaccgtggattccaggtacgtatcagatatagcgtaggcaatgaagtccccgaaggaaaggccgtcttcagcagtaagtgcctagtggcaggtacaagacgaacacgaagagttcgacaaaatgttccgtcgcaaggatgttgccagtcgtatgcaggtcgtatggcgtccaagtacagactaacgccatctggccagaggtacacagtagggatctcgtcccaggtgcttatcacgtatcctccaaaactcgagcaaccgagataacgtgttggcccctgaagtcatccgcattgcatctccaatcgtcggaggaattgaggcccagtacagcacgcgatggtggaaacccggtgtgggaaagcgtccatccaacgtgggggactggaaattcaaggcttgggcgttatgccagggacaatgttcggcggccaaactcgttccttcagtatttcggcaacaggcntcccaggcagggcttagagggtaaccccctgtcgattccgcacaaatgaaagcgagtttggaaacggtaaatacctattcaaccgacttccccttcgagcagaaacttccaagtttcccatggtctttgcctcccggcatgtgttcaagctgttcccaatggctaacctggtggtctctacaaatccacatacaagggaccatctttcaggcgtgccgctcccgtgtggcaacggggaacgcaacagcatt

SEQ ID NO: 684361 - DNA, 462 bp, Homo sapiens
  misc_feature (37)..(37): n is a, c, g, or t
  misc_feature (103)..(104): n is a, c, g, or t
  misc_feature (128)..(129): n is a, c, g, or t
  misc_feature (133)..(133): n is a, c, g, or t
  misc_feature (137)..(137): n is a, c, g, or t
  misc_feature (144)..(144): n is a, c, g, or t
  misc_feature (168)..(168): n is a, c, g, or t
  misc_feature (184)..(184): n is a, c, g, or t
  misc_feature (186)..(187): n is a, c, g, or t
  misc_feature (190)..(191): n is a, c, g, or t
  misc_feature (205)..(205): n is a, c, g, or t
  misc_feature (251)..(251): n is a, c, g, or t
  misc_feature (349)..(349): n is a, c, g, or t
  misc_feature (360)..(360): n is a, c, g, or t
  misc_feature (380)..(380): n is a, c, g, or t
  misc_feature (462)..(462): n is a, c, g, or t
caagtttatttccttatttaaatacaaagacataaancacaaacaggtataatcaagacattgtgtctcacatttacactcccatcggatcctcttccaattnncagaccactgaccaggctagcagnnagangaangaaagantttcttagggagcaccgtcgtgangcccgacgcggggttngnnggnnatcaaagacgaggncagcctctcatacctgtctccattcacatttacctgggaccagggngggcaggggacaccagggcatggctcctgaaccccggccccctggactgaagggacagtgtgtgagaatcagttctgtgaagggcgggagggagcagncacctatgccncctgccttcacagttaaggngaaaaccttagccctatccttgattcctgggggctgccgggccctgtgtgctcccctgcacacctgggtgcctttctgaagn

SEQ ID NO: 684362 - DNA, 269 bp, Homo sapiens
cccccccccccccccctattatttatatattttttttccggggaaatttttcggggtttcccaaagggtttgggtttggtggtaaaagccccccagaatgtttttgaagaaatggccttttttttttcctttccatttgaacttttttatggtttaaaaaaaacgttttgggagggccccttcccccgattgaagagggggttttgggttcccctaaacttgcaacccccgttttttggattttgtaataaaaaaaggttttttgccca

SEQ ID NO: 684363 - DNA, 173 bp, Homo sapiens
gcaaaatgtaatgaaatatcaggttgatttctttgattaaacagaccaaattacttgagtaataggaaattaggaggatctagggacagaaggaaagtgaaaatgtgaaatacaaataccaagatttagaccgggggaaaaaccacaattggtaataaggttgctattgtaaa

SEQ ID NO: 684364 - DNA, 885 bp, Homo sapiens
  misc_feature (639)..(639): n is a, c, g, or t
  misc_feature (643)..(643): n is a, c, g, or t
  misc_feature (663)..(663): n is a, c, g, or t
  misc_feature (700)..(700): n is a, c, g, or t
  misc_feature (703)..(703): n is a, c, g, or t
caattatacttttgcagctggatctatgactatcaggtctctcaaggattttatgtatcaagataatatgtattgacttttttaaatgataaaatgaattctagttagagtctttccttggtatctgcagtggattggttccagaacaccatcccccaatattaaaatccacagttactcaggtcccttatttatataaaatagcacagtatttgcatataacctgtgcacatcctcccatatactttaatctccagatgattagatatgattgcatagcacttacgttgtgctatgtagttgttatattgttttttcatttgtactattttttatgatatttattggttttttaaattttctatccaaagttgtttgaatctaaggatacagagcctgaggatatggaaagctgactaaatatagtaacactgaagagtattcaaatgataactcataccagtaccaaaaacttgaagacttccttttaacattaaaaatacagtaactttttacgtgatttgttgaattcaacatatttggaaccagaataatcagaaacttcattctctaacagatccctgttaattacagatttatttgtcatattaggtcttttctttctcccatattcctaanccgngtactagctccaactgttgngaggtttgactctgaagactgagtagagtactattgntgnttttctttccttagtcagagtaatcagttttaacatgaagttgctcattgctgctaagaagcattaggcttcactgctagcacacaatgacaaactacaaatctgagtcttctttcacagatgttattgaccataattaaagtcaacagtcgtcagagatatgcaagaaggaaactttttgg

SEQ ID NO: 684365 - DNA, 142 bp, Homo sapiens
agaaaaggtctatatgcatactcccgccctggtcaccacccaatgacgtataacgaaggggacagtataacaaagtacccggccatctcatctccagaccccacctatggtgccctaccatttccgacgccaacaacacacc

SEQ ID NO: 684366 - DNA, 939 bp, Homo sapiens
  misc_feature (693)..(693): n is a, c, g, or t
  misc_feature (697)..(697): n is a, c, g, or t
  misc_feature (717)..(717): n is a, c, g, or t
  misc_feature (754)..(754): n is a, c, g, or t
  misc_feature (757)..(757): n is a, c, g, or t
caattatacttttgcagctggatctatgactatcaggtctctcaaggattttatgtatcaagataatatgtattgacttttttaaatgataaaatgaattctagttagagtctttccttggtatctgcagtggattggttccagaacaccatcccccaatattaaaatccacagttactcaggtcccttatttatataaaatagcacagtatttgcatataacctgtgcacatcctcccatatactttaatctccagatgattagatatgattgcatagcacttacgttgtgctatgtagttgttatattgttttttcatttgtactattttttatgatatttattggttttttaaattttctatccaaagttgtttgaatctaaggatacagagcctgaggatatggaaagctgactaaatatagtaacactgaagagtattcaaatgataactcataccagtaccaaaaacttgaagacttccttttaacattaaaaatacagtaactttttacgtgatttgttgaattcaacatatttggaaccagaataatcagaaacttcattcaaaacctatgcatctgaacttttttagtaaggtaatactcaggactgttctgattctaacagatccctgttaattacagatttatttgtcatattaggtcttttctttctcccatattcctaanccgngtactagctccaactgttgngaggtttgactctgaagactgagtagagtactattgntgnttttctttccttagtcagagtaatcagttttaacatgaagttgctcattgctgctaagaagcattaggcttcactgctagcacacaatgacaaactacaaatctgagtcttctttcacagatgttattgaccataattaaagtcaacagtcgtcagagatatgcaagaaggaaactttttgg

SEQ ID NO: 684367 - DNA, 129 bp, Homo sapiens
cttaatagtctcgggagaatgatgatccctacggcacaaagaggggtaactggttcttattaaaaagatttcacaggcttgatacaagggctcatgtttataaccccagcatttgggagaggctgaggt

SEQ ID NO: 684368 - DNA, 516 bp, Homo sapiens
ttttgagatgtagtctcgctctgttgcccaggctggagtgcagtggtgtgatctcggctcactgcaagctccgcctcctgggttcacgtcaaaggccttcttttaaaaatagtattcattatagttttggttccgaactagcatgctgaaacttcagctctcatatctaatgtaatttttttgcattgtgaaattatcttcctaagattttgtataaatcgggtgctgctgtttatcttgttgaagccttttaattgataccttatgaattttcttgacctttaaaatttaaatctatcctgagtgtattcaaaaattgtggttaggtttcttttgaataattctgttcagattgtgaggctaaatatgctttattttttgaaagattataagtttttgaaaaatggcagaaactagacagtagttgcggggagggaggtatcacacttttacacttgtttgctgtctcctgttgcaggaggaccagtatgatcatttgatactctacatgacaaa

SEQ ID NO: 684369 - DNA, 270 bp, Homo sapiens
tgagtaatgaggattcaaggaggggaggaaaaaagtgtgcttgtcagtttggaaagtcacaggagttaccattctataaattagattaggaggaaaaatgagaacccactggtagaagaagaagcaacagtcttctagggtctggcatttgatgagataggtattcagttacatgtgcatttccattgttcatccatggcacaacatacggcagagattcgggaactcgcattcctgaagccaggttattcttatgttctgtaactatgt

SEQ ID NO: 684370 - DNA, 492 bp, Homo sapiens
ggcatagtgtcctccaggttcatctatgtggtcacaaatgacaggattttcttcctttttaaaggctgaatagtattccattgtgtatatatatcacaaatcttttatttattcacctatcaatggacactaggttgattccatatcttggcttttgtgactagtgctgcaataaacatgggagggcagaatctctttgacatactgatttcacttcctttggatatatacccagtagtgggattgctagatcatatggtacttctatttttaatttttttgaggaacctccatactgttttccataatggctgtactaatttccattcccacccacagtgtacaagggctcacctttctccacatcctttccaatgcttgttattttttgtatttttgacaacaactattctaacaagtgtgaggtaatatcgcattgctaactttttacaaatcgcatatttcttttttctcccctcctcataaggcctg

SEQ ID NO: 684371 - DNA, 787 bp, Homo sapiens
agcggggggttgttaaaacccagtgcgttagaagtcggatgcggtggctcacacctgtaatcccagcactttgggaggcccaggcaggcggatcacttgaggttaggagttcaagaccagcctggccaacatggtgaaaccccgtctctactaaaaatacaaaagttagccgggtatggtggtgcatgcctgtaatcccagcttcttgggaggccgaggcacaagaatcgcttgaaccaggagacgggaggtgtcaaggggaatgaagatcggtgccatggtattccaagcctgcgggtgaaagcaaggtgaggacttgtgattttcattaggagactcctagataatactgtggtttgaactgaatggtgggagggaggcaagtgacgtgttatgagcggtcgactttatgctgctagttggttccacaaagatcgttatctgggaggtgagcaaagtgagtgtagcggtagtcgaggtcacaaaggcaatcagcctccttcctctcccagtgcgatggccagcttctcagtgcttctccctgttgttaccaagtagtagaccctacccattctggatacttgcacctgttactaatataattcgaggtgtcattcctaaaatctctcttagatcctgtccttggataacagcggtcagtgcctactacgggggtctagacagacctcttgtggagcagttagaggcgtgccctgactccacaagggccctttcctgggcatgacaagtatgactagtgaatccgaactttgccttgactatccta

SEQ ID NO: 684372 - DNA, 402 bp, Homo sapiens
  misc_feature (50)..(50): n is a, c, g, or t
agttccctgtaaatatatgcataattcatttgtaggcagttaaacctccnacttttatggtaaagctttcaattgtatcagaaaataggcagggcgcagtggctctcatggctgtaatcctagcactttgggaggcggaggtgggtggatcaccttgagcccaggagttcgagaccagcctgggcaacatggtggaaccccgtctctactaaaaatacaaaaattagctgtgcgtggtggtgcgcacctgtggtcccagctacttggaaggctgagctgggaggactgcttgagcctgggaggtccaggctgcagtgagctgacattgtgccactgcactccagcctgggtgacagagcgaaaccgtgtctcaaaaaagaaaataaactgctttgaatgagg

SEQ ID NO: 684373 - DNA, 228 bp, Homo sapiens
cctccaacttcaacaaagctgaagccaagagaggcagaggcttggtagtagctcttgggcagcagacaaaaggatgagctaccagaacagacagattagacattagggacacagagctaataggagtggattgacctgcgggctgtttaaaagatgtcctgcgagtgaacagaagagcgccactctctgtctagctggttatctgttcagtcgcagggtcgagtcgat

SEQ ID NO: 684374 - DNA, 221 bp, Homo sapiens
taggtttttttggaatcccctttgaaaggtaatttccccccccttgccagggcaaaaagtttgtgatttttatcgccgaaaaagcttccaacattttgaaattgacttaaaaaaatgttggcggggaatgtctgtatctggcatttcaatgggctttgtgacccaaattgttttggattaagtctgatctttaaaaaaaaaatttctttgggttctctcta

SEQ ID NO: 684375 - DNA, 164 bp, Homo sapiens
tgaaggagacgacgtttggagttggtttccagctgcggagaccaccagccaagcagaagtgcccacggagacagaggcagcccagaccctccttgtgcctatggggagccgagggctaggtgagaagtaggcaagcgctgggatcctgagccaagccacattgg

SEQ ID NO: 684376 - DNA, 870 bp, Homo sapiens
tcatacgatactgcgcaaacatggtcccaggaggagaacatccgcgtgcccagtgtggcgccaggaagatcgagctaaggagagctggtgtctctgcagactctaaagtatatctgcgtgtgtctctggcgacttggtaaatttaacatgcacattgttagcaggacgagtgtgtactactatactgcagtggtccaccagaaatctggtgaccaggattccagcttaacctcgaaaacatctacagctgtatcttgttcccttgatggcacaaattaacctgtgggactatatagatggcatcttaataaagactttcatagttggatgtacacttcatgccctctttaactcttgcccaagctgaggattctgtcttgtgtcatagtgaataaagaaaaaccagatatatttcagctggtttcagtgaaactgcaaaatcctcaagccaggaagtagaacgccaaggagctgtcctttgtttggattacataaaccagtcacccaagtgcattgcttgtgaaacgagggagtatatgtgctgcagtacggggaattttcacttgtctgtcattttttcaaacaagacaacaaccatcaggtttactttatcatcatccagacatagaagcatgctaaaacacaattttacgtggtgtagccttgtcacccaatggagactgcttcggcttctgggtccacattgcatgggcaacattcgtcttgggaggaatttattacataagaaatttcgtccctgttgaacttggccctgaatggtataggtgggtttcaggacagcccagcgctgaggggcgcgcaccggcgtgactgggcagccaacaaaagagttccggaggacatagacat

SEQ ID NO: 684377 - DNA, 523 bp, Homo sapiens
aatgaaggagatgtacatgtttaaatgtgaccaattgaatttgaatatggtgggaaatacgctgcttgtaagaggcagcatgacctagtagtttaaccacatgaattctgagtaaaaattaatatagtcttattctacctctgccatttaccaaggctgtatccccatgcaagttgctgaatctctctgttctttgctgttctcatctctaactagctcataaaaatcttgtgagatattggcagtggctcatgcctgtaatcccagcactttgggaggccaaggcaggtggatcacgaggtcaggagatcgagaccatcctggctaacatggtgaaacctcgtctctagtaaatatacaaaaaattagcccggcgtggtggcgggagcctgtaatcccagctactcgggaggttgaggcaggagaatggcgtgaacccgggagatggagcttgcagtgagtggagatcgcgccactgcactccagcctgggtgacagagttaggctccgtctcaaaaaaaaa

SEQ ID NO: 684378 - DNA, 470 bp, Homo sapiens
gggtcagtgattagggtaatggtgacacggtgtgttggaagtagaaggtgcgataaaattatgagccttaagataggtaagctagcaatgaatgctagggtgggaagtgggtgagccagtggacattagataaataccttgcaagtgtgagcttagacgtcaaccctaagatagttaaccgtaatgctaatcgtgatcattagtgaatcccttcagtcacatgagggggaaggtagtgggctataagtacggtcattcgtagtccagtcagtctgaaaaacatcttgggttacccacgccgtccactcccataggctacagaaaaggtcacaagcgcgtggtttccaaccatatgtgttttctgcagttatttctcttgttcgggccaagacaagcctaaaaatcctataccattccacaagagtgggaccatcacttgtgcacccactttgactatgagtataccagcc

SEQ ID NO: 684379 - DNA, 288 bp, Homo sapiens
  misc_feature (42)..(42): n is a, c, g, or t
  misc_feature (52)..(52): n is a, c, g, or t
  misc_feature (63)..(63): n is a, c, g, or t
  misc_feature (65)..(65): n is a, c, g, or t
  misc_feature (106)..(106): n is a, c, g, or t
  misc_feature (126)..(126): n is a, c, g, or t
tatgttagacaacagttatgacacatatgccaacagcaccancacccctgtngcccccgaggntnagcagccacaccaagaccctcatagagcggagtgagagttntgaagacatgtctgtcccanctgtacctgacacagaagctggggagcctaggagagctggtggaagtgtgtctgaactcggagtgctctgggagcgggctccacagcctccttgtgggctccagcctttgtcagccgcagcctctcttgagggggactccctgtccccttgaggcccagctg

SEQ ID NO: 684380 - DNA, 882 bp, Homo sapiens
  misc_feature (569)..(569): n is a, c, g, or t
gcttttcgatccgccatctgcggtggagcctggcatcaaaatgcagattttcgtgaaaaacccttacggtggattgaccatcaccctcgaggttgaaccctcggatacgatagaagatgtatgggccaggatccaggataaggaacggaattccttctgtgatccatcagagactgttcttagttggcaatgtgctgtgagatgtgacgtactctgtcttgatctacaatgtttcataccatggtatgtctactcttcatccctcccgtgcagggacgcacttcagtgtgtagagttgcatgagggaacaagcgtagaagagcgaagtcttaccaactacctcccagttgacagatttaggcactatgagaaaggtaccggttccacgactaggtctgctccattgcaatattatctatctagtggtgtgatagcagaattgtgcatcaattacggtacagccattcgtcagacgagttgccctttctagacggaatagtagagtagcattgcgtgctgttcatgtgactacgatcagtttagactgatcagtctattgatgtcagagntgttgggtctgatggtataatttggatgtaagattaataggggcaaagatcgaacgggggcccatcgtgtgtatgcacagtttatcctttggataggaccaattgtatactccataaatagggaatacgaccaaacataagactttgccaacaatgaagatgggggaaataaggttcttacgctctcaaggatgacacgtgtgttcaaaactacgctccaccttagagtgagtcggttactagaggcgtacgcggcaatctggatgtacgttaggccttaagttggtggtgtcctcgcaaacgaaggtaaacc

SEQ ID NO: 684381 - DNA, 433 bp, Homo sapiens
taattcctgttccactccaactaacaaaactatagagatggaggacagattggtggttgccaggagacagggacaaggtacgaggatgtgactaaaaagaggtagcacaagtgaattcctctcagtgatgaaacagttctttggcaaggacagttggtgcaagtggttacaggatactacacatgagatcaccttgcatagaacacacacacacaaaggagtgcatgcaaacactgtgaaaactgcataaggtctgtagtctaacaatagtcagacaatgcccatgccctggttttgatggtgtcctgctgttctgtaagatagctgttctgttagggaaagccgggtaaagcatccaagggactctgtctactacttttgtgactctctgtgaatctacaatcatttcaaaataaaaactttaaagaaaaaa

SEQ ID NO: 684382 - DNA, 570 bp, Homo sapiens
  misc_feature (5)..(5): n is a, c, g, or t
  misc_feature (29)..(29): n is a, c, g, or t
  misc_feature (45)..(45): n is a, c, g, or t
  misc_feature (73)..(73): n is a, c, g, or t
  misc_feature (122)..(122): n is a, c, g, or t
aacanacgcccggacaatggccaacagcncgccaatactcaaaanaagcaagcacgcggctgtgcaggttccnaaaatcccttccagaagaaaatctcagtacgtctatagcaagtaagagnccgagttagtcccttagaaacctcccagtggccgggccgggtgtggtggctcacgcctataatcccaacacttcaggaggccgaggtgggcggatctgagtccaggagtttgagaccagcctgggcaacatagcaagaccacatctatataaaacattaaaaaggaccaggcacggtggctcacgcctgtaatcccaacactttgggaggccgaggcgggcagatgagttgaggtcaggagttcgagaccagcctggccaacacaatgaaaccccgtctctactacaaatacaaaaacttagctgggcatggtggcgggcgcctgtagtcccagctactcgagaggctgaggcaggagaatggcatgaacccaggaggcggagcttgcagtgagccgagattgcgccactgcactccatcctgggcaacggagcaagactccatctcc

SEQ ID NO: 684383 - DNA, 1641 bp, Homo sapiens
tttgttttatattccggtggcagcctataggcagatgcttgtagctgcctccagtttaagaaaaattccttggagaaaacctcagctctgcctcataactgatgctctcctctcccagaaagttgggaaagttccaccttgatttgaactcgctggccaaacaccagctatctctgtagacacagattttgacaggttcagacccagattggaaatgattttgattcaggttgcctttgagtctgtggagagtcagagtttatggcaatttcagcccgctctatcctctgtttgggattatgtgttcccagagagtaaactgtgtggccccagagtcaccctaggaggatctgagtgaccctgggttttgtgtttttactctgtggatgttgtggtcacgctggatcatgttgtgtggaggcttgggagcatgtgttggaggaacagttgagattttaattttatttttggtggcttttttggtacatccaaccctttcaggttaattaaatgccaggtagagctagcccacaagtggattttgttttgaaaatgtgcctgttttccaggagccctttgtggcagcctggtctggttgcccagatatcattttggcttcttggtgccttagtgcctgggatgaattggcctgcctgctgcagtctcttctcctcagccctgatatccgccaactgggtggctttgatgcctctgctgagggctctggtttcctgccagtctgggaggcgtgggatctcatgcgtgggaaaggtaatcaagcaataaaactaagcctgggtgtgagaggtggattaaagtgggcaaggaagaagcaggggagagggagggagccagctgtccagagtggccggaagaggcagaatgtgggctccatcctggctgggacctgtcagcccttgtgagaacttttagggcggtagtattatagtttggattttccccattcatcttctctccttcccctctcctaggttttagctgcccacagaatcctttgaggaggtgattcctggaaacctgtgttcactggatttagtagaaatccaccttgacttcctgttgaatatttgacatgtcctgacaagtgtttccctcccatccccgcaaccccgtcaccctgctttaacaaaaagcttcaaagttgagaccctttgctctgaggtagaagattttatatactcttatttttcagaaaagggcagaataatgcagtagttaggaacacagctctggggacagattgcctgggctcctattgcctctgctgctgattggctgtttgactctgatgagagatctctgtgtctcggtttcctcatctttaaaaagggctaatagctgagcatgctggctcatgcctataatcccagcactttgggaggctgaggtgggaggattgtttgagtccaggagtttgagaccagcctgggtaacatagtggaaccctgtctctacaaaagagtttttaaagattagctgggtggtgtggtatggcctgtggtcccagctactcagaagtctgaggtggaaggtttgcttgggcctagggggtcaaggctgcacaagccttggtgttgtgccactgtactccaatccgggcaacatagtgagaccttgtct

SEQ ID NO: 684384 - DNA, 179 bp, Homo sapiens
tatccccgcttctgcttccccaggtacaataaaactgtgttgtttcaaatgtgctctcagtttttatgtgtgaggtttttcaccatcacatgtgatgatacaatctggcttagccattgcgcccgttgttcctggttctggctacaagtggtccttgcgaatcaggatcttgttgaggt

SEQ ID NO: 684385 - DNA, 261 bp, Homo sapiens
tccgacaacatagaatgacatgttattcgttcaaaacaatgcctccactccaaataaatcacagtcaaaatatctgaagagctcaagatgacatcagtcccatatgtcttaagtcctggggttgtgtggatgacgagtagaagccagttatgatgcacaggtgatagatccaaaataattgccacatgtgttaacatttttccatttctaaagcatccttacagaaaagtcatatatggagtcacagccttctatggtagt

SEQ ID NO: 684386 - DNA, 888 bp, Homo sapiens
tgggttggtcagcaaaaatcttttaaaaaaaaaattaggacccgggttaagtttgggtaccccgcggggggcccgtcggcctgtgggaaggctcaaattccgggccttgtggagggaagttagggtgggggggggtcgggggggggttcccgggggccttggcagaaaggcgggatacacctctgcggccctggcaaggaaccggagagcagaacaggtgccacagccctaaggggagctccaggcccagcgggctcaaaaggtgaggagtctggcccctggcccgtgagaatgcgcgctgcggccccggtgggtcacgcgcagggcacatacctccagtgggggatacctccgtgaacccgcaatatcactccagttaggtgtccccaaaaccaagggccggtctgggtttccccggggccaaggagaaaggtcactctccgggactaacccgcgagaaagggcacaagaggcggcgcgggtggggggagactcataaacaactctctttcaaacacccgggggtggactgggggagtgggtctccggggcagaacccggtataattggaccacaacgacccaggaaatacccgggcctggggctcctggggcagaaccttagggccctggtaaggggggatgcacctccatatggaggggcctccggccctgggccgtggaagggcgcgggaacggaaatcctaaagaggaccaaggtgggacgggtggccagcccatcgggcgcaaacgcggtccccgaccaagggccacggcttcaaattgggggtgacgcgaaaaagaactggggacatgggcttattaaggaaaacaagctctgggcacacacgtctggaaatcggcggaaggggcgcaccaaccggtagac

SEQ ID NO: 684387 - DNA, 275 bp, Homo sapiens
cgaatgtcttaaataagtgattgagcctagagatggaggttttttgatggtgttgagtttgtggggaagcttgaaaagtatcgtggcactcctatagggtaaaataggtgtagaaggaaggaagaagagaggaaggagagggatacggaattgaaatggaggaaaggaaggaacttgaaaactgaagacgtcaatactgcttggcgcacgtagaactctgaagtgtcacagcaagagtggtaggtgccaggcagtaccgacagcaggaccgttga

SEQ ID NO: 684388 - DNA, 727 bp, Homo sapiens
  misc_feature (3)..(4): n is a, c, g, or t
  misc_feature (10)..(10): n is a, c, g, or t
  misc_feature (12)..(12): n is a, c, g, or t
  misc_feature (14)..(14): n is a, c, g, or t
ccnnccgggncncngccattaccagggcggggggccgccacgccccccccaacggcaccgggcggcacaccgggaacaacggaagcgggaaccgaacacacacgcaacaccccaggaccgaagaaaccagcaagaaccaccaacaagggaacaaagccatactggggggggcccacaacgcccaccccaaagagagcgagacacaaaacgggggcgaaagccaccaacaaaagcacacacccaaaacaggaagcgcccgaacagagcaaaaacaaagagcggcaacgaaaagaccccaaccgcccccaaaccccaaaaaccacgccacccaaaagacgaaacaacccagagcaccaaccgaaaaccagcgccaaaacaacgcacacaggccaaaacgccgaaaaaccaaaagccgcccaccgcggacagcaaacagggggccaaaaacagcagaacgaagctaaaagacaacccgaaagccgcccacaccaacaaaaggcccccaacacgcaagatgcggactaaaaaaacgaccccgagcaaaaacccgcgggcaaggccaaagggaccaccaaacaaaccaaaagaaaaaacccgcgaaaaaggccgggaccaaaaagcacaggagacaagccacaacaacaaccaacaccttgggaaaacaagagaaaacaaaacaagggccaataaaaaacccggggaaaacaacctaaaaacaaacaaccca

SEQ ID NO: 684389 - DNA, 116 bp, Homo sapiens
  misc_feature (110)..(110): n is a, c, g, or t
gagccccacttatgcgtgggtacaaagtgactcagcagtgccgggaagtgccactgaggaggcccgaacgttcgctgaaaacaatggaactgctcttcctggagacctcnagccct

SEQ ID NO: 684390 - DNA, 656 bp, Homo sapiens
  misc_feature (524)..(524): n is a, c, g, or t
  misc_feature (593)..(593): n is a, c, g, or t
tgtatatggatgttctggatgactatgctatgcatatgcctatagcagtgctctgatctggaataaacatcgcttctttgtgatccattctctgctatgttgggagacagaacaaattcaaagtgggatagagactcgtactctgcttgatataaacatcagctttttatatgctgtgagacactagaagagctcttaaataaaggcatacttagttaaataaattaatatgacatgcacatactgcatctggtcctggtaatggtctcaacagtgaactgacgattagcttattccacagtattaagcaaacataggcatcttactatggtatataaaacagccttttcctgcagaccagctgttggatcattatttacaaagatacccggcatagtcatatgacaattgtgtaaagtacacttcattcacgagtaaatggcttgatgacaaatcgtataatgaaaggtcatgtgctatggttcatgtcttgccagtccgagccatttggtgcatcatgcagngtagatacacctccagtcacaatgagctttgagatcatgtcttggagcacattgatgaaatctcacgtntctacataaggattacaatgaaattagcactggaccatggtaagcatcgaagacctgatcccc

SEQ ID NO: 684391 - DNA, 173 bp, Homo sapiens
tggggtttatggtttcggaacttaccgaatcccgttctgccgggaatttaccctacggccagaatggctgttgtgacactgcctgtggtggggttatggtttcggaacgcacctgaatcccgtttctgccgggaattttaaagtatgggaagtttagggcatactttgcaagt

SEQ ID NO: 684392 - DNA, 212 bp, Homo sapiens
tgggaggttcgtgattggaaaaaccttgcggagcagaagctactactgtgtaagtaggatacaccccagttgaaatctctgcaccggtcggttctattcagcgaacagcactataccaaaagaagatccgtaccatataataggccccattaaattacagtgtatctcaatgaacttgcaaaggaatatcgctaaaaacaaacaaaaaaact

SEQ ID NO: 684393 - DNA, 359 bp, Homo sapiens
gtaaaatccatgcttcattattcaaaatttcctgataccatttcctggacttccaaggtacaagggtaaccagctgtttcacttcagatgttgtgttttcaacttaatgtaatatgtcttccaaagcctgtagatccttgtcgactttggtttgataagtagccaggaaatctgcaatgccacaggtagttgcacaagagtttgttatgagacagggcctcactctgtcacagagtctggaatgcagtagtgagctcatggcttaatacagtctcaacctcgcaggctcgagcgatcctcctatcacagcctccagagtgctaagtctacaggcacagggtaccacgcctggataatct

SEQ ID NO: 684394 - DNA, 363 bp, Homo sapiens
acagacagaaaagtaaatacaaaagcttagccaactatcacggacgacatgaaccataaatgggtaaatagggaaaggaggatatgccatagacctacaaggggtaaagaccaaagcatgtaaaataaatgatggtccatctacttaatggaatattatacagacctattaaaatgatgtacccaaataatacaagcaagagacttatgatatactattataagagaaaaaagcagggtaatatacagcactgttacaactactaaaaaaaagagactatgcagagagaaggaaagagtggaagaaaactaaaatagttaaacagtgatatgtgtctgcgcaaacgtagtgggtaccagaact

SEQ ID NO: 684395 - DNA, 269 bp, Homo sapiens
cgacgcccttgtagcgctacgtgtcgataatagagatccggagtccgtacgttgcagagcgtgacatgtctctggcttaatcgacaatgcctcgtgccttagccgctgaacatgcaagacagacatatgctaagaggacaccttgattaacaagacgcaggctccgtactcatagctggcatgatgcagcaggaatattatgtcgagcatcccattggtcaatgaggcttcgtctgtatgacgactgattatcttttacgactgagtgg

SEQ ID NO: 684396 - DNA, 377 bp, Homo sapiens
  misc_feature (9)..(9): n is a, c, g, or t
  misc_feature (87)..(87): n is a, c, g, or t
  misc_feature (126)..(126): n is a, c, g, or t
  misc_feature (135)..(135): n is a, c, g, or t
  misc_feature (139)..(139): n is a, c, g, or t
  misc_feature (146)..(146): n is a, c, g, or t
  misc_feature (152)..(152): n is a, c, g, or t
  misc_feature (154)..(155): n is a, c, g, or t
  misc_feature (170)..(170): n is a, c, g, or t
  misc_feature (181)..(181): n is a, c, g, or t
  misc_feature (185)..(185): n is a, c, g, or t
  misc_feature (212)..(212): n is a, c, g, or t
  misc_feature (217)..(217): n is a, c, g, or t
  misc_feature (222)..(222): n is a, c, g, or t
  misc_feature (239)..(239): n is a, c, g, or t
  misc_feature (241)..(241): n is a, c, g, or t
  misc_feature (254)..(254): n is a, c, g, or t
  misc_feature (290)..(290): n is a, c, g, or t
  misc_feature (306)..(306): n is a, c, g, or t
  misc_feature (308)..(308): n is a, c, g, or t
  misc_feature (313)..(313): n is a, c, g, or t
  misc_feature (333)..(333): n is a, c, g, or t
ttacccgtngtggtggcctcgtcgctacgcgcgctccgtgttcgctcggcggcgggaaggtcgaccaccgcgccgttcgcacgcgcnaacgcgcacgtgctcgacgcgcccgacgcacgctcgcgncgaccgacngacngtcgcancgcccngnnctcggcgccgacgcncgctcgccgcngcanctgcacgcaacctgcccaccgcgccgncgcanaccgncgaccctcgcgaacgcncngcgcacgcccganctcgtgaccgcgacccccacgctgcacgtcgacgcntgccgctcgatgcgantntgcgncgccgcacgacgccaaacgncacgcaactgaacaaactgcgccgacgacactgcccaaacgatg

SEQ ID NO: 684397 - DNA, 523 bp, Homo sapiens
catgcatcatggtttcttggtgtcctaatattaagagcaagtatgtaacgtgtcattgggtatataaaaaagtgtgtcctgcttacaagatgcttttgatctaacaatataaattaaatctagattagagctaaattagatttgttatctatttctgcctagtttttgtttcctatcatttttgccttttgagtggtaatgctatgttatatggggcaattcagtattgatattcagtggtttgcactctttattgttaataaagtaaaacacaatggtttgcactctttattgttaataaagtaaaacacctgttacgtactccatgaagtctataacctagagtcatttgtatgcttactggtctagaaaccactgatttattcttggttcttttttctctctctgaagtcgttatctttcattagttacctatttttttggttggtgttttttccagcgctctgttgaattacatattatggtttggtaaaagtgagtttcttatggacagcacaacctg

SEQ ID NO: 684398 - DNA, 154 bp, Homo sapiens
accaggaacatatgggaaattatgaaaccttgctgtcagatctacaacatggaaattgctagcaagatcaacttcttgatgtataagaatcaggcagaaccgaggcaggaatgctgaggcctgcggattagacatccagtatgaaaacacccca

SEQ ID NO: 684399 - DNA, 610 bp, Homo sapiens
tataaaagttccagaagaaaacaggaaaaaaatctttgtggccttgagatatgtcaaggttccttagcacaacaacaacaaaattctttaaaaagaaaaaattgatatattggacttatcgaaactaaaaattttcattcttcaaaagataacattaagaaaatgaaaaggcaagccacagatgggaaaatatttgcaaaatgtatatcaaaggacttgtatctactcactaaagaagataatacacatggtgataagcaccataaaagatactcaacatcagtagccatcaggcaaaatttaaaaccacaaatacagtaactacttacattaccaattaagaatggggtaaaaaattaacaaaacgagttgaccaataccaagtatgggcaaggatgtacagaaaccaagctctcacagtgttgcatggtaaacatggttacaaccactttggaaaaaatagttgggggacttttttctctaagttaaaacatatattttacgcatattacccagctattcccactttggcaatcatttaacctaagagaccggaacactgtacatcttcagggaagactttgtaccaccaaaattttcataagccaac

SEQ ID NO: 684400 - DNA, 921 bp, Homo sapiens
cgaggtgtcacagagattaacgcgggtgaacacaacgttggggacacgcgcgacgagtcccaagatgtccaccggaacggcctcttggggacaacccaccgctccggggagtagcctccccggggccagtcccccccccggaaggggagcttcccccaatagcgcggcacacttaccgcggatccttaaagctatcgcgccaaaatgtcaaagaaaagtgtggcaaaaacccggcgtcccaccagtggcgcgcgaacattgaatctttgctgacccccttgggaacagagcgaccagcaaggggtgactacccccaggcggttagtgggacggtgtcacaaaccacctctatgggggctccttccaagtccggcccccccgcgtggtataccccattgacaagggcggaatgccccttatgagtgaaaacgaaccggggggcacttctatcacccgcgtctaaacgtctacagtgaaaccgtgttagggggagaattaaagaaaattttcagcgccgagtcgcttctttataaacgcggagtgttaaccccgaaggcgggttgtaaaacacccctgttaaaactccacttgccgccggggatattgcgcctctttcaggcctgtgtaaacccctgtatctttaccgcccccccataatagctgacaagacttaatcggggaggatggttcagtgagtggaaaactcctcttgggaggaagaaaagataacatttgaaagagggaacatctgagcaacataagtactcggcgatggccgaccgtatatgagattagagaaagatagtagggaatttagtatgcaggtttcaaacgagaccctttatgagtaatacataacaagagttcatcttacccgcaaattgggcaccagaagcaaaaaccaccttgcggacaataaca

SEQ ID NO: 684401 - DNA, 239 bp, Homo sapiens
  misc_feature (183)..(183): n is a, c, g, or t
cttaaataagctatgtattaaatctgtctccagttagggctatcttcctagcatagggccccttaagtagcatggggggatatatttttttgctataaccgtaaaaatttttcctttaaccacttgccctcttcctttcttccttccaagggtcttttccccctcaagtttttgttgttgtcnttactctgggagatggccaagtgtatttttttctctctatgtaatttttagatcgc

SEQ ID NO: 684402 - DNA, 213 bp, Homo sapiens
aggactacttaccccgaaccggtaacgtatactaggaactacagagcaccctagaccagcggatcagtagacaccacctatacccggactgtacctaacagtacctacaggactactaactaccctacgagcagcgtagagtagaccgtagccctaccagcaactatagggcaccccagaacctaacacctagcaagcgtagaatacacaagg

SEQ ID NO: 684403 - DNA, 112 bp, Homo sapiens
tagaggattccgtcttagggaggatggggtcagatgtagcatggggaggacgggctgaaaagctgtcattggtgttggaagcttgccttgacagggaagtcgcagagaggct

SEQ ID NO: 684404 - DNA, 353 bp, Homo sapiens
gcgtcgacgtgggcagatcacgaggtcaggagatcgcgaccattctggccaactcggcttcccaaagtgctaggatcacaggcgtgagcaccgcgccgggccaactttggatttctaaaaatgtaaatagtttatacattttgtaaccactagtataacagaagtagagcttataccttgcaaaccaggggaagaaagaaagagattaaagaaagttactaattcactagacaacagggaggaaggaagcattaggaaaaaactgacgaaaagagcaaaataaaaaaataaagcaggaaccaactcacatcctccatggaaaatcgtggaatgtgtaaggtaacgtgccagct

SEQ ID NO: 684405 - DNA, 372 bp, Homo sapiens
  misc_feature (38)..(38): n is a, c, g, or t
  misc_feature (310)..(310): n is a, c, g, or t
gcaacttgaaaatgatctgaatgtaagacaagttttgnaatttattcaatacaccacatgaaagactaattacgcattttaaagtaaaatctcctaggtgtaatttgaattcatccttctcctgagcatgtctcttttcaagtacaggcggtcagcacagaactcagacacttgacttgacttcaaatgatgtcaccttcttggcccggtacctctgactgttttcctggcagcagctcaaacaaatgtcaggcagatctaaaatcagaaaagggggaaaatggttgtgtgggatcaactgcatcaaccnagatttattacaaagcaactctaggcagaatgcaggaaaaggctgaggatctgaaaaagtca

SEQ ID NO: 684406 - DNA, 225 bp, Homo sapiens
aactgcactgacctcatgtacaatttcagtctgttcatgttgttttaaaaatgattgctcagcagcatcatacttaaatatgaaggattggagtacagtggtatggtctcgaactcctgagctcaggcgatccacccaccttggcctcccaaagtgctgagattacaggtatgaaccaccatgcccagccaaaaattacttctttttaatgtcatctttttttta

SEQ ID NO: 684407 - DNA, 624 bp, Homo sapiens
  misc_feature (185)..(185): n is a, c, g, or t
  misc_feature (196)..(196): n is a, c, g, or t
  misc_feature (203)..(204): n is a, c, g, or t
  misc_feature (592)..(592): n is a, c, g, or t
gcgcttatagaggatccctctcggctcccagattaagcggattctcgctcagcctcctcagtagctgggattacaggcacctgccgccacgcccagctaaattttgtatttttagtagcagacggggtttcaccagtgttggccacggctggatcttagaactcctgacctcaatgtgatccacnctgcctcgtgnctcccannaagtgctgggattacatggagtgagccacctgtgcccatgccgaagcgttcacatttgaactggattaacttagatattatgtcaattctaccttcaataaacatattaaacatgcttacaaaagaagaatgaaaatatgacccatagccaggatttaaacattttctgaaaagaaagagacccagaaatgatacagatggtttagcagacaaagatatagaaacagttcttactaatatgctctaaatgttcaagacacgaggggaaaaccgaaagatgatgtggcaatacctagaacatatcacaatagagatgaagaatgccgtatctgaaataaaatatatattggctgggattaataggcgataagacacaccatcagtggcnttgaatagattacatagtgactatccaaatga

SEQ ID NO: 684408 - DNA, 132 bp, Homo sapiens
agtaaaacccagcccatgaccctaacaggggccctctcagccctcctaatgacctccggcctagccatgtgatttcacttcacgtccagtacgtgtcgtcagtacgtaggcagtacgtaaccaacacacgta

SEQ ID NO: 684409 - DNA, 800 bp, Homo sapiens
tgatgccatttggtgtaacgggcccaaactgctgcgaacagaggtggtgataccccctaagcttagtgttacgagttgggattagggggctattttctgctagggggtggaagcggatgagtaaaaaagatccctggctacaactatagtgcttgagtggagtatgggctgaaactgggggtgggcggccttctatggctagaggggatgtcaggggtgcgaagacctaatggggctgatttcgcctgctgctagctaggaggaggcctagtagttggggtaggaggcttggattagcgttataaaagggctattaggtggggggctctcatgagttgaggcagtgctacggataaatcatgcaaaggcgaggatgaaaccgatatcgccgatacggctagtataggattcgcttgaaatggctgctgcgatgggccatctgcatcgggccgatatcatacacactgatgacgcaagcaagtgatataaatccctaacgccctctacaagccgaatggaccagtttggacatagcgttcgtaagcgggcacctacaaataagtaaatggctcacactcagcgaagagtgaaatagaatacttgtgagagaaaacggaataaagtacagaggggcctcgagaggtaatatatctcccacaggtgaacacttcctatatgatggaccctgttacacgacacaaatgccaccggggagaaactatttgcgacaaacacccaatatatgagcctagggaaaaaccggttgctaggcacatcacactcgaaaccggttgcccgcg

SEQ ID NO: 684410 - DNA, 181 bp, Homo sapiens
gcttatggaagcactgggccaaccacacagcttaagcacaccaccccgaaacagccacagccaaaggtagtgcatgcactatgaggtattccccataccctctggtgtgttagagaggtttagccacatgagcggagcagagtgacaatctactgcgagggcgtgggatgtgggtagtgga

SEQ ID NO: 684411 - DNA, 233 bp, Homo sapiens
gagcgaggctgagcaggatgttaggcccgggcccctggcacgtcctccaccgtgcctcctttgggaagggaaccagccctccagagcaggagactggcaagagctctttgtctcaccagctcagcccggccactccttccaactcattacaagccacatctgtaccttcttgcaaactccaggactgagacagatttcttgggcgaggccaaggttagtttactcgttcgctg

SEQ ID NO: 684412 - DNA, 138 bp, Homo sapiens
gagatccccagcagtctcgtcggaagccgcagtcagcgctgacgcgtgtaagtctcccccacaggcgtggcgtggcactggcctgtttttgcagacgctgtcgtacgacagtagcaggtcacaggtgaacagctggaa

SEQ ID NO: 684413 - DNA, 296 bp, Homo sapiens
accacatatctagtcagtataatggtaatgagcgtatctgtagattctgctcatatacacacattaaaaaacagagttccagagaggttaggggaactggcttacacacgaaatgagtagcagcgacagaattgaatccagatttatcacttaatagatgacagagactatcccctttaccaaattggaccaccatatatccccacatccatgatatcacaaccatgtggttctagaacagctggctttaccccctgctccaggaatggagtacataacctcagactctgccaagg

SEQ ID NO: 684414 - DNA, 109 bp, Homo sapiens
gaggatcccccgcaaatggaatccccccaaatggaatctccccaaagtggaatccacctagcctgctggttcatgcgtctcggcgcgagcagagccggggattccactt

SEQ ID NO: 684415 - DNA, 547 bp, Homo sapiens
ggcacgaggtgtttctgtgctcggatatgcatatttatagcattgctgggagagacccccaggcctgtgcaccctgtcaagacttctcaagcagcgtgtgggtcccgcactctggccccattttcccgatgtcccctgcgggcgcgggcagacacccaagcctgctggctgtgggcccctcttgggcaggcattggctcaacccgctgagtggggggtcgtgggccagtccccgaggagctgggcccctgcgacaggcacacagggcccgcgcacacccagcgggcccccgcacaggcacaccgtggggtgctggccttatgcccggcgccgggcaccaacttcatgtttggtgtgtgtctgtgtttggttttcaagaaatgattcaaattgctgcttggatattgaaatttactgtgactgtgagtgtacacgtctggaccccgtgtcatatttacaccaatttggtaaaaatgctggtctcagactctcacacttaaaccgcatgtgagctccacaaaaaaaacagactcgagggggggggctgc

SEQ ID NO: 684416 - DNA, 887 bp, Homo sapiens
ccactgtgctcctactcctcatccccaccccgccaggctgccaggtccccctcaagcctccccagctcccacagcaagttcttccagcgtgcctttctccaccgactgcgaggacatcagcacatgcgtacactacgcccggcagcatgcctccgacacaggatcatgacgacaatgacctgacaccccaatggcacaggggagaccagttcagccagcaccatgcaggccgctgaagactccttcgccgatacagagaaccctcattagggctccccaaggacgcggacaggacgcactgatctactctgctcatctggctcatggacctacacggacttcctggccgccccacgcacggcgtgtccgagcctccttcgccgctcctctaccttacgccccgaaccacgcctgcacctccgctactgcgcggttgccctggctggcacttgcttgccccgcctgccctggccccttggtatctcttgtctgttgcttgccacccctttccgccctaccctcgctcacacgaccactgccccttggcttgcccctcgggcccgctctggtccctccggcgccctctgcatcggccccccacccggctaagccttcctgaccacctctctccctaccccactctctcgtcaccgcaagcgctagcctcgcccggtccccgctccttgctcccggcgctctgctccctccgtcttcagccccacacggtccactctcccttcgtgctcccatagcccctgctcccctcctccttcccaccccccttgcccctcgtgccccgtggctcctgtctgcccccgacccccctcttgcccgtccgcgccctcccactcctctccccgcgccctcgtctcgctccctctgccctc

SEQ ID NO: 684417 - DNA, 863 bp, Homo sapiens
ctgctccccgtttgggatccgggttcgctggtgccccccggtgtctttttccccccgctactttgcttagcctggagcctgccatcccttgatactagaggatcccattgatcctcggactttagccccttccgtggccctttaactaggatgctggacatccccgctttacaccagggtgtgagttattatgggtaacctaaggagtgtatagccacgactttgaaaagggtgttgaaattgtatgggaatgtaaggattgttggaaagagatttttttttttggacagcttcaaggagatgttacccatttcagatatagctacccgtttaggtatgactttggaagtgccagaaaccgaaggatactgttagagatcctaccatggtctcccgcaagtggtcacccctggtctcactgcctttccttcccccccgacctgagtgtgaaagactgagagttgaggagttactttgtggatcttgtcccaatttagtgaaatgtggaagtcaacccgacccatgatggaattaaatgtaaattcccagagggctttcacccgtccaccgggtgtccaatgacttgggttaccagaaggtattcttagcttacctgttatgtgaccgtgatttacctcgtccctttcccaccccaaagcctgtccagaaagccattctttagagaaaacccctttacctttgttgttaaactcctgatcgctacttttaagaatatacatgtatgtattcatagggaccttttttctccatatttgtatgattcgcttactgttattgtgctgagtgagctcctgtgtgcttcagaccaaaataaatgagactttgtgtttaccgttaaacca

SEQ ID NO: 684418 - DNA, 196 bp, Homo sapiens
gcatgggatggaggacccggatgtaatcctggtgggcgaattgcgcgatctggaaaccattcggctcgcgctgacggcggcggaaaccgggcatctggtgttcggcacgctgcacaccacgtcggcggctaaaaccgtggaccgggtggtggatgtgtttccggcgggggaaaaggccatggtccgctcgatgctc

SEQ ID NO: 684419 - DNA, 189 bp, Homo sapiens
aatggcataagtaacaagtcaaatgttaatcaccaagacaatggggaaaatgtctccagggcatgtctgagaccttcatggcagcccctcccatcacaggctctgaggcgtaggagggaaaaatgcttccctgggccaggcccaggtacacactgctctgtgcagcctcaggacatggtgctctgcatc

SEQ ID NO: 684420 - DNA, 202 bp, Homo sapiens
  misc_feature (49)..(49): n is a, c, g, or t
ccgagcttgtctgttgagaaggagcatcatgttactcataaaacacaanttcattccttggtatttttctctctgctgtgtgataggtaagggctgcagagaaaataagggtacactcacatatacacacctgaaactatctgcaaagtgttccaaacgtttcttgctattattccaaaatttagaattgtgacttaaatct

SEQ ID NO: 684421 - DNA, 128 bp, Homo sapiens
aggtgctggagcaggttggcagcaataggcaaccttttacactgctggtgggactgtacactagtatgctatatgttataataagccattttgtacattaataataaacagtgatgagacgtagaagg

SEQ ID NO: 684422 - DNA, 914 bp, Homo sapiens
  misc_feature (47)..(47): n is a, c, g, or t
  misc_feature (72)..(72): n is a, c, g, or t
  misc_feature (80)..(80): n is a, c, g, or t
  misc_feature (103)..(104): n is a, c, g, or t
  misc_feature (114)..(114): n is a, c, g, or t
  misc_feature (117)..(117): n is a, c, g, or t
  misc_feature (130)..(130): n is a, c, g, or t
  misc_feature (133)..(133): n is a, c, g, or t
  misc_feature (278)..(278): n is a, c, g, or t
  misc_feature (280)..(280): n is a, c, g, or t
  misc_feature (345)..(345): n is a, c, g, or t
  misc_feature (375)..(375): n is a, c, g, or t
  misc_feature (412)..(412): n is a, c, g, or t
  misc_feature (421)..(421): n is a, c, g, or t
  misc_feature (423)..(423): n is a, c, g, or t
  misc_feature (425)..(425): n is a, c, g, or t
  misc_feature (429)..(429): n is a, c, g, or t
  misc_feature (459)..(459): n is a, c, g, or t
  misc_feature (529)..(529): n is a, c, g, or t
  misc_feature (554)..(554): n is a, c, g, or t
  misc_feature (600)..(600): n is a, c, g, or t
  misc_feature (611)..(611): n is a, c, g, or t
  misc_feature (788)..(788): n is a, c, g, or t
  misc_feature (790)..(790): n is a, c, g, or t
  misc_feature (816)..(816): n is a, c, g, or t
  misc_feature (912)..(912): n is a, c, g, or t
gctgatgggctgtgattggtagggcgccttcggcatgtccgcccgcngcataagccgcgtcttccatctcgnctggcttnatttcactcggcggcgggagctnnaatagcaganggnaccacctcgtgantcnggccggagcccttgcagtggctcatatcggttgcatggaccgccatgttgtcacatcttcctcaagccagtgccagccagtgtatcgctgcatgcaaattcttctcgtgggctatatgcacgctaaccagagctcggcgtgtatngncttcgtcatgaagcaggcccttggaggggccacaaaggacatggggaagatgctggcgggagatnatgagaaggaccccgacgcgcagaaataangagtgagtgagcggcaggaggcgctgcggcagcaggnagtttggancntnattncaagcactgtctgtcgctttggatgcggangtggaggaaggtccgggcagcaagatcctgagataaagtatggggctgaaagaagaagggaggagaaggnaagcagagggagaaagcagccctgngagcagccctgcgagggggagcctgacccggcccaagaaggccatncctgcgggctncggggacgaggaggaggaggaagaggagagcatcctggacacggtgctcaaatacctgcccgggccgctgcaggacatgttcaagaagtaaccaggcctcctgccccagcctactccacctgttactacttcttttttggttctttcttttctttttattaggttaagtctcaattntnaaggggaaaacctcagttggcctctncccctcttccctggccaggggcttctccccctcagctctccctcacacctcccttcatcccagggtatcacctgcaccccactcccaagtagcttnaa

SEQ ID NO: 684423 - DNA, 431 bp, Homo sapiens
ccccttccccccctttatcccgttccgcaccccgccccaatcacttcaggcaaacgcgcaaaccaccctcgcatagcacaaagactaaaacctcttagccccttaagcaatgtttgtattcttgggaacatgtgggacaactgcgcaagtggtgcccttggagctcgctttaaaagtcagatcttttgaaaaatgtttattcatgccctttgcccactttttgatgggatccttttcttactgattcgtttgacgcccttgtagattctggatattactcctttgccagatgcatagcttgcaaacatacttgggtgacgggtgcactaaatctcagaattcaccactatagaattcatccgtgtaaccaaaaaccacttgtacctcaaaagctactggaataaaataaaataaacgacaaaaaaaaaaaa

SEQ ID NO: 684424 - DNA, 524 bp, Homo sapiens
  misc_feature (30)..(30): n is a, c, g, or t
  misc_feature (68)..(68): n is a, c, g, or t
  misc_feature (71)..(71): n is a, c, g, or t
  misc_feature (159)..(159): n is a, c, g, or t
  misc_feature (161)..(161): n is a, c, g, or t
  misc_feature (169)..(170): n is a, c, g, or t
  misc_feature (179)..(179): n is a, c, g, or t
acgaatcacactcaatgaaatatggccaanaacttctcaatctgagaaaagacacgaatatacatgtncancagttaaactccaagcaggataaacaaagagatccacatcaagacacattacagtcaaattgttgaaagccaaagacaaagggatatntntttttttnnttttaaaanacgggtctcaccatgatttggcccaggcgggtctaaaacggcgtggccctcaatgtgattctcccacctcggcctcccaaaggtgctgagactatggagtgtgagccactagacgggaaatcccactaagaaaaaaaccttaacatatagagaaggaaagaagaggggaatcaaaagggtacaccaccaaaaaaacaactaacttttaaacttttttttttttttggaaaggaagttgggccctggtaccccgggggggcgaaacaatggaggtccccggacttgggaaggctgctgacacaaaaaaacaaaatcatgactaaaaacaccggggatagagtgtaa

SEQ ID NO: 684425 - DNA, 114 bp, Homo sapiens
ctgagatggaagccgtcttcccagcccaccatccccaacttgggcatcgtttctggcccagctgtcctggctgtcctggctgtcctggctgtcctagctgtcctaggagctttg

SEQ ID NO: 684426 - DNA, 365 bp, Homo sapiens
tcttgctcaggtctcactacgtgtcgggaagtaccgatgacacactaaaacatcagtgatcaagcctgatggacattctggaagtgtgacaccgatgacatcagagttgtcagtgtggagcccttcgtgaccatgggccaagtgactgccctgctgatctccattgtgtggactctccccgtgttgcctgagcttgatgatctcacggtggcgggcttgatcatgggcacaggcatcgagtcatcatcccacaagtacttgcctgtaccactacatctggcactgcttacgagctggtcctggctgatggcagctttgtgcgatgcatctccgtcccaaaactcagacctgagcaagccaggggt

SEQ ID NO: 684427 - DNA, 102 bp, Homo sapiens
gagttgtcccagatgcagacgcttgtctctgacagctcagtggtcctctccatggacaaaaccggggcctggacctggatagcatcatcgctgaggtacaag

SEQ ID NO: 684428 - DNA, 902 bp, Homo sapiens
  misc_feature (6)..(6): n is a, c, g, or t
  misc_feature (77)..(77): n is a, c, g, or t
  misc_feature (89)..(89): n is a, c, g, or t
  misc_feature (93)..(94): n is a, c, g, or t
  misc_feature (101)..(102): n is a, c, g, or t
  misc_feature (107)..(107): n is a, c, g, or t
  misc_feature (112)..(112): n is a, c, g, or t
  misc_feature (121)..(121): n is a, c, g, or t
  misc_feature (416)..(416): n is a, c, g, or t
  misc_feature (448)..(448): n is a, c, g, or t
  misc_feature (459)..(459): n is a, c, g, or t
  misc_feature (475)..(475): n is a, c, g, or t
  misc_feature (482)..(482): n is a, c, g, or t
  misc_feature (514)..(514): n is a, c, g, or t
  misc_feature (541)..(541): n is a, c, g, or t
  misc_feature (546)..(546): n is a, c, g, or t
  misc_feature (548)..(548): n is a, c, g, or t
  misc_feature (550)..(550): n is a, c, g, or t
  misc_feature (559)..(559): n is a, c, g, or t
  misc_feature (568)..(568): n is a, c, g, or t
  misc_feature (570)..(570): n is a, c, g, or t
  misc_feature (593)..(594): n is a, c, g, or t
  misc_feature (599)..(599): n is a, c, g, or t
  misc_feature (602)..(602): n is a, c, g, or t
  misc_feature (617)..(617): n is a, c, g, or t
  misc_feature (627)..(628): n is a, c, g, or t
  misc_feature (642)..(642): n is a, c, g, or t
  misc_feature (648)..(648): n is a, c, g, or t
  misc_feature (659)..(659): n is a, c, g, or t
  misc_feature (661)..(661): n is a, c, g, or t
  misc_feature (663)..(663): n is a, c, g, or t
  misc_feature (676)..(677): n is a, c, g, or t
  misc_feature (691)..(691): n is a, c, g, or t
  misc_feature (707)..(708): n is a, c, g, or t
  misc_feature (715)..(715): n is a, c, g, or t
  misc_feature (749)..(749): n is a, c, g, or t
  misc_feature (901)..(901): n is a, c, g, or t
tctganagccatccaccctccaatcttacttcactttacaaccaagtatcaatagaggctgttccttcatgcgagcngtgggagtatantcannaattgannacaanacacntccaagaanatcaacagatgtacattatttacatattactatatttaccgcaaatagaaatattttctaagaaaaaaagtcaatttgtggtttctggtctaccacagacctaacttctcagcaaagcatatctatgtagatatctgccgtttgtaactttaaaaataggcattgctttctatgaagcactaagtgctgctccatctataaatagctcctattttgcagtttggtaccacattagaactgccccaaaatgttctgtgaccccaaagacacaaagttgctgcttatctgggtccanggtcagtacaattaaactcaaatatgaaccanggcggcagcangacaggctggaagggntgtggcngtcgccgccgcctccccgcggggctcccctcnactgccttcctggcttctgttttcggnaaaantntntttggccgngttggggtnantatttctagaccctgcgctcganngtctnggngggggggggggggcntgtgcatgtnncgcggcctgccccnggtggngggcaaaaaananangtgtcctgtttcnnggccgtcctggtancggctggccctgcgcnntcactgnaccaagagttttctgggaccaggcctgcctcaangatcagccaggcatgatggtcgcacagccttcatgctaatactgtcctaacacagcctggagctaggcgatttcctttgaccacaaagtacctggagtctaactcagcaccacagcctctgcatggctccaaggtgcccacacctggcgacnc

SEQ ID NO: 684429 - DNA, 140 bp, Homo sapiens
  misc_feature (43)..(43): n is a, c, g, or t
  misc_feature (69)..(69): n is a, c, g, or t
  misc_feature (117)..(117): n is a, c, g, or t
  misc_feature (135)..(135): n is a, c, g, or t
ggccatctggagactcctggctttctgaactttgcgcgttaancgggacagctgctttgctgcccgganagtagtccgcgccaagaagagagcaacgaggaaaggagagggactctngcgtcccggcagcgaagntccga

SEQ ID NO: 684430 - DNA, 759 bp, Homo sapiens
catcctctgtgccccctgtaccaccctcagaggccctgccccacctgcgtgcccctcagccgcctgccaggcgcagatcatctctaggctgttgggacgtcactgccaccgatcagccctccaccatccagagccagtcccggccgacacagggagccagcaacggatccaggacgtgtggacagcgactttgtatgctgacgacacgcctggagccgcagacttcctggcaagaacagcaaccgcacaccgcacagcggacgcagagagacaggcgtgcggggcacacgcgcatgcacacaggacacgagacaagccgcacatgtgcactgccgagacggacacgtggaggcggacaagacacgattggctgccaagggctaccgaggaacacgatagtgccacactcgtagagaacccgcggcacacggtgggaaggtcaccccgcatgccatgcaacggcacccaccggagaaccccaagtatcaaacgacaactcaacgtcatacttccggcagtatgaaggggaagaggaaaagcaggaaagcagactgggcacagagtatcggcgaaccagtagacgggtccaccccgttaagccacagaggtatccaccccagtacagagatggcgcatccagaacgaccgagtgagtgaaccaaccagtttgggtacccatcacaaataacacaacgcattaccgaaaggcacaaacgtgcaatgggtgcaaccacggcactcagcacagagaacgcggag

SEQ ID NO: 684431 - DNA, 853 bp, Homo sapiens
agtttaaaaaaaaaaaaaaaggctggggggggcaggcgcgggggttcatacctgtagtcccagcgcttggggaggctgaggtgggcggatcacgaggtcgggagttcgagaccagttgggccaacggttggtgaaaccccaatctggtactggggaatagaataattagccgggctatggtgggcgcacgcttgtatgtcccagttactggggaggctgaggcaggagaattacttgaacctggggaggtgggagggttgcaatggggtctggagattggtgccatgggactcaagcctgggcaacagagtgagactctgtctcaaaagaggaaaaaaaaaaggggtaaaattttggctgtaacttcagggggtcccttttaaacactttttagtgggggtacaggttaggtgggcttataaggtaggatttcatcagtggttgccggtaattcacaattattccttcttcaaggaattttctccaatcattttagtacgggaaattctattccatttaaacaaataggttaatatttctttctctccaagaggtcccgttgggacccacgttgtgctcttttggatttgtggctattcctaggtacccccatttttttggtggaccccctcaggagttttgtgggttctccatggaggggctgaattcctcttaggcatagttgtcttccacagttcacccatggtgggcgcttgtttcgacctttcatcgctcggggtgtccgacttcaatttaccagccgcgactggctggtggcttcattttttccatctgggggtcacgtggcgctgggaggggcttcgggagggccgtgaggtgtttgcggagcctg

SEQ ID NO: 684432 - DNA, 380 bp, Homo sapiens
  misc_feature (380)..(380): n is a, c, g, or t
atggcggccgcctggccgtctggtccgtctgctccggaggccgtgacggccagactcgttggtgtcctggggttcgtctcaatcactacaagacccttgggggctggtggcaacttcggccggggccaagaatcccttaaatgccaagaccttaaaatgggaccatttttttggtaaggatccgtttcctgttttccagcacccaacataacttgtgaggattccagtggcaatgaaacacattttactgtgaacgcaaatgggtttttcaagcccatatatctgcccaatgtgaatgggtatttctacacagagggagacgcatagtgtctctttctcggatgaggtggagagcagatctgttccaccttgcccccccn

SEQ ID NO: 684433 - DNA, 904 bp, Homo sapiens
  misc_feature (45)..(45): n is a, c, g, or t
  misc_feature (60)..(60): n is a, c, g, or t
  misc_feature (81)..(81): n is a, c, g, or t
  misc_feature (85)..(85): n is a, c, g, or t
  misc_feature (87)..(87): n is a, c, g, or t
  misc_feature (111)..(111): n is a, c, g, or t
  misc_feature (118)..(118): n is a, c, g, or t
  misc_feature (122)..(122): n is a, c, g, or t
  misc_feature (133)..(133): n is a, c, g, or t
  misc_feature (159)..(159): n is a, c, g, or t
  misc_feature (165)..(165): n is a, c, g, or t
  misc_feature (178)..(178): n is a, c, g, or t
  misc_feature (215)..(215): n is a, c, g, or t
  misc_feature (218)..(218): n is a, c, g, or t
  misc_feature (221)..(221): n is a, c, g, or t
  misc_feature (246)..(246): n is a, c, g, or t
  misc_feature (262)..(262): n is a, c, g, or t
  misc_feature (288)..(288): n is a, c, g, or t
  misc_feature (292)..(292): n is a, c, g, or t
  misc_feature (294)..(294): n is a, c, g, or t
  misc_feature (297)..(297): n is a, c, g, or t
  misc_feature (307)..(307): n is a, c, g, or t
  misc_feature (310)..(310): n is a, c, g, or t
  misc_feature (321)..(321): n is a, c, g, or t
  misc_feature (336)..(336): n is a, c, g, or t
  misc_feature (372)..(372): n is a, c, g, or t
  misc_feature (390)..(390): n is a, c, g, or t
  misc_feature (461)..(461): n is a, c, g, or t
  misc_feature (523)..(523): n is a, c, g, or t
  misc_feature (552)..(552): n is a, c, g, or t
  misc_feature (611)..(611): n is a, c, g, or t
  misc_feature (685)..(685): n is a, c, g, or t
  misc_feature (733)..(733): n is a, c, g, or t
  misc_feature (745)..(745): n is a, c, g, or t
  misc_feature (843)..(843): n is a, c, g, or t
  misc_feature (862)..(862): n is a, c, g, or t
tgtgcttgttttattggaagcaagactccagccagcggcagggcncaggggaggaggccnggagagtccagtcctgggtcncccncngggccagcagggggaaaaggggtntaaaaanagcnagaacccccanagaagcccccctgaagcaggggaaanaaaacnagaaaggaaaacngtcccagggcggggagcggaaaagggcccccacaccncanacncccccacccccaagcagtaaattcncaccccccgcctcccnctgtcaacggggggggggattccaanaacncnccncagcctccanacntcaggggcccnccgtgaatcccgggnggctttaacccttgggggtcccaaacaagtttccanaatcccactgtccaccantctcccccaaagaaggtcccagaaaaggtgaagtcccgtgtcttcacgcaacacgggcataagcagcaatnatcgcacgaagtttccctagggtggtcggggatcctctcctgccactcctggggcccctctnttgtcgccttaaggtccatgctacctgtnttgaggagctgtgtccaggttgtgggctccggaggaccgaggagtgaaaggctggaggnacatctgaaggtggaggcgctggcggaagaacctgccggactaggtggcccacagtccggagtttcaggccgtntgaacctcgtccgcaacccctggctcgggttgcgatcgcttcgcgganccttctccagcngcgggttcccctaggctcctcttggacgctggcgcggctggcggggacgagggaacaggatggggattcgggggctggtagccgggctgtcgcggatncagcgcgttctttggaaantaggatggcgaggccgggcacgttcttaagttcgctgagact

SEQ ID NO: 684434 - DNA, 100 bp, Homo sapiens
cttcctggttctgcctcaccaagacctctggcctcaccacagaccctgtcctgcttctgccggtgcttatcatctctgaaggatgagagaattcaagcta

SEQ ID NO: 684435 - DNA, 679 bp, Homo sapiens
tagcattaggagaaatacttaatgtagatgacgggttgatgggtgcaggcaaccaccattgcacgtgtatacctatgaaacaaacttgcacgttctgcacatgtatcccagaacttacagaaaaacaaaaagatggcttaagtcagttgttcctaaggtttcacaaaagaacttcacaggtctacctgaggggaatggtgctgaaatgaataggtttactcacagcaactctgcttaatataattatgccctaactaaatggttttttcacaaaaaagtgtttcgtcacaatcaacaacaccagaacaaacacatcaagtttaaaccccactagttcatatcatttcttagatcacttctcactctctacaactattcaagaacaaaatggaaaagatcataaacctaccaaaaagtttcaacaatcctctaactagtgtgacctagataccggccggtaatagagaaacttcaggaagtatggacaccttacacatgtctatgtcatctatccttaacacaactgatttgacaatcatggctcctacccttcaccccagcatcacgacacactatctcgaaaacagcaacaaaaccaacaccccacacaagcaacaccacttttcgcccgcccgacacgacacgtttacaccatcgtgtcggccccgttgcagtaact

SEQ ID NO: 684436 - DNA, 488 bp, Homo sapiens
  misc_feature (440)..(440): n is a, c, g, or t
  misc_feature (457)..(457): n is a, c, g, or t
tcacaccctaggatataaagataccccgtggtgctcccccatcaaggtgaagtatggggatgtgtactgcagggcccctcaaggaggatactacaaaacagccctgggaaccagttgcgacattcgctgccagaagggctacgagctgcatggctcttccctactgatctgccagtcaaacaaacgatggtctgacaaggtcatctgcaaacaaaagcgatgtcctacccttgccatgccagcaaatggagggtttaagtgtgtagatggtgcctactttaactcccggtgtgagtattattgttcaccaggatacacgttgaaaggggagcggaccgtcacatgtatggacaacaaggcctggagcggccggccagcctcctgtgtggatatggaacctcctagaatcaagtgcccaagttgttgaaggaacgcatttncagaacccaacaaactngacagtccgggtgtcctgggagacaccgaaa

SEQ ID NO: 684437 - DNA, 225 bp, Homo sapiens
aagaaaatcgagattatataggtgagttcgcttctttttcatctgattcatgatccgataatctgttctacgccttctacctccggaatataaaactgctgcatgtactgaattccatttatcagagtgatgatcgaactagggcagctggtacaagaacgctggagtttcaggggtacaatgccatcttcaaaggcttggtagattacatcccctccatcttgc

SEQ ID NO: 684438 - DNA, 568 bp, Homo sapiens
catttgctgttagatttagcttattttgaaatgttgacacttgccaatgtaatgaaaaggacacatcagaatttatcatcagggaagatatcttgtatgtggagcagctgcaatctgatctagacagactgtcctcttagaggccggttgcaagtccattctagtcattgtggcacttcgtagctgcagaaagaaatgatgcaaggactgtttagtggactgagatggctgagcaggttcttggcctgaattatccagaggagataggtggatctagcttcagaggaagtctacaccccattcccttctgcttacaatgtacccatgatatgtgtttagcacagtaatactgtaacaggacatcacatggaaaaatcaaagcagctggctcactgtatttaactgaaaagaatgcctacagattggctatttaatagggcaaattaaggcactttaataacaaacttcattatgtgaaacttgttgaatattaacatacaatataccttgtatattaatgccatagtttttagaaacactaatttaaacaacaaatagtcagccagca

SEQ ID NO: 684439 - DNA, 283 bp, Homo sapiens
cacgaggactctggccgttgtgctgggcgtttgtggcaacccgcccttccaattctcggttatatgactgtcaggaccgtggcacccgggacaagtcgggttaggtcaggctgaagacgatattgcagacgacgcacatctggctctgcttcacaccacacggcagtcacgatgtgtgttgatacttgagctaggggtgccgctgcacggagtctacgtccatacagtccaccagccagcgtaactgatcggtcttcaggccaatcaccgcctgctgacgggg

SEQ ID NO: 684440 - DNA, 285 bp, Homo sapiens
aaagggaagaattagtaatcttgaatacatattattgaatgactcactagttctccttcactgattaatccttttcctcatcccttcctacccctcccatcggccctaagaacaaagagcttgtaaatcaataaattgggcggacgcaaagagctctgggccatgagcaagcctccaacgctccggtcccctggacctgcctttaagactcttattctgtctctttctaactcctttgtctccgctgaactcggggtacccgctgggcaaagtggggctggcttc

SEQ ID NO: 684441 - DNA, 634 bp, Homo sapiens
  misc_feature (283)..(283): n is a, c, g, or t
  misc_feature (560)..(560): n is a, c, g, or t
tttgggctccatcaggggggtgcttcctcatatcccagacgaggggttggccaagcagagaatgctcctcacttcccagagggggttggcggccgggcagaggctgcaatctcggcgcttggggaggccaaggcaggcggctgggaggtggttgtagcgagccgagatcacgccactgcactccagccggggcaccattgagcactgagtgaacgagactccatctgcaatcccggcacctcgggaggccgaggcgggcggatcactcgcggttaggagctgnagaccagcccggccaacacagcgaaaccccgtctccaccaaaaaaaaacgaaaaccagtcaggcgtgggggcgcgcgcttgaaatcgcaggcactcgacaggctgaggcaggagaatcaggcagtgatggttgcagtgagcctgagatggcagcagtaccgtccagcttgggctcagcatcagagggagaccgttggagggagagggagagggagagggagagggagagcgtggtgatgactctaaaccgattttaaattattccaatcatttggtnaaatttacctgatagaattctgaattccttctctgttatcttgaatgtctccgagttttcttaaatcagctata

SEQ ID NO: 684442 - DNA, 303 bp, Homo sapiens
gattatataaaaaaatcctaagcatgaaaatacggtatacaatttatggtgaagggcaacttctggtgaccataaaagggtttatctccttcacctcatattaaagtccatactctggggatatatctgacatctcaatattaaatgactaagatgactaagtcgtttatgtggctcccacctcacacaaagttaaaactattggttactttaaatagttggacaaggttatttgaaaatcgggacaattcacaaatataaaatacttatttaattttcttcggtaaaaggatgtatgctcag

SEQ ID NO: 684443 - DNA, 707 bp, Homo sapiens
ggcccttttatttgctaaattggggggctttttagagggagaagcaaattcccatttggggggttggacctcccagaaacatgctaggggattcctatgtcctctccttgatgccaaaagaggggtgttttaaaaccgttttggcccctaaccaggtggatgttccctggccctttgagcctcggtttcctaattttttagggggacatgggaattcctatttcacaggattgtcacaagggtgaaatggggtaaatgtaacggcttattgtacggggtttgaaacaaagcaaacccccaacacatgtttgctggtgagggaaattcctcacccttaaaatgacgctttgttttttcactgaacctgtcaggacccgtccaggctgaaaccaggggagcgtgtcactcccacaggggcaggcaacattatggggtctttagggcctttagggggagggggggaggaacacaggagctgtgctcctggtgaaccatccaaataacagttcagaggaaaatgagggccctggctttttgttctttgggggtggaagccccaagtcaaaagactcctttttcatttggggtttggcaccattttttaaacaaatgggaaccttttgcaaaaacacaaggatgttttttaatgcacccaaggagtttttggaggggtttgaagagaaccgggcaccattttagcccccttt

SEQ ID NO: 684444 - DNA, 627 bp, Homo sapiens
ctcggctctaccttgttctagagcacattcccagaagcagatgggggctagatggtgatggagggcaggtattttcaagttaaaagtaaacattggtattcacatttcccaaaagaagaaatagaagtttataggaattacataatttgttcaagagcacagctaataagtgagagagccggagctcaaacccaggtcgacataacttcatagcctgtttcctggatcagtctcctatacagttttcaagctatgtcataatttgttcagtgtttgtcttttccctgagggcaggacatttgtctttcctttgtctagcctaccatgggcatctaataaatagtaaatgagtgatgagtaaagtcatgcatgagagggagagggaatgagaatgagagctagggtgagagggaggtgtggtatggaatctgaaaggcagcatcataactggtggcaagcgtttgtcagtagtagatgttcacagggagtcactagaactctcactgagtcccaggtgagaagccagatggatataatgaagtaataagctcaagagttggggggtggggatggtagcagaatggtttgaaagtttttctggcagcttccttgcccttaggtcgagag

SEQ ID NO: 684445 - DNA, 321 bp, Homo sapiens
tataggaggtatgaatacatcaggaattgagaactgagctttggatctggcatggagggtgatgagtggttcgtcagatggagagtgggggaatggctggctggtactaggcaggcgagagcctaggcagagacactgcgattctaagtgggagtaggaggtggagttgcctgaggaagggtgtgagggccaatgggagtgtgccaggagaccagctaccaggacagggtccaggacgacggacaccgttggtctccctgggactgtcttcagacacctcgacctctgacgcagccccgcgtttcactccaccgaactcat

SEQ ID NO: 684446 - DNA, 842 bp, Homo sapiens
ggagtgagcgcgcctgccgccagctccctgcgtcccgtcccgtgtccccgctgttccctgcgtcctgcgatccgccgccatggccagtgaggagctggctgtgcaagctggagctgccggctgcgtgcgcgaggacggccgatggagagtggcccccagctgtgctcccctcgtgctgccccagcccctgtgagcccaagcccagagccctgagcctccctgcccgtgctgcccactggcctagctgcctgacagcggagcttgagctgcccagactgagcctggctggcttggaccatcaactgaggggctgctgctgctgagcccggcgctagcagggtcttcgaacgccctacacggaggttccctggagttcagcctgccgcactcatcacaggaccctggagagcatgttcaaacctgtatgaccgctgggcgtggatgtgttcatcggaccctgatggagctgaagctgctgatggacgcaagctggggtgaccccccaagaaccgaccttggcgcctgactcagcattgctccaaggcaggtgggaatgagggactttcgagtgggcacggctcaagcatcccaggagagctccctgcctccaatcataccacacaaggcaagatgaacgggtcgtagaccgccacgcgcaggaccatcatgcgggcaggaatggcgacttgggcaaaaagcgtatcaggagaatctcgatgatggccctcgtcccgggctgtacaccagtcggtccagcacgcttcttctgaccgacccaggccaccacgcgccttgtaccaacgggaccgccacagcattgcagcaccgagttgtacacccga

SEQ ID NO: 684447 - DNA, 198 bp, Homo sapiens
  misc_feature (182)..(182): n is a, c, g, or t
tgtgggctcagtaatgtccccgctgatgacaatttcgagagtccatgttctatagaaaccttgaggtcggccagccgtgtcttggccaatgagatgtagttgtgaggagggggcgtacttggggaccaggggtgggtggagatgtgccctgtaggcacagggagactcaaaagcacgagttntgaaagcgtaaatggg

SEQ ID NO: 684448 - DNA, 229 bp, Homo sapiens
ccaaactttcttccccccacacttctggttttctgtgtggagggggagcagggatatctaagctgtggtgtgaaagggtaggagagatgctggaggtgggggtgctgtgttctagaccccccatattatcccagtgtccctttgccccttttttccctaccccattcccccaattttttggcccatcccgattttgaaaattttccattaattgtttattggttaccca

SEQ ID NO: 684449 - DNA, 100 bp, Homo sapiens
accactccacttactaccagacacccttagctaaccatttaccaaataagtatagccgatagagatagaaacctggcgcagttagatatagtaccgcagg

SEQ ID NO: 684450 - DNA, 200 bp, Homo sapiens
caacagctggcagatactggcataacgggccagaacattggcatcaccatgatagggcgagggctgagggggtgtgtccccaatctcagcacacaacgccatttggcgaagtcagctccgtccttcttgtactgcgcacagcgctcagaccgcccatccaacccttgggtggtagtctcgccatttgtccctgccatggt

SEQ ID NO: 684451 - DNA, 151 bp, Homo sapiens
ctcggccgtctctagcggagaacgtgcagttaatgagaaggacgcggccaactaacgctccacgtattaaatgaaacatgacggcatccgaaagattggttactggaatgaagatactagtttgtccctgcagccaccgatgcccgctagg

SEQ ID NO: 684452 - DNA, 147 bp, Homo sapiens
ggttcctttagaatgtcgttttctggttcttccaccagaggctgggacaaacctgacagcagtgtagggttccttttgaccccttgttgttacctaagcttggccaaagaggattggcaaggagggaaattgaagctttggaggcca

SEQ ID NO: 684453 - DNA, 408 bp, Homo sapiens
tcgcgcgcctctcgctacgcattacgtttaccacctcttgacttggaaaggattgccgtctgaaaactcccaattctgatattatcctgcgagttgcgttattcgtctccattttctagcgggaggagtgaaagcacgcagcatcaggaaatgcagttcctaagggctgctaagtctggcaagcaccgacacttgacgtgctgatcaaagagcagacggagaggggcgccaacacatagatcctgtccgcacatcgaaccaagaacacgatggcgtcatgtaaggcacataacgcaaggggcgtcggttcagaggatggagagagacacaggacggagccgcgcttgttagggatcatgcactttagagaagtcttgcatgatgagccatcggattctaaaacggaag

SEQ ID NO: 684454 - DNA, 117 bp, Homo sapiens
accctgcttacccataaaatcacgttggtgcttctacagtacgggtcaaacgagcaaatgtttccggggtataaatccggctcagcatgacaatttgatcaatagctttgctggtct

SEQ ID NO: 684455 - DNA, 645 bp, Homo sapiens
gttcactatgttgccccggctggtctccaactcctgggctcaagccatcctcctgcctcagcttcctgagtagctgggacccccggtgtgtgctaccgtgcctggccacttttttgcccctcttaatggagatattccggtttctttttttccatttaaaccaagaaaaaaaatgtatctactctaccttccctctgctctcctccctccctatcctaacttgcccatatgagcaccggctccccactggccaccatactcctgccaagcttttatgctgcttcgcttttctctaaacacgatctgatattgctgctcctgtggtttttctcacaaattaactttgccgtggtttttaaaaaggaatccaaatgcacttgttgcacttaagctttttccataaaggaaaattacggagaggaaaataggccacaccccgccaattatatgtggacacggtttctaaactctatatatacatatatatatatatatctatatatctatatacgtaatcatctagttctgtcatcttactgaaagggataacactttctaaagatcacccttttctgagaagtttcttgggaatctttatgtctaagtgattgtattagatcagccataatgactatgtaatctcca

SEQ ID NO: 684456 - DNA, 662 bp, Homo sapiens
  misc_feature (192)..(192): n is a, c, g, or t
ttttccgggggcgcgacacctaggatttattccccccctttcccacgggttggggtgtttgggccacccccaaaaggggggggggaagggtttttctccccggggttttttcaattcccccccccccctttgcccctatgtggggtttgtttggtggccccaaaacccggggttttttctatatttgtttanaccccccccccctccccccaaaaaggggggggggggtgggggggggggggttttttaaacaacacccctttttttacccccgcgaccgccgggggccccccccccctttttttttttccccataaaaaaccccgggggcccccccccccccttttttttttttggggcggggggggggattttttttcccccgagacacccttttccctcttggcccttttttgggcccccttaaaaccatttttttcaaaaaaacgggggggggcccggccggtttttccggggtttttttcccccccccccccccccccccccccgggttttaaagccccaaaaaaaaaggttttttttttttttttttttttttttaaggggggggttttttttttttttccccttttttgggttttttggaccccttttttccccccccaaccccggttttttttttttttttttttttttcccca

SEQ ID NO: 684457 - DNA, 101 bp, Homo sapiens
cttattaccagaaacctttagccaacccatttccccaataaagtttaggcgatagaaattgaccctcggcgaatagattagcaccgaaggaaagtgaaaat

SEQ ID NO: 684458 - DNA, 447 bp, Homo sapiens
aagcttggcacgaggacattttttaagtaccttaaataaaagaataaaggcatcattataaaactttaatttttttaaaccaaaccaaagggatttaaagttacatatttttaatgtgtattttaatagactgttagtggcactgtccttcatctgagatattaattcaaggccttttcagcttttctccctaaactttctgagtgggcacagaggatccagagtgtttatgtaagcagtaaaagaaagtcctggtatttccaccagaatcccctgcttaacagaaatatgtcccagcatccttatcctgaaactccctgacttagctgccacaaaaagaccctccatgttcctcaaagccaccacccccatcatgtaactcaggcctgagaaaattgtgtcctatcaaagagaagatgttgtgcaaaataaagtccttttgtgctc

SEQ ID NO: 684459 - DNA, 180 bp, Homo sapiens
ctcgtggtgcgcaaggcccataggtatggcccccccttccccctccccagtcatcagttaatttgcagtcaattgtcattgtccagcaaacagtgcattcagtcctcattttttttggtggtttcaacacaaaaaattttggggtgtgtgctttttttttttttttttttttggggggga

SEQ ID NO: 684460 - DNA, 475 bp, Homo sapiens
  misc_feature (124)..(124): n is a, c, g, or t
  misc_feature (139)..(139): n is a, c, g, or t
ctaatggaacattttgatgcatcacttagtactatttcaaggcattgctaggccctcgaggtatcagcagctctgtcctcagaatgggtccccacttccacagtgggtttttgtaagggaaganaattttggggggggnctcacacagcagctccaagcagcacattcagaggaagaagaaaaaatgtttcatttgtgtggttttaagcataaagaagttgtttcccagagctctttgccagctgtcatccctcaaaactcactggccacaattgcttcacatgcacctgcctgaaccagccaccagagggggttaggacccccccagattgactagatcctaaggattctctacctggggctggagttcgggtcaggtgcccgggaagccctgtgcggtgtgggaggatgaatatgtgccaatttggaaagatgagtatttgtgggaaaatgaataaagcaaagtgtaaatcca

SEQ ID NO: 684461 - DNA, 1086 bp, Homo sapiens
taacataaatcaagttttaatacaaaatgtaaacaaacagtacagaagaatggagttacttgcaattcgttggtgaaacaaagctttacatttagaacatctactttctccttaaatagatgacctctttattctcattaactcacaaactatagggttttaaattggggggtagaggtgctagttctctcttatattccttaatttttttaaaaaaagattttaattactgtggtattgggtgtttgtgagtattttctccagaaatagagtgtcgtgttattgccacattgttgttcccggtgcagtaacgtccagaaagaggacttttacagatgtggcttggtgagccaccagtgttagtgtgcttgagaaacgtgaaccgtgggctccctcgtggaagagcagccaggatttcttaaccggtgtgagttcactcttcgtgagtgtttggaaactctttacaatattataattctaatgggatctcattcggcctcctctcgtgtacttattggacagacttggatattcttaaccattagattttagacattacaaacaaaaaaaaaaaaaaaaaaaagaaaaacacacctacaacacacaaaaaaataaaacacaaaacaacaaaacaaacaaaaaaaaaagggggagggcacaaaaaaatccccccagggaggccaaaaaaagaggccacacgattttgataaaaagaggcacacataagaggaccacaaatataaacacagcaagggggcacgattaaaacaacgcagagctggagaacacaactacacggaggacatggaaaaaaaccaaatcatggggggagaaaaagggaacaacctaccagaataacccgcaggagaaaacacgagagaataatggggaacaccacagaaatttgcgggaagaaaaaatatgaccagatactataaaatacgacatgatacacacataacacgagcaacagacgaggcaacaaagggcagagcagagcacacgaaggagcacgaaaaacgcaacaacagacaaaagaaacaaacaacaacacacacaacaaacacacaaaataacaaccccaaa

SEQ ID NO: 684462 - DNA, 874 bp, Homo sapiens
tcttcttcggccttggtttttctttccctccggatggtgtgcgtctatgtgttggtcttttgggccgggcgggaagtcggaggggtgtcctggtcactctaatttcccaccgaaaacgtgggccgggggccgggtgttgcggcccccggggattccggggacgagggagaaggggcgagggaagaagaccttggctatcccagaataccaggacggtccaggtggctggctggcggggtcgcaggccagcgagacaagatcttgtgagcgggctccggggggtgagatgaggtgggtacgcggatgccggtgggggaagtaggtgaggccgcgggaagatggacgtcgatggggaaaatgcagagcggaggacggggtgtggccatcggggaggaatcccgatgtgcagggagacgctggcccgggggtgcggggcgacgcgggagaaggcgggcacagctcctgggggagacggctgtcgataggggtgactgtggccactcacggctcattcacaccggggaacaagatgcttcctaccgtgtcctacgcaagggcggtggaaacacaggaggcgagacgcgggcgacagttagtaatccggggacagggctgggggttagggtgtgcctccaatcggacaccagagtggggccggctgggcaccaacggaagaagcggcggcacggtcctctcgggacgggggggggccaagtggaagcaagggcagggaccccaagaaaccgggcgtcagtacaggtgctgaatgcagcactgatgtagacgagggcctccattcgcacgaccagaggtggcgcgcaacaaggagcaacagggacaccaagtaggaagcgcgtggaagaggctaaggcaa

SEQ ID NO: 684463 - DNA, 127 bp, Homo sapiens
ccagcgcggaatcaccagtgtattcaatgttgtcaagctaggcaataaaatgttctactgaatgtttcttctttgtctaattacggcatacactggtagcaactttgaaatgggaacagggagctta

SEQ ID NO: 684464 - DNA, 189 bp, Homo sapiens
gagatagacattacccgaaaccgagtatgtcaaccgcagcaaagggcgagtgatcgatggccgatttcactgaacaaaggtctgccctgtcgcctaggcttcgcgttcagtgcgggcatgcccagccgcttctagtcagacacatggtacgcaggctggaactaatgccgccacgtaccgcctacgtct

SEQ ID NO: 684465 - DNA, 981 bp, Homo sapiens
ctggctgaaaacctccgccggggccacatcccctcggggtattcacaaccgcggactaggccgcgtggaaaaccggaccttggctacccgagggtccggggctccccagggcgtccccggtggaaggtgcgcaaaacccggcccagcgcacctggaagcgcatttggctgaggtgacgcacctacaccatgttgcagtgacttcctgtttctctgagaaaggttaatagataaccgaggccaaaatggcgaaatgatgaaacaatggtaattctgggcaggtcaagttgtactcagggtttaaaaaaaatgtcattaatcaggattttccagtagccaaattgtcttgtgccggcagctgggtgactcacagatttggctccaatagtaattgtagagtgtgcgtaccatttccttctggatggtgtgactttttcattgcttggaagagaacacattagaatattttatcccctacatctggcagcatggggagcaggctgtaggcaatactctgtccaagcacatctgggcggggaggccgtggagggaccgaggtgacacagagccggccctgtcctcggttctgtctcgggtcacctgaggcatcttcaccgcggcagctcgggcgcgtgggatctgctctcagtgatgacctgggacgcatcctgcctctgtgcgccattcctgccccttcactgtcactccttggtgatcgcccgtgttcttgggtaagcagtggagaggcacagaatggcttcctttgttgatctaccgcgtcaaatctgtatattataatttcaggttaaagggtaagagttgtaagcaaaatgagtactacgtcaaataattcaaaggaacgaagtaattaaaagtaaagctttctcagcacgaagatgttttctcagataagcattctaagtcaacttttcatagtattcaatgtctatttgttattcttcgatagcaccttgcacttaga

SEQ ID NO: 684466 - DNA, 107 bp, Homo sapiens
gatgattcagaaatttttcccttggggaaaaaaatgaatatgaacctttcccttgtgttaagggtaaaaagggcccgacatggtcataaaattttaattttttccca

SEQ ID NO: 684467 - DNA, 600 bp, Homo sapiens
gcttggcacgagggcgtggtggcacatgcctgtagtcccagctgcttgggtgactgatacaggagatttgcttgaacctggaaggcggaggttgcagtgagctgagattgcaacattgtactccagcctgggcaacaagagggaaactccatctcaaaaaaaaaaaaaaagttgtaactgatgctgggcatggtggctcatacctttaatcccagcactttgaaaagccgaggcaggtagatcacttgagctcagaagttcgagactagcctgggcaacatgacaaaaccccatctctacaaaaaatacgaaaaattagctgggcgtggtggcatgcacctgtagtcctagctacctgggaggctgaggtgggaagattacttgaagctgcagtgagccatggttgtgccactgccctccagtctgggcaacaaagtgagaccctgtctcaaaaaaacaaaaaaaaattataactgatgtaaactggcagtttaggctgggtgtggtggctcaagcctgtaattctagcactttgggaggccaaggcatgtggatcacctgagttcaagaatttcagaccagcggtgccaacatggtgaa

SEQ ID NO: 684468 - DNA, 259 bp, Homo sapiens
ggatctcccgggagtatgtcaactggaaaaagaattagccaatcttgtgtggggttctgtgcagcagctctgatgaagaaggacctagcacttcctacttggtacatgaattagaagaagaccttgaaattcttgagtgaggctgcatatgcaggtgtgcaaaacccattctggaattcttggaaagggtcttgcctctttctcattcaccaacctatattagaagcccttgagggacacatttatcactccaaatcca

SEQ ID NO: 684469 - DNA, 734 bp, Homo sapiens
  misc_feature (76)..(76): n is a, c, g, or t
gagtgtggggagagcgggaactactcgacccacagagccgatcgcggagcggattctgcttttaggagtacccgcnaacaagcgggaccgagcaggaatccatatctgggaacaggatgctcccctgtcccgctggtagagatctggtgggggtcttcctgtctgccagtcccttactgggcatccccggggagaggtggctggtgttccctactggcggccctccctggtgcacggggtacccatgtcctgtcctggcacagtgcccgctgttgggtgccaagcgtggacaggaggatcctcgagccctttgtgctcctccctccgagaatgacgggatgaccgagacattcagatgtttatgcccaagagagaagcggatttcgttcagcatttctcccagatcgtagggtgctgactgaggatgagatggggccgccagagataggagatgctatgagcccggctcaaggaggtcctgcagtacaagtgccatgtgacaggcgagtatcaccgggctgtgacggtggtagtagcataccggggagctggggaagccaatggacagccaggatgctgatagtctccagcgggctgaactgtgcgctggtgtgtggaccttgctgcaagtttcatgctggtggggatgacatcatggttcatcccttaccggcggggacaaatctgggtggatcaaaaagcgggcgtggttgggtgccctccatgattttacc

SEQ ID NO: 684470 - DNA, 770 bp, Homo sapiens
tggatacggagtcccgctctgttaaccccaggctggattgcagtggcgcggtctccgctcactgcaagctctgcctcctgggctcacaccattctcctgcctcagcctcctcagtggctgggactgcaggtgcctgccaccacgcctgggttattttttacatattttaacgtggagacgggttttcactgtgttagccaggatggtctcgatctccaggatggtctcaatctccaggatggtctcgatctcctgacgtcgtgattccacccgcctcggcctcccaaaatgctgggattacaggtgtgagccactgtgcccggccaaaaagaacagaaattattttatcctgaagtaagctgtctaatattggggattatactgaccctatttgtccaatacacctgagttttcaaataatttagttcctataagtacttataattttttactcttactgaattcgattagctgacgggacaaacagttgaacgctgattaactggtcgtacctactacaacgttttcgggcgactcactgtggatgggttcctgtcccttcccatgcccaggccccaaagtgtctggctagtgctgcccctcctggagtggcacccctcttctggaggtcagtctatttttcagcgactttgagctgtcgtttaccgtgccctcctgtcttgcgtggtggggtggtaccttctccgcacgtgcaccgtggtttttgccattgcactctgatagttggcggtacggggtgagcccctatg

SEQ ID NO: 684471 - DNA, 882 bp, Homo sapiens
ggaagaataatgtgcattatgtcaggtcagctgaatttccgtaaattccatctgctctttgatttcaagatgtgaatgcttttcaattatgaaactcatgaaagtcagttgaaatttatttatcatgtccacttccatcccttcacctaagctctcacacaaacttagatctccttgcaaggtgccaactgcaagaaggaggtccaaagtgacaagacttctctggacactgttcattgacggttgactgctctagacgtaaacgaatcctacaataactggattcattttcttagccttccattctttcttatttcttgctcactcctttctctggtatcctgtattaattaggcagtgaataagacaaagaacaatacctctttgtgttcctacagattcagttactatcactaactgaatccccaagcatgcaatttagcatctctctacttaggtcaaagcatgttgcgaaattcgcaagactccaatcctacttaattttcatttattttaatcattatatagcgcagagtccttgtaagaggagtaatggtattctgtgaaaccacataagcaacaacagggtgctatatttccccaaagacaggaactcgccagtattgacaacttaagtggcaaatctacccaataaccgcagtagttaagacccatttgttttcaggaagtggagtgaatgagctgcttctcctcctggtatgcctcttctagtaggtctagtgataagatgtcatgtctcaaacaccctcttagtggtgcacattctggaagggactacaagagtttccagcaggtgccagcaaaaggttcttgcaatgtagtatccctaaatgagtaggttggagtggattagacattgtg

SEQ ID NO: 684472 - DNA, 313 bp, Homo sapiens
cattattctggcaggagcctttattcagcaatggtccctgacctgtaagaagctaagaagtgaagctagagattttcaagtgtgtgtgtgtgggggggggggggccttgtgtgtgtagtagtgtttggggaatatgagcaagggaatcccttctatctagtgaaatccgaggcagaggcccagtctatgaagcaggtaaacgtgcctactgcctcagtgaaagcagtcgggatccctagagatgctgtctgtgctcactctgtcaccccatcagtggggctcccagagagccttggagctcaaaggcacccag

SEQ ID NO: 684473 - DNA, 904 bp, Homo sapiens
  misc_feature (48)..(48): n is a, c, g, or t
  misc_feature (63)..(63): n is a, c, g, or t
  misc_feature (74)..(74): n is a, c, g, or t
  misc_feature (89)..(89): n is a, c, g, or t
  misc_feature (94)..(94): n is a, c, g, or t
  misc_feature (117)..(117): n is a, c, g, or t
  misc_feature (136)..(136): n is a, c, g, or t
  misc_feature (162)..(162): n is a, c, g, or t
  misc_feature (171)..(171): n is a, c, g, or t
  misc_feature (177)..(177): n is a, c, g, or t
  misc_feature (190)..(190): n is a, c, g, or t
  misc_feature (201)..(201): n is a, c, g, or t
  misc_feature (241)..(241): n is a, c, g, or t
  misc_feature (257)..(257): n is a, c, g, or t
  misc_feature (261)..(261): n is a, c, g, or t
  misc_feature (292)..(293): n is a, c, g, or t
  misc_feature (340)..(340): n is a, c, g, or t
  misc_feature (358)..(358): n is a, c, g, or t
  misc_feature (396)..(396): n is a, c, g, or t
  misc_feature (410)..(410): n is a, c, g, or t
  misc_feature (496)..(496): n is a, c, g, or t
  misc_feature (540)..(540): n is a, c, g, or t
  misc_feature (547)..(547): n is a, c, g, or t
  misc_feature (591)..(591): n is a, c, g, or t
  misc_feature (598)..(598): n is a, c, g, or t
  misc_feature (600)..(600): n is a, c, g, or t
  misc_feature (620)..(620): n is a, c, g, or t
  misc_feature (623)..(623): n is a, c, g, or t
  misc_feature (638)..(638): n is a, c, g, or t
  misc_feature (655)..(655): n is a, c, g, or t
  misc_feature (697)..(697): n is a, c, g, or t
  misc_feature (721)..(721): n is a, c, g, or t
  misc_feature (724)..(724): n is a, c, g, or t
  misc_feature (741)..(741): n is a, c, g, or t
  misc_feature (746)..(746): n is a, c, g, or t
  misc_feature (748)..(748): n is a, c, g, or t
  misc_feature (771)..(771): n is a, c, g, or t
  misc_feature (777)..(777): n is a, c, g, or t
  misc_feature (781)..(781): n is a, c, g, or t
  misc_feature (787)..(787): n is a, c, g, or t
  misc_feature (825)..(825): n is a, c, g, or t
  misc_feature (832)..(832): n is a, c, g, or t
  misc_feature (848)..(848): n is a, c, g, or t
cccacatgcacataaaaaccaacaggggcaaacaacaaaaatgcatancattatacaaatgangccactctgtnaagtttacaggattnccgtncatgcaaggggatcataggcatnatttatgaagccttaaganccagaagttttgttaccaccaaaccnctgaataanactgtnaagtaagtttttnggaaggcagtnccatgagttggctaaaatttctttaaagcaaataacttcntctaagcctagccgtncaanaaaatttggttgaactgaaaaaataagtatnncattactgtttgcagccctgtaaaggacaagcaagttgtgggcacanccaccaaaaacaataacntctccctcaccgccggcacaagccgtttgccaaaaccntggtttttcggtanaaggatgaataaattgtatccattcatttttactgaagcagtaagtccaggcatcacttagtggctgtttatcagtggtaaatccnccaaagagaaaaagaagaactgaagaaactggtgtgagtaagtnccaagancgaccaactgggcaaatgccttgtggaataaattcattccactnccatgtntncagattaagaaagttaagancantcattctagcatctngatatctgccttcaaanacgaagcctctttttccgacagttgcccaggcatgggcagcncgaggggaaggtgcttaaccagtngtnataggctggctccaggnaaatntntaagtttctaaaaaatgtacatnaccatnccancccctnggatgacttgaatcccaaaaagatgtttcatcgaattnaaaagtncccaatactttatctncaggcaaatatccataccctccaaaaaatataaacttgtgtttatataccagagac

SEQ ID NO: 684474 - DNA, 1224 bp, Homo sapiens
tagcgggtaggccgcggagcggaggtgcatgctcggcttaccccggcacccctaccccctcgggcgcagaacaaccagaccagccgagcgagtccgacccacgacgcaactactcccacaagcagagacagcagaagaacgagcagaccgctctcacagaccgcaccccacagcacaaaacaccaacacaatgccacaagcacacgacccaacaaaagagctccacacgtatcatcgtacagatatgacacagccctgacgcgcacgcagcacagacacgtgccaggcatattacccacccctgcggcaactgacgctcaaaacgagcctacctcaccacctagccacaacagactcgacaagacgcacaccatctacacacaccctacacttctcctccccacacgcgcgcacgcacgccgagcacgaagcctaccaccacacacaacatccaaaaacccagcacacccaagaaactgccacagccaccacacatacacaccccaccaaaccatacggcccccccacctcagcccccactaccccagccacccccaacgaacaaacccaccacataactcccccacccatcgcccacccaaaaaaccccacccaccaaacatagaacataacatacaaacacccaccctacaccccccacaccactctcacactcactattactacccctcaaacaaaaaccaaacacaaccaaccaaaacaaccacaacccaaacccctcaaaccaacttccaccataacacaactcacaaccacaaaaacacacaccatcaatacaacacacacaacacaaaaaccactaacaacactaccacaaacccccctccctcccacctcccaaccctcacccccaatacccacaatcaccaaacaaacaacaccaacaaccatcccctcaaacatacccaactacaccacaccacactcctactaatacatataaacaaataacaccacacaaacaccacaccattacaaacaataaatatactcaacacacaacaccacaaacaacatctaccaataacaaaacacactaccacacacttataaatccacaccctctacaaaactcatatccctacatccacgaacaacaaacataacacacacacctcccttcacaacaaacaataaaactacaacaaccaacaaaaccacacccacacaaccaactctacatttacacacacacataaccaa

SEQ ID NO: 684475 - DNA, 449 bp, Homo sapiens
atcggtccaggcagcgtgcctttcgtcattcagtctgcgcacctgttggtaaggacgatcggtccgtgcctgcttgttagttcgtcagctggctaaagaaagatgtatttcaagccaattaatttaggtagctccaggcattttccagtcagtccgttgtatgtcaacggccagtcaattgaatttaggtagctctatatataagctatctcgtcgcatgcatgcgtgcgtaagtatgcatcctttatatcgaccgcctgcttcttattctatccgtctgcgagaaagcggccgacgggaacggacatgctggatgaagaaatcgcccagcttgagtaacacgtgcatactgacgatatctcagccttcatcaagctatgtatccagagtgagtgtacgtgcgtgcgtgcgtgagtccgtccctcgattaaatactgagtccggctaac

SEQ ID NO: 684476 - DNA, 302 bp, Homo sapiens
ttaaaagcccccccccttttttttaaggaaaatggccccgtcctttcccaagtccccccagggggggggaaagcattgcttttgtgtaaattatgtaaagcaaaattttttttatcttcccccaaaaacttttttattttgtttttttttgaaaaaagagccttggggcccccccttcccccttttttttcccccaactttaaatgtataaagggttttggtttccctgggagtgggtgggggcaaccagggttttcctttcccctttttttagaccagtttaataaaagggccccccttta

SEQ ID NO: 684477 - DNA, 342 bp, Homo sapiens
ggtcgacctcagttccagagttaggcagcctgagcgcgaattagaaccccagctgcatgcagtggctcatgcctgtaatcccagcactttgggaggccgaggtgggcggatcacctgaggtcaggagtttgagactaccctggccaacatggtgaaacccagtctctactaaaaatacaaaaaaaaaaaaaaattagctgggcatggtggcgggcacctgtaatcctagctacttgggaggctgaggcaggagaattgcttgaactcgggaggtggaggtttcagagagcagagatcacgccattgcactctagcctggcaacaagagcgaaactctgtctc

SEQ ID NO: 684478 - DNA, 110 bp, Homo sapiens
gtgatctaagatccatgaagcgtagactgagctctatactgcaccactgtgtatgataagcagcacccaccaaaaatcgtgcctatcgttatcatgggtacggctcgatc

SEQ ID NO: 684479 - DNA, 944 bp, Homo sapiens
ccggtgtcctagaatacactccgggtccaaagctttacgggtccctgttggcacggtctccgcctccccgggtggagccccctgaccgtgtgtgaccattgacaaggggacttttgaaagcgcaggcacccatcggcgtgtctccaaaggtagccgaaacgtggtgtgctaaaatatggcgaacaccagtaaacacggttgtggcttggtgccagaaggctccttattggcaacaacaaggggcgcgcgctcgccaagtgtgttgcaccagacaacatagtggcgcgcctcttttcaagcggcatcttcttcatccattcgtctcccagggaaaccccgtgccttgtgtctagaccggattggtggatctcgttgccctatctaaatgttatggttgcgcgcccccaccccccgtggacgagctgttgggactccccggtcggctgtaaacaatcttcaacttctgaacaaagccttcttggttagaacaacacgaaatggtctggtctattacgaccgccacagaatgcctaatcttctcccgaagatgttccccgcggtgtaactccccgccccagagggagaggttcatatattggacgtcggtaccaccaagacggcgagtccgtgtatgcagtttataaataagggcgcaaggtagcttcggcatagtggcatgggcccgccgtcccccggagaatgaaggataatggtcggccttcggactcgagttctactcactagaaggggagcgtgctgtgattgggaaacaacattgcaagacatgggagtgagggcatcacggggtgcaaaaagggcagatctatggcaaaccaccgggagcatctctgtgtcaaaatgacagatccaggaggtcttgtccgtcgtacaagctgcctgctatcaacaaccccaaaaaaacaaatttcagacccaacaaaaac

SEQ ID NO: 684480 - DNA, 931 bp, Homo sapiens
gagacaaaggcacgggcggcgtggagggcggcgcggagggcgcgggcccgggagcagggagcgagcgggcgcccggagcgcgagtcaggccggggggccgacccgatcggctggacactcgcgggcgccgacctggcatgggcggcacaccagtgctcgtgccaaccttctctgggtgccccatagaggcgtgcccattcccagcttgaccatttgttccacacgccaaggaaggcagtgcaaacgtcttcagcacaacgggcgccggcacgttgtccccaaattggccccaagcaaggggcacaaaaaggcggcgaagggggatacaagaaagacgtgtggcctggaggggacacccgggggcgcgaaggtaccaaggtggtgaagcgccagagggtttttccgggcacacgtgtgagggacccaggtcaaacacaaacaaaggtgtgggcaagtgccccccctgtgagaaagaagggccaaaactgccggtccggaacgtcacacagcgtggaaggggcaagcaacgtgggagggccacaaacgggttcaaaagaggtgcccgagagcgggttgcggacaagaggagggtgggcataacgcgggaagcggctcaggagcagaggtttacagaaggcgggtatccccccccacccggcttgaccaaagcgcaggggggcgtgggaccaggggcccagtagtctggtggggaaacagtgggggaaacgtcctctgtgggtgccaaccacagggggaccaggagagaatctaaaggacccttgaaagaagtcagaactggggggtccccacgggagaggccccagttgacaggactcgccgacgcgtgtagagcagacactacaaagaagcgtgctgaggcccctggaaaccccggaagcgcgggagtgagacccccatgtcgcggcgtagg

SEQ ID NO: 684481 - DNA, 116 bp, Homo sapiens
cacgacaaggcagctctaacttgtctgcacccccagcaaggaggcgagttagttttctagagacttgaatggagtctcccccttcctgcatcaccaccttggttttgttttatttt

SEQ ID NO: 684482 - DNA, 355 bp, Homo sapiens
cattcattctttctttctttcctttctttctttctttctttctatctatctttctttctttctttctttctttctttctttctttctgtttcgtccttttgagacagagtttcactcttgtttccacggctagagtgcaatggcgcgatcttggctcaccgcaccttccgcctcccgggttcgagcgcttctcctgcctcagcctcccgattagcggggattacagggaggcacccccacgcctggcttggctgatgtttgtgtttttagtaggcacgccgtgtctctccatgttgctcaggctggtctccaactcccgacctcctgtgatgcgcccaccgtcgacgcggccgcg

SEQ ID NO: 684483 - DNA, 482 bp, Homo sapiens
tggtgcctggtggagacctggccaaggtacagagagctgtgtgcatgctgagcaacaccccagccattgctgaggcctgggctcgcctggaccacaagtttgacctgatgtatgccaaacgtgccttttttcactggtaccttggggaggggatggaggaaggtgagttttcagaggccccttaggacatggcctccctttggaaggattttgaggaggttgggttggattctttttaaggggagggtttggaaaaagggggggaattctaaagtttaaaacgccccaaagggggtgcctttaccggggagctttttcttttttaaaccatgaaaaagtgtgggccgaaccgttaaatttttttttgccggttttgccttcctttaccaattctggccctttgctttaaacctggatgctttttttcaggcccaagccggccaattctgtggtgggttttgaataaagtattccctgtctta

SEQ ID NO: 684484 - DNA, 99 bp, Homo sapiens
catgctccccgaccccaagaacacgcacaacggggggagcaggatgaccgcgcagaccgtagacgccgtggcgctaggagtcctaccccttcgcacgga

SEQ ID NO: 684485 - DNA, 955 bp, Homo sapiens
  misc_feature (723)..(723): n is a, c, g, or t
caacccccaccccaccctcagaggagggaatgccctcagtagcacacatgagatttgttgcaagaactctgtctgaggaaaatgaatccacagctctaccctaggttctagcgcagccttctactacccgaaagcggccccgtgaaggggaagcccagggtgcccgagaccactaagggcccacatgtgcgtgctgctgcgttgcctactccttggctcgcccctcacacaatgcacattgttatcctatgaatcgttgttttcctctcccccccccctctccttcgtgtcctcccaccctccccactcctcgactttcccccccccttgttttctcatcctccccccttatgcacccgcccctccccctttttatattctaccctcactccccccacccccaccctcctctcctcctcaccccgctccgctccttacttccagcgccacctaacccacccctccacaccacctccaaatccccaacaccgctctacaccgactttccgtctaccccacttcactcctcttcctctcctccctccatctctcctctcatcttcctctactctctctctagccccacgcccccacccacgacctactctgctagcgtcatcgcaagttatcacgttatcacttcaccccacccatctttccctttctaccaccaatctcctccctcatcccctaccctcccccacggctctctacccactaccncattataaaattatgtcaataaatataatgcaccctaacagtcttcctcctcctcctcccaatccttccccaccgaatgacgttttcacagccaacatcatgcgactcgacgcacctcctatagctcctgtccagtctcttccacttccttcccccctctcacttctccctcctcccaacttttcgctatgacatcgccggccccacctccccccactcttcccctcctcct

SEQ ID NO: 684486 - DNA, 724 bp, Homo sapiens
gttaggtcttaccagtacgctgatcttcctccggatcatactggagagacttatcagccgttcgtgatcacgccctcataatcatttccgctgtgatctgcgtagcgcgtagtcgctgtatgtccttatgcctatacatcgtcagctacacaaatgtaatctattactagcgatctcagacgcatcatcgaaatagaatccgtctgcgctatgctgcccgccatcatcctagtcctcatcgccctcccatccctacgcatcctttacataacagacgaggtcaacgatccctcccttacatcaaatcaattggcaccaatggtactgaacctacgagtacaccgactacggcggactaatcttcaactcctacatacttcccccattattcctagaaccaggcgactgcgactccttgacgttgacaatcgagtagatactcgcgattgaagcccccatacgtcatcatacattaccgtcacaagaccgtctggcatctcatgagctgtcccacattaggcttacccaacagatgcaattccggacgtctaaaacaaaccacttacacgtacacgaacgggggtatactacggtcatgctctgacctctgtggaggcaacacagttcctgcccttcgtctagaattaatcgctacaacttttgactagggggttttacctatgaccccgttagcctctctaacaaacaaaagaaaaaaaacacc

SEQ ID NO: 684487 - DNA, 284 bp, Homo sapiens
  misc_feature (154)..(154): n is a, c, g, or t
  misc_feature (165)..(166): n is a, c, g, or t
  misc_feature (170)..(170): n is a, c, g, or t
  misc_feature (175)..(175): n is a, c, g, or t
  misc_feature (189)..(190): n is a, c, g, or t
  misc_feature (195)..(195): n is a, c, g, or t
  misc_feature (197)..(197): n is a, c, g, or t
  misc_feature (200)..(200): n is a, c, g, or t
  misc_feature (225)..(225): n is a, c, g, or t
  misc_feature (228)..(228): n is a, c, g, or t
  misc_feature (233)..(234): n is a, c, g, or t
  misc_feature (256)..(256): n is a, c, g, or t
ccgactcggagcccccagctccgcgcgacagctagccgggctggctctcggtgtgtgcccttcggatggtcggctgaagagggccgccagctggacttctgtagacaagacagatactgtaaagacagcaaagaccaaacagattggcagattnctaatgtttgnnccangcganaaagtgatgattgnnctcancncgngcagtgtcagagtagaagatgtctntgnttgtnnagctgatctctcccatgctttnaagcaattagaactagataatgcagcca

SEQ ID NO: 684488 - DNA, 100 bp, Homo sapiens
taacctttccttatagcatgcctgttttgggttgacagtaagggtaataatgcttgtggtgatttagatattgggctgtaatgtcagtcaagttttaatc

SEQ ID NO: 684489 - DNA, 455 bp, Homo sapiens
cggggagacgcggacatttaaacttactcaggacggcgccggtatcttggccgctgagggtctttactattgacgcctgggaccacagtggatacagcctagtaacaccaacttgtgtaagagatagaacatgcacaaggcggtagatgatgacgtcggcatggagatgaacatgatgatcatcatgcagcagtacatggacgatggacactgacagcgaaagctgaggtagatccgagttactaggacatagcctataattcatcactgcgatagtgacatgacagatactagagcttaagtctataacgctagggtacgaaacggttgctaaagctatggcatgcaagcgtacgcttccagctgagcacctgacatttcatcgtcaatttgtcagctccattcactaggcagcgcctatacctggattgggttatacacaagcgcgcatgtcg

SEQ ID NO: 684490 - DNA, 884 bp, Homo sapiens
  misc_feature (523)..(523): n is a, c, g, or t
  misc_feature (602)..(602): n is a, c, g, or t
tcttcctttcccctttctgggttctcttctctcctctgaagggttgaagacccctctgccgagggaggtgggggatgggggggacagggtcccctggggtgctcgatggcctgaaggggcctgagttgtgggcagatgcagttctctggtgggcgctgggggaaaccctctcacgtggctgtggtccgtggtgagcagcccgaccaataaacctggtttttccaaaacacacaaaataagcaaccaaaacaaaaaccactttgcggcgggccaggacttcggccccatcgaggaaaacagcgttttcagacacacaacactgcctgttggggagcgggggcccccacgtaaaggagagacgcggcaccagtgggcgcccaacggcgagtcccccagaaagaaacaccccggtggcaccagacacacaagcggcctgtcgatccctcacaccccagataaaaaacggcgccgcgggggaaacaccgcgcagacgtcttccggcaaacacatccacaagtggganctccgaggagacaccacgcgggcaccatcccaacggggcgtcccaagaggggcagccggaaatcataaatattaggccnccgggacgggggggtaaagaacatacgcaaccagcagcacacgtcacaacgagcacgacagcgatcggcacagcccaacccgcgctagtacgcagacaacgcagcagaccacgaagaacgcacacctgcgcataccacaacagaccctacccgaccacaccaaaactacaacacgacagcagcgcaagccacgacacgacccgcacaaccaaagaccaccctgatagcgactatagctaccccacagcataacgacacgctacagccagcaagcgagcagcg

SEQ ID NO: 684491 - DNA, 257 bp, Homo sapiens
ctttttttttttggggggggggggtaaataaaggaatttttttcccccccccccctttttttttggggccccccccccccccttttttcccagggagggggggaggggttatgggttttcaaacaacggggggggcggggggttttttttcacagggttttcccttgggccccccttccccccctttcccccctttttttttttttctttcttttttttgggggcttgggccccttttgggggttttaagaaaccca

SEQ ID NO: 684492 - DNA, 397 bp, Homo sapiens
taaatggtgtgaaatagtataaaaatcatgggtgtcattattggcttggcctgagctcaaatcaaaatgtttgaaaaaaggaattattttggcaagtacgtacagtttatgcttgaaatattcaaatgttatgtttttgggaacttctacagctggatgcctccgggcttttatagcagtttatggggagcacttgaaagagcgtgtgtacatgtattttttttctaggcaaacatggaatgcaaacgtgtatttttttaatataaatatataacggtccttttcatcccaggtggccgctaagtgatattcatatgtgtggttatactcataataaggggcctggtaagtcttttcaccattcatgaataataataaatatgtacggctggcttgt

SEQ ID NO: 684493 - DNA, 580 bp, Homo sapiens
  misc_feature (85)..(85): n is a, c, g, or t
aggagacggtaccagggggaccccatgactatattatttcccttggacacccctagatacacagtaatttttcagtaaagtcagntttcttctctagaggggagactagttcagacattctagactgttctgtcagactcagtttcaaaagagaatgtgtgggagaacagtctttgtccgacttttatatataaaataatagtataaaaaagcttctggttgtcaagtgaagtacatgcatgaaacatttatcttgcagctaagacctagcttgttgaaatttgcctggagcaaaatttcatggctgagttacagcctcagaaaaaaaaatattctaggtttgaatttctgtaccaaccttcacatcctggccctatttaaaaggacattttaagtctactgtgaagttgcatttgagatgataaaatttttgttgaaggagaaaagaggggagacaggaatatttgtattggtttgctttagtagctttctatctgtgaaaactagaaatgatctctgcagagagtgtaatagaaatgtttgggtggcctcaaatctgcacagtgtcctgagggctcac

SEQ ID NO: 684494 - DNA, 146 bp, Homo sapiens
  misc_feature (81)..(81): n is a, c, g, or t
  misc_feature (107)..(107): n is a, c, g, or t
  misc_feature (111)..(111): n is a, c, g, or t
  misc_feature (129)..(129): n is a, c, g, or t
aactttctcctcatcctcctctgaagttacttcttcttccttcttctccagggtctctagtttctgtattgtttcctcctnatcttctgtggtcttaggggccctcntggnggagaattgtaatccgtnccttctgtcgtcttctc

SEQ ID NO: 684495 - DNA, 233 bp, Homo sapiens
acttcacttgcggtgacgccatcgcgcccgtgtctcctgtgcgtgtcttacgggtctctgtgactctgtcccttcttcgtgtccccaccggcctgtactcttgctacagacctgcggcattgggctaccatggtactaccaccttactttttccttcggcacgtggacactctgctttcgcacgagcgtgtctgcatgtttggtcctgttgcggtagtaagctctgagaccgg

SEQ ID NO: 684496 - DNA, 935 bp, Homo sapiens
  misc_feature (934)..(934): n is a, c, g, or t
ggtaggcaaccctgacgtcctcagaatggcgtgcacaggtttggtggctggagggagttgtggtggatgcgcgtgccgtatgttgatcaaggttatgaatgcccctgggtgtgcgggaagcggctgcagcgctggtgtaggaggaaactcgcttgatccgacctactaagaactaccgtgagctacctgacagccccggattattctgcctttgaaactgacataatgagacagatgattttgatacgactggcctgtcctaaacacaattgaattgctcagtataaaacgatatgagcttccagccccctcctctggtcaaaaaatgacattactgcatggcaagaatgtgtaaacaattctatggcccagttagagcaatcaagcagttagaatttgagaacctgggacactaatgtcacagcatggatgtaatgcctggaaagtatacaatgaaaatctagttcatatgattgaccacgcacagaaggaacttcagaagttaagaaagcatattcaagattaaacctggcagagaaagaacatgccaatcacagctggatctaattgagagaaatggcgtcaattgcgtatccctggtcagtaagaattatgagattgaacgggactattgtcagctagaaaatggaatctatccaattaagcagccacctggagaagccaacagaaaaactcggaagcttctgaaagccacttcgcagttcgagaaagtgggcttccacaaggcctcgaccttaatggctttggaggcacacgtttcccaacactggttgcgttaaacacacaggtgcgcgggatattgtattcacgaaaatgccgggggttccaagagtggcaaaggacaaaggtaataacggcgttcagcaagagaaagtgtaatctccactttcttcccctccaccatcctctcccng

SEQ ID NO: 684497 - DNA, 180 bp, Homo sapiens
gcctgcgccctggatttccttcttcgccttcctagctccatgggactcgccccaggactggggcttcatggaccatctgccccttactcttcaagccctgactgtggcgtcggtcgatgcctctgatcctcagtatgctctctggccatgttccacggcttctccttccggggagctggc

SEQ ID NO: 684498 - DNA, 764 bp, Homo sapiens
  misc_feature (259)..(259): n is a, c, g, or t
tccatggatatttaaattaatttgtaaaaagagagtttgttttaaaaggtgatttttggagttaaaggatgtggtttagtatttaagaagggacccacaccagtttcggtgccaccagagatgtggcttaaggggcgctgtttaaaggagatccgtaaaggagactgatgtgaccccatgaataggttttgagtaaatccaccccagtaatattttggtggtgttataacccctttgaagattttattatgtaccccgncacgctattttctctcgtgtgttctgtgggattttcacgccacgcttcacgggatagaggtttaaaattttaggaaaatttttgcccgtggacaaaaggctagttctcttttgttcacgccacccactaaaattcacggagatggagatttaatttctaattggctcttagtcacctctggaactgagttatattctgactttctgtcacctaagcaccctggtatttggccctctccactttctgagcaccccaagcggttaacaccgaattgtccacctagaactctgctgtgtgtcaccccctataatcaacgtctaaattcttccacgaccaaagccaatggcacctttatggatttaagtcattagattttccactgaccttaattaatccctcttgacttgattatatcctccagtatttatatcttaaataggaggtaggatttctgtgttaagactcttatttgtaccccataattaaagtaaaatgttttttatga

SEQ ID NO: 684499 - DNA, 295 bp, Homo sapiens
ctcgccaactcacggcgagctgctgtgtgaccccgtcatcattcccgtccgggtcttcatgctgcaccactggacctgcgatctcgcacgcatcgcctttttcagtttcccgagacctccggcacttggggactgagctagggtttgagcgtatgactatcgcgtatcctggtgacgtcaacatgcaaatctttatatttgacctgtgtggtgtggatcaaatgacagtgcaatgcactcagacggaagccgctcggcctgcgagacacagccggtctgggcccggcatggaaac

SEQ ID NO: 684500 - DNA, 137 bp, Homo sapiens
acagcactagggctaaaaaatcagggctctgcctagggggcagcaacaagtcaagatacaaccacaccctctacagagcctggaagtagccctgcaggccctgcgtctcgcaggacactgggctgagaccagatgag

SEQ ID NO: 684501 - DNA, 1131 bp, Homo sapiens
aacaaatccgaaactttcttttgttcgcactgacaggtctgtactttatttctattcctttctggagttcaggactatggagccgagtatttgatcttttactatagccgatgtttactgtgtattaactctacagttaacataggaacaatatacaagtacggatgtgagaatttcgcattttaatgtggtaagatttgcaacccttaatctgagataatcagatagacagtcttaatataaatgtactgtgaagaatgctattgatgttcatggtttctgattactttccaaatttggatgtttttcttgccagattggctttatcttaaagtgaaaggacactggtatccattgtagaagttacattgatgctttcatccagtaagagcaatagaatttccattggtgttcctttaagtcctttactcaattatactaattggaaagcgaagaggaagggcctatattaatatgctgaacagtgtaacaggtgatgactttattagcagacatctgcttaaaggagacctattttgttagcagttggcttaaacctacactttctaagaactaaccattgacccaatgtacaataccgtagcttaggttcctcgggtcactattatggttgacttccagattgtttcgcgtacccgtactccgcggacttgtcgacgattgattcgtccaggaactaaactggtctttttcaaagccaaaaacatttttccacgaatcttctaacattacaaaatctcttggtaaccggatacactgtgcaccttttacacaacacacttttctgggaaacccaatcttataacaaactctccagttaccaccccttaattgtgggtaacttcagacaacggaaatggccctggctctacgagacagccatttaaggggaaacgggggagcatattcatcctttcctcttggaatcgccccaacaaggtgtcttggccacgaagcaattttgtgggggcttattcgtccacaccctttcaccacttctcggccagcggagtaggtttatacgatagacggcgcgttctatcgtcaaccccctgtgggtcgcacccacaatcttcatcgacaacaccgccaaacactacacggaacact

SEQ ID NO: 684502 - DNA, 243 bp, Homo sapiens
  misc_feature (235)..(235): n is a, c, g, or t
agagaccgcgctgtcacatagtacttggtcttagcacacatttctagctttctttctggagcaggtttagtgttatcctccgtttttggtggaacctaattcttttgggacctaattactttctcaacctattggttcttctgtcgtgcctctggggtgaatcttttataaaaacaatatgtaatggtagcttatggttataactgaaccacttaaaacttggccagagtctganggctaaag

SEQ ID NO: 684503 - DNA, 363 bp, Homo sapiens
acggacaacgggttacgcactttgtgtggaacgtgacacggcaaggacgcagacgatgtctgagtgtgaggcgggcgctctgagatgcacgacgggcacgacgcatctctgtcaccagcctacggccttgtgctgcggaaacccacgtacgctcctggaggccctggtcagcttgcttggaatccagcaggcagctggggctgagtgaaaacatctgcacaactgggccactgtgaagcttttccttctccagtgtctaccttcctcctcaactcccagacatctgtataaacacaatccttagttctccccaatctgaatcgcattcctcttttgcctcctttttaatgtcagtaaggatca

SEQ ID NO: 684504 - DNA, 657 bp, Homo sapiens
cagaactgcctgatcccgagcagctgatgatcgggaagaggatggctgctcccaaggccgttccatggtgccactcacagaggaaaatgaggaagccatggaaaacgaacccctagcttgcgcaacagtattcaggtggatgaggagaaatacggagaaactatgctgaaatgaaagatcgaaagaagaggaaaggctccaaaaatgatattttacgtgcagacggtgaagatacaagaagaaaaggcacgacaacgctgcacgaagaaacagaccaccaagtcaccacttaccacgcctgcagccgtctaggaagacagccagacaggagcacaagcacgacgcaccacataacaagacaccggccaacaggaacggcaagacagcacgcagacacccacagaagatgccagtaaacgacggagacaacaagcaccctgacgcaacgacaactgcaagccataacgcacagagacaacagacaaaggacacggctgagctgcccaagatgcagccgcaaagcggagacgcaacgaccaagcacctcgaccacgctgcgaacaaaaaaaccagaaaccacaagcgccaagcagagaaaacagcgaccgaacaaaaacgcaagagcaaggaaaaacacacaacccgacaaaaatcaaa

SEQ ID NO: 684505 - DNA, 219 bp, Homo sapiens
tgttgtgattataggcaagagccattgcacccggccatagggactctggctggcacatttcagtgtgtggtcagatgctggggtagaggttcgaagctaagtggttagacttaataatagacttggggacgttaaggagggtcgtggtaatataacttaaggaataattgcatgatgataggtagtgagggagaaatgtggctggtttgaccagtggag

SEQ ID NO: 684506 - DNA, 147 bp, Homo sapiens
tcgtagtatctaagaccgtacaggaccatcattactgtctcacagcttatctgtgttgctacatccatgccagtttgtgctcatctctcatgcagtcagtgcaggaactataagtagtgtcagcttgtctctggagcgctcgagaat

SEQ ID NO: 684507 - DNA, 903 bp, Homo sapiens
  misc_feature (441)..(442): n is a, c, g, or t
  misc_feature (461)..(461): n is a, c, g, or t
  misc_feature (872)..(872): n is a, c, g, or t
tgacagtccttcactgtaaccattaacttaaaaaaaaaaaaagttaaatctgttatatattattctcctttctggatcccaactcactgtgttatagtgtttatgggggtagagaaatacataggtgtatgtatttcaacagtacggttatttgtttaaacgagaggcacacagatttggtggtttttagcatcatgggccattcattcagtcattcatgcaatcagaggcaggtctccttctgtcacccaggctggagtgcagtggcaagatcacagcacactgcagtcttgaactcctggactcaagtggaactccagcctcagcctcctgagtagctgggataagaggtgtgagctactacagctggctcattacaggctttaaagccaaaatctgagttcaagcctcagccccgttattagctacatgatctttagnnaattattatgtctcctctngtttcctcacctgtaaaatgagaatagtacctaccctcacagtatcaaatgaaaaagtatgctgaaatggctataaatgtaatatactatgcttttttattttgttgagatacaattaatatactataaaatttatcttttaataacctatcatgtaatggtttttggtgtattcacaaggttgtgcgaccatcactactatataattctaaaatatttcctcatccttgaaagagaccccatatccattcaacagtcacacctctcctctcctctccacattctcctcctcctaaatccccaggcaaccactaatctactttctgttgctatggatttacccattctggacatttcccacgaactctactttctgtgttctatggacttgcctaatgaagggatcctccnagagtacgaccgcagtcaacagacgcactgg

SEQ ID NO: 684508 - DNA, 345 bp, Homo sapiens
  misc_feature (232)..(232): n is a, c, g, or t
  misc_feature (269)..(270): n is a, c, g, or t
tttttttttgagacgaagtctctctctgtcgctcaggctggagtgcagtggcgtgatctttcactgccagtctgcctcccagggtcaagcgattctcctacctcagcctccagagtagctgggactacaggtggcatgccaccatacctggctactttttttgtatttttagtagagatggggttttccatgttggctggcctggctcaaactcctgacctcaagtgatttnccacttaggcctcccaaagtgctgggatcacagcatnnccaccatgctcagccaggaatatggatttttaagcaggctcttgaggtagtggtggtgggcactgagtggagacc

SEQ ID NO: 684509 - DNA, 344 bp, Homo sapiens
  misc_feature (15)..(15): n is a, c, g, or t
  misc_feature (17)..(17): n is a, c, g, or t
  misc_feature (43)..(43): n is a, c, g, or t
ctgagccaccccagntntcctggacatagactgtggttcaagngtatcctgtctgttccatgcccaggcagatttccaagcatctggaatggcaactcttctagattagaagtttaagccatctcccattcctgtgtagagaacatggagcccagatggtttcccagctgcatgcctaggcacaatcctgcattctcggtggctgccctctggattctcccttggcgctagtgtctgtgcctgccactgggggatctgtaggccaacctgctctgtttggccctgctctttgtggccgctgcccccccaggggtggagcagaggaagctcaggagcaactatat

SEQ ID NO: 684510 - DNA, 182 bp, Homo sapiens
cctgacccgatacgaggctcgagaggatgccgccgactgcgatagacgcgagcagcaggcctgcggtgaccgggccaccaccgatgacgatggcgccgaccgcggggaagagcaccatgggctggccgaaggtcatcgcgatgaggtcgacgacgaagctcatgcggatgttgggcgcgcgg

SEQ ID NO: 684511 - DNA, 691 bp, Homo sapiens
taatctgagttattggggaggctgaagtgggaggatggcttgagcccaggagttcagggttgcagtgagctatgatggcaccactgcacccaagcctgggcgacagagcgagactctgtatctttaaaaaaaaagatgttaaaaagaaaaagacgaaaatattaatagcaattttttatttttaaaaatgctcattttccaaaattttcttgtgaggaagccattttatttttatagggcatacaatatgtcttatattacaatatttataactatacaacacttattaaaatacaatttatgaacttgtcacccaccccagtgggcttttctcctgccccatagggctggttctgcactcaagacttttttactgtggtctgtgtctctcttagcaagactctacaaaccttcaagagcaggggcatgtctggccttcaattattacttctgattataaggagaatgagcaaatgatctaacctccctgtgcctcagtttcctcatctgtaaaggtggtggtaagtacctacctcagaggggtgggatgagcccttagggttatttcccaattttttcttattagaaaccaggtgttggtcagaagttaagtttggacgaattaaaaccattaaaaattcttagatgaaacatatggaggtaaatttttttgacctgtggtttaggcaaa

SEQ ID NO: 684512 - DNA, 173 bp, Homo sapiens
agctcggtacctgtttgagctgctgaggaaaacactagaaatccagtgcagcctgttctattacttgctcgccatacaccccctttgaatgttgaaatccttgttttttttctttttgttgagacagagtctccgtctgtcgctcaggttggagtgcagtggcgtgatcttgg

SEQ ID NO: 684513 - DNA, 366 bp, Homo sapiens
ctctaaagtgttaacttaggtaatctgtggtgtttgccagttgtcacgtggggtcgcaaagggagaaatactgcgaatattatattttattaaaataacagattttaataaagggtcgtgttcttgcgtaaaagctgcttccactgttggaaaaaaaaatgtgtttccctctattctgaaagaaggctgtttttaacactaaaattatccgaaatgctacataagtaaatcctttgtaaacgatgacataaaaactaattccaaaacggaagacgagttgacatctctgtaaccccttccccatcctgctccgcttcatgtcccctcctgagtagtcatgtgataataaactctcatgttattgtt

SEQ ID NO: 684514 - DNA, 371 bp, Homo sapiens
tacctgttacgatcttttaaggccagctgtcgtcctagcaactgcatggaggcacaatatcatggctttgccatgccctatttcatccaggtcatgcaggagtacttgacaaaggtggataaattagatagttcagaatcactgcgcaacgaagaagaaccagctacagagacacaacccattgtttatggtcagccccagttgatgctgacagcaggcaccagtgttgccgtccctccccaggcaactttaggttatggtaataaccgccacaccgtatggacagccacagactggcatagggtacagcatgtgacgctgcagcgcttgatcctgtagtcacctctctttcgtacttgaaaaattctgtc

SEQ ID NO: 684515 - DNA, 352 bp, Homo sapiens
ccacctcacttttctttttccccaacttcagtcatgcacagggttggtaaatgtgttgctaaaaccgcacatgcacgcaaccgacacacccttacatttctgcaaaatggtttagaaaccggttactccagtattgctgaaaaggaaagagagaggaactcagcttcatgaaatacagagaggaaccgttagaatccctatttaatatagatgaagctccacagccacagatgaaaaggacacattcagcttgctcttctcaaggtctcaagcacagcatttctgattcacgtgtccctgaggtcgcgcccacacaggatagcatctaagagctctggcacagctcgtgccg

SEQ ID NO: 684516 - DNA, 169 bp, Homo sapiens
aggcccttttttttccccccggaggacctaaactggtttttccctttttccaaaccgccagattttttttttggccagaaaatttccccttgaaaatttggctgggacctggggaaggggtaatgttttttctgggttttttccatggggaaaaaaattttttttttga

SEQ ID NO: 684517 - DNA, 169 bp, Homo sapiens
ccacaccgtggcctggcagcattgcactcattcaaatgtgcatcacatccaccataaattcttcaggcaccagtgcctggaccatcccatggatgcagccaatccacaccaacatcagagcagctgtctgttagtccatatacacatcaaccatcattttgtcattccc

SEQ ID NO: 684518 - DNA, 327 bp, Homo sapiens
aggtgatctaaggacgcggcgagtgcatggttaaacaccaatgaggcaggttcaagagtcaggtttctgtagaaaactgtttttttcctcttgtgacagaaaattcagcttctgtccgggcattgtgggtcacgcctgtaaccccgcatttgggaggccaggccgggtggatcacctgaggtcaggagtttgagacccggctgggccacatggttgaaaccccatctccactaaaaatacaaatattatagcagccatggtggcacacgcctgtaatcctagctactggggaggctgaggtgggagaatcacttgaccctggaaagg

SEQ ID NO: 684519 - DNA, 481 bp, Homo sapiens
cagttgttatgggttgaatgtctcccccaaaaaggtatattgaagacttaaccccaatacctgtgaatgtgaccttattttgaaataaggtctttgcagatgtaatcaagatacattgaggtcattagggtgggccttaatacaatatgactggtgccattataagaagaagaaaagagaaaaatacatacgagaatgccatgtgaagactgaagcagagattgaacagaagcatctacaagccaaggaccaccaaggactctcagcatcatcagaagccagaggcgaggtatgaaacagattctccctcaaattcctcaaaggaaccaaccttgccaacaacttgattcaaacgtctagcccccagaactgtgagacaaaacatttctattgtttttctaagtacccaatttgtggaactttgttatcgcagtcctgtgaaactaatgccatagtaagtaaacatacctgtgagttttaa

SEQ ID NO: 684520 - DNA, 125 bp, Homo sapiens
  misc_feature (88)..(88): n is a, c, g, or t
atcttatgcgttggctttatgcacttgcaaataatgcattttttaacaaatggaaggtttatggcaactctgcgttgagccagtctantggtgccatgtttccaataaaacttctcctttcatgt

SEQ ID NO: 684521 - DNA, 250 bp, Homo sapiens
  misc_feature (45)..(45): n is a, c, g, or t
aaattttccagggggggggggaaaaattatattgtttttttgatncccgggggcccccccttttttcaggaaaaaaggtcccaaaccccccggggggggggggaacccgggggaggacaaaattttaaaaaaacaagggggggatttttttttccctttttccaatttcccccaaggggggggtttttcaaaagattttccccatcccgggaaactttttttttttttggggccccccccggatttgcga

SEQ ID NO: 684522 - DNA, 913 bp, Homo sapiens
  misc_feature (450)..(450): n is a, c, g, or t
gatcccactattaattgaggggtactccttccgcgtttccggtgttcctcaggttttccggtcgtagcaggctcccgtattggtaatatcccgtagtggcaacccctaaggcggtttcaattccagggggaagccccccctctgatggacgccaattgcgccgcttaagggcccgaattgctagaggacctggtcatgtcatctatatggcctgagttttttccctcagtctactagaattgtcaggccctctggtccaacattagcgcgcgtctgcaagaccccccgtcccagctgggcccgggtcccaacggaccaaccctcataattttcgcgcccttcataatgctcctggcagtatatcccgcttggggaacccgctcttccccttgggggaaaattttttttcggcccccccctctgacgaatattcttagcgcgtctcttttnccagaggaatcaagctacacttgtgtctggcctgacaaatgctattggaacaaactccccttttcccaggagcgcttggacttgtccgccacctctctatctgcttgaggggcccaaagtggtgctcaaacgatacactagggccattattctctcaaaagagtactaagcagcacctctggtcgcacctgccgcctaaatggccaaaccctgaacagtggttgataatgtcattataaaaggaagcatcttcccatcgctcagggtacttaattgcgccgacagtgcttcataccacaacatttcccagataccccaccaatcatagaagccaatctccacgtatagttagaggtacgtgtatcacaagttcagtcctcggacctgccccgtggagaataccccccccctggcaaattttaacccgtacacccttaaacccttttgtttaccccacaaaaca

SEQ ID NO: 684523 - DNA, 140 bp, Homo sapiens
tttgtaaaaaaattccaaaattttaaaaaggggggatcccttttaaagtcgggccaccagtttgaaatcttgccggcaagaatgtttccccatcgggatttatccccccccccaataaatgttaatggttaaacccccca

SEQ ID NO: 684524 - DNA, 123 bp, Homo sapiens
tggcgttctagaggatcccagagagagacgaagaaaagggaaagaatatacttggtatctcatgaccaaatgatgcaagacatctctaataacgagtacttggagtacggcggccacgaggat

SEQ ID NO: 684525 - DNA, 152 bp, Homo sapiens
cccgcctcagccccccgggtagctgggaataacggcgtgcgccaccatgctcagctaatttttggtagagtggggtttctccacgttatcccggctggtctaaactataggtcgagtgatcctcccgcctggttccaatgtcctggattaca

SEQ ID NO: 684526 - DNA, 389 bp, Homo sapiens
atacatgtactaggggaacaaacccctcgttaccttgtggtgtaaccagactgacttctatactacccagtaaaccacatagcaggtagagagcgtaaaaaaactgcaaatcaggtcatattgacttccccgctatatagctcttccatgaatacagtaatgtctttacaatataatacagatacgtttccatggactgcaagaactacaccgccactgacccctcatactatttcccctacaaccatagtgcttcagcaacattggctgactctacttactcttaataactatacctccctatctactcctaccctaatacttccctctcctctaccaacctgtctccctgcctccctaccaacctcccgattgagtccacatttaag

SEQ ID NO: 684527 - DNA, 576 bp, Homo sapiens
  misc_feature (29)..(29): n is a, c, g, or t
  misc_feature (54)..(54): n is a, c, g, or t
  misc_feature (71)..(71): n is a, c, g, or t
  misc_feature (114)..(115): n is a, c, g, or t
  misc_feature (120)..(120): n is a, c, g, or t
  misc_feature (122)..(122): n is a, c, g, or t
  misc_feature (130)..(130): n is a, c, g, or t
  misc_feature (137)..(137): n is a, c, g, or t
  misc_feature (141)..(141): n is a, c, g, or t
  misc_feature (143)..(143): n is a, c, g, or t
tcgacacaattgattacagccaccaaaanaatagacgtaaaaataaaggcattnggctggtccaagatgtnattatcaatcagtcagcacctgtgattcttttacttatttttnngtggntntttttttnaaacaantttnancccaattttctggagtcattctctctctgcagcagaagaggaagggcctggtacctccctaccaatgactgggggtccttattttctaccccaagagcaggggatataagcggtgtccaaatggggtccggaatttctacagactcatcaacttgagggcaagggaattcattggaaaacccacctggttgtctccttgggggagacttgacatatcttaaagatattaacgatagctaaatctgcatatatctacattttgcaaagggtttccttaagaagtaagcgggtacatatgcatagggggaggagatcagaccttcactggtaaggtaccgcctcaaacatttatggtcagccagtctgtgaaggagacccattttattggatcctcaagacaagatcctaagcctcctgaagggatggtcaggac

SEQ ID NO: 684528 - DNA, 171 bp, Homo sapiens
gaaaatagtaaaatagctgggcacggtggcacatgcatgcagggccagctgctgtggagtctgtggtaggaggatagctcgagcctgggaggttgaggctgcagtgagctatgatcatgccactgcattccagcatgggtgatggagcgagatactggctcaaaaaaaaaa

SEQ ID NO: 684529 - DNA, 316 bp, Homo sapiens
aaccactgcagaaatgacatctgttctgtgccaaccttgcggctctgaattctcctaactccatttcgaaagctgctaacactttacatgaacaccatagtggtggtgcaagtcataattctccatcctccaagactcttgaaaccaaacggggaaaacaatgatcttgcagttatccgtaatgtcagataccacctataaaatatactggactgttatactcttgaatccctgtggacatctacatttgacgacaacatcactctgaagtgttatcagcaacaaaaattcagtagcttatctttaaaagaaaact

SEQ ID NO: 684530 - DNA, 429 bp, Homo sapiens
  misc_feature (174)..(174): n is a, c, g, or t
gggttttccgggctccaagggggtttcccggtttttccggggttccccccctcccccccaggggttggtgtggggtgttttgcccggatctcccggattttttaaagttggcccacttcccccaatttgcggagtggggggggggggggggggtgtttagggctacttcaatcnagctccctttgtttccctgggaaccgccccggcccccttttttctcctttttcctcccctgggggccccggggccggttccttttttgtgtttttggggggggggtggggttttttcccattttcccccggggcccccttggcccttttgggcttttttggtggccctttttttcccgttttcccccggggccgggtggggccggtccgggtttttccgggccttgggtgccccccggggtgcccccgggtccca

SEQ ID NO: 684531 - DNA, 290 bp, Homo sapiens
caggttggtaaagagcagttgagacaataatgaacaattattgtatgaacacattgttagaaacagctaatcacaaacaacctgcgggcacaatgacctcattccacacgtagcacccttcagcaggaccctataaaactttcctccagcccttgcctctttgcaggtagccccttctctgctgagctgaccactgcaacatattttcacaatttctctaataaatctgcccttctttacctacaactatcttggtaaatggctttaccacctgcaaaactgaccctagg

SEQ ID NO: 684532 - DNA, 110 bp, Homo sapiens
agcgggggtgcgggcgctgcctaccgcctcacgccaatgtgggggcggcagcggggagggcggtgcagaggaaagtaaagaatttcctccctcattgtcagggaccagcg

SEQ ID NO: 684533 - DNA, 429 bp, Homo sapiens
  misc_feature (281)..(281): n is a, c, g, or t
ctgggatgtgctgtgtgactgagggtaagtccctctacctctctgagcttcaaggtcctcacctgaacagaagataacaacactgctggcctcatggggctgcggcgaggaccaaagttgcctctgacatgggctttgcctttggagagagtgagaatccccctggggaggcaacaacaacaacaacaacaaactctatctgtctatctatctatctatctatctatctatctatctatctatctatctatctatctatctaatctatctatctcccaggncctgagctccacccagccagcccttgccagttgccagttgacttagcacttagcataagaatgtgtgtttcagagggagctagtctttgaagcaagtggcagggataggccctgagccctcagggagaaggagcaatgggtttttatc

SEQ ID NO: 684534 - DNA, 331 bp, Homo sapiens
  misc_feature (331)..(331): n is a, c, g, or t
gctgaccccccagaaggtgcggctggtggtgtatagagatgaagcacactaccgcttttaggagaacttgtagattttccctgtggatctgcagaagaaagctggccgcggcctgggcctgagcatcgttgggaaacgaaatggaagcggagcgtttatttctgacatcgtgaaaggcggagccgcatacctggctgggagattgactcagcgagatcagatcttatctgtgaatgcagaggacgtgagaaatgcctcacagtagacagctgccaccatcctcaagtgtgcacagagacttgtgcagctagagattgcaagactccggcgn

SEQ ID NO: 684535 - DNA, 369 bp, Homo sapiens
taagtaggaattgccttgaaggcccctgaaagttccaaggcctgccagtaatgcctgattgtgccctgtgaaatagcccactgcaccccccagccttgggccagccatccagaattaataagagacagaaagtagaatgaatggttgccccggggttgccaggaagggccagccgagagggaattactgtgtaatgtgtacaaggtttcagtttgggaagaagaaatgagtccctggagatggattacggtgatggttgcacagcagtatgaatgtacttaatactactgaattgtatactcgaaagggttaatatggtgaattttatgtgtattttatcacaataaaaacattgaaaaataaaaaaaa

SEQ ID NO: 684536 - DNA, 542 bp, Homo sapiens
  misc_feature (8)..(8): n is a, c, g, or t
  misc_feature (37)..(37): n is a, c, g, or t
  misc_feature (89)..(89): n is a, c, g, or t
  misc_feature (440)..(440): n is a, c, g, or t
ccctcccnaaaggccctggtgaatgtgcaagtaccanccatacccctaagtaaattttattaggaattcctgggcaaaaagccattacnacctcccctgttattccgctcccttcctgttttgggggtggaaggtgagggatggggttggtgggggaggtgggcccccaagggtggtgaaattttccccacaggccccaaggggatgcctccttggtccttgcagatccgtaaccccggagagcaaaccttcctctccctgtgggtacactcatattaaacagtcttgaggcagatgtcccaaacacccaaaatagctgccccatttatgtatttacaatagaaataactgaccccaaaatcagaatacttcgaaatcatgtcctgccagaatatttactccctacaagtggggaaagtcaaatagtgatctaaatctgntctgctaatacagaaaatgtaatagagggaattaattacattaatgccactggaaatattattgtataaagactttggagttttcagagggcattttcaaac

SEQ ID NO: 684537 - DNA, 1059 bp, Homo sapiens
  misc_feature (474)..(474): n is a, c, g, or t
  misc_feature (675)..(675): n is a, c, g, or t
  misc_feature (803)..(803): n is a, c, g, or t
ggcgcgaagggcgagcgtagggccgctggcactgcgggtgactttggcgtccattcgatatatcattcctttaacttatgttccatcgaggaatccggcctgctgtgagctttacgaagtaatccatgctcatgaacaagactgggcctgttacaaccgcacacatgactggctagctgtgcgaaaattgtactaatctgtgctctagcagaaggtatcttgcaccgatgactgttattaccgcttaccgatcactgagctcatctgggctagcaagagagctctctgatggcattgggccattaaggcatcaggcagaacatcgtatatagactgacgtgcgcggccttcagactgggggaagcatttacttgagaggtagtgactcttatcacggggcgataacaaccagtgatacgctattgctactgcgactgcacttaggtcctgatgctctaatccctgcatggcctnggctacacgcctcccatagggcatactgcaaacgtctggagtgtcgcgattagtagatatgagtaggaatgctcgttagaagaaacatgattcatggacgatttcactaccaaggacgagactgtcacgagctcctgaagactacatagtctcgtatccctgccagcacccaagggtccgcgacctcgcgttcccgtgtcnttctatgcgctgtgtcagatcgcgcggccttggtagcgcgcgagccaaatagacgaacgtcttgtgtctctcgcgaaatatcatctgtaccaagttaagggtggttgctatctcggaatggtctcaancactggaagggctcaccccgaacggtgggtttcatgtaggcgatataaagttctcggtgggggacccccgcgacgaaggtaattgaatacgtgccgtgcgctcgttgggtagaaatcttccgcccacgattggcaactcccggaggtagagagccagttgaaaaagcggtaaaccggaaaaggaaaacgaaaaatgtgggcccatgatggaatttctttggtagatggcggggacgccgtgggattgacagttggg

SEQ ID NO: 684538 - DNA, 470 bp, Homo sapiens
  misc_feature (17)..(17): n is a, c, g, or t
  misc_feature (67)..(67): n is a, c, g, or t
  misc_feature (77)..(77): n is a, c, g, or t
  misc_feature (82)..(82): n is a, c, g, or t
  misc_feature (117)..(117): n is a, c, g, or t
  misc_feature (119)..(120): n is a, c, g, or t
  misc_feature (137)..(137): n is a, c, g, or t
  misc_feature (144)..(144): n is a, c, g, or t
  misc_feature (146)..(146): n is a, c, g, or t
  misc_feature (161)..(161): n is a, c, g, or t
  misc_feature (197)..(197): n is a, c, g, or t
  misc_feature (208)..(208): n is a, c, g, or t
  misc_feature (220)..(220): n is a, c, g, or t
  misc_feature (232)..(232): n is a, c, g, or t
  misc_feature (274)..(274): n is a, c, g, or t
  misc_feature (286)..(286): n is a, c, g, or t
  misc_feature (304)..(304): n is a, c, g, or t
  misc_feature (307)..(307): n is a, c, g, or t
  misc_feature (311)..(311): n is a, c, g, or t
  misc_feature (321)..(321): n is a, c, g, or t
  misc_feature (334)..(334): n is a, c, g, or t
  misc_feature (372)..(372): n is a, c, g, or t
  misc_feature (400)..(400): n is a, c, g, or t
  misc_feature (424)..(424): n is a, c, g, or t
atgtgtggatttggganaggattggggcatttttttttgggagttgtggggtggtttttaggttggnaagggatttnttgtnacaacgcatttttatttttggtttgttttatttanannacaacattgatgcaatnaaagttntnggccactttgtgaantttgggggttgctcgatacacccgcttgctgtaaanttacccgttcncgtttttatttnttgagttcagcnaaaaaacaaaaaaaaacaaaaaaaaaaaaccccaacctatanaacggacctggnccttttatattgtttttnggncaanttcggttttntttaaaaagggtnttccgaacctttcgttttagttatgttttgccaatttnggggtgggaggtggagggggggggtttnttataatattgtttgttgataaanttatgttggagggtggacagcgaggacaggttggagccgccgatcc

SEQ ID NO: 684539 - DNA, 289 bp, Homo sapiens
  misc_feature (46)..(46): n is a, c, g, or t
  misc_feature (48)..(48): n is a, c, g, or t
  misc_feature (50)..(50): n is a, c, g, or t
  misc_feature (79)..(79): n is a, c, g, or t
  misc_feature (82)..(82): n is a, c, g, or t
  misc_feature (85)..(85): n is a, c, g, or t
  misc_feature (90)..(90): n is a, c, g, or t
  misc_feature (106)..(106): n is a, c, g, or t
  misc_feature (114)..(114): n is a, c, g, or t
  misc_feature (125)..(125): n is a, c, g, or t
  misc_feature (140)..(140): n is a, c, g, or t
  misc_feature (147)..(147): n is a, c, g, or t
  misc_feature (149)..(149): n is a, c, g, or t
  misc_feature (156)..(156): n is a, c, g, or t
  misc_feature (174)..(174): n is a, c, g, or t
  misc_feature (182)..(182): n is a, c, g, or t
  misc_feature (190)..(190): n is a, c, g, or t
  misc_feature (192)..(192): n is a, c, g, or t
  misc_feature (213)..(213): n is a, c, g, or t
  misc_feature (247)..(247): n is a, c, g, or t
  misc_feature (275)..(275): n is a, c, g, or t
attcattcaatcaaggccaacttttataattttttttttgtttccnangnccctgaaatgttatagcatgggaatattntangcnaccanagttaaactttttggnttgacccnggattttttcncattgatttactggntgatgananattttanaacccaacggttttcatncggggggnaattgtanangcatggacttgtgtgttttgngtaattattgaagggcaatgatgtataaaaaagnggattcccctgtttttaaaaataaaacnttgataaaaggtga

SEQ ID NO: 684540 - DNA, 214 bp, Homo sapiens
gttaagcttgatgatggttaaaatcggtttgatagcaccatgggacatttttctaccaaaaataaatgcatgaagagacatagccttttagttttgctaattgtgaaatgggaaatgctttccaggaagtaaatgcaaattctttttaagtgtgctttaaagaaaaattttttccccccaagagaattttaaataaagatttttttttgtttaa

SEQ ID NO: 684541 - DNA, 324 bp, Homo sapiens
tgtcttccactggacaacgaaaatccacccctgaatccaaaaattcagacatggactgtggtaggatttcacagtaaagttagtcttgggatagggagaggtgatgagcccagacaatgcagggtgttaggtttaactggtttgcccccatcaggttttcgcatctttttagtgggtttcagtgcagtccttcaagccacaaattagattggccttcggtgtgctccagattgttggttcatattaaaggactgtctaaagatttgcatcccaaggacatcatggtccataaaaatgatccaagaattcgcccaaaaaacttct

SEQ ID NO: 684542 - DNA, 1612 bp, Homo sapiens
  misc_feature (1309)..(1309): n is a, c, g, or t
ggcgggcttctaagcaattatgcggacgcccgattggcagtgcaccaactggactcggtagttcgaaggtccctcgccaactttccgagcgtgtttgtggaagatgctcgcaaggaaggtccagcagtaggacgctatgaccagtggctacagtttaggtctgcggtgatctaagacatcattgtaccgcaaggacatgagacaacttagccaccggatgagatctagggcactgcattaagtatagtgagtcctcccgaaagcatgtgtcttggccagttagtcaaccataggtgaatccctaggctttcctcctatagtgggacacattgtccaagtcgagaaaggcgatctcctttgaggcgagcgcccctagtttcgagatcttctctcgcgatcctgactcttcgctatgcgccaagcttaaccttgaggaagcccacaacgaatggagaccgtatgtggccgcaggaggaaatagacagcaaagcatgcagagttggaatggggacttgagggagagaggcaattgtaggggccctccctcttgtccatggaaacgcttttcgccctcggactttatcggtttggagggaatggtttccgcaccatgagtcattttcccacgtgagaattttgtcggctattggtccccaaaatcggcggggatgtggtggatatcttggcaagggggaaccaaacaaatttacgtttaagagaagccccctctgcaacaaggggaaccataaagtagcgttcctttccatcttgaagagttcttgccttcaccaatactgagaagtgagaggacccccccttaacttttggcttactgaaggggtttagagcgactaaattagtccggcgtgagtttttccgcccatttctttttccgacaccagcagagaattttgacaaggtgaggaaggggacactcaagtgggaaaacggttgcaaatcggcaacagcgggaaagggttcccatagggactttgcggttcccttttttggggcccctctcagaaaaaggttaccagcacacacttaaagggccgttagggtcttgaagagcaccccctccccgaggaggaagccccgaatggagaatttccttgtgataaccgtttgcgcccaaggaaaggcgcccttatgataggacgctgacctttttaaaagtcgccaaacttgtggatggaccctttgcgttggcggggttggagttcctttcgccccctttgtttttggactctttgaaccaagttttcgaatagggaacgagtctttttttgcccacttcccttagattgtnaaagcgccacatttttgactttactgggaacaccagaaattatatcttaaaagtttcaaaatggttataagagtgaagacccttgtttgtaagttgcttcacacgggcgaagagagttccccacacaggggacaccaacatgtgtggcggcatttttcacccctgaattcacaccttttggttatgaacgaccacaacacggagggtgcttgatacaagagagcagcacacaatgggggccgagagattaaaccagcggggggccacttctgttgggtcccttttgagacatttgttgtgtgg

SEQ ID NO: 684543 - DNA, 318 bp, Homo sapiens
actgatttgatgatgtctgaacatcaaaatcacgcaggtgatgaacactataccttagaacatgcattaggtaaccaggaggcaacagcagtagtgactaactaaggccagacaactcagggtaaattagacctattcatctagatatatttgagcctcctataaaactgcccatggattccaacatgtactcaacatataatacaacttacttcaatgctgcatttataatatctgacatgaaaaccttatttaaggagtcaagatgctgaacaccctaacaaaagcaaaaacaaaattacggcctatgtggtgagt

SEQ ID NO: 684544 - DNA, 140 bp, Homo sapiens
attcgcgggcgcgtcgacgaggcatgagaattgcttgaacctgggaggtggagggtgcagtgagcagagaccgagccactgtactccagcctaggtgacaaagcatgacccacagtctagcccccactccccatctcgga

SEQ ID NO: 684545 - DNA, 599 bp, Homo sapiens
  misc_feature (6)..(6): n is a, c, g, or t
  misc_feature (138)..(138): n is a, c, g, or t
  misc_feature (144)..(144): n is a, c, g, or t
  misc_feature (203)..(205): n is a, c, g, or t
  misc_feature (217)..(217): n is a, c, g, or t
  misc_feature (232)..(232): n is a, c, g, or t
  misc_feature (241)..(241): n is a, c, g, or t
  misc_feature (246)..(246): n is a, c, g, or t
  misc_feature (279)..(279): n is a, c, g, or t
  misc_feature (286)..(286): n is a, c, g, or t
  misc_feature (336)..(336): n is a, c, g, or t
  misc_feature (351)..(351): n is a, c, g, or t
  misc_feature (365)..(365): n is a, c, g, or t
  misc_feature (368)..(368): n is a, c, g, or t
  misc_feature (383)..(383): n is a, c, g, or t
  misc_feature (395)..(395): n is a, c, g, or t
  misc_feature (398)..(399): n is a, c, g, or t
  misc_feature (416)..(416): n is a, c, g, or t
  misc_feature (424)..(424): n is a, c, g, or t
  misc_feature (431)..(431): n is a, c, g, or t
  misc_feature (454)..(454): n is a, c, g, or t
  misc_feature (459)..(459): n is a, c, g, or t
  misc_feature (463)..(464): n is a, c, g, or t
  misc_feature (475)..(475): n is a, c, g, or t
  misc_feature (482)..(483): n is a, c, g, or t
  misc_feature (497)..(497): n is a, c, g, or t
  misc_feature (599)..(599): n is a, c, g, or t
tttgtntccccatttttatgttcatagttcacatttaaaaccacattttttctttactttttttaatttgatataacatcttatcgtttaacatctaagtattcaatataaatcatactgttaaacagctataaggtnccattnaaactgctgcggtgccagatcaagtattttctgttaaatatccgcttttttacattttnnncttcctaaattnattcttgctccccanttgattcanttttnccaaggcattctttgtgcaccttggtgtatttncccagcnccacttttttattccaaaactccttcgtttaggtttttctttctcctgtnattcatctgtgacanttcccgtgggtttnctntacgtcgtcttattngtatcctgtttncgnncctctgcccagtgtacntttagttngctactnctactcacttcttggttatcatnttatnaaanntaaatgaacgnttcattnntttaagtttgtggntaaaatagtgtaccttgcttaaatttggattcccccgtatagatattacgtttgggatttctcatgtttttttgttgtgtaaatttactttctctcattgtn

SEQ ID NO: 684546 - DNA, 87 bp, Homo sapiens
gagagagatgaagggtcttactactgtgcctgtgatgccatggtactgggggaatcccctagtaaacgagacaccgataaactcact

SEQ ID NO: 684547 - DNA, 146 bp, Homo sapiens
ctgcacacacacacgctgatctcacagcaccatgcactgcacatacacatgatctcacagcaccatgcactgcacacgacacatgctgatctcacagcaccatgcactgcacacacacacacacacacgctgatctcacagcacca

SEQ ID NO: 684548 - DNA, 143 bp, Homo sapiens
agcggggcatcacttgaacccagaagacggaggttgcagtgagctgagatcgcaccactgcactccagcctgggcgacagagcaagactccatctcaaaaaaccaaaaagacaacaaccgaaataagaggttcaggataagca

SEQ ID NO: 684549 - DNA, 303 bp, Homo sapiens
cctgaatgagcgggtgaaacccctcaaaaaattgggggcccccggtgccccatttggccaaaatgggggggcccaattttggtttgggggaattttttttttccaagccccccctggggaccagtaataataaaagttaaccctgggggtattttccccaaacccggggggggttttccctgttccccaaggcagggaaggaatgttggggtttcctttcccttttttttaagttgtccccaaacccccccttaattttttttttttggccccttcctttaaaaaaaaaaatttggtccccca

SEQ ID NO: 684550 - DNA, 675 bp, Homo sapiens
ttttccaatttaattgacaacttatattttcctaacccttaaaaaggctgatgaaaacccttcatttcaattgaaaacgtaatggacaccggtgttacccattattattagtttcctaaaacccacttgaaaacatccagcatgcagttttaaaaatcaaggtacaatgatttcaagaaccaagttatcacttgtaacttccagcaagaggctagaattacagattatcatagtcatcatcatcatcatcgtcatcatcatcatctccagcgttttctttccaagtgctttgtgatgatccatgggcgagaatttggtgatgcaccctcatatagaggggtaataagaatgttttgggccccgattaatgatggattaactcagaactttctgacctgctgaggttgcaggaattgaagctttatacagctggaaactgaaaagtaggcttctgtactgtaaacctttgacctggtgagggacatgggagctccctactttagttgaaccagacctgctctgaggggttggtgtcccagtggggcagaacttggcccgctagatacctgaaccaacatttaacccgggggactgtaattctccccccgaagaaagttagtacgacttttttctctggtaaagagaatttaccggctatattgtttggggcctttg

SEQ ID NO: 684551 - DNA, 168 bp, Homo sapiens
  misc_feature (19)..(20): n is a, c, g, or t
  misc_feature (30)..(31): n is a, c, g, or t
  misc_feature (72)..(72): n is a, c, g, or t
  misc_feature (92)..(92): n is a, c, g, or t
  misc_feature (94)..(94): n is a, c, g, or t
  misc_feature (98)..(100): n is a, c, g, or t
  misc_feature (125)..(126): n is a, c, g, or t
  misc_feature (137)..(137): n is a, c, g, or t
agctatacttctattattnntctagaaatnnccctccttttacccctaccatgagccctacaaacaactaanctgccactaatagttaggtntncctnnnattaatcatcatcctagccctaagnntggcctatgantgactacaaaaaggattagactgaaccgaat

SEQ ID NO: 684552 - DNA, 405 bp, Homo sapiens
  misc_feature (3)..(3): n is a, c, g, or t
  misc_feature (49)..(49): n is a, c, g, or t
  misc_feature (157)..(157): n is a, c, g, or t
  misc_feature (184)..(184): n is a, c, g, or t
  misc_feature (237)..(237): n is a, c, g, or t
  misc_feature (246)..(246): n is a, c, g, or t
  misc_feature (255)..(255): n is a, c, g, or t
  misc_feature (288)..(288): n is a, c, g, or t
  misc_feature (310)..(310): n is a, c, g, or t
  misc_feature (349)..(349): n is a, c, g, or t
ggnccctcctgctgctgctggtgtcaaacctgctcctgtgccagagcgnggcccccttgcccatctgtcccggcggggctgcccgatgccaggtgacccttcgagacctgtttgaccgcgccgtcgacctgtcccactacatccataacctctcctnagaaatgttcagcgaattcgataaacngtatacccatggcgggggtcattaccaaggccatcaacagctgccacacttcnttcctttgncaccccctnaggacaaaggagcaagcccaacagatgaatcangacttttctggagcctgatagncagcataatgcgatccctggaatgaagcctctgtatcanctggtcacggaagtacgtggtatggcaagaagcccccggaggctttcctccggctg

SEQ ID NO: 684553 - DNA, 101 bp, Homo sapiens
  misc_feature (3)..(3): n is a, c, g, or t
cantcccccttcgtgtgtcatcccgctttcgtgttccaatcccccttcgtcttcctcttcttctgaggatcttcatcagatggttccagttccccccaagg

SEQ ID NO: 684554 - DNA, 637 bp, Homo sapiens
atcttggctcactgcaacctccacctcccgggttcaagcaattctcctggctcagcctcctgagtgctgggactacaggcgcgtaccttctttagtagagactgggtttcaccatgttggccaggatggtctctatctcctgaccttgtgatctgcctgcctcagcttcccaaagtgctgagatgacaggtgtgagccatcagacccagcattttttttttttaatttaaatttaaatttttttcattttttggagaggtttttttggtttggtttggtggttgttgttgttgttgttgttgttgttttggagacagtcttgctctgtcacccaggctgggagtgcagtggcatgatctctgcaacctctacctcccaggttcaagcaattcttgtgcctcagcctcccaagtaactgggactacaggtgcacgctaccacacctggctgatttttttcatgtttagtagagacggggtttcaaccatgttgcccacggttggtctcaaactcctgagctcaggcaatccaaccgctttggctccccaagtgctcggattccggtgtgagcaccaacccagctttttctttcggtttaatttaccgtggggggggccccttgttccctgctgtccga

SEQ ID NO: 684555 - DNA, 305 bp, Homo sapiens
atcttgaccatctcggcacctgtcatatcttttccctctcgtgataaagctatggcggtcttattattgtgcaaaagacagaagtcatatttctaacctgtatgctgaagtatttggtacaataggcatcctgaagaccagaaacagtgtatatatacgaatgagatattattacactgtatactgacatgagtgttaaaaaaaaaagataaaagtaaatacttgccatgtactaaggcctttaaaatatagctaatcaaatgtatactatttaccaggagagctcacatttttctgcagttttc

SEQ ID NO: 684556 - DNA, 389 bp, Homo sapiens
aaaatcactattgtaactataccaaattactatattatgtgatgcaacaaaattcaaatatgaaaaccatctcggaggccgggcgcggtcgtcacgcctttaatcccagcactttgggaggccgaggtgggtggatcatttgaggtcagaagttcaagaccagcctggccaacacggtgaaaccctgtctctactaaaaatacaaaaattaactgggcgtggtggcacatgcctgtagtcccagctactcgggaggctgaggcaggagaattgcttgaacctgggaggcggaggttgcagtgagccgagatcacgccattgttctccagcctgggcaacaagagcaaaactctgtctcaaaaataaaataaaaaattgctttaaaaaat

SEQ ID NO: 684557 - DNA, 791 bp, Homo sapiens
tcagtgaatccggcaccttcctaggcctgggcacagaacactggctctgttgccatctacatagactattctctctccagtgcctctactacgtgagggaggcccatggacatctgtggtgaccgtgatgtggccttacataactgagaattggtctgttggatccagagctcctatgagagtcccatgaaactgccctgattctctgtggactgtgtgacagatcagtatggccagactgaatctagttgacctgacgacttccagtgcacatcaacatgcagtggcaacaaggcagagaacggccaggtatccaaggagcaggggccatcgaccaaaggaatgggagcagccccagcagagacagaaatgtggagcggaaaccacagacacgaggggctagaaactcagggtagagaatttgcacggcggtgcagacagacatagagactccgaaccagctgacagaaagaagtgagcttcaaccaacgaatactaaccactgatttgaccaatggaaggaaacagaatggataacgtacgatatgcccaataacatggaagaaagtacatggataaacaaagacacaataaactggataatagaaagacgtggatttaggagacttagatttggcactattgagaaaacatgtatgaaaagtagacattaatgacatatagaggagaatagtaaatggtagaaaatatgactggaatatattggtacactattcaagacactatacagacagactagattaggaggacaaaaatagagctgagtactg

SEQ ID NO: 684558 - DNA, 679 bp, Homo sapiens
caggcgcccgccaccacgcccagctaattttttgtatttttggtagagacggggtttcaccgtgttagccaggatggtctcgatctcctgacctcatgatccgcccgcctcggctcccaaagtgctgggattacaggcgtgagccaccggccaggccgacatggtgattcttaattgctatgtcattctttctgaacatacttaacagagaaataacacaagtgggggaacgtacttgcagacaatctaacgaagacctacgtatctagtgagtactctggccagtaccttccgaactcagtgacaaacaaaaacaagacaaacactagccgcggagtacacaaaaaagtggacgaagggtcaagaagccggcgagctcgacaacaacgcgcaggacacgtgcccattggccacagtagcagatcaggcgacctactagaaaaacaaaaacgcacacagaagctggacggaccgacaccagaccgaaaaccccccaacgaggaagagcgaccagacacacacaacgccgaggaatggggcaaagccacgccagatcgcagcaatcggcagcgcacaactcgctcgggagccgaaacacgcctggcgagaggcatagagtgcggaagcagcagcgcacacgaccacgcacgacgaggcacaagagaccgaagcccatcac

SEQ ID NO: 684559 - DNA, 423 bp, Homo sapiens
ctcaaaatctcatgctgaaatgtggtctccagtgttggagatgggaccgggtgggtgggggcaggtccctcatgaatggcttgggccctccccttggtgatgagatctggtcgtttaaacatgtggggcacctccctccctgttcttgctcatgcttttgccacgtgagacacctgctccccttgcaccttccaccatgactggaaacttcctgaggcctcgtcagaagctgaggtgatgctggcaccatgcttcctgtacagcctgcagaaccgtgagccaattaaacttctcttctttataaattacccagtttcaggtatttccttatagtaatacaagaatggcctaatacagcattacacgttaagtcagaaacccataaaagaaaaggagactatatttgagaacttaaaaactgtt

SEQ ID NO: 684560 - DNA, 936 bp, Homo sapiens
agcgggctggggctgctgacgtcgcggctgcggcccgctggccatgctggccctggtgatgtgctggtggatgtgctggctgtgccttggtctggccctgtgcccagcccatgccctgcagcatgctggacggctgctcatgacgtttggttccgtgacctgccgttcttgccgctggcccggtgtttgtcaccatggtcctggtggtcttgcacctggctcggccatgacctcgaccccccgtcttctccgcgcatggccctggtgctgtgtggctgctggatgcctgtgcggacgtgtggcccttccctgctgtgctgcccagctgcactgtccagtgtgactggtgcttgctgtgtgcccgctggtgctgcaggtggcacagacgctccgggcagctgtggccacgcaccatgctgacggcgttacacagtgtgcatccgagtgtgtgtgcctgccgatcgcaacgtaccagtacagtcgcgctcgcgtcgcgcagaaggactgcacgggcctggtccgcgatcgtgggcgtgacggacgtcgctccgttcgaggcgtgccgcctgtggtgtgcccctttgacttgcgcctgcattgccggaggctgcaccggacggcccgacctgctgggggcccctgtgcgacccctggggccccgcgaacgcatacagtgaccaggcacagacccttgccgacagccttggggttgcttcgaccgaacgccattgcacacccagaatacggcattccaattcaggggccggattccgaaacgaacacggtttgcccatgagtgacccaaggggcccaagcaggagtgaggccggcattgaggacagggaaaggggtccattccgaggacgacaaagggtcccgccggacccagagcgaacaaaggcccagggagataccaacagcttggaaccttcccaa

SEQ ID NO: 684561 - DNA, 137 bp, Homo sapiens
tgttttcccgaaatcgcatggtgggggggagggagaaaacctcttgcgggagctttttctttcttattttcactcttttgggttttctcttctgttgttgttgttgttgttttctgttggcaggacacgaatgttca

SEQ ID NO: 684562 - DNA, 503 bp, Homo sapiens
ttagggaaattagattataagtaaaagtgtgggcatattctcctcttttctacaaaggttttcaaatggttcctgaggttttttgttgttgtccgtgttgttactgttgttcttgtcatcaggtttgattttggtccttgccctttccttctagttctccttttattaataggaaggcaggcaaaagccccatttatgtgtgtgttttcccctcagacagctttcatccactgctctgcactagaatcgcaccaatcttcatggtgagcaattttaagaaatgttagtggaaggtaggaattatttcacacatcagcttccagggtcgttaatattaataaagatatttggcttcccattgctgtttggagttgttgattggatatgtgttggtgtcatcctcctcatgagtttctgaaataagtacgggtttgtaaaggattatctacataatccattccatggatgaagaagaggagtgcagctaatgcactgcctggtac

SEQ ID NO: 684563 - DNA, 463 bp, Homo sapiens
  misc_feature (3)..(3): n is a, c, g, or t
ggntgtgttgagtcaagccacaaaatccactgcttcctttgatgtttatgcgttcactgatggatccctttggacccacaagcctatttttgtagatcaacttgggtgcaatgcagaatgtgctcattgtgccctgctgggggataggaatactcactggtgttaattttttataattgctaatcacctatgcagtgagtcagcagaggtacagccctaggaatggtcttctaggctgtgggtggtgtgggatttgatttgccccaccatgtaggcatggagcccattcagatgtgaacgtggttacaggttgagccttgctgtatcgattcctctgcttcactttcctgctctattcctcttcatttccttccagatggggctactgatgctcaccactcatccatctggagtaggctgaagctaccctaggtgggacagagcagcacttccccctcttcct

SEQ ID NO: 684564 - DNA, 231 bp, Homo sapiens
  misc_feature (26)..(26): n is a, c, g, or t
  misc_feature (36)..(36): n is a, c, g, or t
  misc_feature (39)..(39): n is a, c, g, or t
  misc_feature (43)..(43): n is a, c, g, or t
  misc_feature (45)..(45): n is a, c, g, or t
  misc_feature (62)..(62): n is a, c, g, or t
  misc_feature (79)..(80): n is a, c, g, or t
  misc_feature (86)..(86): n is a, c, g, or t
  misc_feature (105)..(105): n is a, c, g, or t
  misc_feature (107)..(107): n is a, c, g, or t
ctctaccggagcttatttgcggtgcntttccaccanttncagncnctcaggttggaggaccnggtgcacactcttggannctcggntgaagtggctgggatgagncngtttctctgacgtcccccatagatcttggtcatggagccaaccccagtgccaccccgtgagggtacatggtgcctgcgcttggtggaatgcaggctcgcggtgtaggaaccatgttcttcatct

SEQ ID NO: 684565 - DNA, 298 bp, Homo sapiens
tgtagtatgtaaagattccaaaacagatgccttcgatgagtagtagccactatcaccattcctcctcagcctggaattctctccctcttcttctctgccccatcaattcccattcttccttaaagagaagtcagggtaagccacctcctgcagaaggccttcttggattccttttcccactcattatggtattggtgcttctaaagcattttgtaatatctctattactgcatgaaccacacttacctaaagtcatttgtacccacatttgctcccctcgttagaactgggatttccc

SEQ ID NO: 684566 - DNA, 446 bp, Homo sapiens
  misc_feature (431)..(431): n is a, c, g, or t
  misc_feature (436)..(436): n is a, c, g, or t
ccacgtgctgtgggccatgtacgggattctgccggcgggatcggtgcagaaaccccatcggcatcagtcgattgcactggacttcattattgattgccccaagggctgttattcattggtgggcaccgagctggacgcggatgggcaaattcgtaacccgcagcgggtcgactggtcgcccggcctggcgtttgtcacgccaccgggttactggcatgcgcattttaatgaatcggatagcgaggcgttcctgatcccgattcaggatgcggggctgcaaacctacttgcgtgcgctggatatccgcttcagttgagtcacttccagtccggtgtttcgcccagtcgttcaacgataaagtcgataaaacaccggaccttggacgatacgatgcgcttgggcgggtacacaaaccacaccgcaaagcacanatctngcgtggggat

SEQ ID NO: 684567 - DNA, 280 bp, Homo sapiens
attttttaaaaaaaggtttttttttttgggcccccccctaaaaatgggggggggcccggggaaaaagggggaaccttggttattttttcaaattgccccccaaaaaggggggccaaaagaaaaccaaggggggggggggggttttttcccccccgtttttttcccccccaaggaaaaaattttgggggaacccccctttttttgttttttaaaaaaaaaaggttccccccggcaggttaaaaagaaaggggggggccaaaaaaagggttttcccccttta

SEQ ID NO: 684568 - DNA, 248 bp, Homo sapiens
ggaacacaaaagcggcgtgattgaaatgtatctttctttaaaggcacaaatatgccagctacttttggacacttggcagggggatatgatggccaatattatggatatctttggagtgaagtcttttccatggacatgttttatagctgttttaaaaaagaagggataatgaatccagaggtatggtattttttttttccttttcttaaatgtctagttgtccccccgctttggtgtcccgggtaccg

SEQ ID NO: 684569 - DNA, 549 bp, Homo sapiens
  misc_feature (33)..(33): n is a, c, g, or t
  misc_feature (46)..(46): n is a, c, g, or t
  misc_feature (50)..(50): n is a, c, g, or t
  misc_feature (60)..(60): n is a, c, g, or t
  misc_feature (70)..(70): n is a, c, g, or t
  misc_feature (77)..(77): n is a, c, g, or t
  misc_feature (95)..(95): n is a, c, g, or t
  misc_feature (105)..(106): n is a, c, g, or t
  misc_feature (121)..(121): n is a, c, g, or t
  misc_feature (133)..(133): n is a, c, g, or t
  misc_feature (163)..(163): n is a, c, g, or t
  misc_feature (184)..(184): n is a, c, g, or t
  misc_feature (186)..(186): n is a, c, g, or t
  misc_feature (245)..(245): n is a, c, g, or t
  misc_feature (247)..(247): n is a, c, g, or t
  misc_feature (256)..(256): n is a, c, g, or t
  misc_feature (263)..(263): n is a, c, g, or t
  misc_feature (269)..(269): n is a, c, g, or t
  misc_feature (273)..(273): n is a, c, g, or t
  misc_feature (282)..(282): n is a, c, g, or t
  misc_feature (288)..(288): n is a, c, g, or t
  misc_feature (316)..(316): n is a, c, g, or t
  misc_feature (384)..(384): n is a, c, g, or t
  misc_feature (397)..(397): n is a, c, g, or t
  misc_feature (407)..(407): n is a, c, g, or t
  misc_feature (410)..(410): n is a, c, g, or t
  misc_feature (425)..(425): n is a, c, g, or t
  misc_feature (439)..(439): n is a, c, g, or t
  misc_feature (445)..(445): n is a, c, g, or t
  misc_feature (449)..(449): n is a, c, g, or t
  misc_feature (458)..(458): n is a, c, g, or t
  misc_feature (464)..(464): n is a, c, g, or t
  misc_feature (501)..(501): n is a, c, g, or t
tttggttaaaacacccctggtccaccaaggttnagagataagagtnggcnggtcacttgngcatgttctnacagagngggtattggggttttttntggtaggaanngcatgtcctaaagcnggccttttgatnttaaattttttaaaaagcaaaattatagangtttagattttaatcaaattngnagggtttttaggtaatttttcaaaatggcttgtttgcttcaactgtttcccccctttgntnttggagganatggggncagggntggngtcaaaacncttgtnattttgttttttgaggtttttgttaagncggcggaagaattatttttttttttttataataaggaataacccccccctttattccttcatttcatnacccatttttggntttttgggtnggntggggcaggccagcnggggtttttttttnccatgncaanttttaattnccatgnccggtatgttcaaagtcaaataactcctctttgtaancaaacggggtaacggcccaaagcggcctttataaatcggcctaacata

SEQ ID NO: 684570 - DNA, 375 bp, Homo sapiens
  misc_feature (31)..(31): n is a, c, g, or t
  misc_feature (62)..(62): n is a, c, g, or t
  misc_feature (289)..(289): n is a, c, g, or t
  misc_feature (310)..(310): n is a, c, g, or t
aggcctctggtgttcagtaagttgagtgtgntcaatgcattttcctctttataatattttcnacgtgtaatgggtttatccaaatgtaactccagccctggcgcagtggctcacacctataaacccagcactttgggaggctgagccgggaggatgacttgagccctggaggtcgagacaagccttggtaacatggcaaaaccccatatatacaaaaaaatcaaaaattagccaggcatggtgacatgcacctgtggtcccatctactcaggaggctgaggggcacggntcacttgagcctgagaggtcnaggctgcagtgagccatgattgtgccactacactccagcctggacaacagagcaagaccctgtct

SEQ ID NO: 684571 - DNA, 127 bp, Homo sapiens
cgccaatcacagaatcgaatctatctcacagctgacaaccttgtgctgaacctacaggatgcaagttacaccaggggcagtgccagcctcatcaacgggtacagaaactgagcctacgtcaccaagc

SEQ ID NO: 684572 - DNA, 556 bp, Homo sapiens
taagaccggtcagcaagttgctcacatctgtaatcctagcacttgggaagccaaggtgggtggatgtgcttgagctcaggcatttgagaccagccgtgggcaacatggcaaaaccctgtctctacaaaaaatacaaaaatgtgctgggcgtggtggcacatgcctgtagtcccagctacttggggggttgaagtgggaggatggtagagactgcagtgagccaaggtcgtgccattgcactgcagtctggctgacggagtgagagccggtctctaaaacaaaacaaaagaaacaaaaaacaacaatccccagttcaggagggcagggacatccctgaactaatagctggagctatgtggtgaacagctgtcatgactgccacggtctctgtcgctgtctctgtctctctgtcatcactatgtcatctgcctctcggtttcggtctctctcggtggtccatctccatccatcaagtcctgcctctataattttccccaaaagttctgacctggtttagggacagagatggggctcccaatatttgacactggtccct

SEQ ID NO: 684573 - DNA, 1121 bp, Homo sapiens
gacctactagagcagcatttatagagtttgatggcaaatagattaggcagaacttcatctagaatattcttagtcaaactaatgtggacacgttctcccatacctagtcagtgtgtcatttcaacacacttgttgcaaatttcttaacaaagcgtctctgaggatgttacacatttagtatctatacaacagtagatatatagagtattgatctcgatagcgtcatacacgttaagactggggtaaagtccgagacaactattctaacacctcaccatgtgaaatctatatgccaccttgtctctcataacataggctgaaaatagttacctaagaatggaaaagtcaatcttcatgttgttgagaggatagttataagagtaatttgttcttgtgtttacagaatttcgggcagccgtagtatttaacaaattgtaacgtttgaattgtaaccaaatagtgtaaacatggaagggccaggttcataacactaactgaacattataaatgggctcttaagcaccttgtagatacaattgttaaccgtatctgggaatcgtgacacggtcgtgaagtgaggggtcttttgactcttcagacactgttctcacatgtacaagccgagaaggccttgccttacatatcataggtgtaagtcattggaaatggcacaaaagtgggcattactatactattatatatatacaagtagtattattactacataactctacctttactttacttgtcaggttaacccagtccccataagaatctgcacaagaaattgcctatgactgaacaggttctcgagattcctaactttaacacacctttaatacaatgcgcaagtcttgcagtaacttaggcgctgaaaatcgcattaccatgaaagagtaaaatcgtccagagagaatagcgggggaaatactcggacctagaggaacgtgaaacgggcaatcctgacaggccagcacgtcaccaattggtcaggaaaggtacaaggaaggggggaacaacgagacgagcaaacggctacagggaagggggaaccgtagcccaccacacaggcgcctgtggagccgaccaccaggaaacatggaaggcagcaccgtggaaac

SEQ ID NO: 684574 - DNA, 225 bp, Homo sapiens
ttttcagaactactagaatgaattctccacatcagccacaagaatgaccttccggcatacaagacacttcttaccatgtaatgcgggggaggagaaagttcaggtacttcattaggatgttggaaaagacgacttcccctctaataggatgaacacatgatcatttcatttacatcattcctgatcccttttaattgctccacactcccctataaacgcaggatt

SEQ ID NO: 684575 - DNA, 142 bp, Homo sapiens
aaccgagctcgtacccaagcctgaagcactggctgaagcaaagcactggctggatactattgcctacactggctccttggtggtctcttggtggttgcaatggtggggtaatccatgtgaccaccaagagaccaccaaggag

SEQ ID NO: 684576 - DNA, 412 bp, Homo sapiens
  misc_feature (228)..(228): n is a, c, g, or t
ccaaacattcaaaaaaagggaagatttaaggagcgctgaagtcgggtcaaaaataaaatatatttacatatatacattgcttagaacgttaaactattagagtctgtcccttccaaagagggatgtttgggaaaaactctgaaggagaggaggaattagttgggatgccaatttcctctccactgctggtcatgagatggtgaggctgtgggacaggttctattggcngcttctaagagcgtacttcacataggaagggttctgtgtacacgttgccaggggcttgagaaggttactgtgtgagttattgggagtcttaattaatttaactcggtcttcggtccattcattaatttgttccagtttctccttgtaatgagttaaaactagaaggcttctctccacagtgttg

SEQ ID NO: 684577 - DNA, 317 bp, Homo sapiens
aaaaaaccccccccccccaaaaagaaatttcggggaaaaacccaaaggttttgggccccccccttttaaaagtttcttccttttggtggggccccaaaccaagagggttcgccatttcccccccccccaggtttttggaacttccgttaaggttgttcccccggccgaccttccggccgttggggccctgggcgttcttttccggggccaaagggggcaggtttttttttggggttcttctttgggccggttcttttgggggcccggggggggggtgccccttttggccccttttttcaattaattaattgccggga

SEQ ID NO: 684578 - DNA, 112 bp, Homo sapiens
acctaaatggctgttactaaatggctatacctacatgcctgctggatttggctgatcatgagttgccatttacggtacagccttatatgtacagccattacagccatttagg

SEQ ID NO: 684579 - DNA, 107 bp, Homo sapiens
gattcgcacgaggaaaagagaaaacagctgggccggtggctcatcctgtaatccaagcacttggggagttgaagtgggccggtacactgagtccaggagttgagacc

SEQ ID NO: 684580 - DNA, 671 bp, Homo sapiens
  misc_feature (626)..(626): n is a, c, g, or t
aggtagttttttcttaaagattagttgtaacgtagactgttataccataccagtaaccttttcatactctgttacattaaaataccttggtctgctgtatacttgggtttttttggcatcatgcatgcatcatttgaaaaatgtcacttcgctgcattatgcgtatcttcaaagtgctgttaacacatttcattatgcaatatcaaaaaagtcatattatcaccactgatctcaacagagataagtattgacttgaccatcagtttacagtagcaaatattggttttccaaaactgcagtttttactggaaagctcagattctgtcattggtaataaatactgtcagttgttttacttaaagtgacaggctcactttattcatttttgagaaaatgtgaaccagatacccaagtctgagtaagcctagttcattgctgtgagttatttcacgtaacaatgatgtttatggaaaaggcagctagttggcctcacaatgtaagaaatggccccaggtgcttttccttgagatcacccgtgtacttcagtgtgccccagaaatgctttcaagagcacttttcccgtcatcatacagaagttaagagtgtcttaatagttgagattaatnaaattaggaaattttacttcatcaaggacattgttagtgttcctt

SEQ ID NO: 684581 - DNA, 299 bp, Homo sapiens
  misc_feature (30)..(30): n is a, c, g, or t
  misc_feature (37)..(37): n is a, c, g, or t
  misc_feature (117)..(117): n is a, c, g, or t
  misc_feature (155)..(155): n is a, c, g, or t
  misc_feature (161)..(161): n is a, c, g, or t
  misc_feature (187)..(187): n is a, c, g, or t
  misc_feature (198)..(198): n is a, c, g, or t
  misc_feature (224)..(224): n is a, c, g, or t
agcggcccccaagtgtttgagggagagacnccagtanccaggtgtgccatggaaacatgtgtaaaacaagcactgcgggattcccgtgtgactcttgcaggacgccgtgaacaatanttttatgatttgctcaacggattgaatctgagtgatcntgtacnctccatgctgccctctgcgcccaacntcccacactantctggacaaactggggtctaggctancccagaagaaaagaaccatatatatatttttgtttgtttgttttgttttgttttttacacaatatagatacacaa

SEQ ID NO: 684582 - DNA, 1259 bp, Homo sapiens
  misc_feature (191)..(191): n is a, c, g, or t
  misc_feature (487)..(487): n is a, c, g, or t
gctcccacaatgctaggcgccggagcagggaggcgatcaagaatattgatgactgagttccagtgtatgttgatctagtaagtgagtatatgccgtggcaaagtttcgaattgaatggtgaggtaatgggagaaaacgtggatacaggtactgggagtcgactaggagagtatagggatagtggtgacatnggtcgtagaggagtagcaggggctgagatgcgtgtggctatgatcgtatgagaaaattgtgagtgacaaggtccaattatctagttgaaattagtcattccaggggttacatgctcgctgttatggatagatcagtaatgcaattctagatgtcgagagcatcttcgtgttgcagaggtacttgtgttgagaatagaatgggtcgagtggcagtgtaacagggtggggatggtatgagtgaggtcgtggagtgaatgagagaagaagatgttggatgcataggagggtcgcgtacnaagtgtaacggactaggattgtagtgtaaagaagtaattacggtagggccagtgttttgtcaccgggtgttacaacatgggcgggtggatttggatttaaagcaaattgggatcttaaagtgggttaaaggtaagtattttaataatgggagtgcattgaaaaggtaaggataaatagtgacttgccactaacttgatcttcaagagtcggggaggtaaactgcgcgaggagaaacaccgagaggaagtcacttgagggtgaactttatttgggtgcggacaaacgcctgggaaggaacactggacggcaatctcttggcagtgggaggaatcaaagcgaaggcggcttgataaggttgctccaattgcacaaggcccggtcaccgtgcttcggcgctaaagtggacgtgcccatggctgccgggcaggtattaaacgcagagggcggttttgattgggactcggcgtgacatttgcgaggctccaactgtagttacggaaacgaacagagattgtggcagccaaaagagaacggattggcatattgaagcctatatacaacgcgttacagccattttccagaaattaacccttcgggttgtggggcgttccccgttttcgcgttggcaacaacgtcacaccatgagcgatcttttagccttgtgggaacgccgattaattccccgatggggtgggtcacacgcttgggagggcgcaacgccccgcgtaggctgagtcctatatctcgtcgtgggacacacattcggtctgg

SEQ ID NO: 684583 - DNA, 865 bp, Homo sapiens
gctgtgcggagcgggcggcacagagcctgttgttgagctcagtatgtcgtgggaatccggggccgggaccatggtctaggttcccagggatggatctcgtgtggtagtgcgtggtactgaagatgtgcgttaaagggaaagggtcgttgccattctcggcccacggtatcgtggtcgcctggctcagtagggccgagctggtgaccaggtgacggtatatatctgttctgtgacgaccataagcttgcagccggtacgcgcttaagccgcatcacggtgttggaggagcaggtcaggcaatgaatctccctctggcaggtggcttctactgctgacctgtagtactctgtaagctcttggatgtaagctggtggcttggggcactgatgaacttagacttgctctagtggcgatggcattggtcaggttcgtgaatcttatctcgagagagggaagacaccagtttgccagaggtccccctcaagtgtctggctcaagaggtaactattcctggattggattgttgaccttcgcctattgagttgaaccataagagaatgccccatataaatgacttgcgtaagaggcgtggtaatctggtccgtggagttggtgtcgcagaaaagaagctaattggggtggccgcgcgagctgggtgagaaacaggctgagtaggaggactggggagtgtgggagggaggttcagggggaagggggatagaggggaggaggggttcaagaggcaggattaagagagacatttgtttgtttggaatggacatttgtaggaaaacgaataactagagacccgcgagtaatggggagaaaagtacgggggcacaaggttaatggccgcggtgtgagc

SEQ ID NO: 684584 - DNA, 475 bp, Homo sapiens
  misc_feature (35)..(35): n is a, c, g, or t
taactaatctattgggttcattattggaattaccntgcggctggaattttcaaattggatctagggcagctggttttacacaaacccctgtgttcctggccatagtgtgttttgattagaaatggcccatattatcctaagaaaagatacggcttttttttttgggagatagaaataaatagccatatccctggcccggaggttttttccaccacaatgttccttggaatggtactggtcaagccatggtgagggggtttgaatggtttgaccttaaccgttttccctgaaaacggtttattggggttttaatttatttattaagaggggttttccgaaatttatatttttattttattttttttccccctgaggtcttttgacatgtggaaaggggatttgaatgaaaaatttaagccttggttggtttttggtcccagaccttggccataaaagccttttagttggatgggga

SEQ ID NO: 684585 - DNA, 360 bp, Homo sapiens
gacgctcttctgtggggtgtgtcctgctcaccagtgaggggagaatcttcaaagggtgcaatatagaaaatgcctgctactccgtagggatatatgtgctgaacggaccgctatccataaggccgtcttacaagggtacaaggatttcaggccaattgctatcgccagttagtcaccaactggcccgtgtacatgaccaaaccggatggctacgtatattgtcatgacggtctaggaactgctgacctcctcactttgcgtcctgagagacctgcagaagacccagtgaccgccagagaatggccactgcctgtaacagccaccttgaagaacttcatacagatgtctcacagacctggt

SEQ ID NO: 684586 - DNA, 283 bp, Homo sapiens
cgcgtcagggggaggggaggggagggtaggggagggctcaccttgacgctgcgtgtggtggacgcgagagggctagcacttgacacatgctcgtgtttgcagcagccggtgcagctgtatcacctccatgcacggtggccagatcaggaagttggcggacgtagggtcgcacttgactaccgaggaatctcgtaaaatgaccgtccctgggtcttgcagacagcggggtaacagctttcctcgatgcttctcttcctccgaatgggcagtgcgcctgcttctc

SEQ ID NO: 684587 - DNA, 138 bp, Homo sapiens
gctagaggatccccgtctctccacactggtcccaggcacagggataacttatttatttatttatttatttgttagtttatttatttatttatttatttttgagatggagtcttactctgtcacccagtgtggagagag

SEQ ID NO: 684588 - DNA, 411 bp, Homo sapiens
  misc_feature (28)..(28): n is a, c, g, or t
taagcctggaacccagtagttattatcntgatcatctccctcttcccatcctccaccctccagtaggtcccagggtctgttgtttctttgtgcccatgtgttctcatcaaaaatgccctttctggccgggcgcggtggttcacgcctgtaatcccagcactttgggaggccgaggtgggcagatcacgaggtcaggagatggagaccaacttggctaacacagtgaaaccccatctctactaaaaaaatacaaaaaattagctgggcgtggtggtgggcgcctgtagtcccagctacttgggaggctgaagcaggagaatggcgtgaacccaggaggcagagcttgcagtgagccgagatcacgccactgcacttcagcctgggcgacagagcgagactctgtctcaaaaa

SEQ ID NO: 684589 - DNA, 183 bp, Homo sapiens
attgaagataaagctcaagtctaaaaggaaaacaaaaacacagggggaaggggttgtatacgcaataactctggggcagaaagaattacgggatgtgaagaacattacacgctgtttttctgaacagggagcagtatgtacacacccataacgatgtgagtgctgagcccctaaatatggaaa

SEQ ID NO: 684590 - DNA, 995 bp, Homo sapiens
ggcttcccttcggaggaaaatttcaggctgaaggtttagctggtgtgccgcctctaaagagagcaatcactaacacttatggctgggatattggcgcttagtagttcaatgggcccccaggctagaatacagaccgtgacaaaaggtgtggagtctctatatttggtacagatgggattcgtcacaaattcaccagatcaagaattccagaacacaagtgtatcaggcctcacctgaagatcatgaaaaataacggtggggatccacagaaccctacataaactgcatatggttaccagaataaacagtacaagaagacgtccatatggggcacacagatataataccagatgctgggattagaacaagcaaatacccctcaaagttcacaagattatccctacagtgaattgcaaaatttgaaagtagtaagcatttggataagaatcaagcccttgaagttggccacaaggacttccaacagaggagaccatgtcttaaacacgttgctcaaaagcactgggcagtcagtagtggcatgtggcatctgaaacttgtgaagcaagaaagccacaattgagtcctaaatgccccagacaagtttccgaatggaccacaatgcacacttggttctattcacaggatggtgagaaaggttttccattcacacaacactgttccacaaccatttacaggccgtagcacacggaggatcacctggtaatcccaggctttgagaatgccagggtaggaactttcccgtggtcctcgactctccgttgatttaaaggcacatcttaccaacataaggactctcaaaaaggttaggactacggggaatgtaaccagggtaccagcacaaattgtctttcataagtaaatctcaaaatttggtgaatagcttgtactcaactgtaccgagcgtagaaacccgggggtaaaatgtcccccattgtgatagcttttgcggaaacaaaccacagaacatgttacag

SEQ ID NO: 684591 - DNA, 410 bp, Homo sapiens
ccccagcctcagaccccacccagcaccttcccagacacgcgtcccgagatttggaaatgtcatgcctgcaatcattgaacccgaggggtgagcccgatttctggatatgattgaccagctcagatgttcccagagaccatatcttttcccttttctttttgggcttaaaacttttttataagggggacccctccttttccttaggaccagaaaccattggggcagaccccttttgagcacatatgacaaattggcctctgttttataaatcccgtttgggataagagctttgatatttaattactaatattattgaatgccttagaggaggcggcgagcccggtgttctgaagacctgtggcccagcagagcctctgacagtaaagttttgctccagcaaaataaaaaaa

SEQ ID NO: 684592 - DNA, 929 bp, Homo sapiens
ggccccgcctgtgatgtgccccctcggccgggggggagacaaagaaagcatcaaggacgaagaatggccggtccgcttgcgagagaagacacgaagaggtgcccccccccccaacgaaggtgaggggaacgaacctcggggaggaggggtctcctctcttcgctcggcggcggagagaacgaccgccggaccgcaacgatgccgaggtggacacaacagtaagtgaaagaagaagaaaaggtgaagcgccgcgcccgccgcagagcgtgtgtcgttagaaatctagccgccccgccccctccgtatacttgatagtggtgggggggagacaaaacacataggatcgtgtcgttgggcgtatatattataataagttgttataccacgcacgctgtttgggaggaagattgtcgccccgcagacaaatcatattgtcgtggacgcacgcgcgggacgactctcgtggtaatactattcttctctgttatttgtattcgctctccccgctcccctcccacgcacgtttatttatctctcacacagtaatagggtttgtctccgcaagacagacactatctgcgggggtgtgtgtgttagaaagaagcgccgcggttaatatagtatttgctgtttaggaacccactgatatatacagcagacagggggggcacccggggggagtgattttctcagcaggcgtcttcaatacccccccccccgcggtggtagatagggtgacgcggggtgtttttctctgatatgatgattgggcccgggtgcgcggagagagtttttcaccaaaagttgttttaataggacagatcacccgtgaccatttcccccgggggcccaaaaaacacccttttttttttttttttttttaaaattttgggttttttttaaaaggaagaaggagatttttggggaga

SEQ ID NO: 684593 - DNA, 1990 bp, Homo sapiens
tttgtgtttcgtctcttgcttggtgtgtgttatcacttggtctgtcatgtcgttgtgtttcgtgggacctgacatgatggtggggctccctaccccgtcgttttactggggtgtccctgcgtgggcttttccaggacgttcttttggtcggactccctcgtgtgggtgtgtgttgtgccttgttgcccgctcgctgtggattgggtgtccgcttcgatagccacggtcgtgtgcctactgaggtaaggcgtatgtgtgtttttgtccgtgggtgatcgcagcgcgatgtgtcttcgtggcgttgctggcgtcctcctcaagattttgtttggtggtgagtctgttggctcgtcgagggtgcggttgagaacgcactgtttgggtgtggtcactaatcgcttcagttgttttgtcgtccgctataggggccggatgtgcttcggtccgcgctccctcacatcagtggtctgtgacagatggtgacgcctcagtaggtgtggtactcctccctgcgatgttattgtggtttctcgtcgggtgggtctaaatattcaatgttgggtggtggctcctcccggtgggtgaatatttataatgtgtgttggatgaggagtgaatatgtggtgtttctttgggttgttttctgatggcgcggtgtgtggagcataccgacttgtgctcggaagacgttttcttttttgtggggctttgtcggtgggtgctccatcttgcgccactgtctgtttgtggtttgtgcctcctcctctgcgactagatgggtgccgctttgtttgtccatccgacggcgcgccggcggttgtggttgtctgaaacactgccgcccaagttttgtgggtggtgtacaccctccactaagagattgggtcatcattgagatagtatattggtggtacgagaatgcctccccgcctggtgtgtctcccactttgtgtgtggtggggatgtataagtaggtcgcctcctgcgcttcttgtaggctgctctcaatggtgaactcgtcatgtgttggagttggtagcaccactgggttatttggtactgctgatgttgtgtgtggtttgaggaacagaccccgacttgtgtattgtgggggccttttttccaacagcgtttttattcataacaggagcggtcacgaagatagttgttgtccccgtggggagactcccccgtgttgggcgcacacacagcacgacaactagtacgcctgctgaagagttgtgtggtgcttctgctgaaaaaggcgggatgcttcgtctacaactcctggtggggccgcgacacatcttgggccgacaactagccacttgttcgcgacgtcaactagttttcccccccttctacagaggatgattggggatactcgtgtggagagatagtagtgggagatatagtagtctcttgtgatgagaggagattctctacacctcacagatacttgtgtctgtcatatatgtctcctctctcacactgcgtccctctcacactttaataatattctgtgtcacactcccacgacgtgtgtctactccggggtgtcgcgttaaccacatgatacgctgtgcgcgaggtgttcgctgttgtgttggccacacctcggctgtctcggatatataagatatgtgagcccacctcttgagaacctcgtccacacccttattgcccgcgagacacactcgagatggttgtgtctaattcggtgtctgccacagtggaggaggaagagtgtggggggtaattcttctccccacattaagacttatgagaccccctctttgttctccagaactggtggattctctgggagcatctcctcttggccaattaaagatccagatgtaaatggtgtgaaatctcaaagagccaaccacctggggtattgtggtctcccatttcttcttaggggtaacacaccaagggcaaaagagtttctatggtatttggaaaccaatgtaaatgggcctgttta

SEQ ID NO: 684594 - DNA, 133 bp, Homo sapiens
aaggtaacatactaagacaggagagctgggtcatctccattctctgcaaagtgaacaagaaagatcaatgttgatggaccctgaggcaagagggcatggcttagggataagggatcccctaggctgcctctgg

SEQ ID NO: 684595 - DNA, 260 bp, Homo sapiens
cgactcttagaggatccccctcacactgcgcccggacagacttgatggagcccgtcaatcacaaccttttccttctctattcctgctgatggtcacaggttgtaacacgagctctctgctactcctgacttccacttccggcttgttgtgtcgcttccacatcctggtcaggaatagttctccaggccgagtgcagcctgctaaatgtgtaccgcacggtactcaggtagggtcgcgagagtggcactcatcgcgggtcg

SEQ ID NO: 684596 - DNA, 939 bp, Homo sapiens
cggtggcggtgtgggtgggtggtggacatgtgttgcgggtgagggagtcctgcggggagtggtcgcgtttgttcggcgagtggtgctttctcggtcgtgcgtctgagtgtgggtggcgcgcaagggtgtccgctaccgtcgtgttgtttgtgtggtcgcggtcggggcacagaagtgtgggcttctttgtggcgagtgtcgggcggtacaacctctagttgggcctgtgggtgtgtgaggtatgagcgtatgccggtcgtgcacgtcgcgggtagggctgtctctcggtggtgtggtggacgtgctgtcggcagtgcaccgaggtgcggcggcggggtctgtggcgtggtctccggaggtgccgcggggctgtggagtgggcacgcggggggtgagtgggtagggggtgtggacaccgccgcggtgtgtcgggtgggagtggtgtgtgtgctgtggggttgctcggtgcgtgtgcgtgggtgtcgtggggtgtgtggtagtggtaggggcggcggcgtgggggtcaggtacgagggtggtgcgggcggctggcggccgccgccgtggtggtggtggggtatgaggtcgcgcgccgaggggttggctgtggcgctacggagggaggcccgcgggtgctccccctgtggcggtggggggggcacggttgtcggggagaaggtgtggcgagggtgtggtagcgtagatgtgtggtctcgcgcaggcggggtgcctgcctgcccctcccgcgacggtggtcgtcccgttcaccacgccgggcacccccgcggaggcccgtggggtgtagcctgccccctagttgcccgccatgttagccgcatgctcccgcctgctggccccccgtgctgtcagtgccctgaccaacgatggtctgtgcccggatgccataaaagcttttttgtctcgctaacaaaaaaaaca

SEQ ID NO: 684597 - DNA, 753 bp, Homo sapiens
  misc_feature (18)..(18): n is a, c, g, or t
  misc_feature (63)..(66): n is a, c, g, or t
  misc_feature (79)..(79): n is a, c, g, or t
  misc_feature (81)..(81): n is a, c, g, or t
  misc_feature (95)..(95): n is a, c, g, or t
  misc_feature (106)..(106): n is a, c, g, or t
  misc_feature (121)..(121): n is a, c, g, or t
  misc_feature (123)..(123): n is a, c, g, or t
  misc_feature (134)..(134): n is a, c, g, or t
  misc_feature (147)..(147): n is a, c, g, or t
  misc_feature (178)..(178): n is a, c, g, or t
  misc_feature (187)..(187): n is a, c, g, or t
  misc_feature (189)..(189): n is a, c, g, or t
  misc_feature (202)..(202): n is a, c, g, or t
  misc_feature (204)..(204): n is a, c, g, or t
  misc_feature (234)..(234): n is a, c, g, or t
  misc_feature (236)..(236): n is a, c, g, or t
  misc_feature (246)..(246): n is a, c, g, or t
  misc_feature (302)..(302): n is a, c, g, or t
  misc_feature (304)..(305): n is a, c, g, or t
  misc_feature (313)..(313): n is a, c, g, or t
  misc_feature (368)..(369): n is a, c, g, or t
  misc_feature (432)..(432): n is a, c, g, or t
  misc_feature (455)..(455): n is a, c, g, or t
  misc_feature (470)..(471): n is a, c, g, or t
  misc_feature (493)..(493): n is a, c, g, or t
  misc_feature (500)..(500): n is a, c, g, or t
  misc_feature (509)..(509): n is a, c, g, or t
  misc_feature (544)..(544): n is a, c, g, or t
  misc_feature (623)..(623): n is a, c, g, or t
  misc_feature (752)..(752): n is a, c, g, or t
agggggagtttcccaggnggcctaaagaagggcggggcataggggtggatcccagggcgctgnnnnggtggggcgtgcntnctcgcgtcgggggnggggggggtgnggttctgggcaggtngnttctgttaatnggggccttcagcntggtgccctcaggtggctggggttgttgggngtttttttntnttcccctgtgaancncgggggcatgttgggaaggccttggggttntnagagaatggnccagcccctccgacgcttgttcttgccgccctggttgtcctgcccgagtggccatntnnaacacctnccgcactccctccttggtcttggctgagcactcaaggtagccaaaggcactgttnnggttcgccatgtcccggccttcctcagaccgaacgggctcctgctttttcttggccagctctntcctggtgtgctcgtcttgcctnaggtccttctttttnnccaccaggatgatgggcacgtnggggcanacgtgcttnacctctggggtccacttctcaggaatgttttccangctgtcagggctgtcgatggagaagcacatgaggatgacatcagtgtccgggtaggagagaggccgcagtcgatcatantcttcctgccctgctgtgtcccacagagccagctccacctgcttgccgtccacctcaatgtccgcaatatagttctcaaagacagtagggacgtagacctccggaaactgatccttgctgaagacgatna

SEQ ID NO: 684598 - DNA, 848 bp, Homo sapiens
tccttcttttttttatataaagatatttatacatagagaacagacacacgtcatgactctttacatattgtcctatctttcctccgtcccttattttcggcccaataaattttaaaaatgggcccaaaattctcggcctctcacccattcttagggaatcccctcttcccctctattaaaaatatagttataattgacccttgctctgaagcccttaatcacttcgtgtttaaccctccataaagcgtctttctgtccattttttctaaaaagtggtatcaagaggccctattcctagcgtttttcggccccccccggcaatattctgtatttaagaactgcccaacatttcacaccaataaggcctttagaaaaaacactgtaaataataaagtttttcttctagttttattagaaaaacagtatttccccacccctccacaataggcctcaaagatggctttctgtatcaacactggaggaatcacagtctttcaaaccaacatccacacaattgtagcatttcttcccacacaacctgtacttttcaaagcataaaatgctgacatacaacatctaggtcgatggaggaatgccctaaacactttcaaaacactcaaataaggagtaccaccttgttagatccactagtggcaacatgatcatgcggcgactttcttctccaaacacatttttgcgttcgaaaataatgttggccctcttttccaacaaattataaaagagaacgatggcccccatataaaagtggtgatataaattctacatttactgtggggaaaaacacccctaacgggggaaaaacccctaaccccatccccaaacaaaca

SEQ ID NO: 684599 - DNA, 198 bp, Homo sapiens
caggatggagcagttctgggagctgtgtcagctaggcatctgtgagcccaaatggcatgaataaaagggcaggttgctaagagccagggagggcatggggcagagagaccaggttggcccagacatggacagaggtgctccagtggacatgggtgctggatgtgaacgccatggtggacgctggtggaagctgggtac

SEQ ID NO: 684600 - DNA, 576 bp, Homo sapiens
  misc_feature (202)..(202): n is a, c, g, or t
gcaacaagagcaaaacttcatctcaaaaaaaaaaaaaaaagaaaagggaaaaaaacaaaccaacaagctttggaaaccttaggaacaatttgtgggacctgtgttgggagcaggaaatgtggtgctagttgtgctcattgtgacggggtggtgaaccattacccctataacctctctatatctctctatacctgtgtgtgtnggagagacctgtgacccacagaaggactatggaacccatggaagaagagtggatggtggacatggtttgggcattttaattaagtaccatggatctaacccaattggagctaacgggggccacacccattttaatcctttataatggatcacttatgagggctggagtggcagaaatgggagtggtttggtggcgtcaagaggtgggaaggctggtggagggctatgggcaggtaattccaagaaaagaagggtggacaagtgggtttagacttccagtgggtagtggtgggaaatgggacttaattagacttttccagggaaatatatcggatcctagatctaataaggacttggtaatagattagaagtagg

SEQ ID NO: 684601 - DNA, 471 bp, Homo sapiens
  misc_feature (275)..(275): n is a, c, g, or t
cgtcagagtcgagacagctgtcatatggtgaactgttctactaaaatacaaaaatagtggcatgtggtgcgtgctgtagtcccagctacttggaggctgaggcaggatcacttgaacccgggaggtggaggttgccagtgaaccacagattgtgccactagcgctttagcccttgcgtgacagaagcgagactactgtctaaagaaaacaaaacaaataaacaacagaaagaggaaacggtgtcttggaatggggtggctttaggtcccctttgnatgacacagccaaggtctgtaatagccctccccctttactccttgccttgtactccagcctccaggcattgcactccggccagccattgcactctggccagccattgcactccggccagccattgcactccggccagccattgaactccggcaagccattgaactccgggcagacattgcactccggccaggcatt

SEQ ID NO: 684602 - DNA, 627 bp, Homo sapiens
  misc_feature (201)..(202): n is a, c, g, or t
  misc_feature (354)..(354): n is a, c, g, or t
  misc_feature (554)..(554): n is a, c, g, or t
  misc_feature (563)..(563): n is a, c, g, or t
tttacttactgcggctgaggggggcctaattaagacaacattaccagcaaacaggggccatcatccacgtcattcaaggcagacatagataactaccaaacacctatatttagtcaccagacagataacatctaaaggatgtactggcaaacagacttcatccgtttttatgagggggtggtaaaaaaatattaaaccganncaaagaaaagaagtcaccaaagagtatatattcgaggctcttattttactatatatgcccttatcaacaaaatcatcagcaaccaaacccacgacacgtgaatcaaacctaataagagagtaacactcatagtcacaaatccactatccaancaattaataatcaccccaacctttctatctctttcctctttcgctaaagttctgctccccgttttcaccgccttgtttcgtgtcgttccctctccttcctttatacttatactccctctgtccttttttctttcccacctcctttcattattcctctcttttatttctatcttatgtttgttcttcgtctattggttgcntccatcccncgtctttccttctttatctctttttcttgtacttcttctttctatacttttatctaacatttat

SEQ ID NO: 684603 - DNA, 120 bp, Homo sapiens
agaagaaggatctgatgatgatgaaacagaaaatggccccaaatcaaaaaaacgacgtccaccaaaagcagagaagaaaaaggctcccaagccagaacgtctgcctccatcaatgaaggt

SEQ ID NO: 684604 - DNA, 601 bp, Homo sapiens
  misc_feature (255)..(255): n is a, c, g, or t
ggactcctgataatatccaagttatggccctgaaaaccctaaacaatatcctcccaactctcccctgtctgaaacaacaatgacaactttctcatattggtgttctcctctaactttaataaacattagctttacttaacaaacatgttttttcagggtggcgttttgagagagttaatattctctttttacttgtgtagaaactggggtctctcatatgttgctcaggctgggctcgagattcctgcggctcanagctattctcgccacctcagtcctcctgagatagctacggaccacaggttgtgtgccatgcgcatctgtgctaatttctttatttttaacaatttcgtggagagacaaggtctcgctattgttgttccaggctagtcttgaactcctggcttcaaacaatccttctgcctctgcctcctgagtagctgggattacaggtgcacaccagtatacctggctaattttttaaggtttttgtagagaagaggtctcactatattgccctggttggtcttgaactccttgggttccagtgatcctcctaacttgggctcccaaactgttgggattacaggcattagccacc

SEQ ID NO: 684605 - DNA, 205 bp, Homo sapiens
agttgtggctctctgggacagacccatctgacctctcttcctcccaaggctgctcctctccgggccgagctaggtcccaattcttcctcagcctctgcttctccaccctataatctttttatcaccttccctcctcacacctggtccggcttacagtttcgttccgtgactagccctccccgacctgcccagcaacttactctta

SEQ ID NO: 684606 - DNA, 898 bp, Homo sapiens
agcggtccagatccctgggtaatcgataaggaaacccggacgctgctgcccctttcttttgtttcaggcggtccgggaatgatggcggtagcattcagactgacgtcgtgcctacctacataacgcgaggccgaccatgctttcaataagaaagaaggagggtctctgcttggggagaaactggcaaggagatagctcccgcaggtacgtacagagaagcatcgcgtctgtgtgtcttcgatgagcacccgatacgggagtgcatagttgatgggcacaactatcattgacaaggaatctgccccttcacgtggtaatgtgtcctatttgcgaggagcggatccttctctggctgtgggtgaccataagatgaagatgcaagaggagctcaattgttcattcctggcgaggattatcttgcgactaggaatccagacaagtgtcgaaccagtctttcgagaagactgccaccttaagatatcatgtctgtacatccgtgtcgccatcgtgcttcaggggtatcgtccagatcggtgacatcgtcactagtgggcgagtgctcggcctctgagcatatgacaggtgcgcgttcagagcgtggctcagagggtctaccataggcatgtcgtgtaccaatgaatgcacgttccatgaagtgtctgagggctggacatcggcccggctcacccacaaatgaaataagaagttattttcgtcattcccgaacatggaataatgaggattcttcttcaggcgtctcgtactcggagccgttgttgggcctagatcgtttcaacggggggggctcgtttaccaggcttgaggcccctgatgggacgggtaagaatcacaaacttgcggtgaatgggggtgaaaagttgctgcttgggttgaactt

SEQ ID NO: 684607 - DNA, 533 bp, Homo sapiens
atgatctcagctcactgcaacctctgcctccgaggctcaagtgatcctcccacctcagcttcccgagtagccagggctacaggtgaacaacaccacgcccagctaatttttgtatttttgtagaaacaggtccttcctatgttgcccaggctggtctcaaactcctaggcccaagtgatctacccaccttggcctcccacagtgctgggtttacagtcatgagccactgcacctggcccaaagagatttcttgaaaacctctcaggcgggttcgaaaagttggaatttcctggatgtttaattgatagtcaatttgaacattctcgtggtagtggggattatgtacaaataatttgaacctgattgattgttttaccatgttttatttttattttaagcattatttagtttttctgtactacctgactgcactttttggaaaatttgagtaagtcagtaacataggattaagtttgtttgattaaatcttttcttgacagaaataagtcttagaactcttagaccctaggcaa

SEQ ID NO: 684608 - DNA, 177 bp, Homo sapiens
atcgtgctgaagatacctcattgtcagccatccatgctccccatattcctacattctcagcattcccgtaagacaggagcgtctctatccattttctgcctctatccacaacttccttcttctcctataagtccttggtgaggtgatcttctgcacgaggtgatcttctagcacgat

SEQ ID NO: 684609 - DNA, 1391 bp, Homo sapiens
  misc_feature (13)..(13): n is a, c, g, or t
  misc_feature (25)..(25): n is a, c, g, or t
  misc_feature (42)..(42): n is a, c, g, or t
  misc_feature (1379)..(1379): n is a, c, g, or t
agcagtagcgtcncatagaataatnagtatagtatcctgtanctctccttcggtcccctaccttctccatattatgctaattaccggatagatacttagatcttagtgtagtatttttctcactcccttcgtatcatctcacatttctacttcttcgtttttgctgcatcaagtgacctatgaaatagaaactgacttcagataattttaatttcttcatagttcagcttcataatagtaaatatctaaatttttgaagaaagttgatcatttagaagttatgtctgtcttttttaggactcaaatccaaaagcatgaagcaacagctaagcaagaactaatggctaaattatcaacttggaaaactggaaaatctggatggcagagaaatatactatctcaccagtatttgctctcgactcaagaaggttaacattttctgattcatgttagactttgaagagactaaagaaaattttcaagaggaacatatgcctgagaacctttgcatgaatttaaaatttcaattatccattcttataagaaggaagatgattgtaaagaaatatctccgaagttaaaatctgtaataggaattgattcattctctaatgaaaacaaaacataaaaacatcacactaatcttggaggaataagaaaaattgtacatccattaaatgtacaattgattgcaacatcttgattgttttaaccattaacttgtcaaattacaatcacagttaagaaaatgatgtaaaattctgttttgtggatctctttcctagattagcttctgaaatcattattagctatatcatttgaggttttctacaatttggtataactaagaatttaaaaatgttttatcatatatatttgtataattaattactggcatggttaaagtggttttcactttttaaatggagaaaatttcagttaaattaataggataaaccaggttgcgaactggtgacctgtaggccatgtttgcactgcaaatatatttggtctgaatgatattgatattggacacatagtacttttacatgttttgaatgtattgctaatatttaaaaattgagagatcttgcataaacaatagattcccagctttgtcagatgtaatcaaaaagtaatccgatgctttgtcaacaacagacttacattgcccatagcaaccgtcagcttagttgatgggtaatgtagcaaacactattggtttcctaccaaataatcccctttttcctggcttttagaacaataattttgttcacctgcccacttctaggaaagaatatcctatctatctaatctatctagctcagggataaatccctatccttttaagtaagtcaagtcaattaaaataacctcanttttccttgcta

SEQ ID NO: 684610 - DNA, 1222 bp, Homo sapiens
  misc_feature (1210)..(1210): n is a, c, g, or t
tgagtcagatgaagccccatgtgtatgatctgccagtagaaggcaatgagcccccggcctcttttcataaagacacaaacgcacttccccctactgttttcaaggataatccaatgtctacacctaaggactcaaatccaaaagcatgaagcaacagctaagcaagaactaatggctaaattatcaacttggaaaactggaaaatctggatggcagagaaatatactatctcaccagtatttgctctcgactcaagaaggttaacattttctgattcatgttagactttgaagagactaaagaaaattttcaagaggaacatatgcctgagaacctttgcatgaatttaaaatttcaattatccattcttataagaaggaagatgattgtaaagaaatatctccgaagttaaaatctgtaataggaattgattcattctctaatgaaaacaaaacataaaaacatcacactaatcttggaggaataagaaaaattgtacatccattaaatgtacaattgattgcaacatcttgattgttttaaccattaacttgtcaaattacaatcacagttaagaaaatgatgtaaaattctgttttgtggatctctttcctagattagcttctgaaatcattattagctatatcatttgaggttttctacaatttggtataactaagaatttaaaaatgttttatcatatatatttgtataattaattactggcatggttaaagtggttttcactttttaaatggagaaaatttcagttaaattaataggataaaccaggttgcgaactggtgacctgtaggccatgtttgcactgcaaatatatttggtctgaatgatattgatattggacacatagtacttttacatgttttgaatgtattgctaatatttaaaaattgagagatcttgcataaacaatagattcccagctttgtcagatgtaatcaaaaagtaatccgatgctttgtcaacaacagacttacattgcccatagcaaccgtcagcttagttgatgggtaatgtagcaaacactattggtttcctaccaaataatcccctttttcctggcttttagaacaataattttgttcacctgcccacttctaggaaagaatatcctatctatctaatctatctagctcagggataaatccctatccttttaagtaagtcaagtcaattaaaataacctcanttttccttgcta

SEQ ID NO: 684611 - DNA, 1340 bp, Homo sapiens
cactatgcgtctgacgttttacccttcacagaatctttagttctggactgcagttgagtggaaatgggcaacggcgggcggagcggcctgcagcaggggaaggggaacgtggatggggtggcagcgactcctactgctgcctcggcctcctgccagtacaggtgcatcgaatgcaaccaggaggccaaagagttgtaccgagactataaccacggtgtgctgaagataaccatctgtaaatcctgccagaaacctgtagacaaatatatcgagtatgatcctgttatcatcttgattaatgctatattgtgcaaagctcaggcctacagacatattcttttcaatactcaaataaatatccatggaaaactctgcatattttgtttgctttgtgaagcatacctgaggtggtggcagcttcaagattccaaccagaatactgcccctgatgacttgatcagatatgctaaggaatgggatttctatagaatgtttgcgattgctgctttagaacaaactgcctattttattggcatttttaccttcctgtgggtagaacggcccatgacggcaaaaaaaaagcccaacttcattttgctgctgaaagcattattattatctagctacggaaaactcttgctgattccagctgtcatttgggaacatgactacacatctgtgtgcctcaaactcattaaagtatttgttcttacatcaaattttcaggcaattagagtgaccctaaacatcaaccgtaagctctccttcttggccgtgttgagtggcttactgctggaaagcatcatggtctacttcttccagagtatggaatgggatgttggaagtgattatgccatctttaaatctcaggacttctgaagagttttattcttcttcactatctgtggcatgaccagctgtatctgaaagagaaaagacatgaaatataaaccaacctcctcatttctgttgagtaaaatgaagcaaagattggaaacactttctgaaaaagaaagcaatgataatagcggtggatacccacccccacaaatgcacccaagagacaagccatttacatacagatattcacagtcacacatagaaacacccacatggacacaaggaatgttgctgcagagactgaatgacatgcaacaggtgaaggtttatacgttatacacaaggccaggtaagcgctcataattcacacataataaaacatctaggtttcattcctttgacatgtttatatctttttaatttaaatgttgttactggcttaaaatattttgtgttcttacaatagaaacgcttttaataaagtctttcagaataaacca

SEQ ID NO: 684612 - DNA, 422 bp, Homo sapiens
ggtctcacttcgctttgagctcacacctcaattaggaatgagttagcacttcagaagggattggaccagatggatgcctgggtggggagaggggcaggaggaagaggctgcccacagctctgcccagctgccctggtgtggctcagaccctcttgggggcttggatcgcttgcttgtgctttgccccctcacgctgaacatccgccgtgagcggagactcaccctgtggggtggaagtcagcagaaccctcccagaacagaagggcccaaaggcgaggcgtgaacactcacaaggagagaagacagcccactgtggatctgtgccaccggcctcccgtctgcaagaacattggcttttgtttccttagctcaatcttagaactgtacacgaaatgcttagtaaatgtgatttgaatgaaaaa

SEQ ID NO: 684613 - DNA, 1484 bp, Homo sapiens
cactatgcgtctgacgttttacccttcacagaatctttagttctggactgcagttgagtggaaatgggcaacggcgggcggagcggcctgcagcaggggaaggggaacgtggatggggtggcagcgactcctactgctgcctcggcctcctgccagtacaggtgcatcgaatgcaaccaggaggccaaagagttgtaccgagactataaccacggtgtgctgaagataaccatctgtaaatcctgccagaaacctgtagacaaatatatcgagtatgatcctgttatcatcttgattaatgctatattgtgcaaagctcaggcctacagacatattcttttcaatactcaaataaatatccatggaaaactctgcatattttgtttgctttgtgaagcatacctgaggtggtggcagcttcaagattccaaccagaatactgcccctgatgacttgatcagatatgctaaggaatgggatttctatagaatgtttgcgattgctgctttagaacaaactgcctattttattggcatttttaccttcctgtgggtagaacggcccatgacggcaaaaaaaaagcccaacttcattttgctgctgaaagcattattattatctagctacggaaaactcttgctgattccagctgtcatttgggaacatgactacacatctgtgtgcctcaaactcattaaagtatttgttcttacatcaaattttcaggcaattagagtgaccctaaacatcaaccgtaagctctccttcttggccgtgttgagtggcttactgctggaaagcatcatggtctacttcttccagagtatggaatgggatgttggaagtgattatgccatctttaaatctcaggacttctgaagagttttattcttcttcactatctgtggcatgaccagctgtatctgaaagagaaaagacatgaaatataaaccaacctcctcatttctgttgagtaaaatgaagcaaagattggaaacactttctgaaaaagaaagcaatgataatagcggtggatacccacccccacaaatgcacccaagagacaagccatttacatacagatattcacagtcacacatagaaacacccacatggacacaaggaatgttgctgcagagactgaatgacatgcaacaggtgaaggtttatacgttatacacaaggccaggtaagcgctcataattcacacataataaaacatctaggtttcattcctttgacatgtttatatctttttaatttaaatgttgttactggcttaaaatattttgtgttcttacaatagaaacgcttttaataaagtctttcagaataaaccaagtttttgtaaattttcaattcaataattaaggtaatctttaaaattggatgatccaaaaataagtgataatgaaaaccactgagttatatactttgcaagggtaaattacatctgaataaagctgtaattaaaaacaaaaaaa

SEQ ID NO: 684614 - DNA, 160 bp, Homo sapiens
caccccacaacaaataattaaccaacccctaatattaatacttccaaagttcaaaaaccctctactataacatccttctctcttacccattattaactaaaaatcccatagttcttattttctctactacctataatatttcacccatttattttacaat

SEQ ID NO: 684615 - DNA, 583 bp, Homo sapiens
atgggatgttggaagtgattatgccattccatactctggaagaagtagaccatgatgctttccagagtatggaatgggatgttggaagtgattatgccatctttaaatctcaggacttctgaagagttttattcttcttcactatctgtggcatgaccagctgtatctgaaagagaaaagacatgaaatataaaccaacctcctcatttctgttgagtaaaatgaagcaaagattggaaacactttctgaaaaagaaagcaatgataatagcggtggatacccacccccacaaatgcacccaagagacaagccatttacatacagatattcacagtcacacatagaaacacccacatggacacaaggaatgttgctgcagagactgaatgacatgcaacaggtgaaggtttatacgttatacacaaggccaggtaagcgctcataattcacacataataaaacatctaggtttcattcctttgacatgtttatatctttttaatttaaatgttgttactggcttaaaatattttgtgttcttacaatagaaacgcttttaataaagtctttcagaataaacca

SEQ ID NO: 684616 - DNA, 1241 bp, Homo sapiens
  misc_feature (730)..(730): n is a, c, g, or t
cactatgcgtctgacgttttacccttcacagaatctttagttctggactgcagttgagtggaaatgggcaacggcgggcggagcggcctgcagcaggggaaggggaacgtggatggggtggcagcgactcctactgctgcctcggcctcctgccagtacaggtgcatcgaatgcaaccaggaggccaaagagttgtaccgagactataaccacggtgtgctgaagataaccatctgtaaatcctgccagaaacctgtagacaaatatatcgagtatgatcctgttatcatcttgattaatgctatattgtgcaaagctcagggccgtagcatggactatattctgtctttgcaagtatcgtcaagactacatactattcacgatcggatagaacctccttgccatacttgtctcgttgtagcatgtttgttgaaggcacttagcctgagggttgggtggcaggccttcgacaggattccaaacgcaaggatagtactggcctccgttgagtggacgtattgcagtccagagtattgcgtgatagggagagtaggggaatgtgtccttactaagggaacagtggtctatggcagatttggccttggcatgtttaggaaaactaaaaattttgtcgccttatatttgggccaattgttggggccaatttgtgtgtaaactcggttttccccttggctaggggggctcagagcaaacggtggggcccccagtnggcaacagggggcgtagacattacagacattaacgcccgcggagtacgtctcccattgtgtttaaggcgtaaggcgattcggaaaaacgcctatgtgactctaaatttgcaatgcgctggaagcccttgagcggtgagacagaaacctcgcttatgggcgcttggggaatttccccgaggggcgtggtttaccgaattgttgaggggtgaaacacccgattggtatctttaggcagcaattggctcgtttgttttggccccactcctataaaatccgtttcagacttcttaaggaagagggctacggttgtcagggggttctccacttgtaagcgaattttccacaaatgtgtgtctattaccgaggggggacgaacaaatgttaaggcacaggtaggaaacctccccggttaagacacattgaatttcgaaactcccgggtaaaaagagccgcttccgtccgccggttatcctgttgtgaggcccggggtgggtttcgggaaccgcgtgg

SEQ ID NO: 684617 - DNA, 438 bp, Homo sapiens
  misc_feature (190)..(190): n is a, c, g, or t
ttattcgttaacaatgggggtaaagagctatatacatgaaaatgagttttataaaattaagtgaagggcaaataaaagccctggttctataaaacattttggaaaggttgtttaataaggggattatccctttgatctaaagcaatgtggttttttttttaaaaaaaaaaacaggggggtttcctttttnggggggtttctttgggttaagcccttcatcaaatgctttatttgggatttgggaagtaatttgcaattttttttggtttttttaaaatttgatttggtataaaattgccaaaaaaaagggtttcaaaaacatagtttggacctggatttttattttaatgcctcaaggttttgtaagtcatttttaattggccaaagattgtagaccctgcttgaggattttttttaataaaacaaagccaatcccca

SEQ ID NO: 684618 - DNA, 1059 bp, Homo sapiens
acatagatgtgtgacaatgagcacgaaactccttatagaaagagtcaaaacaagagaagatggcgtgtagagataagagcatgcaagacctgcttgagcactgggccactttactactgtccgacacggagcctcatttactgcaacagtggcaagaatggttatgccttgtcagcacatcttatccaagcaacaggaaaggataaattcacagcagggaagagcatagaaagacaacggcacaatgttagcacaagcggaaacctccatgccatgggtcaggcccctcctgcaaccaatgagcagaaacacgcggacacacagcaagaccaatggagctgaaaactgaaaccgttacaccgttaagcagaactaccacttgaaccacgaagacacatcttcaaactcacgatccagcgtcactcttaacacacaggagcgaccgccagacgatccaggcacgacgcatggcagagacctagaacacgggtcagcacacactctcacactatcacgggaacctacaccacaggataccatcactgaccgataccttcaccaaccctcacacgactcatccaaccgctcaacctgccacgactcatccgacgtcacaccgttccagggctagcaggcacggctctcacgtgccacttaccacatgccactctgcatcctaccccgaggcacacactacgtagcctgttgaacactttcaagcaggtataacctacaaaacctgggagaagcaagacacgtcacaggccgcactctcacccaccagccactgcactgtaacgggacatcaccggattccctaaacgcaggtgacaccatccccagcagagtaagtcacgccctgctctgcaataccagctgaacacgagggaatcagggaccccgcgccgcgcacacgcgacttagactagtacctgaggacacgaaacactagtccggcccctcactaccatgaacgcatcgatacagcctaacggtccggacaaaacagtgccccgcatcactaataacgtagacccctcgaacgccaccaaccgaact

SEQ ID NO: 684619 - DNA, 1399 bp, Homo sapiens
  misc_feature (1359)..(1359): n is a, c, g, or t
cactatgcgtctgacgttttacccttcacagaatctttagttctggactgcagttgagtggaaatgggcaacggcgggcggagcggcctgcagcaggggaaggggaacgtggatggggtggcagcgactcctactgctgcctcggcctcctgccagtacaggtgcatcgaatgcaaccaggaggccaaagagttgtaccgagactataaccacggtgtgctgaagataaccatctgtaaatcctgccagaaacctgtagacaaatatatcgagtatgatcctgttatcatcttgattaatgctatattgtgcaaagctcaggcctacagacatattcttttcaatactcaaataaatatccatggaaaactctgcatattttgtttgctttgtgaagcatacctgaggtggtggcagcttcaagattccaaccagaatactgcccctgatgacttgatcagatatgctaaggaatgggatttctatagaatgtttgcgattgctgctttagaacaaactgcctattttattggcatttttaccttcctgtgggtagaacggcccatgacggcaaaaaaaaagcccaacttcattttgctgctgaaagcattattattatctagctacggaaaactcttgctgattccagctgtcatttgggaacatgactacacatctgtgtgcctcaaactcattaaagtatttgttcttacatcaaattttcaggcaattagagtgaccctaaacatcaaccgtaagctctccttcttggccgtgttgagtggcttactgctggaaagcatcatggtctacttcttccagagtatggaatgggatgttggaagtgattatgccatctttaaatctcaggacttctgaagagttttattcttcttcactatctgtggcatgaccagctgtatctgaaagagaaaagacatgaaatataaaccaacctcctcatttctgttgagtaaaatgaagcaaagattggaaacactttctgaaaaagaaagcaatgataatagcggtggatacccacccccacaaatgcacccaagagacaagccatttacatacagatattcacagtcacacatagaaacacccacatggacacaaggaatgttgctgcagagactgaatgacatgcaacaggtgaaggtttatacgttatacacaaggccaggtaagcgctcataattcacacataataaaacatctaggtttcattcctttgacatgtttatatctttttaatttaaatgttgttactggcttaaaatattttgtgttcttacaatagaaacgcttttaataaagtctttcagaataaaccatgtaggcgtgccagacctnatcacacccacactcaacacacaacagaaactactactta

SEQ ID NO: 684620 - DNA, 105 bp, Homo sapiens
gctggcgatagctgtattatataatatactctctagagcaacccctctaagcacaagtgatacacgccgatccactcaacactcgtatggtgtacgcagtggctc

SEQ ID NO: 684621 - DNA, 1064 bp, Homo sapiens
  misc_feature (1064)..(1064): n is a, c, g, or t
cgtccgttatcagcgagatccgagaagaataccctgatcgcatgatgaataccttcagatgtggatgcctgtcagctccaaagctgtctgagcaccgtggtcgaggcccgtgacaagtgccagccgctctccgtccatcagttggtaggagaatactgatgagagcctattgcagttgtacagacgtagagccctcgttatgatactctggcgtatcacgcatctcatgagagctggaccacagccgaacgctatcggggactctgaagccatgcttgtcgtcagccagcatgagtggtgtcaccatcctgcgctccgtcatcccgtggccagctcaatgctgacctccgcagagtgggcagtcaacatggtccccttcccacgtctccatttctttatgccgtggctttgcccctctcaccagccgtggaagccagcagtatcgagctctcactagtgccggaactcagccaggaggtcttcgatgccaagaacatgatggctgcctgtgagccccggcacgtgcgatacctcaccgtggctgcatgtcttccgtggtcggatgtccatgaaggaggtcgatgagcagatgcttaacgtgcagaacaagagcagcagctactttgtggaatgcgatccccaagcaatgtcaaggacagcggcctgtgacaatcccagctcgtggcctcatagatgggagtcacctttcattgggaataggacaaggcatccaggagggtcttcaaggggatgtcggaagcaggtcattggccatgtgcccggccaggaagcgctttccttcacatgcgtacccaagggcgaagaggcatgggacgaaaaaggagtaaaccagaggggtgtaacacgacatgtaaaagaccctgtcttgcaaatctacagggaaccagagagggggccccgcgaaaaacagaggagagacacataagagggggccacacaaagcgcctacgagaaacaccaacaaacagaaaggaggcagagagacacaacagcggaacagaaacaggccgactcataccgcacaaagaggtagggcggcgaan

SEQ ID NO: 684622 - DNA, 1547 bp, Homo sapiens
cactatgcgtctgacgttttacccttcacagaatctttagttctggactgcagttgagtggaaatgggcaacggcgggcggagcggcctgcagcaggggaaggggaacgtggatggggtggcagcgactcctactgctgcctcggcctcctgccagtacaggtgcatcgaatgcaaccaggaggccaaagagttgtaccgagactataaccacggtgtgctgaagataaccatctgtaaatcctgccagaaacctgtagacaaatatatcgagtatgatcctgttatcatcttgattaatgctatattgtgcaaagctcaggcctacagacatattcttttcaatactcaaataaatatccatggaaaactctgcatattttgtttgctttgtgaagcatacctgaggtggtggcagcttcaagattccaaccagaatactgcccctgatgacttgatcagatatgctaaggaatgggatttctatagaatgtttgcgattgctgctttagttaacttgcttcagaaacactggatgagcttccaccttaaggcctttgaagtggctcttcctgtgcccggaatgcctgtccccctgatgcccagatgtctgactcctgcatacccctcaagagttggctaaaatgacactttctaaatgaagtgtacctctgacactcctgatctcctgttccggctctactttgttttgcttatagaacaaactgcctattttattggcatttttaccttcctgtgggtagaacggcccatgacggcaaaaaaaaagcccaacttcattttgctgctgaaagcattattattatctagctacggaaaactcttgctgattccagctgtcatttgggaacatgactacacatctgtgtgcctcaaactcattaaagtatttgttcttacatcaaattttcaggcaattagagtgaccctaaacatcaaccgtaagctctccttcttggccgtgttgagtggcttactgctggaaagcatcatggtctacttcttccagagtatggaatgggatgttggaagtgattatgccatctttaaatctcaggacttctgaagagttttattcttcttcactatctgtggcatgaccagctgtatctgaaagagaaaagacatgaaatataaaccaacctcctcatttctgttgagtaaaatgaagcaaagattggaaacactttctgaaaaagaaagcaatgataatagcggtggatacccacccccacaaatgcacccaagagacaagccatttacatacagatattcacagtcacacatagaaacacccacatggacacaaggaatgttgctgcagagactgaatgacatgcaacaggtgaaggtttatacgttatacacaaggccaggtaagcgctcataattcacacataataaaacatctaggtttcattcctttgacatgtttatatctttttaatttaaatgttgttactggcttaaaatattttgtgttcttacaatagaaacgcttttaataaagtctttcagaataaacca

SEQ ID NO: 684623 - DNA, 1438 bp, Homo sapiens
cactatgcgtctgacgttttacccttcacagaatctttagttctggactgcagttgagtggaaatgggcaacggcgggcggagcggcctgcagcaggggaaggggaacgtggatggggtggcagcgactcctactgctgcctcggcctcctgccagtacaggtgcatcgaatgcaaccaggaggccaaagagttgtaccgagactataaccacggtgtgctgaagataaccatctgtaaatcctgccagaaacctgtagacaaatatatcgagtatgatcctgttatcatcttgattaatgctatattgtgcaaagctcaggcctacagacatattcttttcaatactcaaataaatatccatggaaaactctgcatattttgtttgctttgtgaagcatacctgaggtggtggcagcttcaagattccaaccagaatactgcccctgatgacttgatcagatatgctaaggaatgggatttctatagaatgtttgcgattgctgctttaggctggagtgcagtggcacagtcacagctcactgcagccctgaactcctgggctcaagcaatcctcctgcctcggccccccaggtagctggaaccacagaacaaactgcctattttattggcatttttaccttcctgtgggtagaacggcccatgacggcaaaaaaaaagcccaacttcattttgctgctgaaagcattattattatctagctacggaaaactcttgctgattccagctgtcatttgggaacatgactacacatctgtgtgcctcaaactcattaaagtatttgttcttacatcaaattttcaggcaattagagtgaccctaaacatcaaccgtaagctctccttcttggccgtgttgagtggcttactgctggaaagcatcatggtctacttcttccagagtatggaatgggatgttggaagtgattatgccatctttaaatctcaggacttctgaagagttttattcttcttcactatctgtggcatgaccagctgtatctgaaagagaaaagacatgaaatataaaccaacctcctcatttctgttgagtaaaatgaagcaaagattggaaacactttctgaaaaagaaagcaatgataatagcggtggatacccacccccacaaatgcacccaagagacaagccatttacatacagatattcacagtcacacatagaaacacccacatggacacaaggaatgttgctgcagagactgaatgacatgcaacaggtgaaggtttatacgttatacacaaggccaggtaagcgctcataattcacacataataaaacatctaggtttcattcctttgacatgtttatatctttttaatttaaatgttgttactggcttaaaatattttgtgttcttacaatagaaacgcttttaataaagtctttcagaataaacca

SEQ ID NO: 684624 - DNA, 1852 bp, Homo sapiens
cactatgcgtctgacgttttacccttcacagaatctttagttctggactgcagttgagtggaaatgggcaacggcgggcggagcggcctgcagcaggggaaggggaacgtggatggggtggcagcgactcctactgctgcctcggcctcctgccagtacaggtgcatcgaatgcaaccaggaggccaaagagttgtaccgagactataaccacggtgtgctgaagataaccatctgtaaatcctgccagaaacctgtagacaaatatatcgagtatgatcctgttatcatcttgattaatgctatattgtgcaaagctcaggcctacagacatattcttttcaatactcaaataaatatccatggaaaactctgcatattttgtttgctttgtgaagcatacctgaggtggtggcagcttcaagattccaaccagaatactgcccctgatgacttgatcagatatgctaaggaatgggatttctatagaatgtttgcgattgctgctttagaacaaactgcctattttattggcatttttaccttcctgtgggtagaacggcccatgacggcaaaaaaaaagcccaacttcattttgctgctgaaagcattattattatctagctacggaaaactcttgctgattccagctgtcatttgggaacatgactacacatctgtgtgcctcaaactcattaaagtatttgttcttacatcaaattttcaggcaattagagtgaccctaaacatcaaccgtaagctctccttcttggccgtgttgagtggcttactgctggaaagcatcatggtctacttcttccagagtatggaatgggatgttggaagtgattatgccatctttaaatctcaggacttctgaagaggtcctgcagtgcccttgtctccacctaaccagatacggtcagctttgcctctccatggaataagtgaagactttccaaaaactccagtttgcagtgcttactttttccgttgacctccgagtgctcagcttaacacctacagcagtcacgtgcccaagaacttctgacattgccccagggtcagatcttttgtttctacttttcataagtgcatctgcttgtctgacaatcaattataatttatagttaggaaaataaggtcacatatcttgaatcacttgaaagccattaccctgtattgtattatcttatgtttatacttatctatgtctgtctggtattacaatttcatgtgtttatgcctcactctcccagcctgttcagaagtctggtgctgggagaggcatgccttgggttccttgtatccaccttaactcagggcctgccctagtgtcatgtcagttggattttcagcagaatgtggcattctaaatacatcctttattatcacattttattcttcttcactatctgtggcatgaccagctgtatctgaaagagaaaagacatgaaatataaaccaacctcctcatttctgttgagtaaaatgaagcaaagattggaaacactttctgaaaaagaaagcaatgataatagcggtggatacccacccccacaaatgcacccaagagacaagccatttacatacagatattcacagtcacacatagaaacacccacatggacacaaggaatgttgctgcagagactgaatgacatgcaacaggtgaaggtttatacgttatacacaaggccaggtaagcgctcataattcacacataataaaacatctaggtttcattcctttgacatgtttatatctttttaatttaaatgttgttactggcttaaaatattttgtgttcttacaatagaaacgcttttaataaagtctttcagaataaacca

SEQ ID NO: 684625 - DNA, 172 bp, Homo sapiens
  misc_feature (7)..(7): n is a, c, g, or t
  misc_feature (83)..(83): n is a, c, g, or t
  misc_feature (125)..(125): n is a, c, g, or t
  misc_feature (170)..(170): n is a, c, g, or t
gaggggngggggggggcggagggggggcgggcggcgggggggggcgcgaagggcgggcggggggggaacacaagaaagacacnaggaaaaagagcgggggcggcaaagagagagagggggggagnggaggggggggggggggaggagcgagggcgcgggggggggcgggngg

SEQ ID NO: 684626 - DNA, 1286 bp, Homo sapiens
cactatgcgtctgacgttttacccttcacagaatctttagttctggactgcagttgagtggaaatgggcaacggcgggcggagcggcctgcagcaggggaaggggaacgtggatggggtggcagcgactcctactgctgcctcggcctcctgccagtacaggtgcatcgaatgcaaccaggaggccaaagagttgtaccgagactataaccacggtgtgctgaagataaccatctgtaaatcctgccagaaacctgtagacaaatatatcgagtatgatcctgttatcatcttgattaatgctatattgtgcaaagctcaggcctacagacatattcttttcaatactcaaataaatatccatggaaaactctgcatattttgtttgctttgtgaagcatacctgaggtggtggcagcttcaagattccaaccagaatactgcccctgatgacttgatcagatatgctaaggaatgggatttctatagaatgtttgcgattgctgctttagaacaaactgcctattttattggcatttttaccttcctgtgggtagaacggcccatgacggcaaaaaaaaagcccaacttcattttgctgctgaaagcattattattatctagctacggcctcaaactcattaaagtatttgttcttacatcaaattttcaggcaattagagtgaccctaaacatcaaccgtaagctctccttcttggccgtgttgagtggcttactgctggaaagcatcatggtctacttcttccagagtatggaatgggatgttggaagtgattatgccatctttaaatctcaggacttctgaagagttttattcttcttcactatctgtggcatgaccagctgtatctgaaagagaaaagacatgaaatataaaccaacctcctcatttctgttgagtaaaatgaagcaaagattggaaacactttctgaaaaagaaagcaatgataatagcggtggatacccacccccacaaatgcacccaagagacaagccatttacatacagatattcacagtcacacatagaaacacccacatggacacaaggaatgttgctgcagagactgaatgacatgcaacaggtgaaggtttatacgttatacacaaggccaggtaagcgctcataattcacacataataaaacatctaggtttcattcctttgacatgtttatatctttttaatttaaatgttgttactggcttaaaatattttgtgttcttacaatagaaacgcttttaataaagtctttcagaataaacca

SEQ ID NO: 684627 - DNA, 306 bp, Homo sapiens
cccctttggatttttttgggccccccaaaaaaacccggaattttagtttcccccccgccgggggggtgggggccaaagaaaaaattttaaaatagaaaggtggtttttaattttttttcccggggaggcgggttcccgccccttttaaattgggcaaagttttttatggaatttccggggcaaggttttgggggcgggttaaagggggggaattcccccccccctttttaaaaacaaaacccggggttttttctgggcccccgttttaaaggctataaaaaagggcctttgccttttttttgttta

SEQ ID NO: 684628 - DNA, 1384 bp, Homo sapiens
cactatgcgtctgacgttttacccttcacagaatctttagttctggactgcagttgagtggaaatgggcaacggcgggcggagcggcctgcagcaggggaaggggaacgtggatggggtggcagcgactcctactgctgcctcggcctcctgccagtacaggtgcatcgaatgcaaccaggaggccaaagagttgtaccgagactataaccacggtgtgctgaagataaccatctgtaaatcctgccagaaacctgtagacaaatatatcgagtatgatcctgttatcatcttgattaatgctatattgtgcaaagctcaggcctacagacatattcttttcaatactcaaataaatatccatggtcaagattccaaccagaatactgcccctgatgacttgatcagatatgctaaggaatgggatttctatagaatgtttgcgattgctgctttaggctggagtgcagtggcacagtcacagctcactgcagccctgaactcctgggctcaagcaatcctcctgcctcggccccccaggtagctggaaccacagaacaaactgcctattttattggcatttttaccttcctgtgggtagaacggcccatgacggcaaaaaaaaagcccaacttcattttgctgctgaaagcattattattatctagctacggaaaactcttgctgattccagctgtcatttgggaacatgactacacatctgtgtgcctcaaactcattaaagtatttgttcttacatcaaattttcaggcaattagagtgaccctaaacatcaaccgtaagctctccttcttggccgtgttgagtggcttactgctggaaagcatcatggtctacttcttccagagtatggaatgggatgttggaagtgattatgccatctttaaatctcaggacttctgaagagttttattcttcttcactatctgtggcatgaccagctgtatctgaaagagaaaagacatgaaatataaaccaacctcctcatttctgttgagtaaaatgaagcaaagattggaaacactttctgaaaaagaaagcaatgataatagcggtggatacccacccccacaaatgcacccaagagacaagccatttacatacagatattcacagtcacacatagaaacacccacatggacacaaggaatgttgctgcagagactgaatgacatgcaacaggtgaaggtttatacgttatacacaaggccaggtaagcgctcataattcacacataataaaacatctaggtttcattcctttgacatgtttatatctttttaatttaaatgttgttactggcttaaaatattttgtgttcttacaatagaaacgcttttaataaagtctttcagaataaacca

SEQ ID NO: 684629 - DNA, 407 bp, Homo sapiens
tgcacttttacactctgaaaccactgatactactagaagcaaggagacagcccaaccagcccgtgacataagacagagcaaatattcttgtgtaagtacacaccagcacaggcaaccagagcaaaaatagacaattgggattacataatgctaaaaagcttctgcaccacacaggaaacaacaaactgaatagacaaaccacagatagagagaaaatctttgcaatctaactgacaagggactaataacctgaatatataaagaactcaaacaactaaatagcaaagaaacaaataatttcatttctaaaaatgggcaaaaaattgggacaaacatttttcaaaaagaagacatacaaatggcctacagttatattttttaaatgtttgacattgctaatcatcaga

SEQ ID NO: 684630 - DNA, 111 bp, Homo sapiens
gccatcactattgtctggagtggtgcaggccctgcgagccgcctgttgcccagcctgggccccaggaccaccgagccccctgacccacacgcagtctgcctgagtgaggcg

SEQ ID NO: 684631 - DNA, 407 bp, Homo sapiens
tgcggcatccgtaggaaggtccaaaagatacgtccttatccctcttaataagtacctttaaaattcggtcatgggccagtaagtctgagatgtatcttcatttttctcttctaaaaataattccattttcaggaggaaaaaatatgattgattccggcttcccagttttccctcggtcaccctgtgtaaattggtccggattttccatttatttatggggggggctggcagttaaaaaataaagtagcgggccagggaagtgcacgcctgagtcccaggctagtgggaaagcggaggctagaggatcactggagccccagatttcaagcacagccggggcaccacagcaagcccctgtctccaaaccaaaccaaacaaaacccggaagggggccaataataaatatt

SEQ ID NO: 684632 - DNA, 240 bp, Homo sapiens
  misc_feature (223)..(223): n is a, c, g, or t
tggtgagctcggaatgctgtacatgattctagttttggcgaatacgttattttttcatataaacagtctcctaattacaggccaactatttcatatggtattccaagctttgtgcgtggcatatacacaacaaccatgtttatatactttaagtttctggggtcatttgacgatattttccatagataattttgacttatttgggaatcctcacgtttatgtngtaaacatttacacacg

SEQ ID NO: 684633 - DNA, 282 bp, Homo sapiens
tgtgactggcgactgatgctacatcagagagtaaaagttgagtgttgggagaacgacaggatcgaacaactcgattctgttgggggagtctgacgagactttacaatgatggtgttagggtcgacggtcttacaggatcaataggatcctttgttgtggtcgtgtttgctgacagagtgtcactccatcgcccatgggtgtaagtgtcatcggcatggtagtcagctcatgagaagctctgtgtccggatgtcggtggtccagaaaggttaccgtgcacgaa

SEQ ID NO: 684634 - DNA, 256 bp, Homo sapiens
cccaaaggggggaatttttaaaataaataatcccccagtttttggcctttttttaaattaatttttccttttttttaaaataaaataccccaaaaagggtaaagttccaaaaaatgtcgttgaagaataatattttaaaactgtggaaaaaaaggaaaaagacccgtccccaaattttaagattaatatgaaggtcataatttaacataaaagaatattttttatgggtttgtcataaataaataatgaaacccta

SEQ ID NO: 684635 - DNA, 264 bp, Homo sapiens
cgcatcacatttgcatggtaagggcagggcaccgttgcccctcgctctgttcatgtacaaggcatgcgtagcgcatgggcagggcgcatgcaggcctcaagcatgcatggcgggccaggcatcagttccagcacaggttgcgtcatattccgtgcagacgtcttgcagcatcgttcagtcattcagattcagtctttgctctgtgcagtgcttcaggcacacacagggccatcaccaggcacctcaggcacagccagcatcaca

SEQ ID NO: 684636 - DNA, 414 bp, Homo sapiens
  misc_feature (40)..(40): n is a, c, g, or t
  misc_feature (46)..(46): n is a, c, g, or t
gataccgataatgtattaatgaaactggagaactagctantttaanacgcgaactctagaggaccgctctgaaaagcaaatattcaacccctaagtgttttaataagtctacagtttaatatattaggttgttaaaaggaggctgtaattatgaagaaacccatagccaatcctagcctagcacctcatagcaatcgtgagagtgaaggaaaatattgttctgccttgctaagttcaaagacaacgccacctgtcaatagagtggtacctggccaacaatcagcagaattaatcatgcaggcacaggccttagagacatgaggcatggcaaggtggggatattaggatatacacaagaggaaacacacacacaaacaaagcctttgttcacaaagcagacgaccagcttgcaga

SEQ ID NO: 684637 - DNA, 197 bp, Homo sapiens
agaaggctggtaggggcatccgagatcattaaaacgggctgacccgataacaataggtacgaagaatataaaatgtagaataagagaatacaaacaaatttcctttttgaagtacttttaagaaaaagaagcagggtcgctggaagtgtggttctttgtgcctcccacgggtcgcaaatcctcatggtttgggttgg

SEQ ID NO: 684638 - DNA, 1332 bp, Homo sapiens
ggcgagaccgtggccaagacaggtgcatcccagggccccacgaccccagtggaccgctctgtcagggacgtagatccggccctggaaactcaatgaccaatgcacgcagaatcctgaacgcatgcggcagccaggcgtccatgaaggctgcatcttcctgctagtcggtgagtggccatcgcacgcacgtcgtcatctgcaccgggaagtcgccgagccgtcagtccagggatcatgcagcaaggggcgcccgtatcggtccgagtggttgaccccgtctgccagagcataggggccacacgaattgccgcgcaatgcacgggcactgctagacgcgaactcccaatgggagcgccaaggactccgcagatggcacttactcctgtgcaatatggggccacctctaggagcgcttgtgcgccaacttcacaggactaggaaacgcgctaatctcccggaatggacaaactccaggacgtagacagcgttggacccatatgtgccgtccccaatgaggtggacctgtgggggccgacaatagcttagccgctgatgaagcccgaaatatacgcgctagtggacatagcgggcaaaggccccaatttccaatttgccttgttatcgcacaacacatagcttggcaattgccgatccagtgggcgttaccttactgcaggcacccccaagccaatgtgcaagcatgtgggtgactacgaaggatccagggctcgcgtttgaccctagcttcccacgttggcccccttaacaacgtggaccccaaggtcatgctaacctcaacctcttaatggaaatatcaaaggtcgggcccgcgtgtgtacacatggggcggttgggtcgcccaatgaggcacggttctccggacctgacgtggtacacgcatcggcctccgcggggccacagggcggtcccgcaaaaggaaccctttcggcaacacatacaggggccacatcaattcaaagaactgtagcccttggctcttgcttttgtgtccccttagactgagttgctattaccattgggaggactaaatcgaaaagcaaagaatggtttccaagcttggtgggcccattttggtcgaagaccccctgggggagaccattcaccaacaagggtcacagggtcgccaaccagcgccccatatttttgtagccagaaaactggagatgatgtgtggtgtcacccacccaccatcgtgtttagctatccgcgccacacacacgcagtcgagtcagggcagagcacaacatactattgactcgagtcaatcagctggtgcgtgcgctgatgccccaccactaatcatacaagcga

SEQ ID NO: 684639 - DNA, 688 bp, Homo sapiens
cgtgggttgggttgacattagggatataaaatctaccgcagggttatgcgtaagagaatgttttcatgtccttagccaagccttgtgtttctatacgtcataggttggtcaattgcgttcatgaggtcagtgatacgttcgcagtgcttagctaatgggtgttgatcttagacgcgtccttgatgggtgcccggttctagtcgtacgaagcatgttcatttttcgactctctggcacgagttagttcgtagtgtaagcgacatgatcattttgagactatcagctaactggcaaaaggatttagagggtgctattggccatttgatcgctgacctgtgttacgatcttgggcacacagaatactcctggctaggtaggttagtcgcctccgcctatcagtctggccactgttttcctacatagctggcagtgctctgtcagctgctcatagtgagcacgacgtgtttccggcctgtgatcggtggctctgcacaccgggttgtcaccagtcatcttggtcacctcttggtatactcgccgctccagcacatcatgaatggagtcctcctctaagagtcggccttggcgaatgcaattctctgctttgttgaatctaacagatctcgtcaccgtctgctcagccttgctgaggtcacagtcagcatagatgataaggggtgacttagcg

SEQ ID NO: 684640 - DNA, 133 bp, Homo sapiens
atgtggagaagagtgtatcccagctccagcaaacagatggacatattcgccttatctttgtttttattttatctgggcccccagcctattagatggtgcccaccctcatggagggtagattttcctcacctgg

SEQ ID NO: 684641 - DNA, 121 bp, Homo sapiens
tctctctgtgtggcttactgagtcgaagtgctggagaagttcttgccacgccttatgggtggacaggcccccttttctgtggggtcgtccagccgtggtgtggaccagtgagcacagcctt

SEQ ID NO: 684642 - DNA, 124 bp, Homo sapiens
tcctcggctagataggctgttcacctgccggtggtctgaggagtgcccacctatgctagacgccacacagacagcagcagcagcaggtggcagcctgtgagggccgggcctttgacaacgagca

SEQ ID NO: 684643 - DNA, 135 bp, Homo sapiens
aagaaaaccccttaaatgaaaaattcctaatgaacccggggggccgggtttgggcggcccccataaaaaacccgaaccccctaagggcctttatttttggtccccgtaaaatttccaatttttggggttttttta

SEQ ID NO: 684644 - DNA, 286 bp, Homo sapiens
taggctggagatgcggctccagtgtttggtcactgcaacctccgccccctgggttcaagcgattctcctgcctcagacctacccaagtagctgggatatacaggcatgcactaccacacccagctaattattgtatttctagatagagatggggtttctccatgttaggtcaggctggtctcgaaactcccgcacctcagctaatctagcccgccattggacctcccaaacttgctggcgattacacggtgtgagccacacgcacctggacctaattaagtcattt

SEQ ID NO: 684645 - DNA, 656 bp, Homo sapiens
tggcctccccacttctggattaccaaataaaccgtcctcagacgtcgctgagctccccaaccccagcacaagccactgatggcgatgggccctcagcaagcccccccagcagcagcagcagcgagcagcaaccacaggtgcagcagcctcccccgccgccagcagcccagcgcgccacaccacacgcacagctcccactgcgacagcagcagcaacgcaagggaccaagacagtgagacagtcaaggagaaggcaaaggcacacaaagggaaaggggaagccctgccgtgtcccgcaagaaggagacaggagaggcccccacggcaactgcagccacgatctcagccccggtgaccaccatggagtatgcggtagaccctgcacagctgcaggccctgcaggccgcgtggacttcggagcccaacagcattgctcacaagccagttccttccttacttcgtacccaggcttattcttcctgatgatgcgtcccacagatccctggcgcccctgcagagcgggataccctgcgaggctatgtaatggcatggaaaggccttgttccgcctacagccctgcactgtcgcaggcctgatggaggcatgtccccaggctccctactgcagcagtaccagccatagcagcagaaagactgc

SEQ ID NO: 684646 - DNA, 1116 bp, Homo sapiens
  misc_feature (230)..(230): n is a, c, g, or t
cggtttaaagggcccgcgcgttggcgccccctcggcccgggcatgctgctatccagtgccgctgttggctcgggctcctcggcctggtcgtcgccgaggcctgccgtcgtacttcaaggagtcagtttctggagcggagacgggtggagttcccgctggatcgaatccagagacacaagtcagattattgggcaaagtatcgttcgtcagttccggcaagattctacggntgagcgaggagagaagataagggtattgcagtacaagccaggatgcacgcttgtgtatgctctgtcggccagtttcgagcctttcagcgaagcaaaggccagacgctggggggtgcagttcacggtgaaacatgaggcagaacatcgactgtgggggcggctatgtgaaggctgtatcctaatagtttggaccagacagagcatgcacggagactcagaagtacaacatcatgttaggtcccgagcatcggtggccctggcagcaagacggttcatgtcatcttcaatctacaagggcaagaacgtgcggatcaacgaggacatccgtagggaggatgatgagtttgaatgaccgtgtacacaactgatggtgcggcgagagagagcgtatgaggtgaagattgaggagaggcaggtggagtcgggtcgtgggaagacgactgggaactacctgccagccaagaagctaacggatccggatgcgtcaaaagcggaaggaccggactgaacggggcaagaaccgggagtcccagagatcacacccgaggacgggaaagggccgggaaatccggagccttatgctagaagcccgagaatgggcctagaaaagtgggggcagaggggacccccaggggttgacacctcggtgtcaaagggtgcgtgtggaaacccgcggagcatcaacacaattaaagaggggtagatgtaccagaattgtacccaggattatacagacagagacattgacgaaaatagtgcagcggcgcagtcgagaagtaggacgtaagtacgcacacaaaacacgagctcggcagaaggagccagacggaacacatgcgagaagataagcagtgaagtggatcatggtcggcggtcgctcctgagc

SEQ ID NO: 684647 - DNA, 215 bp, Homo sapiens
acagcgggcattcgcgcggcggcgcggcatctggggctgtcgcaggcggcggtgacccgcgcgctgcgcgaactggagcaggaacaggcgctgccgctgctgatccgcacgccgaccgggctgggctttaccccctacggcaaaaccttgctggcgcacgcccggctggtgctgaaccagctggagcaggcgcagggcgaaatggcggcgctgcg

SEQ ID NO: 684648 - DNA, 1263 bp, Homo sapiens
gaccgaacgagaaattctaggctatatacaagcgttgggggcttcgcgtagttgtactatagcctaggccccaagcgttgtaggcccctacgggctactacaactcgcttcgggtgacggccataaaaactctgtcaggctaaggagccccttaataacccagtccacatctatcctagcgaccgcatcgtccaggcattcgcccctccaagatcgcgtaagaaagaaaaaagaaggagaacacaaagaaaaaataagaaaagaaagaataacagacaatgataacacatacaaaagagagaacagagacatagacgagctgcgttgtattgtgtgtctataggatactaactctaattgcaatggccggcaagaggcgcaatcgctgcagtgggcaacccgtgggaaagaacgaaagcgcgcgaggcgatactgagaagaaaatactagacatagcgcgtcaataatctctgcgaggggaacatagctaggcggctataagatggatgcacgccagaggcgagtgaacctttcacctagaagaactgcaagagagatccaataggtacacgctaggggcgcgagagtacaacgggtggctcaagggacataggtcttggcaccccggatagagcatagggttggccacgaattttggcgcaccgcaaatttggctgaaaacagttcccaagcatggggtgggccgtctaaaggtcccgccgaggaagaacgaacttagggtggtacacttactggagggacacacccgtgaaaggcaaagaggaaactctcttgacaccatattataagattgacaacaaacagggagccgttctgcataaaggaggttgaattacagatcacgccaattgttaacaccgataatttcctttcaccaaatggaggggagacaaaccccacgattctagggacacaacatatcccacccttggggcagtcgtatgggacacttgggttcggacaaacggggacgtatagggcacgatatccaagagtagggaaaaccagtgggggaaacgggacacccaaaataatcgtcttggggatgggaaaggaccccccataggtgaggataacaatagacccaccaaacagaggcactatttgatctttgcgaatcatccacaaactttggcctgttcaaacaagccaaagtttcatgtttcacgcaccgccgccagtattgtacgtacacccgtttatctggaggggaggcacatatggggctagctaaatatgccc

SEQ ID NO: 684649 - DNA, 148 bp, Homo sapiens
cggccgccacagcttgctcgagtagctgggactacagtgcgccgtgccatcacgcccagtttattttttataatttagtatgtaaagacgggttttcaccgagtttagcctggatgggtctcgatctccatatctcgtcatgatccag

SEQ ID NO: 684650 - DNA, 113 bp, Homo sapiens
tttaacgacaaggcacacatataccccattatggcccatattagttattatctgaacaccatcagcctacacattcaaccaatagccctggacgtacgcctaagcgctgaaca

SEQ ID NO: 684651 - DNA, 274 bp, Homo sapiens
cattatggccgtttgcagtggctcatgcctgtaatctcagcactctgggagcctgaggcaggagggagggtcgcttgaggccaggagttcatgaccggcctgggcaacatggtgaaactctgtctctgccaaaaatacgattagctgggcataagcccagctacctggagggtggaggtgggaggatcacttgagcccgcgaggtcggggctgcagtgagccatgatctcaccactggactccagcctgggggacagaatgagaccccatctct

SEQ ID NO: 684652 - DNA, 208 bp, Homo sapiens
  misc_feature (64)..(64): n is a, c, g, or t
  misc_feature (66)..(66): n is a, c, g, or t
  misc_feature (92)..(92): n is a, c, g, or t
caactctgtagctctctaatgtttctattttgaatatgacagttagaaatgtcactaaaatatntncattacaaatttgactataaatttgnattgtatttggtaaaactttcaaaatatttctggatttaataataaatttggggtgggggaaataatgttaaaagaaaagtagagcttgagtttatacttaaaatgaatgaatgta

SEQ ID NO: 684653 - DNA, 303 bp, Homo sapiens
gggggggcccccccgtccttttcccccccccagggtttttttcctgacccaggggttaggcaggccctgtggttttagggctgcaagggctcccgtgttaactccggaggggggggggttaaaaatggggccccgggctggggccccccccgggggcccaactccccctccctccgttctcccccacagggggttaggggtgcagccccccggaggtcctttttggtttccccccctgtgggccccctgccctttggctgggcctttcccaaggcccaaaagttaaaatgttttgggttttta

SEQ ID NO: 684654 - DNA, 118 bp, Homo sapiens
cggtccggttatgtattctgaaccgatgggttagagctagccctacggtaacatcattctgaaccgatgggttggtgctagccgtatggtaacattctgaaccaatgggttggtgcta

SEQ ID NO: 684655 - DNA, 465 bp, Homo sapiens
  misc_feature (3)..(3): n is a, c, g, or t
  misc_feature (218)..(218): n is a, c, g, or t
  misc_feature (276)..(276): n is a, c, g, or t
  misc_feature (335)..(335): n is a, c, g, or t
  misc_feature (354)..(354): n is a, c, g, or t
  misc_feature (383)..(383): n is a, c, g, or t
  misc_feature (389)..(389): n is a, c, g, or t
  misc_feature (417)..(417): n is a, c, g, or t
  misc_feature (462)..(462): n is a, c, g, or t
ctntaatttgggagtctgagccaggagatccctcaagtccaggagctgggggctgcagtaagttatgattttgccactgcactccaagcctgggcacagagtgagatcctgtttcttaaaaaagccagtcatgggtggctcatgcttttgtaatatggggtactttgtgaggctgaggctggtggcttgcttgagcccagaagttcgagaccagggtnggcaacgtggcaaaactccgtctctaccaaaattaacaaaaacgagctgggtgtggtnttggcgtgcctgttagtctcagctgaggctaaaggtgggaagattgcttagaacacagngaggttgaggcagcagggngccaagactgtccactgcatcccagcctngagttnacagagtgaggccttgtcttcaaagagnacctctgccaactttgaatgaaaaataccttaatttgtatttttntta

SEQ ID NO: 684656 - DNA, 569 bp, Homo sapiens
gactggtctgcagctcccactgctcaggccactgaatgggtaggagcaaccactgactggtcttaagctgttcttgcataggctcttaagcagcatggaaaaatggttgatggaaaataaacatcagtttctaaaaaaaaagcagaacaggatgttgaaaagaaaaaataaagccctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcagagtggacttgtgttttttctttttaaagaggcaaggttgggctggtgctcacagctgtaatcccagcactttgaggttggctgggagttcaagaccagcctggccaacatgtcagaactactaaaaataaagaaatcagccatg

SEQ ID NO: 684657 - DNA, 232 bp, Homo sapiens
tttatttatttccttaaaaaaattacttggggaattaattttagatttgattgcaaagagccctgtatagcagttggggccagcttttgggttgggttgggttgggttattgttaagagtttattgggtcaagactaacaaaaaactttgtgatgaaaatttttcaaaaaaaaagctacttttttcaaggaaaccctttaaaatattttatcaggcagagccctggcccgga

SEQ ID NO: 684658 - DNA, 1098 bp, Homo sapiens
  misc_feature (115)..(115): n is a, c, g, or t
  misc_feature (127)..(127): n is a, c, g, or t
  misc_feature (129)..(129): n is a, c, g, or t
  misc_feature (147)..(147): n is a, c, g, or t
  misc_feature (149)..(149): n is a, c, g, or t
  misc_feature (153)..(153): n is a, c, g, or t
  misc_feature (156)..(156): n is a, c, g, or t
  misc_feature (181)..(181): n is a, c, g, or t
  misc_feature (192)..(192): n is a, c, g, or t
gcttcctttccgctcggctgttatcctgcgcaggagccgcaggtccgtagcagcgcatgtgcgcccagccggaatggcatggtcttgaatgccccacttccacaatggacttggnagcggcgcgtgncnacgtggttcaaccagccngnccgnaanatccgcagacgtaaggcccggcaangccaaggcgcngccgcactcgtcccgcgccccgcgtcgggtcccatccggcccatcgtgcgctgccccacggttcggtaccacacgaaggtgcgcgccggccgcggcttcagcctggaggagctcagggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgcccaacgcccggctcttcggcatacgggcaaaaagagccaaggaagccgcagaacaggatgttgaaaagaaaaaataaagccctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcagagtggacttgtgttttttctttttaaagaggcaaggttgggctggtgctcacagctgtaatcccagcactttgaggttggctgggagttcaagaccagcctggccaacatgtcagaactactaaaaataaagaaatcagccatg

SEQ ID NO: 684659 - DNA, 1665 bp, Homo sapiens
  misc_feature (115)..(115): n is a, c, g, or t
  misc_feature (127)..(127): n is a, c, g, or t
  misc_feature (129)..(129): n is a, c, g, or t
  misc_feature (147)..(147): n is a, c, g, or t
  misc_feature (149)..(149): n is a, c, g, or t
  misc_feature (153)..(153): n is a, c, g, or t
  misc_feature (156)..(156): n is a, c, g, or t
  misc_feature (181)..(181): n is a, c, g, or t
  misc_feature (192)..(192): n is a, c, g, or t
  misc_feature (1246)..(1246): n is a, c, g, or t
  misc_feature (1369)..(1369): n is a, c, g, or t
gcttcctttccgctcggctgttatcctgcgcaggagccgcaggtccgtagcagcgcatgtgcgcccagccggaatggcatggtcttgaatgccccacttccacaatggacttggnagcggcgcgtgncnacgtggttcaaccagccngnccgnaanatccgcagacgtaaggcccggcaangccaaggcgcngccgcactcgtcccgcgccccgcgtcgggtcccatccggcccatcgtgcgctgccccacggttcggtaccacacgaaggtgcgcgccggccgcggcttcagcctggaggagctcagggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgcccaacgcccggctcttcggcatacgggcaaaaagagccaaggaagccgcagaacaggatgttgaaaagaaaaaataaagccctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcagagtggacttgtgttttttctttttaaagaggcaaggttgggctggtgctcacagctgtaatcccagcactttgaggttggctgggagttcaagaccagcctggccaacatgtcagaactactaaaaataaagaaatcagccatgcttggtgctgcacacttgtagttgcagctcctgggaggcagaggtgagggatcacttaacccaggaggcagaggctgcactgagccaggatcacgccactgcactctagcctgggcaacagtgagactgtctcaaaaaaaaaaaaaangagacggggtcttcggcacccaggctggagtacagtggccacaatcatggctcactgcagtcttgaactcagtggcctcaagcagtcctccctcagcctcccaagtagaggggttaataggcncgagaccgtgcacccaaccttagagtggcctttttataagcaaagcagtttctagttaatgtagacatctgggactgggggcgatcattctttaagctggtggtgcccggtaaccagggtcctctggctctgataacccttccttcagtgggctcttaacccagaacaccaggtatgagatggccctgccaagtgtcggcctctcctgttaacaaaactttctaaagccatgttcttgcttcatggaccagaggcgccaaaaaagtgcagggtgcctggtctgagctggatcccct

SEQ ID NO: 684660 - DNA, 2150 bp, Homo sapiens
  misc_feature (34)..(34): n is a, c, g, or t
gtttctttttactccccctcgtgtgggtgttgtngtgtctttctctatctagtgtgcgggtgtgcctttgttatgatgatctggtcgctgattgtattgatgtatctttatgtttcggttcgtggggtctcccaccatacgctggtttgtgtgtgtctctttgtgtgatcgtgcttcctatgtgttgttgatggaatgtatgatctgttgttgtgcggctgcggtctcactacatctttctgttgggatctttttttgtttctttttgctcctacttcgtgtgggggttgttgtgtgtggtgtgattatagattgtttgtgttgggtggggggcttgatgttgtcttgctctcttcgtcagggtggcggtggtgtatctctacccctcctctgtgttgtgtttcagtgcgcggtcttggtttgtgtgggttctcaatacgtgttgattctaccttctgtggggtggtgttctttcttctcttcttttttttttgtttcctcgggttgttttcttttggtgtgttatatgtttgtgttagttgtcttttcttcggctggtgtgttttcgtggtggtcgtcggctctatgtttgtttgttgctctggtggtcgactcttagtgtgttttggttcgttgttctctatgttgtgtctccttccctttcattgttttgtttttgtttctctcttggtgttgtggttgtggtggatgcgctctcctcgttgttggtgccgtgcgttgtggtgttttagtggggtcctcttctgtgttgggtggggtggttttgcttcgtttgtcttcgtctcctgggtgttggttctggtgtctcactactgtgttgtgttgggtgtgttctgttgactcacgtctgtgttgtttttgttgttctttcttctcctcgtttgtttgttgtgttgttgttcttgtgggtggtggtggtagttccgctctgttgatgatgttgtagggtgcgccctctccgtggggttttgtttggtgcgggctcaccctattctgtttcttcgtgtgcggcttctcttttctgtgtgtgctagggggtgtggtcgtctgcgctcctcttctgctgctctgctgcgcgtggcgctacggctgggtgttggttctggtcggtgtgtgggtgcgacactgacatttgtctgttgcttctggggtggtgagtcttcccttctgctcttcttctcttctgtggttggggactctccccccagccgttggtttgttgtgacaccactgtggtgcttcttctgttcgtctgcctgctgttgtgttgttgtctccctaccatggttttgttgttgatgatatattagtttatgtcgtcccccatgctgttttggttttattagtgttttgttgattggagttcgtagcgctgccggctgctgctgttgttgatgggaggggcggcttcttccctcgtctccgtccttattattgtttgttgcgtcttctctcccgatggctactgcgcccacgcacgtctgtgttgtataaggagtagattggtgtttgttgtgcatacacctctctctctcgctgccttccgctcctcatctcatcatgtttgttcatctcagcgcgcgcttcggattgggaggagagagtagagagatagagtgcacttcaatcactcataaatgatagtatcacatcattttgttttttcgcagagagtgaatttgtttatgatctcaccttcataagtgtctctcgtcctctctttgtactgatggtgtggcttcgtgcgcgaggaggtgtcgggttattctctttggagagtgatatagatgaacacacactttgtgcgtgatttgagcgtgagagagggaggtactccctccttatgactccctctaaatgagtccacaataaaatgaaaatgtgaattgatgttctcttatgtgtgtgcgctgtatgtatataatctctctctctctcttagatatagataatggagcaccccgtgtattatatagatatataagtcgctcccgccgatctgtctatgaatattataatattaataaataaaacaataataaataaataagaagagaatatataataaatcgctttgagggagatgatcctctgggagccgagaaatgagatggtaattgtctatcccc

SEQ ID NO: 684661 - DNA, 1118 bp, Homo sapiens
  misc_feature (115)..(115): n is a, c, g, or t
  misc_feature (127)..(127): n is a, c, g, or t
  misc_feature (129)..(129): n is a, c, g, or t
  misc_feature (147)..(147): n is a, c, g, or t
  misc_feature (149)..(149): n is a, c, g, or t
  misc_feature (153)..(153): n is a, c, g, or t
  misc_feature (156)..(156): n is a, c, g, or t
  misc_feature (181)..(181): n is a, c, g, or t
  misc_feature (192)..(192): n is a, c, g, or t
gcttcctttccgctcggctgttatcctgcgcaggagccgcaggtccgtagcagcgcatgtgcgcccagccggaatggcatggtcttgaatgccccacttccacaatggacttggnagcggcgcgtgncnacgtggttcaaccagccngnccgnaanatccgcagacgtaaggcccggcaangccaaggcgcngccgcactcgtcccgcgccccgcgtcgggtcccatccggcccatcgtgcgctgccccacggttcggtaccacacgaaggtgcgcgccggccgcggcttcagcctggaggagctcagggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgcccaacgcccggctcttcggcatacgggcaaaaagagccaaggaagccgcagaacaggatgttgaaaagaaaaaataaagccctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcagagtggacttgtgttttttctttttaaagaggcaaggttgggctggtgctcacagctgtaatcccagcactttgaggttggctgggagttcaagaccagcctggccaacatgtcagaactactaaaaataaagaaatcagccatgaaaaaaaaaaaaagtcgacg

SEQ ID NO: 684662 - DNA, 408 bp, Homo sapiens
  misc_feature (354)..(354): n is a, c, g, or t
ggcagcttcaaaatatgactcaggaaagaatgtgacatggtaaacttagaaatcttagtaaaagtggctcagggctgagcacggtggctcacgcctgtaatccccgcactttgggaggccaaggcaggcagatcacaaggtcaggagatcgagaccatcctggctaacacggtgaaaccccatctctactaaaaatatgaaaattagccaggcatggtggcacgtgcctgtaatcccagctacttggcaggatgaggcaggagaatcttttgaatctgggaggcggaggttgcaatgagctgagatggtgccactgcactgtagcctgggtgacagagccggactccgtctcanaacaaacaaacgaaaactgaaggcagatctcatttgctggagtgttttgaatga

SEQ ID NO: 684663 - DNA, 417 bp, Homo sapiens
aaaacgttaccacctgcacaactggttttctacaacttgagccattaagggtctatgtctttggattgtgccgcaggatccactatgggccgactggacggcaaagttattgtcctgacagcctgccgctcaagggattggacgggcatccgcattagcttttgcaagagaaggagccaaagtcatagccacagatatcaacgagtccaaactccaggagctggaaagttaccgaggtattcaaactcgagtccttgatgtcacaaagaagagacagattgatcagtttgcctcagaaatccgagagaattgatgttctctttaatgttgctggttttgtccaccacggaaccatcctggattgcgaggaaaaagactgggacttctcaatgaatctcaacgtccgcagcatgttcc

SEQ ID NO: 684664 - DNA, 887 bp, Homo sapiens
cttatatcatacaattcttctatactcttgaccccttgtacgcattaccccatggttccccacaccgcctatttgtgaaccccatttttaccaccataatttctgtgccgccccaaattgccgttcccctcccccgggccctttgccccaccgcagctttttcaaggaccccatcctttcggaaccccccagaatgttctttcttcttaacaaacaggttttatcccgcctttctttagacattacccacaggtgtactaaaacaattctccccgcctcaatgtttttacaagatcttttaaatcccctaccagtttttaaccaccaaatattgatctcttccaagttctccttaatcaccgacaacatattaaaaaggttttctataaacacctggccggagtcacaatcaaaccttttcctcaagggcatgaacaaatctatttgttaacacaccatcttggactaaacgtagtcccctgcgccccccctttaaatccacacaatagggccctcccttttagaagtcaaacagtaacggcgatctttcaccgctttaagaaatcatattataaaatcctcttacgtgcattcaacataaatttctttaagatccggcattttttacatacaagaagaataataccgccagagggagaattaacagaccccttgcatttccccctacccccaggagtaatatgttctccccattttaacaccctgtttatagcccctaatttctatatacaccccaccaagtccaaattctgaaaacaattataatttgcggaatctgtctaagaatccaaaccacacttgcgacagaaaaaatacaaactgaagggggaaacgggaaaccaaaatcccgggacggcccacataac

SEQ ID NO: 684665 - DNA, 130 bp, Homo sapiens
ccccgctgtatacactacttcaattgtacaatgctatagtatcaaaatgtttgggcaaaaaagactcttgaaaggaaccatgaagtttggacaaagatagaaatctgtaataaagccaatgaactccaac

SEQ ID NO: 684666 - DNA, 239 bp, Homo sapiens
aagaggggtcccgagcgcggatgctttaggattatgacagcgtggagcaggatggcgatgtacccggaccacaacgctctgttgaaggctggattctctctgtactcgagtgcatgaggagccaccgaagaagacatacacgacaaattcgcagattatggggaattaaaacattcatctcacctcgacaggcgacaggatatctgaggggtatactctagttgaatataacaacagga

SEQ ID NO: 684667 - DNA, 431 bp, Homo sapiens
  misc_feature (4)..(4): n is a, c, g, or t
  misc_feature (34)..(34): n is a, c, g, or t
  misc_feature (70)..(70): n is a, c, g, or t
  misc_feature (93)..(93): n is a, c, g, or t
  misc_feature (425)..(425): n is a, c, g, or t
  misc_feature (428)..(428): n is a, c, g, or t
gtgnggtggataataacactaaaaatgatatgtngcgttccaatttaaatgtggtatactagtttgcccnctgctggtgggtgaatgatattntagcgttatacgactggatgataatgataaaaattgaaagtataataattattaagggaatcatgccctcttgccgtctcggaagggcgcctgggccgtggctctctggcttatggatcgggaggagtgcgtgtcccggcggctcatctgcgagattcgggatgaggtacttgaccgggccctgggctatcctgatgtttcgggccccctcttgcccgcccggggcggattcatggccgcgcgggggcttttggagcgggtttttctatttttccagggcccgggatctccccccaccggctctttttcgaggggaaatcaccaaaatcatnccntca

SEQ ID NO: 684668 - DNA, 270 bp, Homo sapiens
aatgcagaagagcaagcagcaagagcaagcagcaagcagcaagagcaaacagcaaacagcaacaagcaacaagaaaagaaaagacaaagattgtttcccatgcctgcttaacacaacatccattcttcagccccatgagtcaaggcagtaattttaactcttcaagtcttcattatttaaacaaatatatttcttcaagacttatagctgcccataaatacatgcacttctctgcgtgggggtccctgagctctgaattctgtaatccca

SEQ ID NO: 684669 - DNA, 548 bp, Homo sapiens
  misc_feature (130)..(130): n is a, c, g, or t
gagcggtttcgccatgttggccaggctagtctcaaactcctgacctcaggtgatccacccacctcggctcccaaagcgctgggattacaggcgtgagccactgcgccccgccccctcaagtgttgattgnactttacatttctcttactgtttattgacaagtgtgaaatattatgagaaggaacgtgtgtgttctcacacgtgagtggtggccacagaggagtggactatacacatcgaaggaggaatgacctatcgcgcgagaaaacccctgtgggaaggatacactgaggacatatacaggagagcaccggggtcagcacaatcgtcatcggagagcccacgatgtaaagccatctagttgtagccagggacaacgataaaagataactgttggcacgcgcagaatattacgcacgactattccagacacagtgtcgcacagtacataggacaaacgagattgtatgacgaggggaaagaaaccatggggtggggatactagctgagctttgtatgacaagctaggcgatgaaaaacgcggagag

SEQ ID NO: 684670 - DNA, 728 bp, Homo sapiens
aagtggctgtacggttggaattttgggatcccggtcactgagctcgggtgacgcggtctgggtagctgggatcgagccttccgcgggatctgcctggcgatcccgaccatcctcctgctgtctctccgctccgtctagcccgcaaccctgccaaggctcctgtccttttcctccgtgtcctttgccatgcagttgtggtcggaccgggccttgagccgggcttcgccggtgtgcagtctttaaccatggcgtccctcttcaagaatgaaataactcgtggatgatgtaatacacaggaacagaatcgagagttacgcatggtacatgagagggctataatcagagatcgatgcatctttagagataacacaagaaagagacagctggaattagaaattacgaccaatggccaagattggtaaataagtgaagcttgcaacagattttagcctagacaacttgtgcatctacggaaacacgacagacgagaacttttgctgtaagttcaaaaagttacttctatgtctacatcaaacaatagtgatgaattcccaagagtgaagatggtctggatgcaatgtctaccacagggaaatagacaatgcatgctagttaacaagaagatggatccacaaaagacattacaaagcaatgcgagatatttccaagaaggaatacatgatgatggacagtgactgaagcaagatgatcaatgatacacttgatga

SEQ ID NO: 684671 - DNA, 852 bp, Homo sapiens
  misc_feature (212)..(212): n is a, c, g, or t
  misc_feature (229)..(229): n is a, c, g, or t
tccctgtcgccgcggaggggcgggggcaggacgcgcaactccggccggagctgtccggggtcgtgagccggccccgccttggtggcggcgccccctcgcggtccagaggcagacgcatcgggtgggctcgggtctccagcccggccgggagggaggggaccgggtctgcggagcggggactcggggcctcggcggggcgcgcaacacgcagngcggggcggccccgggngttgcgggggcctctgcgcggttgaccaggtctcccagaggcgttaggcgccgcccaatggccgagcccgttcagccagaccgcgggggcggcgaaggaacgcgggcggccaagctgtggagacgccgggtctggaagggccccggaggacgcgggcccccagcccggaagtttatgagatccgacatttatggaccacggcccaaggggggttcagcacgtccgtgggagttctaatgggacggggattcaggccaatccagaggggtttaaacgaaattgaaacagttacattcaggcaaacaccgagcacggagttgacccttaacgttgacggtccggtggcgaagcctaggtgggagcctgggttcgggtccttttaggtgagttctacccattaccatatcccttgttatttcaccttcttggagcggcaatttggttccacccgggggctttaagagtcgagattgtcctcatggaagatggagccgaaatgactggtgttgacgggcttcgaggggttttcttgtgccaaagaatccgacacctttggcctcaccgcctttaggcgagtggaactgcgggggacgggcacccggggggcacaggccggactgtaa

SEQ ID NO: 684672 - DNA, 203 bp, Homo sapiens
agtggagagagaacggcaagtggagctgggaaaggacttggtgactaaggcagaggctaaattcagtttcaatcagcctcctaaattatcacctactgtaaccacactaaatgtgcactatctgatacctggatacatccctgcctctgcttttgctcacactcttcagtcagcctagaactaccttcccaaacctttctctc

SEQ ID NO: 684673 - DNA, 640 bp, Homo sapiens
ctaggtgtcacgttctctgttcatttctcagcttgcccctgaagcgagtcatatgctaaccccatgtcaaacagggactaacagtactaatccatcagtcgtagtgaggtctacgagaaggaccgggactaagccaggctctcgggaaaattcaaacaacagttcctcttgggtcttcaatatagccccttctcagtctgtcatgggctgaagaaccactggacgcgtgtaaaccaagcacatgaggtataagtccacagcaccagagtgaaggcctagatggcaaaacacatgggctatgtgactccagtactgacttccagagctaaggaaggactgacttagtgagctgttccaagaccactgagctcatggttccctggtggctgggacctccatcatgaccggggcttgaagagggtactctgttcccgctgccacatttggaacagtatgacggttgcagcagaggccaaaaactaagtgatcagccccagagagtcgatggagggacactgacaaaccaatcacaaagttggtgccattagctcttagggaggagaggtggggcctgggcaaggacagcagctggagggtgaaacgcagacctggctctcagtagcggtagtgatccggtttg

SEQ ID NO: 684674 - DNA, 412 bp, Homo sapiens
  misc_feature (212)..(212): n is a, c, g, or t
  misc_feature (229)..(229): n is a, c, g, or t
tccctgtcgccgcggaggggcgggggcaggacgcgcaactccggccggagctgtccggggtcgtgagccggccccgccttggtggcggcgccccctcgcggtccagaggcagacgcatcgggtgggctcgggtctccagcccggccgggagggaggggaccgggtctgcggagcggggactcggggcctcggcggggcgcgcaacacgcagngcggggcggccccgggngttgcgggggcctctgcgcggttgaccaggtctcccagaggcgttaggcgccgcccaatggccgagcccgttcagccagaccgcggcgatgacaatgacgctgtggcccaatctgtggacacaccggactggaccgcctggatcgaggcctgctcccggcccgatatgtggttcatacaacgg

SEQ ID NO: 684675 - DNA, 410 bp, Homo sapiens
ggggggggggggggggtgggccccacatgtcaagtccaggggcggtttttttcccctttttccccgcggcctgaagagggggtccttgtttccaaagtcggcccaaaggggggtttttttggggttttcccttttagcccttcaggggtgggggggggggggaattttggggggggggggggggttttttttgggggccccccaaaggggggcccccccggggtttacccccccccctgggggtttttttttttttttaaagggggggggggggggggcgactaatgttggggcccgaaactatgggaaggggggtaaaattttttttttggcaaaccttttttgggggttttttggtttttttttttttttccccccattttaatttttaaaaaaaaaggcccccccga

SEQ ID NO: 684676 - DNA, 1206 bp, Homo sapiens
gtgcttccccttggtaaacccgtggcacccccgaactcccgggggaaagatgggcacatcccagaaaagcccactcacgggggaaggcccccaccaccggtgtgaagttgttgaaaaacgcccctgtccaaagacacaagaaaagggcctaagtgggctgtatacaccccgccccaacaaggagggtcccaaaaacggggttttcgggaaaaactttgggtggtgtcgcttttcctggaagaggtgggtttttcgcgtggggaaatgagcccacctttccgcgtctctgtgagggaaaaccttccaccgtggcttctacgtggggtgcctctttgggttggccaccccccctggtgtgtgtcgtcaaaataatgggctgcccacacttgggggaatgggctatataattggggagatttgggtaaaatgatttgggagacacccaattcttgagaaaggtggttgtgaaaagcttacccacaggaattttttggggaaaatttccacaccccaattcacggttttctcccacaattcttgggaccccccctttaaaagggagaggaaaatttttggagagcgccagaaagcctctgtggcccccctattgcgccgggtggaaaggcccaaatatcctttgcacaaatccctccgaaaaccacacacaggggggcgattatgggcgggttttccacgcacgggaccccacgttaagcctatatggccacagtgggccacgagaagagttttttaaattatgggaacaccacacaagccttatagccacggaggagggagagagtctctccgcagagataatgtgacacacgcggagaagctacacacggtgtaaccacacacagagtttttgtggaaactctcaccgccacaggacacacacagtgggtgggccacagggccctatagctcgctcaccacacaagagaagacacacaggtgtttaagaccacaaaaactcacacagtggtaatggggccacaaaatctctcgagggagccgtaatttgggagactaaattgtaaaaccacggtgtatttttagttttctgtttctgtggagaaagtggtaaaccacttcccacacacaaagggtgtttaaagtaaggtttttttttttgcaccccatgctgttgattgctaaaaggaaccgtctgatcgtgacgcctgaataaatgtctttttttta

SEQ ID NO: 684677 - DNA, 225 bp, Homo sapiens
ggcagtgaatggcctttttttaaaccctgcgtcaaacaatgggaaagggcagtgcccggtgccctggtgctcccaactgccctcctgctttgggcctgggccgagggccttttgtaggccatgttcctcgggcaactgccccgggccggaactgggccctccaacggccctggggggtgggtcctgcataactaaccccaacccataaaaggcttttattagtta

SEQ ID NO: 684678 - DNA, 174 bp, Homo sapiens
  misc_feature (31)..(31): n is a, c, g, or t
agcatggccaagctatagtttatggcccgcnattcgtgcaggacgggatcacaacttcttccgcaacatcggtgacgtcggcaacttcgccaacgacgtgtgcaactcaagccccacgctgcaggcgtcgacactgcccgcttgttgatgaacggcccaaaaatgtgtaaaata

SEQ ID NO: 684679 - DNA, 396 bp, Homo sapiens
tcggactgaagatgtcaggaactgtattaatttattacatcaagaacttaaatgtatttaaatgatctagagcgtgctagatgtgttaactttactcatttagataattatactatgattacagaagagaacgtccttgtcttcagaaaatgtaagtatttagaggttaaaggtaaacctctaatttggtttgccagtatttcagataactacacacacacacacacacacacacacacacggaatgataacacaaaaagtaaggtgtaagacaaggcatggtgactcacacctgtaattccaacactttgagaggcccaggcaggtgtatcacctaggtctggagtacgagaccagcctgcacaacatggtgaaacccctctttattaacgtaca

SEQ ID NO: 684680 - DNA, 284 bp, Homo sapiens
  misc_feature (27)..(27): n is a, c, g, or t
  misc_feature (88)..(88): n is a, c, g, or t
  misc_feature (228)..(228): n is a, c, g, or t
ataaaatataagaaaaagatcattttntggccagccacaatggttcatgcctgtaatcccagcattttgggaggccaaggcaggtggntcacttgaggtcaggagtttgacctgtctactaaaaatgcaaaaaatagccgggtatggtggtgagcacctgtaatctcagctatttgggaggctgacgcatgagaatcgcttgaacccaggaggcagaggtttgcagtnagccaagatcacaccattgcactctagtctgggcgacagaggaaacttccatcttc

SEQ ID NO: 684681 - DNA, 560 bp, Homo sapiens
catggttacccgccctccggagtatcgggatcgcctccccactcgtccccgggctgtcactggctgccgccttattcgcctgctgtggagcgccgctggctagtgtgtctgcgcgcacctcccggccgcgcaagattggcacagctggggaaggagtgaacatccagaggaatcgctggggctggggtggtgggttgagagccaggaaaacaggtggcgcagtgaaccaagaaacgtacgttgcgctggactaatgcgtggacgtcgggcaggatcgtgagccaaacaggcgaggtgtacaccaatgggcctgattcgagagtgaagccgcacctgatggacacacatcagcaacccgggaacacaggaagcttagatggcacagacgaagcctgggcgggccaaaacggttgccagagatgccgggtggctgtggacgcctgaggaacaaaagttgacaaaatgcaacctgaaacgactccccgggtgaacacaaataccgagcattaaaccttcagaataactgaggaagacacatcatagcacgataacaccacctc

SEQ ID NO: 684682 - DNA, 336 bp, Homo sapiens
aggtcgtcgtgaatactggggacccttctgccagatggtctaagtgtcagtctctttttttgggatgcggttgcttctaagtcatcttgcctcatggttgggcatgggttcaggatccctcatctccatcaagttctcttaattcctcgggtgtgtgtagtcttttagctcttacatttctctaagatcgcatatcttaaaacccgttcactcccgtacttctttcactgtttttttttttttgtttagtgggggcccattctccaaagcaccccaaggaattcccgggaaggggacctgggattataaactctctctctcggaaggtattgtgtg

SEQ ID NO: 684683 - DNA, 177 bp, Homo sapiens
cccagcaaagtgaggctcctgtaaaatactaccatactactcttgggtgatgtcatcagggtttctaggtccaaataggctaggtcttgtaaagttctatcctgatcaatgtatttctctttgatcttctaagttttcttcttcttatccctgtacgctgtcatcctcctctttcga

SEQ ID NO: 684684 - DNA, 309 bp, Homo sapiens
actagtgattaattcgcggcggtgggacgacccgatggactgttcttccgaggctgcggcgatctcctgcaccaggtcagaggtcttggcaatcgaaggcacaatctcatccagcaggttgcccgcccgttcagccaaggccacgctgttcttggccacttcactgatttcctgtgcggcaatctggctgcgctcggccagtttgcgcacttctgccgccaccaccgcgaaccctttgccgtgctcaccggcccgcgcggcttcgatcgcggcattgagcgccagcagattggtctggtaagcgataga

SEQ ID NO: 684685 - DNA, 359 bp, Homo sapiens
ttgaaaaggccatcggttcgggcctttttggtttttcgcccacttgcaaaaaggggttttttttcaaagggttttaatttgggtaccccaaggtttttccaattcctacgtttttaaacctgggcccattaatttttattcggctcccttttgggggaatttgggtccggggccccccctaaattttttttttttttttttttttttttttttttttttttttttttttttttttttttttttttttttttttttttttttttttttttttttttttttttttttttttttttttttttttttttcagacttcagttttaatggttaaagctgcctgtgggagccagtctggagcacgc

SEQ ID NO: 684686 - DNA, 885 bp, Homo sapiens
  misc_feature (10)..(10): n is a, c, g, or t
  misc_feature (20)..(20): n is a, c, g, or t
  misc_feature (30)..(30): n is a, c, g, or t
  misc_feature (39)..(39): n is a, c, g, or t
  misc_feature (41)..(41): n is a, c, g, or t
  misc_feature (46)..(46): n is a, c, g, or t
  misc_feature (50)..(50): n is a, c, g, or t
  misc_feature (82)..(82): n is a, c, g, or t
  misc_feature (84)..(84): n is a, c, g, or t
  misc_feature (90)..(90): n is a, c, g, or t
  misc_feature (93)..(93): n is a, c, g, or t
  misc_feature (100)..(100): n is a, c, g, or t
  misc_feature (108)..(108): n is a, c, g, or t
  misc_feature (139)..(139): n is a, c, g, or t
  misc_feature (169)..(169): n is a, c, g, or t
  misc_feature (171)..(171): n is a, c, g, or t
  misc_feature (185)..(185): n is a, c, g, or t
  misc_feature (187)..(187): n is a, c, g, or t
  misc_feature (204)..(204): n is a, c, g, or t
  misc_feature (208)..(208): n is a, c, g, or t
  misc_feature (228)..(228): n is a, c, g, or t
  misc_feature (236)..(236): n is a, c, g, or t
  misc_feature (240)..(240): n is a, c, g, or t
  misc_feature (242)..(242): n is a, c, g, or t
  misc_feature (246)..(246): n is a, c, g, or t
  misc_feature (248)..(248): n is a, c, g, or t
  misc_feature (250)..(250): n is a, c, g, or t
  misc_feature (272)..(272): n is a, c, g, or t
  misc_feature (275)..(275): n is a, c, g, or t
  misc_feature (289)..(289): n is a, c, g, or t
  misc_feature (296)..(296): n is a, c, g, or t
  misc_feature (310)..(310): n is a, c, g, or t
  misc_feature (317)..(317): n is a, c, g, or t
  misc_feature (320)..(320): n is a, c, g, or t
  misc_feature (328)..(328): n is a, c, g, or t
  misc_feature (333)..(333): n is a, c, g, or t
  misc_feature (335)..(335): n is a, c, g, or t
  misc_feature (338)..(338): n is a, c, g, or t
  misc_feature (352)..(352): n is a, c, g, or t
  misc_feature (355)..(355): n is a, c, g, or t
  misc_feature (404)..(404): n is a, c, g, or t
  misc_feature (414)..(414): n is a, c, g, or t
  misc_feature (420)..(420): n is a, c, g, or t
  misc_feature (438)..(438): n is a, c, g, or t
  misc_feature (443)..(443): n is a, c, g, or t
  misc_feature (449)..(449): n is a, c, g, or t
  misc_feature (458)..(458): n is a, c, g, or t
  misc_feature (465)..(465): n is a, c, g, or t
  misc_feature (474)..(474): n is a, c, g, or t
  misc_feature (484)..(484): n is a, c, g, or t
  misc_feature (530)..(530): n is a, c, g, or t
  misc_feature (554)..(554): n is a, c, g, or t
  misc_feature (783)..(783): n is a, c, g, or t
  misc_feature (858)..(858): n is a, c, g, or t
tggtttccanagcaatttantcaggaaaanctattcaanangccancaanagttctcctgtgtgtattgtgctgaaaaaaananactganaanatttaanaagttcancatttaaaaagtctgaattcattttcaccanacggtattgtacacggtcatctgttgaaananatttcttttttaananatcttagtttaaaaaantcanaggtactgtgagttctgtanaaactggngganantaantnanttcctttgttttaacttaaaanccncaacttcaccgcanaaaaaanaatgtaggccaaanaaagcanaancggtcacncgtananaanagtattgtttctanaanttgaagctttctgaatggacgggttcaggcctgatgcaactgtaaaaanattacttaangaaaanactaaatggaaattgtanaaaangttatnaccttttancgttagnagcttaaanagcactaaancactaattgctattcaaaaacaaaaacctgtttttgaatccccaanaaggcagcatgtgtatacaaccanaccaccttgtacttaggggtgtgtcaaaacataattcaacagaaactttggctttaggaaagagtcacaaatatttaaaagaatggctttgtcattttaagtatacggtcggggaaaagtgtgctttaattaaatatacatcataccagtgatgctggcaaggttgaaagttactcctaatgttgatagctataaaaactagtttgtacataacaagacaatgagaggnaaaagcaatccctttgaaacaaaattctcaaataaaaaatgttcacagtggtttgtatcaacagtatgcattttntgacaagaacatgtacagattcagagc

SEQ ID NO: 684687 - DNA, 480 bp, Homo sapiens
  misc_feature (21)..(21): n is a, c, g, or t
  misc_feature (468)..(468): n is a, c, g, or t
aattagactactgaaaaaaanagagatattagtgttctaatttatgggctgctcttcctcagtccctcagataaattttgtcctattgtttttttgctattagcagtctgtctgcataatcttgctaaatgacctttccactctcctgccttcaactataatctgctatttgatgactactaatatgtttctccaaatcatgtcttctatagaattgtatatttactgtatactggtagtttcactgagtgtcctatgtgtagttaaggttcagaatatccaatacaaattccccacatgtcctagctttcacaagctttctttttttaaattaaaaaaattatttttctcttattcattgaagtagagatatctcagtacatggcaccatattcacttatttctccaaactggaaatctagaagtcattcttaactattttcacatgtgctttcagtctatgtcctnggccccacttta

SEQ ID NO: 684688 - DNA, 717 bp, Homo sapiens
  misc_feature (25)..(25): n is a, c, g, or t
  misc_feature (563)..(563): n is a, c, g, or t
  misc_feature (567)..(567): n is a, c, g, or t
  misc_feature (578)..(578): n is a, c, g, or t
  misc_feature (580)..(580): n is a, c, g, or t
  misc_feature (587)..(587): n is a, c, g, or t
  misc_feature (590)..(590): n is a, c, g, or t
  misc_feature (593)..(593): n is a, c, g, or t
  misc_feature (602)..(602): n is a, c, g, or t
  misc_feature (604)..(604): n is a, c, g, or t
gacaagtgtgagaaggcctgccgcnccgaggaggagtgccttgccctcaacagcacctggggctgtttctacagactttgataatcacatgtagcgtctgcatctgaaattgtttttacatctgtcccacctgcacccttcaccccaggctgttagtttcttgaggacaaggacttcatcattttcaaacattattggtcaaataaatgaagaaataggctgcatcctttctctttatcctttgacctcctctatcatcctgctgttatcttccagaaggagaagaaacagcttcacaggaaaagtagaggagattttcccattttggtgaaagtgccaaatcagaatgtgaaataggaattctgggctctgtaccaggcatttactcctatgctgttagctgatgttaaagagggtggatttcttttcccttaggtctcaccttctgtgccttcaggggaagttggttggaagtttgaatggtttgttgttgtcgtcattgttttgtattaaggagggctgtaatggaacgaatacaatggttattgatggagagtaagttnaganaagctcaaggntnattattnaanggnaggaggggnanaaaaaaagtaaatctataaagagcttgggacaccaagtccagaacttcatgcatataacagccaattaacaatcaaattttagaaagtctcagagagggacttgcaaacacac

SEQ ID NO: 684689 - DNA, 638 bp, Homo sapiens
aagaaaaggtaaggtaaataaacatttttcaaaatgaaaaaaaaaaaaaaaaaaaaaaaaaaaaaaaaaaaaaaaaaaaaaaaaaaaaaaaaaaaaaaaaaaaaaaaaaaaaaaaaaaaaaccttgtggcccgcttggcccaagcgatttttaaactgggcaaggttaagcatggggcccgaatttgggcctaattggccaattcccccttaaggggggccgtttacaattcaatggcccgggttttaaaacggtgggactgggaaaaccctgggggtccccaatttaaaccccttggaagaaaatccccttttgccaagtgggggaaaaaccaaaaggccccgaccgaacggcctttccaaaaggtggccaaccctaatggccaatggaaattggaaggggtaaaaatttggtaaaattccgggtaaaattttggtaaaacaagccaatttttaacccaatggcccaaattgggaaaaaccctttataatcaaaaggattaccccgaattgggttgaagggttgtccaatttggaaccaggagccccttattaagaaccggggcctcaaccgtaaagggccgtttttggggccaaggtcgccaaaggccttaatccggaaccctaaggggacccccc

SEQ ID NO: 684690 - DNA, 1542 bp, Homo sapiens
  misc_feature (709)..(709): n is a, c, g, or t
  misc_feature (843)..(843): n is a, c, g, or t
  misc_feature (1082)..(1082): n is a, c, g, or t
ggacgtagtaattagttgtcctcctctggggttgataatatagttggtgtgtgttcttttatgatagagtctttcttctctactatgtggtgttctgctatgtggagtgaaagccccctttgtgtggcaggttttttcttgacaggcctttgtaaattatttttgggtagacaaccaataagccgtcttcgttgtaagttgggactattattattaagggggtggcctcgtaaattacaccccggggggggaagccccctaatatgtgcccgcaccaatatgtgtggaaagtgatctcctcagcgaaaatttggtggccgctcatcccctaagaaccccctttgtgtgggaaaaaacaccaacacgggggagatataataagttgggggttaaactgtcgagaagtagaccacttccggaggaagtattgttgtccccacgcgccacgtaaaggggaatttgaaaggtttgccggagaaacaacacaataggtcccggcgttttctctctaatataaaaggggaaaaaaagaaatttcgcccacactgctgtgtgtttccgcgtgaactcggcctatcacggtgatatagttatacctgtgtaggccccccgaagaaatttggcgtgcccttttgagaaaggaaacacacgggaacggtatataatcgaggcgaatattttttcacaccgccccacttggacacacagnctcttttggagagaaggtgatgaaaatagcgaaatattatagagaaattggcctcataaagagagaggtggtctcacagagaaaaggctgtctccaagagaggcctgcctgagattttgtgtgagaactaaacngttcttctgtctgtgcacattttgggttgcgcaccacatggagagagaggagatttatccctcgtgtccaacaagccacaacatcggccctccacagagacacctgtagataagaactgtgttgtttgcgcgccacactctcgaagcgcctcgcttaagagaattcacccactcggagaataccacgcgctcccacactggggagaaggcctcacctcggagagagaagctcagaatgnggccacacctgtgagagagacgccacatcgagaggaatggcctcgcttgtcacaccagagatgcctcacacaggagatcgggtctccacacggtgtctacatcaataagggtaatatattgagaacctgtgttctcctgagaattcacatggtccacacaaaggagaaaataagacctcttaaggggcctccacagaataaataaagggtgaagcccaagaagcacttttacattgtgcaccactgctttctctggagacttgggaataataccacggttccacgcggttaattaagcacgccacctggctaagggaaaatgaatctttggtgttttgggttaaattgcttcctaagaaaaagatttcatagatggactgtttagaaagaagaaatgtaaagatcccgctttgggattatgaaattaacccccaatttaaaattttgtttaaactgtcca

SEQ ID NO: 684691 - DNA, 4059 bp, Homo sapiens
  misc_feature (122)..(122): n is a, c, g, or t
cgcgctcagcggacgactggccggatcccaacgcgctgccccttgcccagcctgcgagcgcgtggtacgaaggcgcgtctgcatccatgccccagcccggggagctggaggcgctcgcagtnagaggcgagtgatgctaggctgagcgcgtggcggcccgtgtcgtgccccgctgagccaagtgcggaagggcagcggcgcgctccagctctgctcgccgcgcgcagggcgggggggcctggccgcccgctgggagctgcggacgagcaggcgcgctgaggacccgagggaggacacggttaaagcattgctatcaactgtgaacccagagagccctccttagccaacacgctaactccgaagcctcccttacgcccccgaaccaccgaaggcggcgacacctgattcagcgcacaaacacaggtcccttctgtcccggatacaattacgcggcagacacacactcagactcgcgcggggcagccaagagacgagctatgaagtcttacactccatatttcattctcctgtggagtgctgttgggatagcgaaggctgccaaaatcatcatcgtgccgccaattatgtttgaaagccatatgtacattttcaagacgctagcctcagccttgcacgagagaggccaccatacagtgttcctcctctctgaaggcagagacatcgccccatctaatcattacagcctccagcgctacccagggatctttaacagtaccacctcagatgctttcctacagtccaagatgcggaatattttctctgggagattgacagcaatcgaactgtttgacatactggatcactatactaagaactgtgacctgatggttggcaaccatgccctgatccagggtctgaagaaagaaaaatttgacctgctgctggtggaccctaatgatatgtgtggatttgtgatagctcatcttttaggggttaaatatgctgtattttcaactggcctttggtatcctgctgaagtgggtgctcctgctccattagcatacgtcccagagtttaactcactcctcacagaccgcatgaacttgctgcaaaggatgaaaaataccggtgtttacctcatttccagattaggggtcagctttctggttcttcccaaatatgaaaggataatgcagaagtacaacctgctgccggagaagtccatgtatgatttggttcatgggtccagcctgtggatgctgtgtactgacgtagcactggaattcccaagacccactctgcctaatgttgtttatgtaggaggaatcctaaccaaaccagccagcccactaccagaagatctccaaagatgggtaaatggtgctaatgaacatggctttgtcttggtgtcttttggagctggtgtcaagtatctgtcagaagacattgctaacaaactggcaggagctctggggagattgcctcaaaaagtgatttggaggttttctggacccaaaccaaagaatctaggaaacaacactaaactcatagaatggttaccacaaaatgacctgcttgggcattcaaagattaaagccttcctgagccatggtggtttgaacagtatttttgaaactatgtatcatggtgtgcctgtagtgggaattccactctttggagaccattatgatactatgaccagagtacaggcaaaaggcatggggatattgctagaatggaagacagttactgaaaaagagctctatgaagcactagtgaaggttatcaataatcccagctaccgtcagagggctcagaagctttcggaaattcacaaggatcaacctggtcaccctgtcaatcgaactatctattggatagattatattattcgtcacaatggagcccatcacctacgtgccgctgtccatcagatctccttttgtcagtattttttactggatattgcctttgtgcttttgcttggtgctgccttgttatactttctcttgtcttgggtgacaaaatttatctacagaaaaatcaaaagtctgtggtctagaaataagcatagcacagttaatggacattaccacaatggaatcctcaatggcaagtacaaaagaaatggccatattaaacatgaaaagaaagtgaaatgagccaacagcccaggtgatagaaataaattggttcactcattgaatttttattgctattatttagtctaacagctactaaaagtaaaacatcagtaaacaattctaacatgcccttatgagatctactaatgaaattctgtggaattaagatggctgtaaaaagcacaaacctaaaatgcagaaatgtattttattcaaatactgatgtagagagttttggcactgaaccttttagaagccttaattatttaaatcaattcagtgactgtgtcagaccttagttttaaatcttgatatgtgcgtgtcccggatcaggaatggttcatttttcttaataatgtgtgtgtgtgtatgtgtgtgtgtgtgtgtgtgtgtttgtgtgtgtgtgtgtgtgtcctaattaagagaatttttactggctgcttgttacatttgttgagggtacaacacactcaagaataaagtaaaaggatagtcaggatccagatgtttcttttctagcatttaatgtgtgtgaactcagaacactaccatgaaagaacacttccccccaaaactggatgcagaggaagaaaaaaaaaaaaagaaatggcacagttttttgtatttttttttttagttattttttgttgttgttgtttgtattgtttctcttttctgatagagtatggccacttctgggggaaaaacatgtaattaagtaaatgtatacattggttttcacgttttacttttgttttcccactaccaataattttcctctggaagaattttatagttttttctatttcattttaatgagtaacaatatgttaaatgcataattaagacaaagcaatgaaattctgactttattcaaagtactgaagattattgcttctagggcatttttaaacagcaccattgtattgttgaatgtttatgtaactgatggcttttctataatgtaatttttgaatgttcaggtgttacatttccaaagtttaacttttaaaaaaccatcttctgatcccttttattgtctgggccatacaatctatattacataggtgccaacatttaattcttttaaatggaacatttgcagttttccatattggtacctgctttttctggagaggtttgagatcttgttaacaaatcagactttacactatatacagatgtgacagataaattgaaccacttgtttgtgaaaatgagttcctgtcatcttcctcattcactcagccctcaccccagcagccttttccggtcattgtagctgacatggagcagtgacagtattcatttgagaacagggatgcaagtcacagacatcataaaatcagggtctccctgctgaagcattcactagttggcaactatgaatttattccatgtcattctgtttacttagcacttgcactacccttgttggttgagtgtatgctttatttgtttctagtttgaaatcccacatctgatagctgagagtaggcaaatacaacatttacctaatgtcattcactaacatggaagagttgtgaaaattctagagtgctgtaaatccttggcatacactatgacaaacaacttcattactctcccaccaggagctgctctcctgcacttagaaataatgtcacaagtagttttctaatgtacaatgcagacaaatgtactgctctctgaatacttgaagaaatggtattatacatacatagaaacttattagttataccttttcacaatcttattacgatgttgccgttaaaagggaaaaaagacacaggcaatgaatggtgggatagtaagaggacttagagtgtatgaatgagttgattttacttttttggaatttgattaagttgacagtaggcactgattggatgattaaacataagttaatctccactgtgataaaaacttaaataataaacatgatttaaaatag

SEQ ID NO: 684692 - DNA, 4077 bp, Homo sapiens
gggttggttccaagtctttgctattgtgaatagtgccgcaataaacatacgtgtgcatgtgtctttatagcagcatgatttatagtcctttgggtatatacccagtaatgggatggctgggttctagatccctgaggaatcgccacattgacttgcacaatggttgaactagtttacagtcccaccaacagtgtaaaagtgttcctatttctccacatcctctccggcacctgttgtttcctgactttttaatgattgccattctaactggtgtgagatgatatctcattgtggttttgatttgcatttctctgatggccagtgatggtgagcattttttcatgtgttttttggctgcataaatgtcttcttttgagaagtgtctgttcatgatttttttttttagacaaagtattagatcagatatttttggggaaaaatgctttgtgattgcttgttttgaatggtgagcattgtattttgttttaagttgttttctggttgttattacagctatgaagtcttacactccatatttcattctcctgtggagtgctgttgggatagcgaaggctgccaaaatcatcatcgtgccgccaattatgtttgaaagccatatgtacattttcaagacgctagcctcagccttgcacgagagaggccaccatacagtgttcctcctctctgaaggcagagacatcgccccatctaatcattacagcctccagcgctacccagggatctttaacagtaccacctcagatgctttcctacagtccaagatgcggaatattttctctgggagattgacagcaatcgaactgtttgacatactggatcactatactaagaactgtgacctgatggttggcaaccatgccctgatccagggtctgaagaaagaaaaatttgacctgctgctggtggaccctaatgatatgtgtggatttgtgatagctcatcttttaggggttaaatatgctgtattttcaactggcctttggtatcctgctgaagtgggtgctcctgctccattagcatacgtcccagagtttaactcactcctcacagaccgcatgaacttgctgcaaaggatgaaaaataccggtgtttacctcatttccagattaggggtcagctttctggttcttcccaaatatgaaaggataatgcagaagtacaacctgctgccggagaagtccatgtatgatttggttcatgggtccagcctgtggatgctgtgtactgacgtagcactggaattcccaagacccactctgcctaatgttgtttatgtaggaggaatcctaaccaaaccagccagcccactaccagaagatctccaaagatgggtaaatggtgctaatgaacatggctttgtcttggtgtcttttggagctggtgtcaagtatctgtcagaagacattgctaacaaactggcaggagctctggggagattgcctcaaaaagtgatttggaggttttctggacccaaaccaaagaatctaggaaacaacactaaactcatagaatggttaccacaaaatgacctgcttgggcattcaaagattaaagccttcctgagccatggtggtttgaacagtatttttgaaactatgtatcatggtgtgcctgtagtgggaattccactctttggagaccattatgatactatgaccagagtacaggcaaaaggcatggggatattgctagaatggaagacagttactgaaaaagagctctatgaagcactagtgaaggttatcaataatcccagctaccgtcagagggctcagaagctttcggaaattcacaaggatcaacctggtcaccctgtcaatcgaactatctattggatagattatattattcgtcacaatggagcccatcacctacgtgccgctgtccatcagatctccttttgtcagtattttttactggatattgcctttgtgcttttgcttggtgctgccttgttatactttctcttgtcttgggtgacaaaatttatctacagaaaaatcaaaagtctgtggtctagaaataagcatagcacagttaatggacattaccacaatggaatcctcaatggcaagtacaaaagaaatggccatattaaacatgaaaagaaagtgaaatgagccaacagcccaggtgatagaaataaattggttcactcattgaatttttattgctattatttagtctaacagctactaaaagtaaaacatcagtaaacaattctaacatgcccttatgagatctactaatgaaattctgtggaattaagatggctgtaaaaagcacaaacctaaaatgcagaaatgtattttattcaaatactgatgtagagagttttggcactgaaccttttagaagccttaattatttaaatcaattcagtgactgtgtcagaccttagttttaaatcttgatatgtgcgtgtcccggatcaggaatggttcatttttcttaataatgtgtgtgtgtgtatgtgtgtgtgtgtgtgtgtgtgtttgtgtgtgtgtgtgtgtgtcctaattaagagaatttttactggctgcttgttacatttgttgagggtacaacacactcaagaataaagtaaaaggatagtcaggatccagatgtttcttttctagcatttaatgtgtgtgaactcagaacactaccatgaaagaacacttccccccaaaactggatgcagaggaagaaaaaaaaaaaaagaaatggcacagttttttgtatttttttttttagttattttttgttgttgttgtttgtattgtttctcttttctgatagagtatggccacttctgggggaaaaacatgtaattaagtaaatgtatacattggttttcacgttttacttttgttttcccactaccaataattttcctctggaagaattttatagttttttctatttcattttaatgagtaacaatatgttaaatgcataattaagacaaagcaatgaaattctgactttattcaaagtactgaagattattgcttctagggcatttttaaacagcaccattgtattgttgaatgtttatgtaactgatggcttttctataatgtaatttttgaatgttcaggtgttacatttccaaagtttaacttttaaaaaaccatcttctgatcccttttattgtctgggccatacaatctatattacataggtgccaacatttaattcttttaaatggaacatttgcagttttccatattggtacctgctttttctggagaggtttgagatcttgttaacaaatcagactttacactatatacagatgtgacagataaattgaaccacttgtttgtgaaaatgagttcctgtcatcttcctcattcactcagccctcaccccagcagccttttccggtcattgtagctgacatggagcagtgacagtattcatttgagaacagggatgcaagtcacagacatcataaaatcagggtctccctgctgaagcattcactagttggcaactatgaatttattccatgtcattctgtttacttagcacttgcactacccttgttggttgagtgtatgctttatttgtttctagtttgaaatcccacatctgatagctgagagtaggcaaatacaacatttacctaatgtcattcactaacatggaagagttgtgaaaattctagagtgctgtaaatccttggcatacactatgacaaacaacttcattactctcccaccaggagctgctctcctgcacttagaaataatgtcacaagtagttttctaatgtacaatgcagacaaatgtactgctctctgaatacttgaagaaatggtattatacatacatagaaacttattagttataccttttcacaatcttattacgatgttgccgttaaaagggaaaaaagacacaggcaatgaatggtgggatagtaagaggacttagagtgtatgaatgagttgattttacttttttggaatttgattaagttgacagtaggcactgattggatgattaaacataagttaatctccactgtgataaaaacttaaataataaacatgatttaaaatag

SEQ ID NO: 684693 - DNA, 238 bp, Homo sapiens
actggtctctgtagtgccatcaggtaacttgctgagcagtatacaaagagtgagatcatatcctcatatggcattccagcagagttccacggaccaacagaatggatcccataagcgagttcatattcttcctttcccatcagattaatgaagcccgggttcagtgaattaatacaggaaaaatgttgctaagaaccagtaatgcacctcctgctcacacgatatagaataagaaagt

SEQ ID NO: 684694 - DNA, 4179 bp, Homo sapiens
  misc_feature (122)..(122): n is a, c, g, or t
cgcgctcagcggacgactggccggatcccaacgcgctgccccttgcccagcctgcgagcgcgtggtacgaaggcgcgtctgcatccatgccccagcccggggagctggaggcgctcgcagtnagaggcgagtgatgctaggctgagcgcgtggcggcccgtgtcgtgccccgctgagccaagtgcggaagggcagcggcgcgctccagctctgctcgccgcgcgcagggcgggggggcctggccgcccgctgggagctgcggacgagcaggcgcgctgaggacccgagggaggacacggttaaagcattgctatcaactgtgaacccagagagccctccttagccaacacgctaactccgaagcctcccttacgcccccgaaccaccgaaggcggcgacacctgattcagcgcacaaacacaggtcccttctgtcccggatacaattacgcggcagacacacactcagactcgcgcggggcagccaagagacgagctatgaagtcttacactccatatttcattctcctgtggagtgctgttgggatagcgaaggctgccaaaatcatcatcgtgccgccaattatgtttgaaagccatatgtacattttcaagacgctagcctcagccttgcacgagagaggccaccatacagtgttcctcctctctgaaggcagagacatcgccccatctaatcattacagcctccagcgctacccagggatctttaacagtaccacctcagatgctttcctacagtccaagatgcggaatattttctctgggagattgacagcaatcgaactgtttgacatactggatcactatactaagaactgtgacctgatggttggcaaccatgccctgatccagggtctgaagaaagaaaaatttgacctgctgctggtggaccctaatgatatgtgtggatttgtgatagctcatcttttaggggttaaatatgctgtattttcaactggcctttggtatcctgctgaagtgggtgctcctgctccattagcatacgtcccagagtttaactcactcctcacagaccgcatgaacttgctgcaaaggatgaaaaataccggtgtttacctcatttccagattaggggtcagctttctggttcttcccaaatatgaaaggataatgcagaagtacaacctgctgccggagaagtccatgtatgatttggttcatgggtccagcctgtggatgctgtgtactgacgtagcactggaattcccaagacccactctgcctaatgttgtttatgtaggaggaatcctaaccaaaccagccagcccactaccagaagatctccaaagatgggtaaatggtgctaatgaacatggctttgtcttggtgtcttttggagctggtgtcaagtatctgtcagaagacattgctaacaaactggcaggagctctggggagattgcctcaaaaagtgatttggaggttttctggacccaaaccaaagaatctaggaaacaacactaaactcatagaatggttaccacaaaatgacctgcttgggcattcaaagattaaagccttcctgagccatggtggtttgaacagtatttttgaaactatgtatcatggtgtgcctgtagtgggaattccactctttggagaccattatgatactatgaccagagtacaggcaaaaggcatggggatattgctagaatggaagacagttactgaaaaagagctctatgaagcactagtgaaggttatcaataatcccagctaccgtcagagggctcagaagctttcggaaattcacaaggatcaacctggtcaccctgtcaatcgaactatctattggatagattatattattcgtcacaatggagcccatcacctacgtgccgctgtccatcagatctccttttgtcagtattttttactggatattgcctttgtgcttttgcttggtgctgccttgttatactttctcttgtcttgggtgacaaaatttatctacagaaaaatcaaaagtctgtggtctagaaataagcatagcacagttaatggacattaccacaatggaatcctcaatggcaagtacaaaagaaatggccatattaaacatgaaaagaaagtgaaatgagccaacagcccaggtgatagaaataaattggttcactcattgaatttttattgctattatttagtctaacagctactaaaagtaaaacatcagtaaacaattctaacatgcccttatgagatctactaatgaaattctgtggaattaagatggctgtaaaaagcacaaacctaaaatgcagaaatgtattttattcaaatactgatgtagagagttttggcactgaaccttttagaagccttaattatttaaatcaattcagtgactgtgtcagaccttagttttaaatcttgatatgtgcgtgtcccggatcaggaatggttcatttttcttaataatgtgtgtgtgtgtatgtgtgtgtgtgtgtgtgtgtgtttgtgtgtgtgtgtgtgtgtcctaattaagagaatttttactggctgcttgttacatttgttgagggtacaacacactcaagaataaagtaaaaggatagtcaggatccagatgtttcttttctagcatttaatgtgtgtgaactcagaacactaccatgaaagaacacttccccccaaaactggatgcagaggaagaaaaaaaaaaaaagaaatggcacagttttttgtatttttttttttagttattttttgttgttgttgtttgtattgtttctcttttctgatagagtatggccacttctgggggaaaaacatgtaattaagtaaatgtatacattggttttcacgttttacttttgttttcccactaccaataattttcctctggaagaattttatagttttttctatttcattttaatgagtaacaatatgttaaatgcataattaagacaaagcaatgaaattctgactttattcaaagtactgaagattattgcttctagggcatttttaaacagcaccattgtattgttgaatgtttatgtaactgatggcttttctataatgtaatttttgaatgttcaggtgttacatttccaaagtttaacttttaaaaaaccatcttctgatcccttttattgtctgggccatacaatctatattacataggtgccaacatttaattcttttaaatggaacatttgcagttttccatattggtacctgctttttctggagaggtttgagatcttgttaacaaatcagactttacactatatacagatgtgacagataaattgaaccacttgtttgtgaaaatgagttcctgtcatcttcctcattcactcagccctcaccccagcagccttttccggtcattgtagctgacatggagcagtgacagtattcatttgagaacagggatgcaagtcacagacatcataaaatcagggtctccctgctgaagcattcactagttggcaactatgaatttattccatgtcattctgtttacttagcacttgcactacccttgttggttgagtgtatgctttatttgtttctagtttgaaatcccacatctgatagctgagagtaggcaaatacaacatttacctaatgtcattcactaacatggaagagttgtgaaaattctagagtgctgtaaatccttggcatacactatgacaaacaacttcattactctcccaccaggagctgctctcctgcacttagaaataatgtcacaagtagttttctaatgtacaatgcagacaaatgtactgctctctgaatacttgaagaaatggtattatacatacatagaaacttattagttataccttttcacaatcttattacgatgttgccgttaaaagggaaaaaagacacaggcaatgaatggtgggatagtaagaggacttagagtgtatgaatgagttgattttacttttttggaatttgattaagttgacagtaggcactgattggatgattaaacataagttaatctccactgtgataaaaacttaaataataaacatgatttaaaatagaaaaaaaaaaaaaggggggcgtaatatcctgggggcaagttagcgtcagttttgtcaggggccaagggggttaaagaggcggcgggtaaaagggagggaagtcgggtggggactggggga

SEQ ID NO: 684695 - DNA, 133 bp, Homo sapiens
cgcctatcagatgcataccaaagctctcttataactgtagttatcaacctagactcccaattaaattttagctcaacaaggcacaggatacagagcaattccctagctaaagttccacagaatgtttgaaact

SEQ ID NO: 684696 - DNA, 160 bp, Homo sapiens
gtttatcaggctggtcttgaacaacccgacctcaggttatccacctgcctcggctcccaaagtactgggattacagtgcgtgacccactgcgcttggttagaacttatttaactttttaggcacttggtaaactggtagctgtatagtccatgtagtact

SEQ ID NO: 684697 - DNA, 217 bp, Homo sapiens
tacatgctacacacaaatagtcaccccgtacaccacacacacacactcataagccacccacacaccacacacacacgccgtgtcatgctacattgaaagccccaagatgcgatttcatttatcctattgtgctctggcttgcgatttgcatgacaatttcacgagtattttcgtgtttccgtacgttaatctactccagcaggttacatcttttgcc

SEQ ID NO: 684698 - DNA, 1863 bp, Homo sapiens
  misc_feature (122)..(122): n is a, c, g, or t
cgcgctcagcggacgactggccggatcccaacgcgctgccccttgcccagcctgcgagcgcgtggtacgaaggcgcgtctgcatccatgccccagcccggggagctggaggcgctcgcagtnagaggcgagtgatgctaggctgagcgcgtggcggcccgtgtcgtgccccgctgagccaagtgcggaagggcagcggcgcgctccagctctgctcgccgcgcgcagggcgggggggcctggccgcccgctgggagctgcggacgagcaggcgcgctgaggacccgagggaggacacggttaaagcattgctatcaactgtgaacccagagagccctccttagccaacacgctaactccgaagcctcccttacgcccccgaaccaccgaaggcggcgacacctgattcagcgcacaaacacaggtcccttctgtcccggatacaattacgcggcagacacacactcagactcgcgcggggcagccaagagacgagctatgaagtcttacactccatatttcattctcctgtggagtgctgttgggatagcgaaggctgccaaaatcatcatcgtgccgccaattatgtttgaaagccatatgtacattttcaagacgctagcctcagccttgcacgagagaggccaccatacagtgttcctcctctctgaaggcagagacatcgccccatctaatcattacagcctccagcgctacccagggatctttaacagtaccacctcagatgctttcctacagtccaagatgcggaatattttctctgggagattgacagcaatcgaactgtttgacatactggatcactatactaagaactgtgacctgatggttggcaaccatgccctgatccagggtctgaagaaagaaaaatttgacctgctgctggtggaccctaatgatatgtgtggatttgtgatagctcatcttttaggggttaaatatgctgtattttcaactggcctttggtatcctgctgaagtgggtgctcctgctccattagcatacgtcccagagtttaactcactcctcacagaccgcatgaacttgctgcaaaggatgaaaaataccggtgtttacctcatttccagattaggggtcagctttctggttcttcccaaatatgaaaggataatgcagaagtacaacctgctgccggagaagtccatgtatgatttggttcatgggtccagcctgtggatgctgtgtactgacgtagcactggaattcccaagacccactctgcctaatgttgtttatgtaggaggaatcctaaccaaaccagccagcccactaccagaagatctccaaagatgggtaaatggtgctaatgaacatggctttgtcttggtgtcttttggagctggtgtcaagtatctgtcagaagacattgctaacaaactggcaggagctctggggagattgcctcaaaaagtgatttggaggttttctggacccaaaccaaagaatctaggaaacaacactaaactcatagaatggttaccacaaaatgacctgcttgggcattcaaagattaaagccttcctgagccatggtggtttgaacagtatttttgaaactatgtatcatggtgtgcctgtagtgggaattccactctttggagaccattatgatactatgaccagagtacaggcaaaaggcatggggatattgctagaatggaagacagttactgaaaaagagctctatgaagcactagtgaaggttatcaataatcccaggtaaggtttcaattaacattaaagctgatgaacttacataccacagtatattgtcagtagccaattattttcaatagattgtcaataaattatcaaattatgga

SEQ ID NO: 684699 - DNA, 101 bp, Homo sapiens
ctcctcagtcccagggttggctcatcagtcccagggttggctcctcagtcccagggtggggctcagtccaattcccattcccagctgtcatcactcagccc

SEQ ID NO: 684700 - DNA, 365 bp, Homo sapiens
catctagaggatcccgttagagaacaggtgaggatggcttccatggagtctcccagtgaatgctttcccgccagaacaactacgggctctatgactcctggggaacgtgtgggagtggacagcattaacgtaacaggctggtgagcaggacatgcgcgttcttcgggggggattcctggatcgacacaagcttgatgggttctgccaatcaccgggcccgggtcaccaccaggatgggcaacactccagattcagcctcagacaacctcggttttcccgctgtgctggcagacgaaggcccgggccgccaggggaacctgtaagcagcccgggtgttgacaagggagaaaaagccttctaggggt

SEQ ID NO: 684701 - DNA, 350 bp, Homo sapiens
  misc_feature (5)..(5): n is a, c, g, or t
gtgtntatcgatggccacggggcctgagtcgccacccccatttttttggtcgttggagacggaatctcactcggtcgcccaggctggagtgcgccccgggcagtggtgcgatctcggctcccggcaacctccgcctcccagtttcaagcgattctctttacctcagcccccacaagtagctgggattacaggcgcctgccatcatgcccggctaatttttggtattttagtagagacagggtttcaccatttcagccaagcgggtcttgaactcctgaccttgtgatccacccagccgggcctcccaaagtgtggggattacaggtgggtggcatcgataaacaccgggt

SEQ ID NO: 684702 - DNA, 458 bp, Homo sapiens
aacacagtgtcgtttacacttaacacaattacttactaagacaattacaacccacactcattattgctagagaacaactacactttttaacggctgcacatacaatctcagaaatccaagcattatccacagtcatcatttccatattcaacacagctcatagacaaggaactgcggcatgggcagcggatggctcacgacctgtaatcccatgcacttatgggacggccgagtgcaggagagatcacgacggtcagtgagatacgagaccatcgctggctaaacacgtgtgaaaccccagtctctacgtaacaaatacaaagattagcctgggtgtgagatggcgggcgcctgatggtccctggctactcgggaggctgaggcaggagaatggcacggaacccgggaggcggagctgcagtgagccgagatcgcgccactatgctccagcctgggcg

SEQ ID NO: 684703 - DNA, 508 bp, Homo sapiens
tggatgccaagtctggcggattgtgcactaactttcgtacttatgtcagtatgatattcttacatagacatctgtatgctgtgcttgacaagttcattagttactatgccgtttgaatttggaagtggttggctgatggtgaattccagttggtatagtgtggaaagtagccatatttacactatcatacttgatgtttttcttacacctcgttctccctcacgaatacagtctaaacggctagtaaatgatcttctgaatctcacctattattggagacatcatagagactggataaatattatatcaaaagtacttaccggattacttctaagtattttatgaaatttattttttacacaccatcggtagccaatcttttggccatattgcaagaagaattgtctcgggccacacataaaatacactaacactaacaacagttgatcagctcatacatatatagttcacacagaccactcctaatgtatgattaaacttcataaaa

SEQ ID NO: 684704 - DNA, 107 bp, Homo sapiens
atgacaacatccgaaaacactacatgtcgtcaaaggcatattcagaagggggatcacagcgctcaaaagtggtcagataaagacttatagtgcagtcattgcgagta

SEQ ID NO: 684705 - DNA, 323 bp, Homo sapiens
gtagccggacggtgttccttgtctggtcattcctctctccttcaaccaaagatcgtaatattctctcttcccacctctatgatcctttattcttgctgcccttttttgtttgtttttgtttttttttttggagatgtagtctagctctgtcacccaggcgggggagcaggggcgtgatctgggctcacggcaacctccacctccggggttaaagcagctcttggcctcagcctcctgagtagctgggattacaggcacgtgccaccacgcccggctaacttttattttggtttggtttggttttttggagacaaagggaaaca

SEQ ID NO: 684706 - DNA, 354 bp, Homo sapiens
ttgggccaaggctttttgaccccggggtgaaggatttttgggttggttgggggtccacggcccagggcctcctttggtttaggctgggggaagggggtccctttcttggtctgggggtttttgggcagcccctcctggtttcttgtcccacagccccagggtggggaatcggtcctgtttgaaggcccctcctttgccgattggttttcccctccccccaatttggttcggggatacgtggtggcttgtaaggaaccccagaaaaagtggtgcctcttggcagattcgccatcccccaacgacccagggcaggaccgcgggggacgttttggggttaaaccccttcccccccca

SEQ ID NO: 684707 - DNA, 959 bp, Homo sapiens
gctgccatcttagcgtccccgacgtgtgtagcgcctaatctcaggtggtccacccgagaccccttgagcaccaaccctagtcccccgcgcggccccttattcgctccgacaagatgaaagaaacaatcatgaaccaggaaaaactcgccaaactgcaagcacaagtgcgcattggtgggaacaggaactgctcgcagacaagaagaaggtggttcactagaaccagccacagcagactgacaaaacacttcagatactcctatacacgaacgttaccgggtacaccaactatctctggtatcgacgagctgaatactgttacaaaccacggacacagtgatccactttaacaaccctaaagttcaggcatctctggcagcgaacacatttcaccattacaggccatgctgagacgaagcagcttgacagacatgctacccagaatcttccaaccagcttggtgccggatagtctgactagtatacaggagactggccgaagctctgccaatccaatctgtggactgccacacgcaccactgcctcctggcagaggatgatgctgactcgaaagctccaagaatatatgtcgaacccaaatatgaacgacaccatcccaagcactgacacacacactgcaccttgcgtccactcctgcacgcataacctgaagacacttactggaagccgccatttacatatcatcaccggcctactcaaacatgcatgcgtctctcgcaccccccccaaacccagcaccttttatatcacccaccccaagaccatgggcaaccgccagaactacaacgaaccggcataataccaacgcatccacagccgaaataaccccgcacacctctgcactcagttaacacaggtaaccactctacgcaacataacaacccacacaaaacacgatatcgcacaagaaccacaaacagcacgcagccacgaaactaa

SEQ ID NO: 684708 - DNA, 369 bp, Homo sapiens
  misc_feature (198)..(198): n is a, c, g, or t
cgtatattctaaggctagtcaacgtgatgaatgttatcagcaccgtttggcctaattcttggttgatccgcttaaagtcatccatgacttcgtgcgccgtcaccggatctaacgctgccacgggttcatcagccaagaggacgctgggttttgcgttaatgtccgcgctaatgacacccgttgttgttgaccaccagncaattgatcagtccgacgaatgctttatctaacattgcattcgatctagtgcctctaagggcgaatcttttctgttttggaaatccccaacaacagggccaaatggatatccgaaccacgactcatcacattttgcggactcgatcgtgcagagatatcgatggaaatcat

SEQ ID NO: 684709 - DNA, 190 bp, Homo sapiens
atatgtctattaggctttattagagatgggtctgttctttacattttgttgataaaactgtttcatattttaaggaggaaaacttcttattttatttttattaaggtaacttgataattgacttaaccctaggaaattgaggttgaattaaggtaacgtggggtagatatatgctgctctaattgagaga

SEQ ID NO: 684710 - DNA, 97 bp, Homo sapiens
ggatttgctggtgcagtacaactaggcttaatagggatcaagcttctaacgttagaagcttgaattcgagattcaagcttctaaacgtttttttttt

SEQ ID NO: 684711 - DNA, 653 bp, Homo sapiens
  misc_feature (653)..(653): n is a, c, g, or t
gtgtcccttctattggctagaacgaggtcggctcgcccgtgtggtggggttggcctgatgcgagactgctccggatctctgatcagtgtcagcagccttgtgagatctgcctaggtcacagatgcctggtccatcatgtcagacactaagcatgccaatctattgatacatggacttttgagaaacatgcacacaaagcagcacttataaaatcaggcctaacataagaaaaaaccaaaaaacaaaaaaaaaaaaaaaaatgttgtgggggccccccggcccgaagaagaagtcctctacagaaaccccaatctcgctgggggagcgcgccgggggacccccaccagcagaggacacgacgcgacacaagagtgtgggcacaaacccggcgtcccaccaacgagagagacaaccccccggggcggcacaagacaaacgaacccgcgcggcgggaggccctccccccaacacaaaaaaaaaaaacacaagccggccccgggcggagccaccccccggagcttttcttgcgagacgcaccacatccacacagcgcgccgcacttcacacaggcagcaccaaaccgcggcgagcaccacacaccacacgggggccgccccacaaggccaccctccaaattactcacatcccgcccn

SEQ ID NO: 684712 - DNA, 272 bp, Homo sapiens
tctgagtgatcttaccgactagccgacaggcgctacgagttactgtgcactctgcaggcggcactcgaagactggagaagacgtaggcacgaccaccctgaggttgcaccatgctgaacatcgtgcactgtctatcgcgatcagaacaagtacaaggaggctgcccacctgctcaatgatgctctggccatccgggagaaaacactgggcaaggaccacccagccgttgttgcgacattaaacaacctggcagtcctgtcgggctagtcggg

SEQ ID NO: 684713 - DNA, 444 bp, Homo sapiens
  misc_feature (175)..(175): n is a, c, g, or t
  misc_feature (203)..(203): n is a, c, g, or t
  misc_feature (404)..(404): n is a, c, g, or t
ggcgggagctgagaaatggccatctgggagaagcattgattcctgtgcccagctagaggcgctgtgcgtcgctcgttctttgtattgctggttgtaaagttgtattcagtcagacactcccactgccacaaataacatgttccctggagttgctaacagtatcacacgcgatcangactcaactcctatagccccgttatttnggactcccatgcaggtttagcaattcacagtggtgttggctatatagagcagagaaggcctccatagtttctcagaaagtcagcttgacagttgactcacgtattttctgtatccagaaagagatgggacgtgaagtttagatagacagggctaggattagcgaggaatttgtcagtcgcgttttcctaaaaaaaccactngagttagaccatctgtactcatagtctctcatctaaggcc

SEQ ID NO: 684714 - DNA, 152 bp, Homo sapiens
ctgttaatgaaaccttggaatggagtttggagtcaggatctcatatctctgcctgaaactcctggaagaccaccctgttgtggaagcctggtgcagatacggatgcctcgagaacacctgttgcagcgcgagttgcaccagcacgagatgcg

SEQ ID NO: 684715 - DNA, 306 bp, Homo sapiens
aggtcaggagttcgagaccaacctggccaacgtggtgaaacccgtctctactaaaaatacaaaattagccgggcatggtggcagctgcctgtaatcccagctactcgggaagcttaggcaggagaattgcttgaaccttgggaggtggggattgcagtaagccaagattgttctgcagcatgggtaacaaagtaagacttcgtctaagtaaataaactaaatttttaaatcaaacatgacaaactgttatatattcagagtaccttgaaattgaacatattgtgcatgatcataggcttttgcctg

SEQ ID NO: 684716 - DNA, 506 bp, Homo sapiens
ccaggctctctacctaacaggtcaaaaataagcaagtcgggaccacaacaacaacaacaaagagaggcggggagattctattatatggtagggtgtgggtgaaaaacacatagggaggtccggagagcgtaaagaactaggtccagctagatttcaaaattccaggtccaaaaatgaagtcaacatagtccctcaaacatttatgttggctatatgtcccttttctcatgagaaataggggcagctcccttatttcagaaacaaaaactaagaggtggcccctgagtcttccctcaggtatgtgatgcattataagtatcatcaaactctatgtcccaacatcgggtagaaatctcaggccgggacacttctcgtgataaccagggtagtacactatttaagcaaatcatcgggtcgggataactacaatagcatctcagatgcctctccctccctccctcgggagtggggtattgccaggctcaaccaattccatatcctagatg

SEQ ID NO: 684717 - DNA, 1127 bp, Homo sapiens
gggcagtcgttcgggtgagcgaagtatggcggccgagagggaacctcctccgctgagggcacggcgaagcccaccgactttgaggatcctggaggacggagaggaccctgttcaccagccactgtctcaaccctagagtcaagtccatcattctccaggaaaccatgctacgtcttcccttgcacgcaacgcatctcacgtggcaaattccaattgggcccaaaaaacccaacaagcacagtcggcaactacacgacttgcattgacccacgcaggaccgactcattataatgacacgagacgcccaaccagtgaagcgaaacggtctctctcaggcgacacggcctctgaaagagggtaaacccatataccttattccttcgggacacccttctctacctggacaatgttgcgacagctcgttgtacagctttcccttaacttaaccacttcccattgggcctccccttaagcacatttgtgcaccttccaaacagcaacgttaatggtccgtggcactcccccggtggaactccttatcggggactagccgaagtacccagtgggctacacgacggccactgtgacaacggcacaggcaacggtgcaccaaaatcttggggacgcgcacaccatatttttgttcgggtcgcactccaatttcaggcacacaacactatgggggggctgcgattacttccgaaagacattcccccaaggtcacaaacacaggctttgtgctgtgcaactatgaggtctattgcgacacagcggtcctgatatttattgggggcatatactcaagcggcacgcttacaacgaagagcaaaagaagaacacattcttccttccgtccacatgtgttctcaaagctcaacgaaacgttggaaaccttcactcaagcgtgatccaaacacgactacgccaattcccctgacgagacacctttatccagggggtatgcaggaccaccgaagcaacaagaattatagcccaagacgcaaacaattcttctaccagatgtactgagcatatcaaccatgtggtgacccccccagaatatccacccggaaacaacagcgcactacacagcaacacgcgaggcctgcaccaccgatgtgccccca

SEQ ID NO: 684718 - DNA, 179 bp, Homo sapiens
atactaactaaagagaagctgctccgggagactaagggcacctagacagcactggcaggagagcagaggcgcgtgccgcgtatatggaacaaaagcaccccatgtgtagtggacagaagcacagacctagggcttaggagaggaatgcaaccaaacttcctgtttcttcaggagctgac

SEQ ID NO: 684719 - DNA, 395 bp, Homo sapiens
  misc_feature (23)..(23): n is a, c, g, or t
gctgccaggaattccggcacganaaaattgtccacatgttgctgagccatccagggggaagtaagtgatctactagatttatgaacaaaatggaatggaatagcgattcgaacggaatgcaatggaatggaatggaatggactcgaatggaatagagtcgaatggaatggagtcgaatggaatgtaatcaaatggaatggaatcaaatggactggaattgaattaaattgtaaggagcagaatggaatggggtgttatcaaaagatatcgaatggaatggaatgcagtggaatggacttgaatggaatggactggaatggaatggaatcgaatggaatggaatggaatggagtggactcgaatggaatggaaacgaatggaactggaatggaatg

SEQ ID NO: 684720 - DNA, 587 bp, Homo sapiens
tggacgagcaggcccgaggtcctgggggcgaggggcggggctgggccggtggctctctcctctccgctggcgagcgctgggctcggggtcccggcgggctcctctcgggtcgggcgggttgggcgggcccaccaggttcccgtagtctgggccgtgcccggcaaaagcgcctttgtccacccgtcggccggtttgggctgttggagcctgccgcggcccctgggcgggaaggcggtgcggggagctggggagccccgctcggtaaataacccagagcggtggctccacccgctggggagcgcccttcatgacggaaggccggtgacccgaggggctctccaccccatgctgcaagatcccacagccagcaagctaaagcatggcgggccatccccctccagcggctcgctcgtgtgcacccaggaatactaccggcgttgagtcgcccccttgccccccatccaccgcggatgctctgctggcgccagtggcggccctgtgcaggctggcggaaccagcgctcggctgaaggccggtgggctggggaggctcggcccccggagtggtgacggggacctctcttctca

SEQ ID NO: 684721 - DNA, 460 bp, Homo sapiens
  misc_feature (381)..(381): n is a, c, g, or t
gctccacaaagctattttagaaacaaaaattatgctggattctaattaactcctaaaatggtcattttcaatgaatattgcagtgatttctgaaagagaaactgatcagtatctaatgcttgtagcagttttactttgtataggtatgtcaaaattgataattgatgatatttttattgaggctaatatattatcctttggtgccacgactggatgaagaaacttttggaaggctaaactagtggatacaagaaacttaggcagattattacaccatatgggtgtgagagataatgaatattatctacttggtatcagcaaacaggtgtccaaggtgatcaattcaggactcttccactgaagagatgtgaagtgtaagtntaactggaagtaatatgagaattcaatacagtggctatataaaaatcaagacagcagcacacagagcctcatgtggagc

SEQ ID NO: 684722 - DNA, 1113 bp, Homo sapiens
agcgggtctgtggcccggcccgttggcgcccgagtgcactgaagatggcggggctgtaggacggttgctccggagcgtcggtctggccgacatgtgagtgcacaattccattgaggcgcgatttcatgtccaactggtcgagaccgctctagcgacctggctgtcactgttggagatgcaagcgcagcattcgacgaaaatctctattggtgttgctggctataccagtgcgaagacaacatagttgattcagccaccagcttacctcatgaccatgtcaacactagtcatgttctagcctctagccatggtctacccctaatctatgtatagggagtcatccatggccgttgtgcaatcggcacgtagtatgcgaacaggactctaacgcactaagcatcgacctttattaagggggggaacacatgatatctggcttgcttttatgcttgcgttatcctgtgtggtatgtttcggcccctttttgctgggtggattccgcttagcatggaagagtctcgtttcagcctctctttacggtggacccatagagggcctacatcgaaagattgtcaccggatggttggaagcgctggtgataggatctggtggcgacagggttcttcagaggttggggactataccccaacattttacgctcatgtctttggcccctggagagttaaaattaactagcgcacagtgcacaaggaaagtgggctgggattcatggaggaacgcaacaattgggagaccatttcgtgacaaactgctttggctgcaagcaatcatgtgaaacacctaaaagggccagtaatttttcacgcgaaaggataccttaacgggatttggttggcctaggttttcagcaacacgggttatcgtcgggttccattttgacacaaactttagaggacagggttcttccttttccataagagttctgaacccccaccataagagggaaggtttccaagtccgaaaggacgagttgtttggaaggcggaatacacaacaggaataccgtcccccgagagtgggggtcgccggacaggcagattggggaacacggaaaataaccgccttccccgagccttctggtggtcggaacaa

SEQ ID NO: 684723 - DNA, 153 bp, Homo sapiens
ccccctcctatcatgcatggtagaaaggctggcttcctgtattcattttgttgagctgccataacaaattaccacaaactggttggtttaaaacaacaggctgggcgcggtggctcacacctgtagtcccagctactcgggaggctgaggtgg

SEQ ID NO: 684724 - DNA, 245 bp, Homo sapiens
ttttttcccccccccccccaaaaaggcccaaaattttcggggccagggaggttttggctttttcaaaaaatccccttggcccggaaaaaggggtcccccctgggtttgaccaaccggccccgggggtggggttttttaaaaccacccccggagggggggggggattcctctttttccccaaaaaaaaatggggaaccttttccccgggcttccctttaaaaaaaagggcccttttgggtccccca

SEQ ID NO: 684725 - DNA, 565 bp, Homo sapiens
tcgatggcactaccagagttgagggagtcaacgtggacgaagagcaggtttcgacttgcgctgtactaggtcgcatctcatgaaacagttcgacggtgtcatatgcaacgggcacatgggcgtcaagtggcgatggcgaagcaggtccggcgggagcttgaccaacgcgatcttcccattggcacagcatacgagacgtagcatcccacaccctatccgatgcatcgacggaacgttcacccgtgagagagggtggtgggcccatgtcaaattgcgcgcggcgttctcggtactgcttccataatgcacgtaagctgggaaccacaggatcgtctgggaagctcgatggggatgcctgggaatcggaagcgtggtttactcgccgattcaaaatgtcatgcgcttgggcatgcacttcgacacgacaagccgtacagcgaggcaaggagatggcatgctctaaaaagacccagtcacagccaaatactttgtagtcgagcatccactgcaaatggtattgaacatgtgcctcgtacggctggaatgtatgcatggcgcgcccttg

SEQ ID NO: 684726 - DNA, 83 bp, Homo sapiens
tattttcagtattttctacataatatggtaaaatgtagagcaattgcaatgcatcaataaaatgggtaaattttctgaaaaaa

SEQ ID NO: 684727 - DNA, 748 bp, Homo sapiens
gcttttgctggtgtagctcgtccggttagccttcaggaagattggcataagccaagcaaatgactaatcaagagtctgccgtacatgtgacaaatgatgccagaattccagaaaagtatcatttcgaatgaagaaccgtacaagagtagaagaaattatctgtggtcttatcgaaaggaggagctgcggcaaagcttcagataatatcggactttgatatgacagctcagtagattttcatataaagggaaagagatgacgcaaatgtcaataatatgattgacaatgtaagctggttacaggatgattgtagaataaagttattgcaattaaatggaaaaatactactgctatagaagattgatccgtgttcgttactgtagaagagaagtacccttatatggtggaatggtagtactagaatacactatggttagcgttgtacagcagagctttaccaaaagctaagctgtacagaagattgtggcagaatctgaggttatgctcaaagaaggatatgagaattggttgataagctcaaatcaagcatagcatcccgggtgttacatatgtatcgggtgtgaatctggcgatgtactagaggaagtcattcgtcaagctggtgtatatcatcccagatgtggaaaagttgtgtaccaattttatggattttgatgaaactggggtgtcaaaaggatttaaggagaatattttcatgtattaacaaaatgatggggcttgaggaata

SEQ ID NO: 684728 - DNA, 219 bp, Homo sapiens
gctataggcccttctcatctgtcaggggctgaagaaacaggggaccggtaaaccaagcacacaggtataagtccacagaccaggtgaaggcctagatggcaaaacacatggggcttggtgactccactacgtgacttccagagctaagagcaggacgtgacttaggtgacgctgttccgaagaccacgtgagctcgatggttcccatgtggcatgggac

SEQ ID NO: 684729 - DNA, 1022 bp, Homo sapiens
  misc_feature (504)..(504): n is a, c, g, or t
taagtaactgggtctgtaagtgcttttctctaaaacgtccccggcagattgaattgagggccagtgtggcctttggcagaggcaggtgtgtgtggccctcgttaaaggcaggtgctggccgcgccagggcatctcaggtgcgtgagtgtgtgggagcgtggtgcttccacctataagccgtgtggatagggggactgtggtggcattttaaaaatgtggtaaaaagcggcattccttttgtggattctctcctgtgggcgggagtgtgaacctgtgcaggtggccaccccaagaaacctgtgtggtctctgattgcactgtgcaagcaagtatacccagcttctctctcacctccgagtttctcacagtgtggcctattatatgtgtgtaattattaaaattctcaagagcgccattgtggtggaattatgcaaccctatagcattgtaaaaacattaccacctttgtgtgtgtgcgcccactgtgtgacatttgtgttcaccnagaacagttgtgttcacccagtgtattgtgtgtgttttgttgacaccccctgtgtgtgaagccgtgtatgtgtgcgcccccggtcccctgtgtgcctctgtgtgtgcccacctcttttctgtgtctcccggtgttcacccccacaaggacaaccctctgtgtgttgtcgggaagacagaggctcacaaaatctcttttccagctttcccggtgtgtgggagcatttcttcccctgtgtgtacactctttgcaatctcacgacaccatgtggacttctcaagagacggctcacttgaacactccggctagagccagacaaacgtggggtgctctgggagggcgttattttccccccccactactttgtgggcgtagggagtgagaagggacctaacaggttccccggtgggacttcttattaaacccttccccaagaaagcgagagggggccctccattgggacttccatttctcccaaagacatggtgccttgcaccatttctctggagagagaaccc

SEQ ID NO: 684730 - DNA, 81 bp, Homo sapiens
  misc_feature (14)..(14): n is a, c, g, or t
  misc_feature (51)..(51): n is a, c, g, or t
ggcacgagtttatnagctatctttttccccatgtaaaacttcaggtaaatnctttgcagattttttacttggaagaatgat

SEQ ID NO: 684731 - DNA, 137 bp, Homo sapiens
ctcttccaaactgccattttcgtgccttttaagtatgctttgtaattggctgttgataggtagacatgatacactgggtaaaaggaattgcagtaaacagggctttcatcctgttttcaggtgttggggataacata

SEQ ID NO: 684732 - DNA, 111 bp, Homo sapiens
ttctcgtctatcactgattagagtggggtggcaggtattagtggatatatttatttagcattctgaccattctgactctgcccagaacgccgtcccacctgcagacaccct

SEQ ID NO: 684733 - DNA, 173 bp, Homo sapiens
ctacattatggtgatttgagacccagattctgccctcatttgcgccggatgtgtagggctgaccctgggtttccaaattcctcttgttatctcctcacctctcccaccagattgctctcccaccttatatttcttcctccatagctttacctctccttttccattgccttaga

SEQ ID NO: 684734 - DNA, 210 bp, Homo sapiens
  misc_feature (11)..(11): n is a, c, g, or t
  misc_feature (20)..(20): n is a, c, g, or t
  misc_feature (28)..(28): n is a, c, g, or t
  misc_feature (84)..(84): n is a, c, g, or t
  misc_feature (183)..(183): n is a, c, g, or t
ctcaccctganatgggagcngtcttccnagcccaccatccccatcgtgggcatcattgctggcctggttctttttggagctgtnatcactggagctgtggtcgctgctgtaatgtggaggaggaagagctcagatataaggaggtggggagaccaccccacccccatgtccaccatgaccctnttccaacgctgacctgtgctccctccc

SEQ ID NO: 684735 - DNA, 560 bp, Homo sapiens
  misc_feature (328)..(328): n is a, c, g, or t
  misc_feature (332)..(332): n is a, c, g, or t
  misc_feature (352)..(352): n is a, c, g, or t
  misc_feature (385)..(385): n is a, c, g, or t
  misc_feature (395)..(395): n is a, c, g, or t
  misc_feature (435)..(435): n is a, c, g, or t
  misc_feature (447)..(447): n is a, c, g, or t
  misc_feature (492)..(492): n is a, c, g, or t
  misc_feature (506)..(506): n is a, c, g, or t
  misc_feature (538)..(538): n is a, c, g, or t
  misc_feature (548)..(548): n is a, c, g, or t
ttgttttgtcgcctacgctggagtgcagtggtgtgatcacagctcactgcagcctcaacttcctggactcaagcgattttcctgcctcaacctcccaagaactaggaccccaggtgcatgccactacaccaggctaatttgttgtagagaggaggtcttgctatgttgcccaggctggtctcgaactcctgtgcccaaaagatcctcccacctcagcctcccaacatgccagggattacaggcatgagccaccctgcccagctcaataacctaagttctatgaatgaaaaccatgactgcctgtgggagtgagggggccgtcagtggntggnggagctgggtgaagacccanccaggcccagggccagcttcaggttgaccttantccccccagnttcccactttccccttccccaagtggttttgggccgcagnattaaggaacantgttggggggttgttgaaaagagggggacgcaaggttgggggcantgcattggggaccnggggtgttcagggacaagcaagcagctttacngttttgtagntttcgtttgttt

SEQ ID NO: 684736 - DNA, 319 bp, Homo sapiens
  misc_feature (18)..(18): n is a, c, g, or t
aggtcttttcccctcaanagctcagtaatctttccacgttctcccttttcctgagaggtttactcactgagaagttcaggctggtttcgaactcctgatctcaggtgatccacctgcctcggcctctcaaagtgctggaattacaggtgtgagccaccgcgcctggcctaatttttaagttacttgtagagatgtggtctctctgtgtttcccaagctggtctcaaactctaggcctcaagtgatcctcctgcattggccttccaaagtgttgggattacagtcatgagccactgtgcccagctgcgtttcacttccga

SEQ ID NO: 684737 - DNA, 116 bp, Homo sapiens
cactgggtataaaccacattctttattaaaaaaaaaagaaacaaaagcagggtaggtggggagcagtggcccatgcttgtactcccagcgcttggggaggttgaggatggtccgca

SEQ ID NO: 684738 - DNA, 245 bp, Homo sapiens
ctgtcagtcgctctgggcataaacactaatgtcaattaaggcttcaactcaaggttaagtcaaactcaagtcaaggctgaactgactctagtgtcaattagggctggatggttggctatacacatggtattgggaacaactatctccaaaatgaattttctgatatccggcagggagtgagctcagactgaagacttgggcacagtgatgacatttataagatttctgtccagtatgcattctct

SEQ ID NO: 684739 - DNA, 689 bp, Homo sapiens
taaaaaggttcttggtttagccccccctccatgtttttaatcgaccaaaattgttggcaaacccttgagaaacaatttttttatattgccctctccaaaaaaaccggtgtaaggaggctgcccaaggttacagttttggggttccattttattccggaaacagctctgagtagtaactgccccttattgtatgtcgccaataatcataaacctgctccatcaaaaaagtagtatttccgcataattgatttgcctaaacttgcaatccacaaagaacgtgatgtgttttgtaacctgagcaagtgtattcggcaatccagagagatgtaaggtgcattttttccctccccgttgtgtcactccttgtgatgatagagggccatactacccgtttcagaccccatgtaatcgtgtcccgcatggagatgggctaagtagatagcaattggtttctcgcttaaggcaattcgccgctttggtagttgccataacctgtctcacttgacctgaagcgtctggcttcaattcacagggctcttttttgctcttagcatgcgggttccctaccacaggagcaaccagttctcatgggtggcactcagtctatcttctcccaagctcacctcatttttttcctgccccagttattttttccaacgactaaaacattaaggcagttttctaaaaaa

SEQ ID NO: 684740 - DNA, 99 bp, Homo sapiens
gccagcaccaaccagacatctatgtacctctgtgccagcagtttaccgagctcctacaatgagcagttcttcgggccagggacacggctcaccgtgcta

SEQ ID NO: 684741 - DNA, 100 bp, Homo sapiens
  misc_feature (55)..(55): n is a, c, g, or t
gccagcaccaaccagacatctatgtacctctgtgccagcagtttattcggcagcnaacaccggggagctgttttttggagaaggctctaggctgaccgta

SEQ ID NO: 684742 - DNA, 89 bp, Homo sapiens
gacagcagcttctacatctgcagtgctagagcggcccgagctcctacaatgagcagttcttcgggccagggacacggctcaccgtgcta

SEQ ID NO: 684743 - DNA, 862 bp, Homo sapiens
gcccggatcaccgtacctctcggcgtggttgccggagttcccgactgtgtctgtctctgtcgccgtcccgtctcctgaccaggcgcggagccctgtgagccggggtgggccccaggtgcgcatatcatgtgctgttccgcaaagcgcgctgggctgcggggcgctgggcgtatggggttactgtgcgctgtgctgggcgctgtcatgatcgtgatggtgcctgtcggctcatcaagcagcaggtccttaagaacgtgcgcatctgaccccagtagcctgttcttcaacaatgtggaaggagatcccttatcccttctatctcgtccgtcgtacttctttgacgtcatgaagcccagtcgagatcctgaaggtgcgagaagctcgcaggtgttgggagcgcggtgccctacgtgtacagggagttcaggcacaaaagcaacagtcgaagccttcaagaaacgaactgacaccgtgtccttcctcgagtaccgcaccttccagttccagccctccaagtcccacggtcggagagcgaggtacatcgtcatgcccaacatcctggtcttgggtgcggcggtgatgatggagaataagcccatgaccctgaagctcatcatgaccgttgtgcatttcaccaactcctcgggggaacggtgccgttcatgaaccccgcactgtgggttgacgatcatgtgcgggctacaaggacccccttggtgattctcatcaagaagtactttccaggcatgttccccttcaaggaccaaatcgggattattgctgactcaaaactccagaattctgggctccttcagcggtgtcacggggggtcaaacattagaggatcactcgtgccagtgaa

SEQ ID NO: 684744 - DNA, 100 bp, Homo sapiens
gccagcaccaaccagacatctatgtacctctgtgccagcagtttacatggcccaacttcctacgagcagtacttcgggccgggcaccaggctcacggtca

SEQ ID NO: 684745 - DNA, 98 bp, Homo sapiens
aagacagcagcatatatctctgcagcgttggagggactagcccgccgagctcctacaatgagcagttcttcgggccagggacacggctcaccgtgcta

SEQ ID NO: 684746 - DNA, 204 bp, Homo sapiens
tcccactcctacccctgacctcccatctcccgaatatgggcctccagtctctctgctggatacttgtaattccctcctaactagaactatcctagtatctatgtcactctggtccagatactgtattataacgggaaataggccacaattaaccttcctacacggagttctaggccacatacaggctcctagcttcagcaggct

SEQ ID NO: 684747 - DNA, 97 bp, Homo sapiens
gccagcaccaaccagacatctatgtacctctgtgccagcagtttatctcagggccgtgggggctacaccttcggttcggggaccaggttaaccgttg

SEQ ID NO: 684748 - DNA, 96 bp, Homo sapiens
gccagcaccaaccagacatctatgtacctctgtgccagcagtttatcgtacggggccaacgtcctgactttcggggccggcagcaggctgaccgtg

SEQ ID NO: 684749 - DNA, 146 bp, Homo sapiens
gcggccgcctactactactactgctcgaattcaagcttctaacgatgtacggggacatggtaagtactgtgtaagcgtaagctgctatatttatgtgtgtatttgagcctgggcaacagagtgagactccatctcaggaataaaaa

SEQ ID NO: 684750 - DNA, 94 bp, Homo sapiens
gccagcaccaaccagacatctatgtacctctgtgccagcagtttacccggcgaggatacgcagtattttggcccaggcacccggctgacagtgc

SEQ ID NO: 684751 - DNA, 101 bp, Homo sapiens
agtttacaatcacgtgtccatcgagcacgtctgaaagcccctggtagccccgacttctttttaattagaataaggtacgcccttcagaaaataatagaaag

SEQ ID NO: 684752 - DNA, 346 bp, Homo sapiens
catgaacaagatttaaaatttccctttgccaaatcctgtgtagagggtcctgcccacccatgggccttccatccttccaacatccgtccttggccccttcgtaaacttatacatttgcaaactgcctgatttcctttggggaattattccctataaactttttgtaaagtgtcagtgatttcacccattctttcacccaagcttcaccataggttttatgtttgttcttgcttccatttaaatgcagaatttatgttgctctgataggggctcttttcaagttgatgtcttatgcttcttagtgcctcaaactagatcctgctcagacatgttatagccaagttag

SEQ ID NO: 684753 - DNA, 937 bp, Homo sapiens
cttatttcccgctcctcctgtgtgccccgggccggtcctctttccctttgattgccgggcccatccggcagaatgaacagctcggagcgaagaggaagcgagctgcgcgctcgattaccagtctgaaggagcaagcaataggcgaatatgaagagcttagagcagagaaccagaatacacaggagacgtgtgacacacaagttaggccagaacgagatgaagccgtacaaaaactggcagaatttcagacccaatttctcacatggtcatcgcggctgtctattacagtgcagaagcatcttgaaactagagaagacttgtcgagaaagtgctgaagctttggcaccaaggctactaagaaataaacgtgagagacttcgcactgtggtacatggccaagctgggaccagatgtatgtaactgaagagatcacattgatgaatgaagattcgactacagacacagacggtgccgccgagacttgtgtctcagtacagtgtcagaagccaatttaacgaaccttcgagatcccacattgtatctgttcaggaggcaaccggaacgatttcgcccttggaggctggaaatctcaagagcaaactcgtaaagtactgaagcagttacaataaagttcagcaggacagacggtttaaccttccggaagtttcttgtaacgaggcaccggtctttggaaaaactggcatggagtgtgcccggttagcctgtgaacaagcttttggcgcaggtccagtaaccgtggggtggggaaggcccctgtcaatagaatccgacattgccccagtggtttttggggcaagcctatgaaaaccctttgggggaccacagcttaaatggtgtataccttaaatgaccccgctgtgacacgagttactccaccgcatattacacaatagccagcaaactctccggccgtagt

SEQ ID NO: 684754 - DNA, 90 bp, Homo sapiens
  misc_feature (45)..(45): n is a, c, g, or t
gacagcagcttctacatctgcagtgctagagcggcttcggcagcnaacaccggggagctgttttttggagaaggctctaggctgaccgta

SEQ ID NO: 684755 - DNA, 87 bp, Homo sapiens
tctgtgtacttctgtgccagcaggtccagggggccgagctcctacaatgagcagttcttcgggccagggacacggctcaccgtgcta

SEQ ID NO: 684756 - DNA, 1344 bp, Homo sapiens
  misc_feature (517)..(517): n is a, c, g, or t
  misc_feature (541)..(541): n is a, c, g, or t
  misc_feature (545)..(545): n is a, c, g, or t
  misc_feature (563)..(563): n is a, c, g, or t
  misc_feature (594)..(594): n is a, c, g, or t
  misc_feature (661)..(661): n is a, c, g, or t
ccacgcgtcgcgacgcctcatggagacccatctaccttgttgggagatccagtgtccagagcaggtggtcggtggcatctacggggttgggaacaggaagcggggcgcacgtgttcgaggagtcccaggtggccggcacccccatgtttgtggtcaaggcctatctgcccgttgcaacgagtcggctttggcttcaccgctgtaccgtgaggtccaactacgtgtgcggcatggcgttgcccccagctgtggtgttatgatgcagctggctagatcctgcccgtgcagatccccgttcgacaacagctagtccgccccagtccaggtggtggcggagacgcgtcatagcgcaagggcctgaaagaaggcatccctgccctggacaagcttacactggacaagattgtatggcggccttcctgcaagcgcgctgccgcgcccggggactcgcagtcaccagcagcaccacgtcctcgaattctcagacgacacctggagactgtcccgacacagcgangctcccctgagaggtttctggggncccntgcgtgccatcactcaancataacacttgatgccgtttctttcaatatntatttccagagtccggaggcagcagacacgcctcttagtagggacttaatgggccggtcggggaggnggagggggatgggacacccaacactttttccatattcttcagagaggaaactacagatgtaccaaactaattttaacaaacgcattcaagaggtattatattgggtacaataggcccgcagatggcttttgcacccagcaaaggggaaaggaacacgcgaggctagatgatttctagcaggacaggaagtcctgtgcggtagtcaccatgagacacctccagagtgtaactaggtagccattggaatacataaatttgcgtcaggtggatgaaaaagcacaacacaaaacaaaaaagaaaagaaacaaaaaaaaaaagaaaaaacaacagcacaaccacacaaccaacacaaaacaggcgacagagcacacacaacacaaaagcggggggggagaccgcaccaggaacgagacaggatgcagaggggaggcacgaggagggagagagaagaggaggagggcgaaacagaggagcgagcggaagcggaagagagaaagagggggacgggaggagaggagggagagagagaaagagaagaaaaggaagagaaggaggagagagagaggggggaagcgagaagaaggaagtgaggcaaggagggagggaggagggccagagaaaggggagaagggacacacaggaggagggaagaaggccagggagagaagaaaacagggaaaagc

SEQ ID NO: 684757 - DNA, 411 bp, Homo sapiens
ggctgtctagaggatccacgtatatgtaccatgtgtagcatatatcagtacttcattctttttatggctgaataatataccatggcatagatatataatcatgccttcttagtgatggggatatgttctggaaagtattattaggcgttcttattatgccagtgtcatggggtgtgcttacagaagcctaaatggtgtagcctaatggacactaggaattatatggatagcttttgctcctaggctacaaacctgtacagcacgttgctgcactgaatactgtaggcaactggagcccactgttaagtatttgtatatctaaacatagaaaaagtacagtaaaaaacagtgatataatctcatgggaccataccatagtcatatatgtggttccttgttgactgaaacatc

SEQ ID NO: 684758 - DNA, 649 bp, Homo sapiens
taaaaacataacaggggaacattaagcgatgtacggaagaaaagtagtaattttctgatggcacagtttgacacagtaagttaggttcaataggcaagaacttaaaagcatgtctcaaacagcaagaaaattcaattttcaaattaaactattacttctaatggggtcacatttttaactacagggataattatacttaaagcagcgaactggtgtctgtctcttcattcattttcccagccgccaacttactttaccacttatgactgcacttgtcagtatgagaattttattgaatcatattgggcaagcagtgattttaaaacctcaagtttttacacatgatttatatgttctgtataatgtccagtttgtaactttttaaaagtttgaatgtatagagggataaataggaaatataagaaattggtaatatgggggcttttatccttactgtatttagaaatacaagggtattgatatgaaattatgtaaattccaaatgcttatgaatcgaatcaatgttgagcaaaagatctgttggtgtgtaaataatgtgtggcaggcatttgagagacataaatattcccataattatgttttggatcaaataggcataaaaaagcctagtaaaagtgcctattctgca

SEQ ID NO: 684759 - DNA, 961 bp, Homo sapiens
cgtccatctactctaccatctttgcaaggcacactcatcacagcgctaagctcgcactgattttgtacctgagtaggcctagaaataaacatgctagcttttattccagttctaaccaataggaaatagaccctcgttccacagaagctggcatcaagtatttcctcacgcaagcaagcgcatccagtaatccttctaatagctatccgtcttgcaaggaattgatactcctcacggactaatgagaccataacctaattaattaccatatcaatacttcatcattaagataagtcataatggcgtatagcgaataaaacttaggaatagcccccctttcacgttctgaggtcccagaggttacccaaaggcacccgttcgtgacatcccggtctgattcgttcttgacatgagcaaaaactagcccccatctcgaatcatatgccgaagatctgtccctcacgtaaacgtaagccttgtcctcactctctcagatcttgatccaatgatagcaggccgttgaggtggattaaaccaaaaccagctacgcaaaatgcttagcatatgcctcaattacccacataggatgaataatagcagtggtaccgtaaatcctaaataaccagttcttaatttaactattatatgatcctaatagtacgcattctactagtcagttaactcagaccgaccctactactatgtcgcactggaagaggtaaatgataaaccgttattccttcacttcttcctaagaggtgacccgtacgctgtttgcaagggctctctgcaatgctccaaataagggttttccccataagaaaaccctttattaataaaggatatccccaaaaccctctaagaaaagatggtggaaccctccccagaagacatcttgattaaaaaaaggaagggggggctagatgttatgttgtctgtctttatttcttatcatgtgtgt

SEQ ID NO: 684760 - DNA, 131 bp, Homo sapiens
gaaagtagctgaagtcgatatcagatctagtgacgctttgggccaagatcatggggtttctagatatagaatcatatcgtctgcaaacagagatacttcgacgttcctttctttttggcttgccttttatt

SEQ ID NO: 684761 - DNA, 191 bp, Homo sapiens
  misc_feature (134)..(134): n is a, c, g, or t
  misc_feature (181)..(182): n is a, c, g, or t
cctaagtggaactgctccggctttcaagcccgcgagcctagcccaggcgcatgacagatttgcgacaggaaggcctgtcatccaagcgtcaccataacttcatggagctgacaccgacgcctacatagcctgangtttggacaaacaatgtcgacctggccgcgtacgtttggccggcacnntcggagcag

SEQ ID NO: 684762 - DNA, 153 bp, Homo sapiens
gtcggggtttcaccatgttggttaggctggtctcgaactcctgacctcaggtgatcggcccgcctcagcctcccaaagtgctgggattacaggcgtgagccactgtgtccggcccaaaagctgcattttcagttcgagatgaaaaggtatttc

SEQ ID NO: 684763 - DNA, 105 bp, Homo sapiens
tgtgtgtgtctaagtggtgacggtatgtgtggtgtaggggtgagtggtgatggtggttgtgtggcgtgtgtgtgcagtgttttcggtgacgggggctcctgacga

SEQ ID NO: 684764 - DNA, 476 bp, Homo sapiens
ggaacaagtgatgtggaattaatgggtgcaaaagctgtacagacaatccaataacacacacagttctggaaaggaacacatcacttgtggcttgttggatgacgcttgtcaccattcctaatccctctccccatccgtgtttcaatttggggaacacttgtatctgctggtgtcagccaattctgattctgaactagcgactcacaggctttttacatacacacacgccttgctctttcatattctatgcgtgtccgactcgctggccttcatgacactaacagcgccaggccacaagttgtgcagacacctcggtcttcaccggaccatttatctttctatttgtcctgttttacacgctaagtgtttagcactttaaagatactctaattttcagaagttcaatacttgtacaaaggtaattctactgtacggtgactaacaggtaccactgacgaccaacaagggttacttga

SEQ ID NO: 684765 - DNA, 286 bp, Homo sapiens
cgacccgtagcgtcggtacaattgacgtgggcaacgcgcccatagatgtcccagtcatcgagcagtaccccctggaggtcgaattcgacacctctcgacttcgccccatacagtgtgtgctacgccaccgatatcattcggcagcgcgtagctatgccgcctgcgccaggttatcgagccgcatatatcaaacaaggcgctcgaagcatacaggcgcccgtctaaatattcgacccttcaacccgacttgggtgtataatcacataggttggctggaacgtaacag

SEQ ID NO: 684766 - DNA, 405 bp, Homo sapiens
ttgcggcgttgcccctggggtgcaatactgcaatcttggctcactgcaacctccacctcctggttcaagcgattctcctgcctctagctgggattacaggcatgcgccaacacgcccagttaactttttgtatctagtagagttggggtttcaccatgttggtcaggctggtctcgaactcctaagcttaggtgatccacctgactcggtctcccaaagtgctgggattacaggcgtgagccaacacacccggtcagccaccacatcggcctttttttttattttttttggcctcgacactggcgtctcaggcgggtttcaaactctggggccccagtgattcacctgccagtggccccccagagtgttgaaattacgggtgtgagcgaaatagtctcactctgt

SEQ ID NO: 684767 - DNA, 905 bp, Homo sapiens
ggtccgccgccagtcctctcaacgcgcgcttggccgcccgagacgcgggagccgacgcgccggacgaggctcgctgcgctcccttgttgcccagcgcgggcccgttgaggcggagccctcagttccgggccaggacacggtctgggccgcgaatctccggcgaagagcggcggggcaggggggggaacaaattgaggatgaattgtgctgccgtgtcttcttttcaacaaggctagtgcgaaaacatgatatgtggaaccaaagaggcagtcgagaggttgtgtgaggaatttggaccctaatacttcaggacaatttaacaattcagtgtatccagaaaacccatcgaagggaccgggctacagatgtatcgggtcactaatttcaagagagtggatcctgatgtctgaagcctgtgaaaacagctgcatctgtgttatagtgacctggtctggccaaaggaaggctcactctcttgggtgccccatgtgaggtgtgtgtcggtatggagagacacaccagtgctcatgtgtggcccgtttgaaaataccgatgacgaccagggttgagcttctcagggaaaagttacccaggcccttgataaggttacctcttggttatcatcaggatcctccttcctcagatcgacgaaccacggacggacttggtgtggcaccccattcggtggctgcagccgagtccgtgtccccgtttcgatttattttcacttttcatgtgggccttggcccaaaaaccccgatgttcggcgaggccaaaacatacccccggctgggtccacccggaagaaacctccgcccggggggccccggaggggcgcaggaccctgtgccacgtggggtggcaaacacacacatgacggtgggacacactccaacaacggagcg

SEQ ID NO: 684768 - DNA, 1217 bp, Homo sapiens
agggggcaagccatggaggcgacgcggatgcggatgcacctgggagcgacggtgctggcccatggcgcgcagctgggcgcctccttcctgacaggccaggcatggatctgtgagcgctgatgaggctgcccgcacggctcccattccaccgtcgacctctggttctacttcacactgcagaactgggattctggacttatgggctgtaccattgccatgcatggtattccctctcgacgtggtttccactcaacaagcccagtgatggggactacattccacatggcctacaacgtcatcaccgccactttactcattgctcaagctcatcgagcggtccccccgcaccctagccaacgctccaatcacgtacgttgagcatcatcatcttcactcatgggtgccagcatccaccatggtgggtgactctgtcaaccaaccgcatgctctccagtggataccagcacccaccatgtctgtacgatgagaaccccatcatcaagaatctacacgccggaggacgctgatcgactcctttgagctgctctactcatatgatgagtacctgggtcactgccatgtggtacatcccccttctacactcatcctccttccatgtactatcagcggctggcttactggcatctaaagctgagagcctctgattaccagggcctgccatgctcactggtgagcacccagtgggacctgcactaactggtaccatggtaaccgaggcccaagcatcttcacaatccctccatgcaatcatatcacaccagttcttcgccatcgcttgggcactcgtaccgtgcaccaggaaaggcgcagcgcgaccatacatcaggggacacgaacagggcctctctacctatatctcatccatcggcagtgccccgtgtgcgtgggtgacgcgactaggacgacgagatgttgtatatgcccgtcacacagaacacagacacccacgggttacaacaccgccaacgaccagccaagggaacacaacacagtaaagacagagacgaaaaaaaccacaagacacggacagaaacaacgaaagacagacggagcagacgcaaaaaacgagaaagggcacgggaacaaacgcgagacaggtagccgagagacggacgtgagaccagggcagcgagccccgccgcgccgccgaacagccggacgacacgcggaacaagacgcgacgcgagccctacgaa

SEQ ID NO: 684769 - DNA, 435 bp, Homo sapiens
  misc_feature (36)..(36): n is a, c, g, or t
  misc_feature (48)..(48): n is a, c, g, or t
  misc_feature (121)..(121): n is a, c, g, or t
  misc_feature (123)..(123): n is a, c, g, or t
  misc_feature (125)..(126): n is a, c, g, or t
  misc_feature (310)..(310): n is a, c, g, or t
  misc_feature (312)..(312): n is a, c, g, or t
  misc_feature (314)..(314): n is a, c, g, or t
  misc_feature (316)..(316): n is a, c, g, or t
  misc_feature (368)..(368): n is a, c, g, or t
gccaacggtgtgacgtcatgctctaacagcggcatncctggcgctccnattatcgaatgcggtctgcccactgttgcgccagagcgggagtggcaaccggtacccacttccccagaggcanantnntgcgcttgcatatcggcccattgcccattgccaagccgtatagccgcatcgaaccctttgcgcgatagatcctgcacggccaacgatgcatcaatatccagtgcaatgtcggcataagtcgcgtggaaagatggcaggcgcggcattaaccaataatgtgcaaaagaaggcagcacgctgatancngnanacgctttggccaggcgtctgacccggcctattccctgttgcaatgccaacangtgcggctcgcaaccgccaacaactcacggccggcagcatttagatgcaacccccgcccttgtcgtt

SEQ ID NO: 684770 - DNA, 220 bp, Homo sapiens
gtcgtatgttctaattaaaagctaaaaggacttgcagctccatcagtttcaccccacaatatggagagcactcaggtcgaggcgtactgctcccagctcctgcaaaatagcgcaggcatggtctgaggcgagggcgatgcttccatgaggtgtccgccgactgcgtcgcgatcctcaatggctcagtgacttgctggccttgagcattcgttgaaggatg

SEQ ID NO: 684771 - DNA, 239 bp, Homo sapiens
tttttttttttaccccaaccccccttatcccaggggggttttattttagggggggggggggggttttccatttgggaaattgccccccccctttcccccaagggttttccaagggtttcccttttgggggttaaaaaaatggggccccccccaaaaaagccccttgggttggttgggggggggccccccaaattttaatttccgatttttttttccaaaaaagggggttttttccctca

SEQ ID NO: 684772 - DNA, 735 bp, Homo sapiens
agcgggtttgatttgtacttccctgataatcagagatattaagcttattttaaattaattaattagagacagggtctcgctctgtagcccaggctggagtgcagtggtgtgacctcagttcactgtgacctccgcctcctgggttcaaacaattcttctgcctcagactcccaagtagctgagactacaggcacacaccaccacgcctggctaatttttgtattttcggtagagacggggtttcaccatattggccaggctgctcttgaactcctgacctcaagtgatctgcctgctttggcctcccaaagtgctgggatgacaggcatgagccaccaggcctggcctccagtctgcaattctaaggcaggacacacgctccttgaatcatctcagttgcccttgtttgatctatgtccaactctagtccacctttttatatacatatatatttatttatttatacatttcattggtagacgccttctgatgatgcccaatgtggtagtgagttggcaaaaacagcacacagagcaaatttcatgactaacctcccattagtgcaaggttgccctaggactgtaataaatcagatcgtaatgaagcctggtatattataaatagttgtgtcccatgtttattacataatgcttatgatgtgctgtaattgcaaagagtgcaggttttcacatcagaaataccttggttgattcctaggcacttatctggtgtgaa

SEQ ID NO: 684773 - DNA, 891 bp, Homo sapiens
ggcgaaaggaacactgactgaagcttttcctgtcctaggtggaaaagcaattgaattttgcatagctcgtatggtagggcaagtctacagtgatgtcaacatatgattataccatattctttccatgggatagtgtgtactagctcctcagttaaacattcatagcatcggaaggaatcaaccgctttgatgttcagtacctccttgaaaatacgaagatctaggctccctgcatcaactttgaagaactgggtccaaacaactgcagcccagtgagtagcaaaaacaaacacctttaaggatcaagagatgtctagccaaataagcgtcaactattacatgcagatggtcctgaacgatataaactttcatcaacccaagcagtggggcaagtaactcccaagctagccactactttgtgcaactcattcatatgcaatctgaatatgacagccaactgttggaattcatacattcgcaccaagaacaaaaaggcagacatgggttcaaggcagattgcctatccaacaatcaagtattctgattgacaactggacgaaaaggagattaataccaattacagaaataacagatttcgccatgacgcacaactcagtgatatagggcaccggccttagaacgaaacattacgacataaactatggtaagcactcaataagcaattatgtacctaaaaaaacccattgcaagcatttaaggaataattcacttgagacaattccatagcttacatggcacatatgctcgggggacaagggacgaacaattccagagacaaagtacggagcacattaacaagccacaaagatataaagcaggccaatagattgggatcaccttcgcttaaccaggaggaatacaaatacctac

SEQ ID NO: 684774 - DNA, 1236 bp, Homo sapiens
ggcctgcaccagctgttgcttcgctgggcttgggagtgccctggggtccccgtggcgaacagagggctgctgtgtggactgacgccgcaggggcgagctagcctggctccgctgcctctccgctgggatccagacgcctcctggtggcttgctggctggagtggtctgagtgctgtgctgcggtgccatggctcaccgtccggggattttgccaaccagcactctcgcagtggaccctgagtgagctcttcaccaagctctgactgcattggccagggctcgtttggtggcaggtctacaagtggcctcgataaccaccaccacatggaccgtggtggccatcacagatcatcagaccatggatgtgacggcctgaggatgacgactcggagggacagatccatgcagtgagatcacgtgtcctcaggttcaggttgcgacaaggctcattacaatcagcccgcttaccttactggctcctacctacaagagcaacaagctattggatcatcatggagtaccttgggctggcggctcaagcagctggaccttgcttaaacccaggtcccctggcatggagacatagcatttgccacggatccttgcgttagattctgcaacgggccctggattagtcttgcacctccgaaacggcaaggaatccaactcgagaccatcaaatgcttgcacacgtgctaactactcgggagccagtggttgaccgtgacagctggcggaccgttctggcgggtagccacgggccaagcttcacatgcactgccgccagcatttacatgagggaagccaccatttcgttgtggccggccccactttcctctggcatggcaaccgtgaccggtccattcctgcggcaggtccaggcacatatacgacttacaccgggcgtgaccatccttgtatccccatgggggattcatgcaggcaccacattgggatcgctttgcgccgatctggtgtgtgtggtcactcgcacaaccacttcatgtgacccctcgctaatccccaatatgtcgtggtgttaccgtggttcccgcgtcactttccccagagggaacgcagttgcctagacccccagtacctggtgtagtggtgcccagtggcacacggaccaaggcccctttcacagtgcaagcgttacgcagtgtcgagtgcccattacccttcacagcacagaaaggacaccacccgtcaattctccggtgcacagcaggtagc

SEQ ID NO: 684775 - DNA, 342 bp, Homo sapiens
gggggggaaaagaaagacccccagaaagaaagaagaaaagagtgggggttttggggaaggggagggggaattatgtcaaaaggtaaaaaaagggggaaggggggtggaaggaaggaaggaaaaaaaaataccccgctttttttgaaccagcagatttgcaaaatgggccctcagtgcaaatggcccccctcggctggggcagagggctctttttttttttttcagaaagagttttttgggtcaccagggcacccatagccactttactcatttgtgttacctgtctggcccccgaaagtttttgtgattttgatccccaaaaaaaccataaagctttcttca

SEQ ID NO: 684776 - DNA, 1331 bp, Homo sapiens
  misc_feature (811)..(811): n is a, c, g, or t
  misc_feature (964)..(964): n is a, c, g, or t
  misc_feature (1196)..(1196): n is a, c, g, or t
cccgtggcgaggcgctgtttgttttgcttcgccgcccggcgctgcgttatttatgttgctgtactgctgtcccctgtgggagcgctccccccgttccgatctaactcgtgtggggagggtcgcgccgcgctgtcgggctttatgaacgcactgctgattggtagctcgctgagtttgttcgagcgacagcttgatggttcttttttgttcccccccccgcgtgacgctgggttaagcctttgatgtgcacaatctccgtgggccccctcccttggggggggactcccaagcttatttgaagaggcttgtaggcacatttttccctgtgtgagaaacccttttagaggtcacaccccattatatgtttatctcggagagagaaggaaatggtttaaaagggggacacacacaggttttaatggcaaagaattctcctctccaaagtaccctcgagagggacccttttcttgggggcaaatgtaccccagatacgctcatttcttagaggtctcccaaaaggtcttaagaacgactctgtttcaataacctgttatagcccaccttttgggccaaaatgggtttggggaaccactggaaactttgtccacgcactatgagagagaaaatgtggtactcgtgtaaacacattcacgagatggttatatgggacccactcacataccaccgtttgaaaggtgaaaaatgcccaaaatgctgacactctccccacacctattgagcccctccacgtatatgacactctcttaaaaggcgaaatttatttataagtctccacacaataactctcttntggaggtattataaccacgtacacttgagactctttgtgcacacacacacacttgcgtaaataaccctcttctgcaataacagtgtttaattttctctttctcgaatgttttcacagctatacacacactcgagagttataccacagagaagnctataaataaatataatataaaatgagagaaccacgatatgcttaaaaatatttgaaaattgtcacattcctggccgcggtttggtggcttaacgccctgtatgtcccacgcacactttgggaaggtccaaggcacggcacgatcaccgaaggtcacggagatcgaaggccactcctggccacaacacatggtgaaaaccccgtttccaccttaaaaatcccacaaaattancctgggtatatggtgaacgcacatgcctaaatatcccacgctatctcgggagagactgaggcataagaatcacttgaaccccggaggttgcccccctgcactccagcccggtgacagagccagactccgtttcca

SEQ ID NO: 684777 - DNA, 452 bp, Homo sapiens
cgtacagagttgaggattttttcctctcttgtactaataagcaatctgtaggaaaacaaaggcaaaattttccctagatttggcatctgttaatgattcttgcctgacctttaccacagtggttgcaaagaaaggatgttcctattctaacaccccaaccacacttaccagttagtctttggctttctcctgtggggaagagctggcccgtctgttttatgtttcgttttgttttatccatttgagcactactttaccttctggtataacaaaatattttgaggtcatcttgtacctttcttgtccaaactatagcattaagcacttcttgagaaatctagttccatttagggggaatgatggtagagaccaagatttgggtgctgagtgtgctcgttgctgcttgttgctgtctccgcgccctttgaccctcacgtaccatttgtataatg

SEQ ID NO: 684778 - DNA, 98 bp, Homo sapiens
tagacttgattgctattggagaggaatgactttctttttctcagaaatttcattgaacacagctttacatttaactggcaagtgtctgatctaacgag

SEQ ID NO: 684779 - DNA, 823 bp, Homo sapiens
  misc_feature (96)..(96): n is a, c, g, or t
  misc_feature (115)..(115): n is a, c, g, or t
  misc_feature (132)..(132): n is a, c, g, or t
  misc_feature (217)..(217): n is a, c, g, or t
  misc_feature (252)..(252): n is a, c, g, or t
  misc_feature (261)..(261): n is a, c, g, or t
  misc_feature (307)..(307): n is a, c, g, or t
  misc_feature (312)..(312): n is a, c, g, or t
  misc_feature (397)..(397): n is a, c, g, or t
  misc_feature (430)..(430): n is a, c, g, or t
  misc_feature (566)..(566): n is a, c, g, or t
  misc_feature (575)..(575): n is a, c, g, or t
cggacgagaaggtgtacaacgagccttttctctccaacggtaaacacagagacagcttgggaataagccaaaaacagggtgatctcattagatttngaagatatatgactccttngggctacatttcatatngatcaatttctaggtatttttcactggcccaaagtattgcattcccttaacagcaagcacaagttctctatatcacttgtttttngttgttgttgttgtagtcgtcgttgttttgagacngagtcttgntcaggtgccccggagtgcagtggtgcaatctcagctcactgcaacntccanctcctgggttcaagcaattctcctgcttcagcctcccgagtagctgggattacaggtgtgtaccaccacgcctggcaattttttngtatttttagtagagatggggtttcgccgtgtnggtcaggctggtctcgaactcctgacctcaggtgatccgcctgcctcggcctcccaaagtgctgggattacaggagtgagccactgtgcctggcctatcccacttggtttttgactgaaggggaagtgtagaaatntattgattngtgatttctggtgtcacctgtgttaccaaaaatcaaaacaaatcttcttatccctgatcattattcattatttttgagacagagtctcgctctgtcgcccagtgtggagtgccagggtgtgaatcttggctcactggcaactccgactccaggttcaagcgaatctcccactcagctcctgagtgggtcctacaggcgcaacgacacgcccagctattttgtatccagtaaagtgggggttcaccaag

SEQ ID NO: 684780 - DNA, 401 bp, Homo sapiens
  misc_feature (129)..(130): n is a, c, g, or t
cttcgacaatctcatttctaccttccaacatctcatttctccttccaacatctcatttctccttccaacatctcatttctccttccaacatctcatttctccttccaacatctcattatctccttccannatctcatttcacctgccaaaatctcgtttctccttccaagatctcattcatcctagtactatatcactaatatcttctatgttttacctattcatctcatttctggctcatcttctagccactagaatatacacttccatgagagtcacataattttatattcaatgactcttattcgtccttgcctctgatcatatctaacccctagaaggtactcaccattagctgtagtattaataaattcgcataagtaatacccgagcctgaagta

SEQ ID NO: 684781 - DNA, 271 bp, Homo sapiens
  misc_feature (129)..(130): n is a, c, g, or t
cttcgacaatctcatttctaccttccaacatctcatttctccttccaacatctcatttctccttccaacatctcatttctccttccaacatctcatttctccttccaacatctcattatctccttccannatctcatttcacccaaggaagacatagacctggaagaatgatgctgtgtaggttatttttatccctctctgccatctcctcattcaagggacacctgcacctcactcctctttgggtgtgtgtactgctctattctgctta

SEQ ID NO: 684782 - DNA, 1006 bp, Homo sapiens
gccaaaccgtatactccgcccgagcgagcctcatggagatccatcgatgccgggcatcgacatgtctggtggggcagtgtgatgggcacgagagttgatcacgccggaattctgactcgcgcttacagcttccacatggacatgagcggacgcgtgttcccggtgtacagccgatgctacgacggtgcaggtgaatgggcaggaaaagtactcgtatcgtgaatgatgacggtcggcgcgggcggtgcccgaggcgttgcgagccggcggcaccatccagggcttcctgggcatactcttggaccacgcatgtgcctttaccgtcgtggaacttcgaccccgagggacccctatctctcatcgcgccgtttggtcctgcttcggcagctcgtgttgagcgtcggtcgcacgggacttggttctgtctagggcctcatctgccctgggtagtgacctggtgatgtggctcctggcgtcagactggtgtgttgagttgggcagcttgcactcggaacacggtcccttgtttgcttcccttttggttggtcaaggagttcttttggagagacaacccaatgtccctggcaacaggagcagaaccccgcgtggatcttgtgtccttcctctgatggcggagcttgctgggaaacggttgctacggtcgcgccgcttctggcactagtcatctggcctacggtctatggctggccggctgtcggctccctctgactcccggggcaggtgcctctgtgcgtggcccattggaattgtagcatcaacatcttccctcgtgttcgacaccatgggccgcctttcccaggagttgtggtccccagcagagcctggatccgtcttcccttctggctccgggggctgtgggggttagaccggggggcgccgttgggccggaagcctcaagaacctcacgtctaagagcggtcccttggtagaaaagccagtgtgtgggccctggtgtgcccaagtgcgccttccctggaacctgggg

SEQ ID NO: 684783 - DNA, 265 bp, Homo sapiens
  misc_feature (129)..(130): n is a, c, g, or t
cttcgacaatctcatttctaccttccaacatctcatttctccttccaacatctcatttctccttccaacatctcatttctccttccaacatctcatttctccttccaacatctcattatctccttccannatctcatttcaccgctattatccactcggtgttacctattgcaagaaatgagatgttggaaggagaaatgagatgagaaatgagatgttggaaggagaaatgagatgttagaaggagaaatgagatgttggaagg

SEQ ID NO: 684784 - DNA, 347 bp, Homo sapiens
tcctgtgtatgacctctctgcttctgtcgctcgggacagtcaaagctgtcgtctccgaagtatgttcttatcgattcgctgattcctggctattcttcgctgtgctcggtagttccatatcccggcaggtaccttctggtgcttccatcgcgtctcttgatttgccttgcttcattttccaattgtcgtctgggccatatccgtgtgaagagacaacattttcagttaaaggaagactatctattcttttagtgagattctgaagttgagcgtaataccagtctttttccttttcttctttgtcacgatcagcaagaagcaatgacctctctttctcaagttcttct

SEQ ID NO: 684785 - DNA, 182 bp, Homo sapiens
cggtcccctttacattcatttctccttcaacatctcatttcttgtggagttatatcaaaagctattatccactcggtgttacctattgcaagaaatgagatgttggaaggagaaatgagatgagaaatgagatgttggaaggagaaatgagatgttagaaggagaaatgagatgttggaagg

SEQ ID NO: 684786 - DNA, 1061 bp, Homo sapiens
ggagtcgagaagcatagagcctgagttgatacaacgtgaagagtgagctgcacccatggatccgctgccactcctccactgagtgaagtgaaaggctccctcctcaaagcacctatcaggggtgccctgcagggtgatgccatcggatacgcctctagagaaggaatcagatcatagtaaaccccggtgagtggatccttccctgcacctgttgggtggtgctcttatgagacactggattatagacggaatggataaatggatgagctagggctctgtgtgcgtctgccgtgcacactctggggagccagtgggccccagcaaccctccagtgacaggagatctggggatgcctggcatgctggagctacatgatgttacagacgggttacgtccatcaaaacccccagtttctcacctcatgtcccacaaggacaaggctagcaacaagaggcgagatgggagcaaataactcgtgactgcatggagtacccaacgttgaacgtgcgctggcctcccctgtctcagggagcaggtcaccaggtcaccaatggggcacattctagccagcccacatgcggaggagaatgccaacccaaacgaacccaactggcatggcgacaacatcaacgagaggagaggcacggaacgacagtcgaggcggcgacctgatcgatgacggccagcaaacgagacgaccgaagagcacagagagcagaacgaggcggaaagcaaagaagtagaacaccggacaagcggacgccggagcaacaccagaagagagaggccgagaggaagaagacacgaacaaaacacgagcgcagagaacgaacaaaaagcgagaaaacgaggacaacgaaaagaacgaaagagagaaggacagggggaaaaaagggaagaggcgaacacagagacacgagagcgcagacaaccgcgacacagacaaagaggcgagaggagggaacgagcccaggtggaggaaaaagaaagaaaaaaagagacagaacgaaaaaggaaagacgggggagagggaccgcaggacgagaagagcgggaggggag

SEQ ID NO: 684787 - DNA, 106 bp, Homo sapiens
acacctctatgagttggtgctactttatcatcctcattttaaatgatgaagaaactgaggcccagtgcagattaagtaatttgcccaaagtcacatggccactcaa

SEQ ID NO: 684788 - DNA, 1251 bp, Homo sapiens
tggagaagacatgcggaacaagatggacagtgagatgaggaggctgcaagacttcaaccgggatcttagagagagattggaatctgcaaatcgccgcctggcaagcgaagacacaggaggcccagtgccggcagtcagtgacatgtgtggccaaggctgctatgcatcgagagaacattaagcggaaacaacccaagtgccgaggttacgaaggaggcgaaaagggtacgaaaaggccaaggcgcaagaaggacccatgggggtgaaaagggccgcccggagacagggcacaaaggcggccacaattaggacggaagcccaaaaaacccaggtttggggcaaccctttgggggacccagggaaaacccacgtgctgtgcaacatgagaacccacccataaagatattaccgagggagaccaacacggtcggagaaaaaaccaccagaaaaaaagagcgcccccggtgggagcgaggacacaccagaagtgggaagtgacgaaaccatgtgtggatttttttgggggaccacacacacaccaaatgaggcgagaaaacaccggggggaaaccccgcaatttctgggggggacgaccccaacaaattatttgggcggggcagtgcgcactccacaacacaggcgcgaggcacacaccacccaagaaaaaaaacgaaggacgacggagaggagcgacgcaacaccctcgacaagaaattttttacccccccagatatcatttaggtgggggcggcacacaacggacggaacaacagtcgcggcggcacgacaacgccccacgagaaaacaaagaacaaaaacacaacctcttcgtgcgggggggcacccccccacaccagaacagggggagcacgcacacacccccacgacacaaacaacaaaaatgcaggagaaatcacgcgagcgggtggtacacgggacagagcaccacacagaccgaactgcagacagacaacaacaagaaggggggggagaaaagagatgacataaacagagaagcggaggatgaacacaacaccaccaacaaaaaagaaaagagagagagagaagaagaagccacccagaacagagacaaatactctccccacccccccccccgaggggggggcgaacgatcaaaacaaaacaaacaagaggcgagcggcgaaaaaccaaaccacaccagacgaaaaccaccacaacagaaagggggagagcgaaagacacacaacaacacagaaagagaaaaaaaaa

SEQ ID NO: 684789 - DNA, 136 bp, Homo sapiens
actgacttacgtatgttaaccaaaccccccctttcccctttaaatgtataccatctactcgtgctgaatccttccaaggcagattgctccagcgtatatctccaggtcctcgcttagatcgattttccacaaacaa

SEQ ID NO: 684790 - DNA, 372 bp, Homo sapiens
ggtcttttgacttcaaccaccatcagctaacatcatatcattcctctactaaatgatagcactaatcttcttccacatgcccccactccaagctctgctttgtcataggaatccttgaagcgccatggtataccgaccttcagacattttgataccatactggaatgcagccttgggcaaagctatctttgttgttcatatactcgctgtattcttcctgggtatcaaagtcccaacggcctaagggccccttctatgttaccctggtccattttgctataatccacctcctcatcactatccacagccatgtcatccatcgtggctgggtagcactctgcataactgtaggacatgccaaagaaatctccc

SEQ ID NO: 684791 - DNA, 790 bp, Homo sapiens
tgaggtggctcacgcctgtaatcccagcaccaggggaggccaaggcaggtggatcacctgaggtcaagagttcgagaccagcctggcaacatggtgaaatcccgtctctgctagaaatacaaaaaaattagccaggcatggtggtgggcgcctgtaatcccagccacttgagaggctgaggtaggagaatcgcctgaacccgggaggcagaggctgcagtgagccgaggtcacaccactgcactctagcctgcgcaacagggtgagactgcatctcggggaacaaacaaacaaacacgggagtgacattaacattcaaaattaatttcaaaatagccccagaattttggcccccttccccaattattgggccaacacttccattaacgcggatatggccccagcatctctaattatacttccacgtggcggtaattgggcgggggaaagctccgggtttcccttccttagaagctggggatatcttttcaaacaatttgggacgccaattcacggcttggttaatccccgggccattttggaagagggccagagccgattttgggtctcccagggtccgggaggctccagggaccatttcttggcccgcgccttgggcttgaaaccccccggttcttccttcttaacagatttactaaacaatttagcgctgcggtggggggcgcgaccattggccttgtggcccccaggtctactcctgagaagggctcgagggcagcggagaattgggtcttgacgccttgagaaggccgcagtttgtagttggaggc

SEQ ID NO: 684792 - DNA, 311 bp, Homo sapiens
ggcacgggcagcggcggagacggcaggaggaggcgggggtagcagcgcggaggtgctccgcccctgcgcccctgcccgctacgcctccggccccgggacgtcgccgagcttctcctcgccgcccgccagtacgtcacggccacatctcagcgctggaggttcctggtccccggccgcggcgagcttccggggctgacggtgggaagggcgggggcggaggggggtgaagaagttgttgactctgggcgcgcagagcgggtggaagagagcccgaagtttagacaactgaggcgggggcacgggggtgcggg

SEQ ID NO: 684793 - DNA, 864 bp, Homo sapiens
  misc_feature (75)..(75): n is a, c, g, or t
  misc_feature (77)..(77): n is a, c, g, or t
  misc_feature (408)..(408): n is a, c, g, or t
  misc_feature (412)..(412): n is a, c, g, or t
  misc_feature (427)..(428): n is a, c, g, or t
  misc_feature (469)..(469): n is a, c, g, or t
  misc_feature (489)..(489): n is a, c, g, or t
  misc_feature (494)..(494): n is a, c, g, or t
  misc_feature (544)..(544): n is a, c, g, or t
  misc_feature (550)..(550): n is a, c, g, or t
  misc_feature (567)..(567): n is a, c, g, or t
  misc_feature (575)..(575): n is a, c, g, or t
  misc_feature (671)..(671): n is a, c, g, or t
  misc_feature (758)..(758): n is a, c, g, or t
  misc_feature (815)..(815): n is a, c, g, or t
tggggactggggtggggtcggggaatagccccttggagtggatgtggaccccagagtcaaggagggaagctggtngnccagttggctgggggcaaggcccagggtcacctcaggtcgacaggtcctgctggtgggcgggcccagagtttatcttcatggagtgctggtttctggcactgggctggaaggaggccagctccagggatctggccgggggtgggcaggcagaattcaagaattcatcttcaacaagcgagtgacagcagaggctccgggagatgggcacaatgtccgaatcccacagacagacagcaggggactggcagagaaagcccatctctgcacggaggcccgggtaggagggggtggtggggccggttcgccaagatgaaggctttccccttctantgtncccagggtggagatnntgggtagggtggcccaatccctaggccagagctgtttggtncatagtcaagctcccagagnttggnatctgtggctctggccagcagggcctggggccagcttttaaggcatcagngggggngggggctgcggcagggnccccgggncccacggctggggtataggccagatgggcaggcaggggcaggagacagccatgcctgcagcaaatgtgggaaaaacagctgtttcaaaccgcaagngtggaatgggggccggacaggccgggccttgaaggaatcagagcggggggctgtccggggtggtttgaaaaataaaacttagaaaangaaacagaagtcagttgtcaaagttaaaaaaaaaggagacagtctctgtatcttcangggaggtcagggaacctccaaggcactcgaaaggccaaattacaggagc

SEQ ID NO: 684794 - DNA, 503 bp, Homo sapiens
ctctctgctccagattcctggaagctgacagctattcgggccgaatatgtctcgctccgatggactctagctagtgctcagcagctacatctctcttactggcctggaggctatccagcgtactccaaagattcaggtttactcacttcatcctggaaaaaatgttaagtcaaatttcctgaattgctatgtgtctgggtttcatccatccgacattgaagttgacttactgaagaatggagagagaattgacaaaagtggagcattcagacttgtctttcagcaaggactggtctttctatctcttgtactacactgaattcacccccactgaacaagatgagtatgcctgccgtgtgaaccatgtgactttgtcacagcccaagatagttaagtgggatcgagacatgtaagcagcatcatggaggtctgaagatgccgcatttggattgggtgaattccaaattctgcttgcttgctttttaatattgatatgcttatac

SEQ ID NO: 684795 - DNA, 1163 bp, Homo sapiens
  misc_feature (1163)..(1163): n is a, c, g, or t
gttatttgtattaagaaatgtaagaaaaaaaatatagaaagcaagaaggataggatttggtgtatgtgtatggatggacccttggatataaaatcacttcttggcgcttaccattcattatggtttagcacagccagtgagcttctcgtactttcttcctttctattgttccatcgagacgaaagcctagcattgcatcatgcaccccgcaggattctcaggtgcatcgagcgcaatcttggggtcactgaagccacgggctcccgtgtcgtttcctaggtgacttcgtcatgcactactagtcccctgtgaagatacgtgggataatggtacaattgccatgcactcattggggtgtcaagtattgatcttttgttgttcattgttgagattacttttaaaactacaaaagaacaacaaatgtcatgaatggtaggctgtggggtgccacgaggactggtgtccgttggatatctccctagtgagactcggtcctcttagtttccacacgcatgaggcactcctgagcctctcccgcatggatgtccttcgaggtgagcccaagcaaaacttcttgagaccctccccaaagtgcgttggcgcccccttcgagctttttgtgaagcttatatacttgatgtgtccacccccgctgggtgaaagaaagaaacaacgatgtgattaaggcagagacgaaaccgtgggtgtcgttctccccctacgcatgtccgacacagggggggccgttggctacccaatgtggagggatccatacgtgcggaataaacttgtcgcaacccagatagttgtgccacattcgattgaaccctaatttatatcttcgggtaccctccacttagagtggcctctgaacgcagcccttctgccttggctggtgtattgtagcacaactagggtacgttgccaccaccctgtggtagtattatcactgaccaattttgttgtgagagccggcgacattgcaacctgccgagaaagtttactatccagcgacagcattgtgccggacattttgctgccaacatagactgcctgacttgggtgagataacacacttctatggtgcaagaactctgtaatcacactgcacagtagttcccaccttctattttcaccatctgcacaacacgatacgtgcggcn

SEQ ID NO: 684796 - DNA, 630 bp, Homo sapiens
gggcgggcaaaaaaaaaaaaatctttattatgattatgttaaaagtaaaaattggcatgttttctaaataggctgttaccgggataaaaaaatccaaaaggggggcctttttaaggattcacctgaattacctttaaaattaaaacccccgctaattattatcttttaaaataccccaaaattttttcaatccccaatacaaacctcagtaacccaattctcctaatatgcaattttttataccctctgaactaaaaggaaggggtttgcctaaacaaaaaaaaaacaaggtttttatcctaagaaatctatccttggggggaaaaaaccttatttaaaccaaaggggtaatttttaatttttcccagggggtattctttattttgaaaaacacggttaattatcccaatttttagttataattggtgagggggaatctccccaacctaatttcctgggggccgggaaaaaaccactttttaaaaggttggtttaaatctttgtaaccccgtttccttattcaaattggcactccaacttccctttttttaaaggcccaaatttaccctttttttgttgggttaaagggaattcttattacacatgaagagcttttcctttttaattgtt

SEQ ID NO: 684797 - DNA, 120 bp, Homo sapiens
agatataggagcaagtggtttctaggtatctagagtgaagtagaaacagaatactactaggggcatagtggtaaagataataccatagtatagtactagcgtagagttaaagagaagagg

SEQ ID NO: 684798 - DNA, 299 bp, Homo sapiens
gagacagggcctcactctctcacccaggctggagtgcagtggtacagtctcagctcattgcaacctctgcctcccaagtagctgggattacaggtctgtaccaccatgcctggctaatttttgtacttttggtagagacagggtttcaccatgttgcctaggttggtctcgaacttctgagctcaagcaatctgcatatctcagcctcccaaagtgctgggattacaggcgtgagccattgtgcccggacaccacaatcggtttttacctgtggacacctgcccttctgtcgtcttctc

SEQ ID NO: 684799 - DNA, 321 bp, Homo sapiens
accctgttgtctaatgcaactagagtgaattatagctgggcactgtggctcacgcctgcatcccagtcattcaggaagctgaggcaggagaatcacccgaacccaggaggtggaagttgcagtgagccgagatcacgccactgcactccagcctgggcaacaagagcaaaactctgtacccccccccccccaaaaaaaaaagaaaagacaaacacgagtttacttctggcctttaaaaaaacagaccaccaggcggggcacccaacccaagcccttgatcattacaaattcaaacaccaaaaaccccgtgttcccattcta

SEQ ID NO: 684800 - DNA, 204 bp, Homo sapiens
gagcgcctaaggatcccctaatgctgtcagataggacctgactagggagatagatgatctatatagggaaatcgatggtctttacgagaaatagatgatcactacaggtcaaaagttagggtataaaaggatttatcaagtgcatgagttactattatttccaagatatcaagtccccttgtattatatgaatctagatagcaa

SEQ ID NO: 684801 - DNA, 755 bp, Homo sapiens
  misc_feature (20)..(20): n is a, c, g, or t
  misc_feature (84)..(84): n is a, c, g, or t
  misc_feature (103)..(103): n is a, c, g, or t
  misc_feature (107)..(107): n is a, c, g, or t
  misc_feature (110)..(110): n is a, c, g, or t
  misc_feature (116)..(116): n is a, c, g, or t
  misc_feature (127)..(127): n is a, c, g, or t
  misc_feature (130)..(130): n is a, c, g, or t
  misc_feature (145)..(145): n is a, c, g, or t
  misc_feature (166)..(166): n is a, c, g, or t
  misc_feature (204)..(204): n is a, c, g, or t
  misc_feature (258)..(258): n is a, c, g, or t
  misc_feature (279)..(279): n is a, c, g, or t
  misc_feature (290)..(290): n is a, c, g, or t
  misc_feature (308)..(308): n is a, c, g, or t
  misc_feature (310)..(310): n is a, c, g, or t
  misc_feature (451)..(451): n is a, c, g, or t
  misc_feature (643)..(643): n is a, c, g, or t
  misc_feature (676)..(676): n is a, c, g, or t
  misc_feature (688)..(688): n is a, c, g, or t
  misc_feature (706)..(706): n is a, c, g, or t
ttatatgtggataagactanaaaagtgcctttatgggacgtttttcttcctcctcccatccgaatgagctttgctttagaagantcacagttacttagaggcnagtntgngtggcngcagcgcccanggngcatcagtgcttgtnaaaaagcaatacctgtgtgangcacttttacaccacaggcaaagggaaggaccactctngtgtgacactcctgcagggtcccttaataaaaaataaaagcattccatcaagtncttctggatggtgttattgcngtccatttgtnggtgagtcattttctgtncngtgtttgccttgaagggatcttccaatgtatctccaatattcctttcttatagtgtccttttctttagctaggctttcacataactctaatgctttattaagaatgtcttccttattgtcacactgattttctagcatgtnttcatagatatccacaagaaaggcaattaggtagggggaactatgacttggttgtaaatcaagtaatttatttaacagattaggatatttggaaagaccacgatcctgcaaaatccctttcaaatagttccatgcactttcattatgtggtactagtttaatcatttccagagtgtattggacttctctctncaatacagcacgatcattgtagccagtggtgtnagaaataacgantattctttggttccaganagagttatttctcacatcctctttcagaagttggtccacatactgcagc

SEQ ID NO: 684802 - DNA, 141 bp, Homo sapiens
cattacatttcatttttctttagaaagtggcatttcactacattgcctaggagggcatgtagtcgctgttcacaggacgtaactgtcgctcactgcagcctcacattcctaggctcaagcaatcctcctgccgcagccgcg

SEQ ID NO: 684803 - DNA, 127 bp, Homo sapiens
  misc_feature (106)..(106): n is a, c, g, or t
  misc_feature (127)..(127): n is a, c, g, or t
gcagatcttcatctgtagccaggaagagagcattaaacccaggaacttgtggagaagattgactttgaccgtgtgtccgcatcatggcctcctccccgttacttcngtgttttgatgtgttgacccn

SEQ ID NO: 684804 - DNA, 243 bp, Homo sapiens
gaacttctagtggtagttctgccctacactttatagcccagccagaacaatcacattctactgcaggccacatggaggagagagtacctcggagtgcccctatttccatacacacggaaacgagcaaacagttcactgtaaatacagtctagaggtatccaggtgactgacagtactccagagaccccgagaacagcgtaaaagaccccttgaggtcacctcacccctcctcagatctagaga

SEQ ID NO: 684805 - DNA, 1575 bp, Homo sapiens
aagagcctatgaggaggcgacggtgcgattatacttcagatgtcgaggtgcgagagtagcgtcagaatagagagagaagaggatgacgaataggcaacactattatatccctactctgacattgtgcctagcagagtacgtaacgaattgtgctacgttgggcgtttggagtgctggatagctagattgtcactcgagtacagaaagaaatagaattcgtacacacacgtactctgttgggtgcatcgttgtatagagatattttagcacgctatcactcggataaacaattgggcaatatgtattcatagagcacacacaattcgacgttaccctataactagtgactgtgagttcatgcgtgttaggcaccataaagtaggtttctttgacacgtcataacatctatgcacactggtaatagttagttaaagagccaaaatggctactcgtgggtgtacctttgagcacaaaaagtttaggttgcttgattgtcagcttatttgtataaccttagatagaagtagccagggaatggactcgttgtctttaaaagtagtggagcatgagtgggtccttgtcaggtgtgaaacacctgaaagggacgaggtgtcaaaaagtctcggggctcctaagttactaattggaggggagtgactccttgggatagagggtgttgaaagtaatagcgaagatgtacttgtttgggcagtggtgctcttgagtgaccattgaagttttttagaacactataattctaggagggcttgtgaaaggagatgggcaaccatacggaatcacaaggggggatggagttttggggaatataacacattacacatgtttgcattggtagttggaaggaccaggaataagaactaacaggtaggcaacaatttaaaaaaggttaattatatgggcaggagccggaagtgttgacctcgacggaatacaacaaaggcagaattcgagcggtttaacaaatgtacgggcatcatacaggctcgtgacccagtggccaacacaaacaacgacgtctcatgagcagtacagagtgttgatcaacgcgagcaaaccttgtttgcttgctgtacacaccttcaaatccatgtgcctttccgtcttctgctccccactctttcgttcttctctcccacagtcaacgcaaagtcgccaacacacaacgagacactacacgacgacaataccaacacacaaccgaggacaagcaggaaagggagaaaaagaaggaaggacgaaagacagaagacagggcaaggaacagcactgcagagaagacagacagcagaagaacgcagagacagaagaacggaagcgaagcgaacgcaggagagagggaaacaggaaggaaaacagaagaagaagagcaagacagacacagacagaaggcacacggaaagcactgagggtgacaacagcccggcaagagagcagacaagaaccaacacacggaggagaggcaacaaagagccaagaacgacaacgaagaagccgcaacacgagaacaaagacacgaacagcacgaagaacagagcgacaaggacgacgaggaac

SEQ ID NO: 684806 - DNA, 1249 bp, Homo sapiens
ggtgaagacagggcactctgcgcgcgaccacatgcgacagcctgtgccactggagacctgcagggtgcacagtgactgtgcaacacgtgtggttaccgcccactggctccagtgctctctgcctggcaagtcgtcgcaccttcgtgcccgccctgtcaccgatctcatctccacgatcggcataggcagtgatgctaggctcacagctgcgttctcacgagggggtctgctggataggggggccccgtggggggctcaggtcattgctgcttacgcatgctgttcgtatcctcagcgcatacttattgcattccatagacgtaaaacattcgtatttcgcatccaccccatgagtggttaattgcgaggctaacatatcggagaatgtcagccatcgtggtggtctatcgttgcatgcgggcgagcccttgactgcatgggaacgcagtatatacgttttcccttctccttcaaacggaacgtgcacgccaggtcacatccgtgtgctgaaggaccaggcacgagacctgtagatcgtatgcagtcatggcaatcgcgcgtggcagagtgtctatggacactagcggctgtggcttgcctatggctccatgtgtcatctgcatgggtatacgcgaaaacactcatccctttcaatggtgtagacatcacatggggctatccgatgagagatacctacgttacagcggcctctcaaattcccaaggcgcaagttatattttcttgtatgcgcccaagcaaagcccaactgaggggggcgtctcgcgggggacagggtaggacgacacccttgtgcaacgaaaggaagggagcaaccatattatggtccccgcaccttcgttgctcaaccgagaaggttacagcaacgcaaacctcgtggcatgggggatggttcccccaaaatactaaagtggctcgttaggattacccaaaggggtcaggctgcggtggccagcagtgcatggagagggcacacgcgaaccaagcccaagataggggaccccgtatccgtggggcaacacccattctatacgcagataaagacaacggccatgcgacgacaaaagggggctacgaaaggacccatgggggagagctccaagggggaagcaacgcgggccacccaagcgggaaagcatggccgatattggcgggcggaaccaagaccctggtaaggcggtggaaaacgcagttggacacaccccccacgaaatgcccccgatagcacgaa

SEQ ID NO: 684807 - DNA, 197 bp, Homo sapiens
accctctcgatcagctgatcagcatcttcctcattacaaaagggagaaaaatctgtttggtgtgttaaagggtagattttgtaaaaagtaaaattatgactcaccgtaccattcaatataaaatgaaaatgtggcaaagatttaacttacttattaataagggaaccagtcaactctgctggatcagcggatcgagt

SEQ ID NO: 684808 - DNA, 508 bp, Homo sapiens
  misc_feature (36)..(36): n is a, c, g, or t
  misc_feature (128)..(128): n is a, c, g, or t
  misc_feature (169)..(169): n is a, c, g, or t
tcccatgatgtcagtgatgggttctcctccctcctntgatgatgccagtgggacctgtctctggaatgaggctgccatgggaggtcacatgcccaatgatgcctaggcctccagtgatggaacctccnctcctgctcgtgatgatgcctgctgagcccagaatgactcnctatgcagatgaggacaggagggaggcctctttatattagtttcctattacttgttttgcttcaccaggagatcatggtgctgtgactctgggtgttttctttttttttgaaatggagtctgacccaagctggagttcagtgggacaatctcggctcacagcaacatttgcctcccggattcaagcaattttcctgcctcagcctcccagctactcatgagactgaggcaaaaaaattgcttgaacctgggaggcagaggttgcagtgagctgagattttagctgagatcacgcccctgcgctccagcctgggggaaaaaagcaagactctgtctccca

SEQ ID NO: 684809 - DNA, 349 bp, Homo sapiens
tgctctgagatcctatatctgcacccacagctaatatactgcttgttttaaaaatgatttttgaggcaggtgcagtggctcgtggctataatcctagcactttgaaagacaaggcaggcggatcaattgagggcaggagttcgagaacaacctggacaacatagcaaaaccccgtctctattaaaaatacaataattagctgggcattgtggtgcatgcctgtaatcccagctacttgggaggctgaggcacaagaatcacttgaacccaggaggtgtaggttacagtgagatgagattgtgccactgcactgcattccagcctgggtgacagagcaagaccttctctc

SEQ ID NO: 684810 - DNA, 116 bp, Homo sapiens
ttctatgcacaatatgctccatgctatagcatcttacccatggatgactgcatatgacctctaaatgatcttccagactccagccttgactcctacagccagccagagtggtctct

SEQ ID NO: 684811 - DNA, 258 bp, Homo sapiens
ttaatgagtgcggctggaggaccacggacattgaactcactgaggctgtacagaggggacccatggatgggggggctctggcgtcctgaggccacctggccccacctgctcctgatggcaacccggcgcggccagatatggcccgagctacagcttccaggatgcttctctggaacctcaaggcaggcagcccaggccctgggcctgatatataaccccgtcatgctgctgctgaccacacccagccaacctgcccct

SEQ ID NO: 684812 - DNA, 86 bp, Homo sapiens
aagacagcagcatatatctctgcagcgttgccgtggggtcgtcggtcgggacccagtacttcgggccaggcacgcggctcctggtg

SEQ ID NO: 684813 - DNA, 159 bp, Homo sapiens
caaccacatacacggtggaagcgcaaggaaatgtagcaacatatggacccaggtatcttccgtgacagttttttagcttccaatgtatagaaaaattcagttatgttcaatatcatcaaagcaaggcaaagcatatgccttcccattagaaacaaagta

SEQ ID NO: 684814 - DNA, 615 bp, Homo sapiens
tatggcgaccatttcaaataatttaaggaaaacaaaaatcataatgctacccaggttacttctataaaaaaatagaccagatctaaggtaaaaactagaagttacattagctgctaatacaaatacgagatttcaaatttcttacataaagaccctaactagggccagtctcagtggctcacacctgtaatcccagcactttgggagactgaggtgacaggatcacttgagaccaggagtttgagaccagcctgggaaatgtagtgagattccatctctactaaaaatataaacattagccgggcgtggtggtgggtgcctgtagtcccagttacttgggagacttaggcagaagaatcgcttgagcctgagagtcagaggttgcagtgagctgagattgtgttactgcactgcagcctgggcgacagagcgagactccatctcagaaaaaaaaagggggggaaaattacttatcagcttatccatcataagtctgtgtatatggcatatatttttattatgcaatggaataaaaccattattagaaacatgccaggttggtagtcttggtatcgtttagtaagaaacaaagatggaaatggtcgccaatccggg

SEQ ID NO: 684815 - DNA, 396 bp, Homo sapiens
tcgtacagagtgaatgtgggctgtggttggtattacatgctgccgagattagcttatgggttcagaatttacttccctgtcaaatactttgttttccttgttgaaagcctcgacagtggattacttatcgggattcagcctgaatgttattagcatataagaagttactagattcgatattttaatcctatgctttggtgtggattcagcgtcttttgatagattcagaagtacctcaggtttctagttctccaaatacatctcaatctttgttcgagcatcaccatttctgctattaggcctctgttactttacactcggatgcatctttggtctctgatttagaatataggctctggaaagttgatattaaattctgattctgccatttcctgt

SEQ ID NO: 684816 - DNA, 224 bp, Homo sapiens
gcagaagagcagtacattctcagtctagtgtgatatatatataaagacgactcaaacactttcgaccgcgagaggagaccatttatacaacactatctgatttcggtcacctgaagttatattcttatactaacaggcttcggaaataatctcgccatattgtaacttactactccgggaaaaaaagaagcatttggatacataggtatggtctgagctattat

SEQ ID NO: 684817 - DNA, 613 bp, Homo sapiens
ggatatggttaaccttttaaaaggcaggaaagacatacagttccaaatatttgtaagcttgttctcctttagtacttgaagggcattatcatcttttgttgctgttttgttctgtaaatggggtttcatgtatttctgcctaacaagtagcttttataatactctgaacttttcagaaaattgttatttgctttcctacacagtatgagggctattgacatccataacactttgatcccaagtaagtatagtgtgtctacaatgacaatataagggagacttgatcaatgctagagagtactacccattcaaaactgtaagctaaggtaatttttatattatgtaacagttttccaaagcacctcgaacaggaagagtaacataaatataaatctgcattatttgaaaagagttgtaagcttttttattcatgataaaatttacataggacagatataatctctggaaagccattggtactgactgtggtaaaagtacttggtgatacagattctggtaaaaacacatgcatgttattccatctctgtgtagtaaaaagtatacttgtacaatgttttgtacttgtatttcatgttattaaaatagtgatgtt

SEQ ID NO: 684818 - DNA, 512 bp, Homo sapiens
  misc_feature (499)..(499): n is a, c, g, or t
cgtagagacagggtttcactgtgttagccaggatgctctcgatctcctggcctcgtgatccgcccgcctcggcctcccaaagtgctgggattacagacatgagccaccgcgcctggccgattgagcatattttcatatgttcaaggaccatttgcattttttctcctatctttagcccaataaagatagagttattggtcttttaagagctctttattagggataataaaagttgcaatttttttttccaatttgtcttttactttgctcagcttttactccctccaaagtttttcttttaatttatgtaatcatatttatcaatcttttcctttattgtttttagattttgggtcatggttaggaaatatttttcccattgccaggatatgaagggacactcatgtttctcctattatttatatggatcacttctttgactcatttgaaatttacctgatgtatgaagaatggaataatttttactttttaaattcantttaattttgaga

SEQ ID NO: 684819 - DNA, 425 bp, Homo sapiens
  misc_feature (109)..(109): n is a, c, g, or t
ggcggcagcaggcagggttgctgcggcggaaaaatgagaacatcaccagctccatcaatgaatcatggactggcttttccgctatctggtgggtttacttcaatggganaaggtcaccggctgcgttagggtatttcgagaggcgttacgccatcagtgtgacgctccatgtgatttcgcctgcgcagaacagttgcacgacgaggttccgaaccctttttttattgagtgtcgctccatgagttgcaacgaacagcaggtgagggcgacgacctttttgcgtagcaagccctttcgggtagggcttttacccttgtgaaccattccattcgcttttagagaccatttacccttttgggccatttggcggtgggtgggggtagggcgtccgcgaactcatgacggcgcacccgtttatccattgg

SEQ ID NO: 684820 - DNA, 90 bp, Homo sapiens
taagaggatggccattgacagtcccgacgttctgtgacaagcatatacaaacaacctgggtccaaataaaaactaaattgtaaactcctg

SEQ ID NO: 684821 - DNA, 648 bp, Homo sapiens
accgctcattgcagcctcaacttccccgggctcaggtgagttctccatgtcagcctcctgagcagctggaattacaggcacaccaccatgcccagctaattttgtatttttagtagacacagggtctcactgtgttgcccaggctggtcttgaactcctgggctcaagtgatccacctgccttggcctctcaaagtgctggagttacaggcatgagcaacctcgcccagcctcaattcattttaaactattaaaaagctgtcaaggccaggcaaccactgcactccaacctgggtgacagactgagaccctaactcaaaaaaaaaaaaaaaaaaaagggggggccgccctttttttttttttttgtattgatgtaatttttgtttttttcttctattttatattttttattatttgatttgtctgtattgtttggttctaggtggtataagagaaaaacgtagggatgagaggcttcaccaagcatggtagttagacttgtacgttggaggagtacttagaggcctgtgatctcatgtggaagaataatgagtaaggtgagattctaccgattctcagtgggggggaggagagaggggattgtggacctattggaaataataaacagtagtaaggagaaggcgtgtaa

SEQ ID NO: 684822 - DNA, 121 bp, Homo sapiens
gaagaagcagagactgttggcccgggcgagaagaaggctgctggaaaggggcgttccccgaagagacccctgtacttcgagcggagttacaccgtcacccccttgtgagaccgagagctag

SEQ ID NO: 684823 - DNA, 484 bp, Homo sapiens
tctagaggatcttccgcaatctccacctctcgggctcaagcgattctcccgcccagcctcccgagtagctgggaccacaggcgcgtgccaccacgcctgccaaatttctttgcatttctcagcagagacagggcttccccgtgccggtcatgccggtcttgaactcctggcctcgtgatctgcccgcctcggcctcccaaagtgctgggattgcaggcgtgagtcactgcgcctggccaagtttcagttctatatgaagtatttgatgttttgtttgaaacaatacagcattaaagaaccaatgttattcactaatatcattcatctttcagtttggatgatttggtttgctgcatctagattgcggtgtttggagtcggggtttcaccgtgttgctcaggctggttttgaactcctgagctcaagcaatcctcctgccttggcctcccaaaatgctgggattacagatgtgagccaccacacc

SEQ ID NO: 684824 - DNA, 874 bp, Homo sapiens
  misc_feature (874)..(874): n is a, c, g, or t
ggcgcaatgatgatgcagtactcccgtggctccagaatgccgtcttgccttgtgctatcaactgcgtgctggtgagtattccggctggacaatcgtgatccgcgaaagcgccaaggacatagaccggcggatgttaaccgtatcgcaggagagcccgggttgcaagatttgccacgatgggacgtatctactctcgatggcctaaaattctaggaccgacctaggtcatggacgtgtgggcagctgaagtgcctgcgtgttgtacagtgtctagccactcctgtgagtaccctcacccgtagaaggtacttgaacctggcaggaaatgcagtcacacaggagcttaaacggtaaatgcgtattaccccgtcgtcaattttgcaaacttgctacttcgtggagatgaacgagctttggattctctcatcaaggtctacccaatgctggtggtggtgtcagttccacacagtcgcacacaatctcctgcttggtgaagaatggacaaccagaagactgttctaataggagtgctggaatttcttgttatctacaggaactctaaatagtctaagaagctgtccacgtgttgtgatgccacagaacggtctctctggaaaacacacatgccttgaattccactgggcagtggaggttccttatgttccacaacaaatttgatccagctaaccaattaacggcggggtcaagaccaagacgagcagggtggatgaggcgctcaaacagtgggaccgggcgcaccacaaaaaatggcgtggcactacccgcggcacacaagccacacaaaaaacaaagcggcgaaacagcgggcgcaactggtacactaagcacacaacaaccatataccaagtcaatn

SEQ ID NO: 684825 - DNA, 250 bp, Homo sapiens
cttgccagtctctactttaatggtccaagccaacttgtggtcatcaccgagacagtgttttccttcacttccttgaagtacgcatgacccctcctccaagtgggcctaatccttatgcgctgtaactgtcctcccttttggtcatgtgctatacccacacctgtgactggttatcgatacaggaggctcctctacaccaattaatgtagcttgtagatattggcctcccacaagattccagtactatata

SEQ ID NO: 684826 - DNA, 179 bp, Homo sapiens
tgttgaaagcaccctacctgtgtacccgagctacgagctcagtccaggccttactcatgcccagcccagaagaataagtcagcgccctgtcctagtataattccgagtcactacagtttgagccatgaaacagaaaaacccatgactccttcatgctgcttgctggatgaaaccatggt

SEQ ID NO: 684827 - DNA, 360 bp, Homo sapiens
atttttttacaagatacagctggacaggtgctcctgaaagggaactgtggaggagaaagggatcccacaccctggaaagtcacctactccacggaaagatcaaccaaactggaggaatctccagatgcagagaagagtgtagcagtaagttggagttctgaaaagcagagcgagaactcaacagatcatctgaactactggcacagtcaccaaaaattgagacgcttgggtggggggtgggcaccgagaccttggctctggaggctagtccctgggaaagagctgagggggtggagcagagactgcttgggaggtttatgaatcagtctgtcaagtttgacagagcagatactgcctggg

SEQ ID NO: 684828 - DNA, 167 bp, Homo sapiens
cgcagtgcggtcaggcagtccagagtcagttcagtcattcagcgcagtggggtgtttgattcagtgcggtgtctgagcagtgcaccacaggtttcgggtgcacaccagctcacacatcagtgttttgatttgattcgcatctttggagttccacacacacatcagtc

SEQ ID NO: 684829 - DNA, 310 bp, Homo sapiens
cacaggtcctgcagtgatgcaggcattgcacattgttcctggactagtagtctgaacctacagggggcggggaccccaccctgaagcagataggcggtcccagtgctcaggtgtggtatgccgactcatggagcctgcaccccaatatcacactccagaccacttattgacaccctcccccaaacacatacggtgtccccaacacacatgatttccaacacaccacaccccaacacacacagttctcaacacacacagagtgcccatcatacacataatgtctaacacacacaatccccctgcacacaat

SEQ ID NO: 684830 - DNA, 291 bp, Homo sapiens
aggagaggtggcgacgggggcgtatcatcacccagattcatcgccatcatatgtcatcaacataataagtctgcctgggaaacctggtcgtcgtggtcaccttgtacaagaagtcctacctcctcacccaagagaaggagctcggtgacatttgaggatgaagtggaccaaatcaaagaagctgacaagaactcgattcttcatgtgaaagctgaagtacacaagtccttggacagttacgcagcaagcttggccaaagccattggggccgaagccaaaatcaacttattt

SEQ ID NO: 684831 - DNA, 829 bp, Homo sapiens
  misc_feature (769)..(769): n is a, c, g, or t
gacaaccccagcaatgtggagaagcctggggcttgccctggtctctgtctcctcccatcgggaagggaaaagagagcaggaccaaagctccttatgtaagcaacccccagctgagcataagagatcaagatccaggtgctaaactccaatggttcagtgactgtggttgctcttcttcaagcaagttgatacctgtgcttactggcgggcatctaaaattagaagcacctggagtaaaatttgagagaaaggagggatattctaatatttcttatatgggttgttactcatcagggaatctctttctcgattaaaaagtacacacattctttaagaataaggttccagagcaattttcctgtttatcaacaaggagaagaccaaagagatgttctggactcttttaaatggaagcaaaggatgatttcctcatatatgattaggatgtggacgtctttgaataatcatcgtgggtggcctttttcctttcctaaatttcccatatgtagaagaagcattaagattggttactgtgacaaggaatgtggaaacgttgtcttctcacgaattaaagatgagactttgtaccgtgatcttgggtcggggtaaaacgtgactccttggtcattacatattgggttccaattaggattggcttggaggggagcttcagatatagcaggggcaagggtatattggctccaggtttacaccaaaacagggcgatggggtcaaaagcgttccatggaataataaaagcggagagtanactgtgcgcaatggacgagcgtatgataaagggcacaggacttgggaagaattagtataa

SEQ ID NO: 684832 - DNA, 707 bp, Homo sapiens
  misc_feature (558)..(558): n is a, c, g, or t
tggaaacggagtctcgctctgtcacccaggctggagtgcactggcttgatctcggctcactgcaagctccacctcccaggttcacgccattctcctgcctcagcctcccgagtagctgggactataggcgcccaccaggagccgggctaattttggtattttaagtagagacggggtttcaccaggttagccaggatggtctcgatctcctgaccttgtgatccggccgcctcggcctcccaaagtgctgggattacaggcgtgagccaccgtgcccggcctacaaatgttaacaaagcaattaccaagggccttttacaatattttgtgctttaatgaggaataatatgcttgttgaaaagacctacttaaagtcttcagttaatattctttcaaatcaagatcttattgaagtaccttatatatgtggtgggcaatggttcacattttgggagcccttggtattgggggaagttgaaatggtatcactttctaaacagagaaatggtgttggggtttaattagacagatatctggaagtacctatttttggcaggngtttcgacacagagccgcgtaaacctggtctcactactctgggatataatctgggatacatccgtgtatgctgaagcggggacacatcacttggtaaactgactttttaacgtattttatccggttaacacaggcaaggtgcacacttt

SEQ ID NO: 684833 - DNA, 643 bp, Homo sapiens
gcagatcaaaaatggcggtagtgggtgtgtcctcggtatctcggcatgctgggtcggtcccggccacagctggttgcggcctatgtcagagtggctgcccagtggcgagagaggggctcgagctctgcaatgtgagaatgacgtctcacacttctgtcgtcgcagctcccccgggtgtgagcagttcagtcattgctgaaagtgttgtaccgtagaagtcgcgacctactggagaagcatcgaagagatcctgagattcatcagctcgtacgccccatctcacgcatcaaggtagcaagccccgtttcccctgcgggagaatggctaaccatgacgtctagttcacataacccttcgatgtgaactcccaagcttccagagctgggactagcgagaggatagaagtagaaagacgagactctggtgacgccacttacgctcgggagactacctcagggagccaacacgcaccgtgggattgtggcacacgttgtagccttcttggacatcagtgcgactcgcccatgaccaccgaatgtggtataactcggcgcaaccctttataggctaccagcgcgtgtgcttatcacctaggttattgtcacggacttcgacgtgcacctgggctacttacgtggggtac

SEQ ID NO: 684834 - DNA, 123 bp, Homo sapiens
atgcacttttgctgggaggttgaataatagagaactagaacgtgtcagttgctttcagcaaacgtagaggctgctggatccagaagggaagagtaagcgggagaggagggtttctgatgacga

SEQ ID NO: 684835 - DNA, 176 bp, Homo sapiens
tgatccgaaccggggctttggtcgatggaccttgcactccaaaggtgaggagacaggccactgcctttcaagtgcattgcagtcatgatttcatcctcaagtttccgcacagtgcccaccagaagtatgtccgacaaagcctggcagaaggcagaataatactcatgtaaagacag

SEQ ID NO: 684836 - DNA, 455 bp, Homo sapiens
aggaagataatgtgtgtacacaggaacatgtacagacttgggtctggtcattattccctaacacaatacacagtataacaactatttacatcgcatccacatggtattaggtagtatgagtgatgtggagatgatttaaagcatacaagagaatatgcagagtttatatgcaaatactatgtcagttttattcatttttcctaggagacaggatttggctctgtcacccaggtgggtgtccaaactctggcctcaagagatcctcccacctcagcctcctgaataactgggattacaggtgtgagccactgcacctggcctatgtaactttttaaatagggaataaaatagctggtcaccctgatgcttccaaaggaatcatgcatttgtggaagaggggaacagtgcaatgcaagatttacgaagacagagctgattaccttccctccccagtc

SEQ ID NO: 684837 - DNA, 259 bp, Homo sapiens
tgggattacaggcctgagccaccacgcccaactgggaccagggttacctggttaacgatggaggtgaaatctctttgtaatccactgggttttcatcggctaaccatcttatgcctgactattaaacctattctatataaacacaagaccactttaatttttcgctaatttacagagtgacatcagctgcctatgcctatgataaggtagcagtctgcattcttatggccattagatgttacaaacttcttgcctgtaa

SEQ ID NO: 684838 - DNA, 240 bp, Homo sapiens
ccccgacggagcattcaatggagggatgagtaggtggatggataaataaatacatctgaagaaggatgatagattaatggaagagatggtgaaggaggacaaggtaatcaagcaattggtagataagtagatggatgggtgggtggatggatgaacagatggatagagagaaagctaggtgagtggatggatggatgcatggataggtgaataagtggatgaatgaatggtccgtcgaag

SEQ ID NO: 684839 - DNA, 546 bp, Homo sapiens
ctaggttcatgaacgtccagacgaactacaatactgcgcgactgggagctgctgaagttgctgaatggtattggagtgagcgacggtgacccgcctgtttcgaatggagacaatcgcgatcacctgacacgtttgatgttgcaagcaaacaccgtcctcggagaatatgcgccgatgatgaagcgaccgggggcttgccgggagatgctaatagtccctggaacctaagatcattcacttgatggctgcgtcggttgcgggtttggccatcgctcgtttcagcacgaatataagatcggtaactacgtcgatcacgtccagaagacggacatatacgtactctataaataatcgcgtatagtggcacttcttaaaggcatcggaacagtcggcgagaaagacctgctcaacacggtgacccgatccctcgcccaggctgcggctacggtaggcaaattcatcgacagaccttgctacgtcatcgaggggaactggtcggtcagattccgggacgtcgatacgtaggacgttgtttttcccgatcag

SEQ ID NO: 684840 - DNA, 152 bp, Homo sapiens
  misc_feature (35)..(35): n is a, c, g, or t
tgacttttagaagttcaatagccttagtgtagctnctgatctcagtattcctttcttctgctgggtttgggtttggttgttcttgtttctctagttccttgaggtgtgaccttagattgtctgtttgtgctattgaaacttctaaaactagg

SEQ ID NO: 684841 - DNA, 349 bp, Homo sapiens
taatgctcttattaagtatgtacttcaatgctggatcacagacagctcatatctcagttatcggtatataaaccatgcatgcagtagcatcattttaaaaaatgcaccttatgattaatttattttggctagggagtttatccctattcatcgaattatttttaagaagatgccaatataattttagtaagaaggcagtaacctctcatcatgatcataggcagttgaaaaatttatacacctttttctttcacattttacataaataataatgcttctgccagcagtaccgtggtagccacaattgcacaatatattttcttaaaaaataccagcagttactcatgga

SEQ ID NO: 684842 - DNA, 145 bp, Homo sapiens
gatagacagctcagatcatctgcagaatcttataagggaattgaggtcttcatacacccagactcagcctcatcaaagtgcaataacgaagacaggcatcaccagagacatcagcttcaccagatgggtcacaaaatctggttta

SEQ ID NO: 684843 - DNA, 805 bp, Homo sapiens
  misc_feature (433)..(433): n is a, c, g, or t
  misc_feature (646)..(646): n is a, c, g, or t
ccgctaacggaagataccttgcgattgctggaaaaaatcgccccttccacacaaacatacgagcatcgagcgcgattgaggccctggatcgccaggtcgtcagcggtctgaataaagcgcagctaatgcgcgatttcgtcgccgatggcggctcgctgattgggctggtgaaaaagcattgtgagatctgggccggtgactaagccgggaattgccttacagaagaatatccctgacaatggtgtattaacttacatttaacaatgttatgaaacaccctttagaaaccttgaccaccgcgagcacggcattttgctgatggctttcctctcttgcactgctgctgaccggccccgcactggggctggcgctggcacaaaaactggtgaccatgttgccatctgatggatcttagtcagctttacactttatngttgtgtctgtggttttaagtgctgggcgctatgagtattatgttctgcgcttgatctggcgacgctggttctcgctggcggattacaacgtcgattatcgccgtacttcgcggcgatacttgcttattctccttcgcctaaaggaacgttaatggcataagcaatcactgcacgaaacgggaaacgcctggcccttgagttaccccttggtngagcttatgctgggacttttatgcacccggagttacgatgtatgttaaaattggcggcaagaatctattgctgtcgaccggagatacacggcaggtcacactttatcaatctgaaagtacgaatccgaaaaataccctgtgaaactcaacaaaataacc

SEQ ID NO: 684844 - DNA, 462 bp, Homo sapiens
atgagcaggctagctttggggaagagggacacatggtaggtacagcagccaggatgccgactagcaggactgggacgtatcagaagagagatgtgtcactcggcacctatgcagccgggctgcggagccacaggaacaggagtttgggaagagcgcttggataagggactacagcagtggtggcagctccaggaaccttgacgcccaggacagaagctttggaacgagacccctgagctctgggttcagccccgaggaagcccagaaacaggatgaggactttgagaagaagattccaagtgtggaagacagccttggagagggcagcagggatgctggccggacaggagagagaggatccgggggcttgttcagtcctagcactgcccacgtgccggatggggcactcgggcagagagaccagagcagctggcaaaacagtgatgctagccatactctggg

SEQ ID NO: 684845 - DNA, 523 bp, Homo sapiens
ccgctaacggaagataccttgcgattgctggaaaaaatcgccccttccacactaacatacgagcattcctgtgtgaattgtcctctcgctcacaatgccaacaagatactgagcaaggcgcagctaagtgaacgagttgcagtacggcgatgcgttcgacgcggctgatcagagctggcgggaacaaaaagcaactaggccgagaatactggcagccggtgacattaatgccagggaaatggccttctaaggagaggacagtaattcccaccttttaatccagaactgacacaaaaataacgcaaaacaaataccaccaattatctctcccaacctgcacatactacaaaaaccaacccccccacattccacaaccacaaccccttttcacatccatatcacttaacatccagaccaaataattatttgccaataccaataacagccatattaacaccaacactagataaacacctgacttacctgaacacaaacttgccacctcacacctgaaaaaaatcaa

SEQ ID NO: 684846 - DNA, 130 bp, Homo sapiens
agaagattagagtgttcatcgtccttccttcagttctcttactaggctgatggttacagtcccacaacagccacagcactcagaataagggcatctctgctttaccagtcactttgagtggagagaagat

SEQ ID NO: 684847 - DNA, 243 bp, Homo sapiens
gaatggggggtcagcgccgtctgttagaagctgagtctcttcacatagacggatggagcagtgcttagcaactttttgtcttgattgtggaaaagcttctggactaaggtttgccaggctcctgggacgttccatgcatcttaaaatcctggaacttgagcccctgttcaacacagttgctccttttgcacctttgaggaacagcttctgtcctctgccctctggtgccgtgtccgctgcatt

SEQ ID NO: 684848 - DNA, 611 bp, Homo sapiens
  misc_feature (11)..(11): n is a, c, g, or t
  misc_feature (21)..(21): n is a, c, g, or t
  misc_feature (72)..(72): n is a, c, g, or t
  misc_feature (99)..(99): n is a, c, g, or t
  misc_feature (124)..(124): n is a, c, g, or t
  misc_feature (150)..(150): n is a, c, g, or t
  misc_feature (167)..(167): n is a, c, g, or t
ttccccacccnaatctcatcnggaattataatcccccatgtgtcaggagagggactggtgggaggtaattgnatcatgggggcaattctacccagctgntcccatgatagtacatgagttctcntgagatctgatgatttaaaagtgtgncacttcccttcttgctnttctctctgctgccatgtaagacatgccttgcttcccctttgccttctgcccatgattgtaagttttctgaggcctacccgagcccatgcgagacctgtgaatcgagttaaaccttttttcttcgataaatcacccagtgatatgggttggctgtgtcgccacccaaaatctcaccttgatttgtaatctccataatccccatgtgtcaagggtgggaccaggtggagataattggatcgatgggagaggtttcccccatgctgttcttgtgatagcgagtctcgatgagatctgatggttttataagcatctggcatttcccctgcttgcactcattccatcctgcctgcttctcctttgccttctgccataattgtaagtttcctgaggctttcccaacaaagtggaactgtgagtcaattaaacctctttcctttataaat

SEQ ID NO: 684849 - DNA, 238 bp, Homo sapiens
ggcccgtatacatccttacaggagactcatatgactaattcttttgtatattactatcaactatagctactgttggtttaaaataaaatttctaacttttcagtcattattggctagcaatatgccaacatgtttactttgcctgtgtttaggaatttcccaagtctccttttcccaggagaggactaccacaagtcatcactgcccagaatatcagtttccaacactaggatgtgtg

SEQ ID NO: 684850 - DNA, 754 bp, Homo sapiens
ccgctaacggaagataccttgcgattgctggaaaaaatcgccccttccacacaatcagtacgacgcacacggcagtcggcgtcgctgaccagcggcggcgaggcaaggcttgaacgatgctgtccgggctgtgacgcgcatgggcatttatgtgggtgccaaagtcttcctcatctacgagggctatgagggcctcgtggaggcgaggtgagaacatcaagcaggccaactggctgacgcgtctccaacatcatccagactggagcggacactagtcacttggcagcgctcgcatgcaaggcctttaccaccagggcaggggcgccgggcagcggccctacaacctggtccagcacggcaatcaccaaactgtgacgtcactcggcggggaatggcagcctcacaggtgccaacatcttgccgcaagcgagtggagcagcatgactggaggagcttggtggcggaaagggtaagatctcaggagactacaagaccggagcctactcgcgacctgaacatcgcggagactagatgggcctccaatcgataacagacttctgcggaaacgacatgaccaacggcacggacctcgggcctccaccgcattcatggagggtcatcgaatgccatcacaaccactgcaccagagccaacagaggaccttcgagctaggaagatgatgggccggacacagacgggtacctgacagcatggtatctagcaaggacacaaaggccgactggatgccaacccc

SEQ ID NO: 684851 - DNA, 276 bp, Homo sapiens
  misc_feature (9)..(9): n is a, c, g, or t
gtgaatacngcttctgagattgtgagggaagagatagcgtggaagccaggctagccagttcatcattgtgaaggctgggagaattggggaccataggctgaaatggcaagctatacgattctaggctctcatttctgccggctatttatttcgacctctcctattttccccaaacgtcgtctatcgagtgaaaacccattaagatgaagccagaggcatcagtgtgcgttatctgtgggggcagcacgcagggcagagagcggcacctaggtccca

SEQ ID NO: 684852 - DNA, 759 bp, Homo sapiens
acccgggaggcggagcttgcagtgatccgagatcgcgccactgcactccagcctgggctacagagcgagactccgtctcaaaaaaaaaaaaagtcagtgagatgggggaaggcagatccaccctaaatctgctgggcacaaatctaattcagactttccagccaaattataaagcaggctagaaaaaacgttgaaaaagaagagacaggcctagcctcccactttatacattgttatctcccgatgcgtggaacgcattccgtgccttgtgaaacgtcggactttcaagtttctatcagatttggggactgggactgggcatctcctttgatcctcagcttgcagaaagcctatggtggaacctggtgcatcatattaacgacagaacacaacaagatgtgcctgggtttcctagaaagccaaccaaaataggattggacagaaaaagatatggcagccaatgaagagaatcggaagtggatgagagaacactgtccctgaacactaagtcgaccaagccacgggttaccccttgcgcacctcaagatttccaatgaaaagccagtatcgcggggactatgattgcattctttgagccagagaaataatgcggtgtatgctacttaggcttgaaagcacccaccgtgttcaaaggagcagaagtgcaagcaagcagaagaatgacctaagaatgggctaagatctgaaagggttcatggttataaaagagatgatggtcagaatggaagtaaataaagg

SEQ ID NO: 684853 - DNA, 548 bp, Homo sapiens
  misc_feature (481)..(481): n is a, c, g, or t
tttgattcccactttccccaaataatttaagcaacatttactgaacatggattacatatgggacactggattagttgataaagattgaatggggagcgaaatcctctctggaacatttcagtggagctgaacctaaagtggaggaaatgaacataaactattacacccatgaaggtaaaatgacacctaagataagtgccgtgaaagaaagaatatgattccacagcaaaaaggaatatgcagttaaagaagtcatccttaggaaatgatactttaactgctacgtagaaagtgagcaaattacctaggaaaatggatgaatgtgtgagggcttgagaagtattcaagataattgaattgtacctgaagaggccaatgacctcggtgggtggattactgggatacagaagcaggacaggaaggctgaagcacaaagacctaaggtaggtagtgaaagatgaagctgagtacgagagccttntgaggttccttttaaaaatgtaatttcattgtggttttgatttgcatttctctgatggccagtgatg

SEQ ID NO: 684854 - DNA, 109 bp, Homo sapiens
gaggatccccaaccgcctgcgaaacccaagccgccgcgtaggagcgtgcgttcgggccctcttctcccacctgttcgactccccatccccaggatgtcaacctcagtcc

SEQ ID NO: 684855 - DNA, 212 bp, Homo sapiens
agactagcaataaacttacatgtggaatggctcagacttatctgtattttctttctttcttttttttttaaaaaaaacttttaggttcagggctactaagtacagggttgttacatagtataacttgtgtcacaagggtttgttgcacagattatttcatcacccaggtatttagcctagtaccctttagttttttttccggatcctctaga

SEQ ID NO: 684856 - DNA, 243 bp, Homo sapiens
tcagagtaacggatcgtgatgcagttcccaatgatttgaattggtagtaaatcagatctgtcatcatcaaggacaggtaacacaagaagaaggacggcagttagcacgtcaagttaaggtaccttacgtggtggcatcagcaaagattaggattgaattgtagatcaagctttccatgaactggtccgtgttatcaggaaatttcaagagctgtcaatgtcctcattacatgccatgggtacc

SEQ ID NO: 684857 - DNA, 154 bp, Homo sapiens
cagaggcttccacttgtgggtgcagtgatgacagaatgaacatcacagcattctttgacgcccccccaccctggggtttatgtttaactccaaatgctttgtgcctctaaggggtgtccctctgggtatgcattggatggggtcctctaaaata

SEQ ID NO: 684858 - DNA, 105 bp, Homo sapiens
ccccaccgcagttccggagagagccaagttgataaacgggcacgccagaaatgaagatagagctttgagataccccatcaaaaatggaaatgccgctttcataga

SEQ ID NO: 684859 - DNA, 448 bp, Homo sapiens
cacgagggtcgccgagatagctcagcgagatgctcgcgacgaagtcggcgggcttaccccggtagctgcaggcatccgcagcaaagtgcacgtccggtatccgcacccacttgcgcacacctaacaggccggtgagggccgtttcggtggcatccaggtcgccggtgacccaggcgatctgcgtcggcgactgcaagggaagcgtcatcgtctcgcacaatagtcgagccgccgggcggccagaaagggcccgaaagaatttgccatgccgatccggtccgaaccgggaaaccgcgggtgaacacgttctaatttcgtgctccgcggtccgtgaccggccgtggccggatcagtgccgggtcagcacgtcgaccagcagccgcagctgggcgtcgaagacggcttccacatcggtcagcgtgtccgccccgtactgtccgaacacctc

SEQ ID NO: 684860 - DNA, 174 bp, Homo sapiens
gggccccaacccccccccctggggtccttttttttattttttaaaaatccctctcgggactcccgtcctcgctgttgggggcaaatgccccaacccctgtaccccccctttttttgcctgggcagggggaaaggggggcccggggcccgtaattattaaacatgaattccatta

SEQ ID NO: 684861 - DNA, 421 bp, Homo sapiens
  misc_feature (38)..(38): n is a, c, g, or t
  misc_feature (41)..(41): n is a, c, g, or t
  misc_feature (58)..(58): n is a, c, g, or t
  misc_feature (271)..(271): n is a, c, g, or t
caggcaccactgcttcctctgcctcacatgggtgtttntancatcttaatgtcatctnttttgacagctttctgaagttaagtgagatcacagttgggggtggtgatttagaagacaattttagtgactttctgttttactcagggataatattttttacatataacattagtgatgccagtagataaaagcatgctgttcatcatgccaaaagtttgtgagaggagtcatatgttttgggtagactgtggccatgagtcttttatcattnccagttgtgatagataaacttttttttttttttttttttgagatggagtctccctctgttgccaggctacagtacagtgatacagtcttggctcactgcaacctctgcctcccgggttcaagtgatcgtcctgccttaaccttccaagtt

SEQ ID NO: 684862 - DNA, 1414 bp, Homo sapiens
  misc_feature (282)..(282): n is a, c, g, or t
  misc_feature (542)..(542): n is a, c, g, or t
gaatgctgagtatatgcacgtctgcgagagaccataagcttggcgccacccggattgatcccggtggactaccgcaacagagaagctgaacgccctaccgacttgccgcccagtattgcggcatctcggctcggaggcaacgagtgctctgcgtcggaccgtcaccgacgctagctcccgcaagaagtcaaaacagcgtcacggtgcgctcagcccgactctctcatctaggcttgactagatcacgtcggccgtgcgatcaaggtgagacgttgtgtggcnaattgtgccgttgagcgaaacgttgagttgactgtgacactagtgtgggacacgtgaccggtcgagagaggtgatcaaacgctgtgggtagtggttcttaactaacaccgaccttgcgtcgcagaggggtaccacactgggcatggggcacggtggcatacagtcgacgcgtccttgtcacaggtcgtgactcacacaactgggaataacacggagagtctactcaatacttacattctcgcaattgcgtccgatagacnaaccagcgtgtcaaagattgagagcccttgtgtgtttggcccagtcgcgccaatggcgacttgactcagggagagcccgagggggttcgctgagcactgcccaccgataggaattccaagcgtgcgcgaccaagacaggggttaccctgtggtccgaccaagttggtttggggcctttgtaggaaatcgcatggctacgtgcataaagtagggtcttctcgatccataaacgcaagagttagttggggtaagcaaggaatgcgcaaggaggagtaacactctaattccatccacagagcgttcatcccatcgttggtacctaaagtgtaggaactcaggccctacgtagacctatttagacgtggacatttgtccccttgggcggggacccattatggtgcgcttggttggctttgcccatagttgggccaaacccctagtggacatgtaataggaagcactggcggtaccatacaccaatagaactcgcctatggacataggagggttaaatagttgccaaagggcaccctaaagggcatcgagttacctgttacaggcgatgtggccctccgatcggaaaacgccgagttttttacgagtggaggcaaacaaagcataggggtgcgccctgtgaaaacagacgcccaagtttgacgtttaccatagacggtgtatgtggggttgtggggcccaaacacacgaacactacatatgcgcccagaaagtaggcaaacgcgaggaaattagcctagaacaagatgacagtccccatttgcaaaccgaagaacgcccaacacgatagccaaggcatttctgtgacacatcgcggtacacagggtgtgagtagacgacgagaggatgtgaccaaag

SEQ ID NO: 684863 - DNA, 279 bp, Homo sapiens
tgagcagtaacaaagagtattctaagagcccacaaatctcagatccaggtggcttccagttaatgagaagcttacaatgaagaatgtttctgttctaaagaagatatactgagatgagaattatgatctttatcagagatcatacctccagactgatatagccctacgagctctcctcacaaaatgccctaaacttcaagagatgctttttcccgggctgggcacctatatacaagactaaccaggtctctccatatcagagcagtcaaactcaattcc

SEQ ID NO: 684864 - DNA, 640 bp, Homo sapiens
atgtgaatggttctgtgcttgtttgttgtctttggttttgtgcttgtatgggaattagctttactggtaacttccttatttagtttttagtggtcaactctaataaaatgaaactagggctgagctagttagccctcactagccaaactgaaacgtctatgcgaacattaaaagaagagatccatcatgtagcttgtgacgacttttattttattagtcaccggggaactttgcagtgatgaaaatacaccagggtaagtaaaccttcacatggcttcaaagaggaaagacaagcaaatcttctctaagtctactcttactagtaatttccgtaagtgtacaccaaactctggacttggtaaacaatctgaagtactatagaacagttaagttgaacgacatggaccgtcaacgagtacgtagttcatggtttatatgttcttattctactggagtctcgtgaacacatctaggtggaatgcatctgagactaagggctggttttgtaatcctcataacgaaaccagtctgaagaattaacaattctcttcatggtattctaaacctcctaagatatttaggcttctgtacataaaagtgttttgctaaatttacgatatatagatccttcatatcatta

SEQ ID NO: 684865 - DNA, 588 bp, Homo sapiens
aggctgaggtaaagatagagacatcctggctacatggtgaaacccgtctctactaaaaatataaaaattagctgggtgtagtggtgccaccttgcgtgcctgtagtcccagctactcgggaggctgaggcaggagaatcgctggaacccaggtaggcggaggttccagtgagccaagatcgcaccactgcactccagcctggtgacagagtgagactccatctcaaaaaaaaaaaaaaaattaccccactttccccttatttaccattactacccttctttacttcccgggttctctacggaattctatgtcataactctggagaattaatttggcttcttctatgggaacctggagtcagatgtcgggagaactaagcaaagagggggaccggatagtcagcatgcgatttcgggggcaagaagagaactaagactgggcacaagggcacctttatggccatccagacagtgggtctgtgcaacctggggggaaccactcttgaagggcaaccggaaccctcaagggctgatggtttctttacccaataaccttccaattggtctctcaaatagcagcctggattaa

SEQ ID NO: 684866 - DNA, 791 bp, Homo sapiens
agcggaatcaaaataatggcatttgcaggcaacctggtatggaattggcagacgattattctacagtgaagtacactcaggaatggaaaaccaaagcattgtatgctctcacacataagtgggagctaagctttgaagatgcaaaggcgtcagaatgacttaatggactttggccgcactccgagggaaagggtgggacggcaaggtgacgcggatagaaagactacgacacctgagtacatgtctacgactacgtctgagtgatgggtgcacctaaatctcagtaaatcacctgcgtaaagaatttattcatgtaaccgaaactaccagctgttccccaaaaacctactggtaataaaaccaactagaggtaatactacattgtgagaagatgctacacgagctaaaagataaactataaaagtatactagtagtactttttactttacaaccaacgaagaacgaagtcatagcaagagtcagctcctggagcttctgtagggaagaagatttacaatcgaatgaaatagtgtgatccttcagaagacgggtataagctttccgttatcaaaagtattacaaccacctcctctcacccttagccactatctatcatctcagatgatcggagttgtatctatgatacaatcataatagattcagaaagtgctaactataaggcgttaactcgagcctgggttaaaaagcagaagtagagattatatgaattgtcctgattactcattctttcaagatattcacagcaagcatattctttggaaggaacatc

SEQ ID NO: 684867 - DNA, 494 bp, Homo sapiens
gagatcgggaagtagtaacgacgtggataggaacacgggcatatcgagttgtcctgccgttaacatcggcagaccgatgcccgctggaccttgatgctgcaactgccgttgagcgcggtgatggcggacttgcaggcgatgcaacacgacctcgacgcccagcgcataaccgatattttcggtatggccgtggccggtctgctcatcgccggcattggcttgctggtgatctggctggtgggccacgggattgcccggccgctcaagcaaatggtggcgatgctcaatgacatcgcccaggccgaaggtgacctgacccggcgcctgaccagtgatcgcgccgacgaactgggggcgattgccagcggcttcaatacattcctggccaagttgcaggtaatgattacccaggtggtgagctcggtgcagaaggtcagcgactcgtcggagcacactgccgacatcgcgattcgcaccaaccagggcgtgcacaa

SEQ ID NO: 684868 - DNA, 424 bp, Homo sapiens
ttttttttgggtaaatttttttttttaaattcttttttgcttagaaaggggccagggtgttaaattttgccggggacaatttgaaaacttttttgaaagcggggggatccccttggactccgcgcactggggagcttttaaagacccagggttcccccgcggggtgttcccccccaaacccaacttggggggcgctgtggttccccccccttggccccacccgtggggggggaaaaaaatgctgcacgccggttcacacttttcccgacaaattcgttttagccaagcctttttctgctcaaaatttccctactgtggaaacccccttggggtaaacactggacttgttccccccattaaaaagcccgttgcggggggggtttttctttcctggatcgggaaaaactggggtgtcataccttcg

SEQ ID NO: 684869 - DNA, 225 bp, Homo sapiens
cagtctactactcaggatatgtctcttaactgctgtcttagatgtacaattattggccccttctcctttcttctgtcactgtacatctcgttcttggtctctcctattgttctttaactgagccgtaatgtggaatcgatatttacatgttgatacggttaatttcttggccagtgtacggtatttgcctcatttccggctactgaatttgaaaattagatatta

SEQ ID NO: 684870 - DNA, 466 bp, Homo sapiens
  misc_feature (2)..(2): n is a, c, g, or t
  misc_feature (20)..(20): n is a, c, g, or t
  misc_feature (22)..(22): n is a, c, g, or t
  misc_feature (40)..(40): n is a, c, g, or t
  misc_feature (42)..(42): n is a, c, g, or t
tnagtagttacgggaaaaanangatctccgccccttctgnanccccccttaaaatttaaggaggagtatcctaatctctgaaagggggaatgagggtaggaggtgggactcaactctggaaagtggggctcaggcacctcagacccaaactgagcactagcctaaaataggtccccagggcagatgcctagtttcccataggacacaccgacctgtgtcaagtcagttcacccatggctctggcagcacccagaagttacccaccctcaccctggaaatgtctgcataaactgccccttcatttgcatataattaaaagtggatacaaataccactgcagaactgcctctgagctgctactgtgggcgcacagcctgtagggcagccctgctttgcaaggagcagcgcctctgctgctgctgtgcacagccggccgcttcaataaaagttgctaacaccaaaaaaa

SEQ ID NO: 684871 - DNA, 220 bp, Homo sapiens
tcggcccggttaagcggctcacagtaaatagcaattcagctgcttcagccgctgtcataacaaactcagagcagtcttaatggggggattagggcaggaggagggggggtgtcactctgagccctgggagagcctgggtggcaaggaagggttccccttttctctcctatctgaatatctaaatctctctctcctatcttaatattcacggacccgctct

SEQ ID NO: 684872 - DNA, 636 bp, Homo sapiens
ggtggggcctccaaaatggtgtggccaagccttgaaaaaaaatccaaggccatgattggttggaacaatgccaaacaggggtgttgcccaggcctaaaggttcattcctcgacccctgatccaaaactggggggcaagcaccatccgtttacttacctcccttcgggccaagcacaccaggaagaactgtgagacctggggtgtaaatggttaaacgggtactttggtggacataaaggaactgggcatatgggagccattggctgtgaagctgcaaacttataaaacaacagtggaaacggcagttttggtactgcgaattgatgacatcgtttcaggccccaaaaaaaaaggcgatgaccaaagccggcaaggcggggctccttattctggccaggagtgagtgctaggcaagggtacttcaatgccaaaacccaacagagtttccccctttcctaaagccaaaagggccaggaacactgtggacgttttttttcaaaaaggatcaggttggggggcagcccccagtccctttttgtcccaggtcagttttccaaaaaacactgaaaaggaatttttttttattgtaaggtttccatttagtttgcttccgaagattaaatttaagtcatttga

SEQ ID NO: 684873 - DNA, 107 bp, Homo sapiens
gtagaggatcccaaaaatgaatctcatcaaaatgcaaaggaaatgacttgatatcatgaagtatttccagaagtaacatttgttttcctcatcctgaattttatttc

SEQ ID NO: 684874 - DNA, 114 bp, Homo sapiens
ccggacggctacgaacatcaggtttacaactcaatacgatacgtctagtcagtacgtggatgggtgtacttaatttagatggcgaaacaccagcttcattgaaaaagcaatttg

SEQ ID NO: 684875 - DNA, 101 bp, Homo sapiens
tgtgagctccatgtgtagaagtgggctagggcatttttaatcttagagcgaaagcatataatcactgcgcccgctcataaggggatggcctagcctccttg

SEQ ID NO: 684876 - DNA, 156 bp, Homo sapiens
gagtagaaccccccctctctctcggtctctgcccctctctctcttggctctgccccctctctctcttggctcctgcccgctctctctctgggctctgccccctctctctctgtgtcttggcccctctctctctggtctctgccccctctctctatg

SEQ ID NO: 684877 - DNA, 862 bp, Homo sapiens
tttttccccacggaagatattgacccctctggcgactctttgtggtggaccacaataatacaccaggtggtgcccccacaaagatacaagctgtggtgtccgctggtcctgagatttttccgcgcgggtatgtttttggcaccacacccttgttcttatatctcatcggttttgatgaggaaacatacacaagtggctgcctctcctcttgagtgatttttacttcggcgcggatgtattaatattggccattacatactcgttgcgtgctgattgtgttcctcaccgcacgtaacattctctacttttccgcgggcagcactaactagaacgcctctctttctttttgccttgggttagtaccaccgcgctcgtgttttttgtaccaaataatcgcggcggtaggcacaccacacacgcgccctcggtggtttatgttgggggacgatgcttttttttccctctttttagtaggaggagcgtcttcttttctttaaactctggatgtgtgtccccaaagaaatttttttttgtgttctccaccactcctctcctgtaccaccaaatttttttctctcttcattccctccatcaactcgcggttagtgattctaatcatctagatgcgacgagataaatttgtttgttgataaaatggtgttcattagacattcgcgtgggagaacctcctgtatggagtagggttaatcataatagaccccggcgggggagaaaaaaaagaacactccgcggggggggccaatttttttttttttttaaaccgggtttttccccctcttttttcttcccccccccccccccctttttaaaaaaaaaatttttttgttattttttgggggga

SEQ ID NO: 684878 - DNA, 772 bp, Homo sapiens
  misc_feature (37)..(37): n is a, c, g, or t
  misc_feature (81)..(81): n is a, c, g, or t
  misc_feature (134)..(134): n is a, c, g, or t
  misc_feature (164)..(164): n is a, c, g, or t
  misc_feature (168)..(168): n is a, c, g, or t
  misc_feature (174)..(174): n is a, c, g, or t
  misc_feature (176)..(176): n is a, c, g, or t
  misc_feature (182)..(182): n is a, c, g, or t
  misc_feature (191)..(191): n is a, c, g, or t
  misc_feature (205)..(205): n is a, c, g, or t
  misc_feature (236)..(236): n is a, c, g, or t
  misc_feature (238)..(238): n is a, c, g, or t
  misc_feature (240)..(242): n is a, c, g, or t
  misc_feature (257)..(257): n is a, c, g, or t
  misc_feature (261)..(261): n is a, c, g, or t
  misc_feature (381)..(381): n is a, c, g, or t
  misc_feature (438)..(438): n is a, c, g, or t
  misc_feature (447)..(447): n is a, c, g, or t
  misc_feature (454)..(454): n is a, c, g, or t
  misc_feature (471)..(471): n is a, c, g, or t
  misc_feature (475)..(475): n is a, c, g, or t
  misc_feature (518)..(518): n is a, c, g, or t
  misc_feature (532)..(532): n is a, c, g, or t
  misc_feature (549)..(549): n is a, c, g, or t
  misc_feature (558)..(558): n is a, c, g, or t
  misc_feature (564)..(564): n is a, c, g, or t
  misc_feature (567)..(567): n is a, c, g, or t
  misc_feature (569)..(569): n is a, c, g, or t
  misc_feature (597)..(597): n is a, c, g, or t
  misc_feature (603)..(603): n is a, c, g, or t
  misc_feature (632)..(632): n is a, c, g, or t
  misc_feature (651)..(651): n is a, c, g, or t
  misc_feature (656)..(656): n is a, c, g, or t
  misc_feature (671)..(671): n is a, c, g, or t
  misc_feature (673)..(673): n is a, c, g, or t
  misc_feature (769)..(769): n is a, c, g, or t
gggcaggggcaggggcaggggcaggggagggggctancagcccccggcacacgaagtcgaagtccaggaaggctgcctgcnccagcaggctgtgaggggccgcgcagtcgcggggcgggctcagtgtgggggcntccccggtgaactcctcgtcgaaatagctnatgncggagngnccgganagcgtgggnacaaaaggcggtgncaggcgccgggacaacagggcttcccaaccnanannnctgaagaagggctgnttcntcacatcttctgcatctctctcgctagatcccagcctccgctctgggattacctccgaagcagcctatctcatgatgccgatgagcttcggccgacaggaagcggggagtagacgaaccncgtcgttgacgatgatgtcgaagacctcctcctcatcatcccctgggaatggggacntcgccaacnaggatcncgtagagcaacacaaanagtncccacacagtccacagatcgagtagtacgacgtgtccatcagnacctcaagggccangaaatccggggtcccanagaatgtgntggtcnggncnccatagcccatccccttccttgcagaanccaaantctgcgatcttgacgtagccctcggtgtncaggagcaaattgtccaanttcangtccctgtagacgananagtgtacaatgaagaaactgtaggacacaacaccacgcaggcggataaagattggcaggggctcagagaacacgtcgctgtggatgtgcacatcangtt

SEQ ID NO: 684879 - DNA, 99 bp, Homo sapiens
gtcggagcatgaacgcgcagccatcctcagtgtacccgcagcccagaaccctgaggacctccgcatgtttgccaggctccttcactacttccgcggccc

SEQ ID NO: 684880 - DNA, 109 bp, Homo sapiens
cagtatctggaatggacagtcgatctatcaggtgctatgcaagaaattatgtaacttttaaactgtatcgtttctccttcagtcccacatatctcacatagatacacat

SEQ ID NO: 684881 - DNA, 479 bp, Homo sapiens
ctagaacggagctggaactacactccgttgctactcttgcctgattacttacaaactttctcttatggtaggtctgtctatttcgagttcttccctaatttagttaaacctaaattaggtacctatgttaattcttcacagcataatagcatttatctcagtttgcaattgtgtgtgcatacagtgattattcgcttaatggctgttgctccctaaggtctacaagggcaggttccccagggtgtccacatagaaggtgctcagaaaaataccttgaattggcctagcttggtaagaacatgggctttggcagcaggaagttcaaatacctgctctactcttcattattagtaatgtgatcttggacaacccacatagccttgctgagacctgttttatttgtaaaacctctcttggagttgctgtggcgatacaatgacaaccatatataaacgagccaggcttcttctagaagaatg

SEQ ID NO: 684882 - DNA, 793 bp, Homo sapiens
  misc_feature (268)..(268): n is a, c, g, or t
gcccctggatccggtttgactgcaccagctgagatcaggaactgaatgatgcttgttgacgatctttctgtatgctgggcatgcttctgccgaaggctggccacctcccgccacagagcctcattctcatgcttcatggccaggagcttggagtccatgcactcctggcttcccacttctatcgacgcatgcacggtccgtcgagcgagctgtggtgcaccgcgtgtccatggctggatcttttagtgtcttgcgacatccttcgagnggtgtgacaccacgtggtcacttttcctcttgtatgttctccagtggaagctgctccttggccacgcaaggaagcatgggtgctggaactccgtgtcgtctctctctggacttgaccaggcgccgtgcctgctcgatgtgggagccaactttccggcaaagccatacatgttgagtctgcgcaggcacgaagctggccatgtcgtagtgcttgaagtacttgggcatcaccgtccttggtcaaagcgtggtcctggtcgaactaccgtggaagctgtttcccgctcgggctccagtcagatgagcgcgtcggtgtccgggtcgctcacgagggtccacagctgtggtcaggaagagccgggacgttgcgtgggccccgtcgcgccggggtccacgggcagatccatctcgagcaaggagggaataggcggacgcggagcagggcgaaatgagggggccgaagggcccggggtaccgccgcggcggccagactttccgggcggccgcgaccggtggccatggccgg

SEQ ID NO: 684883 - DNA, 192 bp, Homo sapiens
  misc_feature (120)..(120): n is a, c, g, or t
ggggttttaaagaacttcctcccaacttggtttaacccttaaaggtttcctccaaaagcctggcccttaatggggtttttttcctggttgttcaaatggtggaattttaatggggtaagntaaccaatcccttttcctcccttttgggggttttttaaaaaaataaagtttggcaagaaacaagaaaacttt

SEQ ID NO: 684884 - DNA, 108 bp, Homo sapiens
tctatatctgtgtcttttgtgcccacatcccatttatgaccaacctccaagtctgggctacatctggataccacctaatgatcacatgccaggtgcagaccagggcca

SEQ ID NO: 684885 - DNA, 723 bp, Homo sapiens
ttccgtagaggtggacatggtgtgcggactttcgccgacgcatattgcttgccaggtatggagtcccgtgagcgcgcagaggagtccctgaggagctagggacccctaaaggccgtttcaccgcgtgctgggccagtcctcagtcagctggagggtgggtcccacggaatcctgttagtttctaccagctcctcgcccttctctggagctggtgtgagctatcagagagtcctgtggagcgtcggctgggatcagcttggtctcggtgaaaagtaaactttgtaaagctttccagagttgtcgaatcttcgcacctagaaaacttgatcacagtcaatatctgcagtttccaatttgccgcaagaaagaagaaggtagctgattttcagcttctctgtggagttctttattggatgaagacaatgaccattcaagaccaggagtattcgagttcaagccaagagactagcagagaagctaggatgtgatacacgtggtgagtgaaagtcagtactggtcacacatggactgtaaactttcaaaagtatgagcagagagctcttaacaaagacagtgctactacaagtaacttgaagatggctcgacagatatggattaacaagtgaacttttctctggacttccccagaagaagattgtggttgagttcagttcacctaagtgttgccaaaagaatttcatgatggacatttgcgttctacca

SEQ ID NO: 684886 - DNA, 821 bp, Homo sapiens
tgatgctaggtgatccaaaacacagtttgacagacgcaactgaatgaggcaaaatcacatggctgaatcacgcgctatcaggaatcacagctctcaatagcatatgagggatgttataggaaagcggttgaatcacaagtctcagaaccacatgtcagaggcaaataagctgtgtacgcagattgttggttcatagtcagaaactgaagaacacagaaatggtgatcagtggtcgtactgtccagtggcagagctgtactggcgatcttcctcccataccatcgcgctgcccattgctcctgcaggtctctggccctctccaaggagtaccggttacagtacttggcctcctgaaacagtgctgaacattggctaatatgcgcagctcattcttaggaatcccagaacaggccttaagtcttctccacatggccatcgagcccatgctctggctcgacggggctatcctggacaaaggtcgtagccatgttcttgagtggccaagtgccaggtggcttcagcagcttcctaacgatcagccgaagaaagcagaagctctggaggcggccatcgagaacctctaatgaagccaagaagctattttgcaaagggtgactgcaaagagcgcatcagggagcgtcgtttacttcctaggccagactctaccatacctggggaagactccaggagaggaaccggtgtgcgatgctcttccggcagctgccatcaggagcacgcccttctcatggggtacccttgataaaccaatctctagagaggacatcctgctgggctgactgtgcagagtataagattttgga

SEQ ID NO: 684887 - DNA, 262 bp, Homo sapiens
ccgacggcaccgaggtgatcggtgaggcgctcgtgaatgtccgctggtatacggcaacaacgacgtaccgggcaacatgctggcgggtgcggtttccacttacgtgcgtcgctacggcgtggcaccgggcaagaagctggtgctgtcgaccaacaacgatcacgcctaccgcgttgcgctggactggtttgatgcaggcctcgcgtgcgtggctgaggctgatgcacgccacaacccacgtggtgcactggttgaagaagtc

SEQ ID NO: 684888 - DNA, 1011 bp, Homo sapiens
gcgtcaggaaatcaaaatcaccagcaagtttcgaggcaaatacctctcaattacgccccgccctgaaaggaccgagaaagcgagaagagagagaacgaggagcagagaggaggcgaagcagcacaaagcaacgcgtttttcggcaggcagcgaagaaagaaggagagacagaaagagaagacaagcgaagcaagaagaaggagggaagagagagaagaagaacagaacagagagacagcgacaggacaacaagaaaagcacagaaagcagcagagaagagagaaaacaagaaaacaaacacaaagaaaagaaaagaaaaaaagaaacaagaaaaaagaaaagcaaaagaaaggaagaaaaacaaaaagaagaaaaagagaaacgaaaacaaaagagaaaaagaacaagcaagaaagagagaaagaaaagaacgagaaaagagagagaagaggaacaaaaagaggaagaaggaaggagaagaacaaaaagaagaggagaagaagagagagagaaaaaggaaataaagcagagagaaagaaaagagaaagcaaggaacacgagagaaagagagagagaacacagacagcaggagagagagagccaaggacaagaaaagcagcgagacaaagagaagggcacgagacaagaaacgaaggagcggaagaggacagcaccgaaggcaggaagcgggagggacggcgagccgagcagaccctgagcagagacggaaggagacgagagagcgagaagagccggacagacggagaagagagagaggagagcgaggagaggaagcggagagggaagagagcagagggcgggtggaagggacggaggggacgcaggcggaggagaggaagagcggggcgaggagacgggacgggagggggcggggggacggaaggaggacggggcacgagcggagagaagggcgaagaggggggagacgaggaagaggagcgggacggaagagggagggagagagcgagaaggagggagcggggacgagaa

SEQ ID NO: 684889 - DNA, 464 bp, Homo sapiens
cccccaggttggggcccctcctcctcctccctggaaatggtggcctcctttaccccaaaggccttttccctgggcagctcccttcggggcaaacaacggatgagcaagcataactttttgcagggccataacgggcaaggggtgcgggccccccggcccttttacgacccccccaaccttttgggtcccctttgggccctcaacaaaacctgaacaggttttgcccacctgggcccttccctacattattattattttatggccccctggccacacccaacaaaggttttcagtggggccagtttttttctccccttttttctgcctttggccccgcctggccccgcctgcccccctgtggggggggaaagtactgccgggtttggggccggttttgctcccttatggggccccccctttttcagctttttgctatttaaaaaataaacccccccgttttgtta

SEQ ID NO: 684890 - DNA, 1191 bp, Homo sapiens
  misc_feature (92)..(92): n is a, c, g, or t
  misc_feature (143)..(143): n is a, c, g, or t
  misc_feature (177)..(177): n is a, c, g, or t
  misc_feature (187)..(187): n is a, c, g, or t
  misc_feature (356)..(356): n is a, c, g, or t
  misc_feature (406)..(406): n is a, c, g, or t
  misc_feature (445)..(445): n is a, c, g, or t
  misc_feature (777)..(777): n is a, c, g, or t
tcttgtttcggggggtgacatagcagagcacaccataagtggacagtaacagaccaccgacagcacacgaatggatggctagggaagtgagnagacgatcaagtcatagatttgttgtgcgacaagaagccagggcaccttgntatgtgcctcctgcctatatgtgcgtggcaagcncccagtcctnctgacgtacacataagtgcgcgccagcacggccgcgttttaattccgctctcaccactgggagatttgttcttctaaagccgctggagaccacccgtcgcacttcggcccagagagtaatgtttctcgccatagggccagagacgtaggcaccataccaaaagccgcgnggggacaccccaaatgatccccacagctgtgggcgcgacaaccctatgtntccattgtctgcgcccaacgcgccccaacggacttcgtntggggcgcccccggagaaccgctcgggcgttagaagacggggtccactacaatttgggcgaacgagtcacaagagggtccggcccgcaaaaccaatggggatggggcggccccccttctcccaaaacaccggggcgtggaatcccaaaacactccaggcgccgcggtcgagcgtggcatgcacgcacttgctacccgcacgctccctcggcgaggcagtcccttcgtacgaagcaacacaccgacagaccgccggtgggcctcctcgttctcatccacgcaacaggcgggccccaacaaccgcacgagagcctccggcgtacgaaactcacnccctcggagtaagaggagaatctcctgcttcaccctgtggtgtggacgccaccacgcagaggcgccaccaatcggccgctggggaaacctctcctatacgcgaggaccccacaatgggtgcgctccttaagacaccagaaagtcgtgagacgcgagaatatggcaaggaccggagagtgtctcacagccagcgaggaatggagcaatgtcagtgctctccctcgcgggctggaagtccccgatcagtgctccccgccgggcactccggggatcttgtactacctcgatgtcgtaggaagtcgcgcgtgtcttacaacacatcggtgcacgggccagcaatgataaagattttcatggtgtatcaaaatttgccccaaaacataaacccccacctttcccgggcggtaacataac

SEQ ID NO: 684891 - DNA, 396 bp, Homo sapiens
tttgacggcagccaaggtaccccttgaatagccggtgcgatccatggattgagcaaagatggtgtaagcctgctcgttttcaggctcgacaatgacatcgtaggtttcagcaacggcaatccggaattcatcgatcgacactggcttaacgtactgaccgtcggctgcgacaaccgtcattttcaagccggggatccgcacgtcgaaataggtcatcgccgagccattgataaagcgaagccggattttctcccctggcttgaagattcccgtccagttcccatttggcgcctggccgttcatgaggtaggtgtaggtgtgcccgctcacgtcaacgagatcggttgggctcatcttcatctcggcccacatctttcgatcggccacagcagcaga

SEQ ID NO: 684892 - DNA, 208 bp, Homo sapiens
cagcgccactatcctcattgtgttgtggtaaatatgtagagggagtataaggctgtgactaatatgttgagtcctgtaagtatgaaagtgatatttgatcaggaaaacctggttacttacccaaaaaagtcttccaatccggtaattatgggggggtaaggccaagttagccaagcttgcttgaaatcattaaaaaactattaatggg

SEQ ID NO: 684893 - DNA, 263 bp, Homo sapiens
ccttcccaggaagttcccggggtcgacccacgcgtccggtatattttataggcaaaaaaaaaaaaaaaaatggtttcaccatgttgcgcaggctggtcttgaaattctcagttcaagcagtccacccacctcggcctcccaaagtgctgatattacagacatgagccaccccacccagtcagcacacattttttttttttttaaataagacagggtgttgctgttgcccaggctggagcgcagtggcatgatcatagctcact

SEQ ID NO: 684894 - DNA, 318 bp, Homo sapiens
  misc_feature (230)..(230): n is a, c, g, or t
gccagtcttaattacagacacaagtttaaacctgtaaaactgactaataaagttacaagagatgcttaataaagtagcaacaattagaacatacaattatataaacagtgtattataagaagcaagcatcattttctgtattttcatctgacgcttcctagtttattttatcccagtggaagcaaactgcttcaaatgtgatgtagcaggcctggtctcctctatctatnaatcaagtgggtgagcagtccaaaatagcaacgagctccacatttaggaagcaaggggaagaagaaaacgagggcaggctttcaatca

SEQ ID NO: 684895 - DNA, 575 bp, Homo sapiens
aaaaaaacgggcccaacccctttttttcccaaaattaaaatggggtttttaaaaaaaaaaccccccgggcccattttaaaatcactttttcaaaaataaaacaaaaattttcctttttaaaaaaagggggtaaaaactcccctaaaaaataaatttggaaccctttttaatacaaaactttttaaaaaagggggcccctttaaaaggggttttttttttttccaaaagggggtacctccaattccccacacaaaaattttttttcccaatgtgggaaaaacgtaaaaaagaaaattttcccttttccaaaaaataaaacttgtccccctttcttaaaaaaaaatttttttgggtgcccccccctaaaggctgtttaaaaatctccaaaattttgcggggaaaataccacccggggaaaacatttgtggggggttgccaactggcccatttaaaaagttattgctgttccccccaaaagagaaaaacagtgcgggttgggcccaacacgggaaaggggggctatttcttccccccgggaaaaaaaatttccccctcttaaaatagtgggggggccc

SEQ ID NO: 684896 - DNA, 587 bp, Homo sapiens
  misc_feature (464)..(464): n is a, c, g, or t
  misc_feature (518)..(518): n is a, c, g, or t
aggcctcgacaccgagaaagtgaccggcaaggcactatccgcgctaagggaagccgtcaaggccgacgaccttgcccgcgataaggcattgatggctagcccccagttagccatcgaacacctcgccgacggggtttcgctacgcattgacggcgccgacctcgatgtaccgatcggtacgacgaatcagcgccgggtacatggcgagctcgtcatggagatgggtgaggcttggcgagtgcgaatctcccccacttctgaggtcatgaccttagggaacgatgccgagaaggcccaccaaaccgtggtgtcacaactcgaggacttaggtgtggcgagtctggagcaggcagagtctcgtctagctgaacgcagggtcatggagacccacatctcttcctggcgggaacacctcgaggaagagcagggcgaagtcaccatccaagagcttgaagccatggctnagcgcactaccgaaaccgtcagcatcacggccgccgaggctcagaagctggaanaagaggctgtcgccgcagcgaatgaagcgcgtacgcccaaggtcggctgacaccggttaaaaccgtgga

SEQ ID NO: 684897 - DNA, 385 bp, Homo sapiens
ctgcaggagtaggctagcgagcagaatagcctccatgacgtaggagagctcgttgataaacagctaaaggatcttgaccagcaaaggaatgtatggccagcgtactgggtattgggctgacttagagcgggtgcagatagccctcaaccatgctgtagatcacctctcccttcaaacggatatcctatagccgattgtcatctgcattgatgccatggtggagcagattacagagtgccacagagctgactttgccttcatactgtccatagaacaggtgctgtcggctatgtccactcagccataacaaactctagagcaggttagccagtaggtcctgggaggctacacaggaatccaagagagggtctagctgagtgtgcac

SEQ ID NO: 684898 - DNA, 285 bp, Homo sapiens
catacaagtaagcttatttaaagtgtttagacagggccttgcataaagtaaatgctatggcacactagcttcagcgagcctcccatggtgaagggcataccattattgcagatccaaattcggcctatattccagtgcaagaaggtcactctgagaggcagtacaagtttcagtcacattggtgcatgtctctcctctgcctgccagcgaagttccacccgactaatctgcttcccatatatccttcccatgtacatcttcaggggctccctgccatgtgcagca

SEQ ID NO: 684899 - DNA, 902 bp, Homo sapiens
  misc_feature (1)..(1): n is a, c, g, or t
  misc_feature (332)..(332): n is a, c, g, or t
  misc_feature (340)..(340): n is a, c, g, or t
  misc_feature (389)..(390): n is a, c, g, or t
  misc_feature (393)..(393): n is a, c, g, or t
  misc_feature (396)..(397): n is a, c, g, or t
  misc_feature (402)..(402): n is a, c, g, or t
  misc_feature (404)..(404): n is a, c, g, or t
  misc_feature (415)..(415): n is a, c, g, or t
  misc_feature (426)..(426): n is a, c, g, or t
  misc_feature (546)..(546): n is a, c, g, or t
  misc_feature (570)..(573): n is a, c, g, or t
  misc_feature (575)..(575): n is a, c, g, or t
  misc_feature (577)..(578): n is a, c, g, or t
  misc_feature (586)..(587): n is a, c, g, or t
  misc_feature (591)..(596): n is a, c, g, or t
  misc_feature (605)..(605): n is a, c, g, or t
  misc_feature (609)..(610): n is a, c, g, or t
  misc_feature (616)..(616): n is a, c, g, or t
  misc_feature (621)..(621): n is a, c, g, or t
  misc_feature (623)..(623): n is a, c, g, or t
  misc_feature (644)..(644): n is a, c, g, or t
  misc_feature (648)..(648): n is a, c, g, or t
  misc_feature (652)..(652): n is a, c, g, or t
  misc_feature (659)..(659): n is a, c, g, or t
  misc_feature (663)..(663): n is a, c, g, or t
  misc_feature (666)..(666): n is a, c, g, or t
  misc_feature (670)..(670): n is a, c, g, or t
  misc_feature (704)..(704): n is a, c, g, or t
  misc_feature (747)..(747): n is a, c, g, or t
  misc_feature (751)..(751): n is a, c, g, or t
  misc_feature (755)..(755): n is a, c, g, or t
  misc_feature (761)..(761): n is a, c, g, or t
  misc_feature (763)..(763): n is a, c, g, or t
  misc_feature (772)..(772): n is a, c, g, or t
  misc_feature (799)..(799): n is a, c, g, or t
  misc_feature (802)..(802): n is a, c, g, or t
  misc_feature (804)..(804): n is a, c, g, or t
  misc_feature (807)..(807): n is a, c, g, or t
  misc_feature (812)..(812): n is a, c, g, or t
  misc_feature (823)..(823): n is a, c, g, or t
  misc_feature (896)..(896): n is a, c, g, or t
nttcctatgaatgtaaatcataaattttgatgttttaaaaatcctaaatggtttaaaggacttaccgagacttgattaacccagtttttaaaataaaaaatcaaattataaatttatattataaaaataactgccagttttgcatagtaatatagtaacaaatcaacactcttcaaagtttaaaggaaaaggaagctggtattggtttctgtctgaagtcagatctaacttttacgaagacaatagtttcagatcagaatcaaataaatttcagaactcagtttgagagaaaaggaaaaactttagttaaaatctttacaataaaataattntgactatnaatctctttagttaaatatgtacacattacatggtatttgtataaagannggnaanngttantntttttctggcnaatcttatgcncaaatacaccatcttttagagtataatgtccgtttatcattcgttaacagctgtgttagacagtggctctgctttgtgcaaaacgtgataaacaaaattaggaaaaattctgcaaaattntttagttccccaaggaaattactnnnntngnnaatggcannagannnnnnggttgcacnctgnngcttgnttgtntnctcaggctacaatgaccagcnctgntgtnacccccntatntgntaantaattgggtagatttagtatgaagtaaaaaatgnagtaatagaaattgtgatttttatgaagaaaaatggaaaatanggtngatnttgtantnaagatgaantaaaaaatattaaataatattttgagnagngngangggtntttagaataantaaatttttggcctttttttcttcccctgggggctcgtgcggtccctgggccgtcgtttccccgggttgcccngtacct

SEQ ID NO: 684900 - DNA, 887 bp, Homo sapiens
  misc_feature (1)..(1): n is a, c, g, or t
  misc_feature (332)..(332): n is a, c, g, or t
  misc_feature (340)..(340): n is a, c, g, or t
  misc_feature (389)..(390): n is a, c, g, or t
  misc_feature (393)..(393): n is a, c, g, or t
  misc_feature (396)..(397): n is a, c, g, or t
  misc_feature (402)..(402): n is a, c, g, or t
  misc_feature (404)..(404): n is a, c, g, or t
  misc_feature (415)..(415): n is a, c, g, or t
  misc_feature (426)..(426): n is a, c, g, or t
  misc_feature (546)..(546): n is a, c, g, or t
  misc_feature (570)..(573): n is a, c, g, or t
  misc_feature (575)..(575): n is a, c, g, or t
  misc_feature (577)..(578): n is a, c, g, or t
  misc_feature (586)..(587): n is a, c, g, or t
  misc_feature (591)..(596): n is a, c, g, or t
  misc_feature (605)..(605): n is a, c, g, or t
  misc_feature (609)..(610): n is a, c, g, or t
  misc_feature (616)..(616): n is a, c, g, or t
  misc_feature (621)..(621): n is a, c, g, or t
  misc_feature (623)..(623): n is a, c, g, or t
  misc_feature (644)..(644): n is a, c, g, or t
  misc_feature (648)..(648): n is a, c, g, or t
  misc_feature (652)..(652): n is a, c, g, or t
  misc_feature (659)..(659): n is a, c, g, or t
  misc_feature (663)..(663): n is a, c, g, or t
  misc_feature (666)..(666): n is a, c, g, or t
  misc_feature (670)..(670): n is a, c, g, or t
  misc_feature (704)..(704): n is a, c, g, or t
  misc_feature (747)..(747): n is a, c, g, or t
  misc_feature (751)..(751): n is a, c, g, or t
  misc_feature (755)..(755): n is a, c, g, or t
  misc_feature (761)..(761): n is a, c, g, or t
  misc_feature (763)..(763): n is a, c, g, or t
  misc_feature (772)..(772): n is a, c, g, or t
  misc_feature (799)..(799): n is a, c, g, or t
  misc_feature (802)..(802): n is a, c, g, or t
  misc_feature (804)..(804): n is a, c, g, or t
  misc_feature (807)..(807): n is a, c, g, or t
  misc_feature (812)..(812): n is a, c, g, or t
  misc_feature (823)..(823): n is a, c, g, or t
  misc_feature (886)..(886): n is a, c, g, or t
nttcctatgaatgtaaatcataaattttgatgttttaaaaatcctaaatggtttaaaggacttaccgagacttgattaacccagtttttaaaataaaaaatcaaattataaatttatattataaaaataactgccagttttgcatagtaatatagtaacaaatcaacactcttcaaagtttaaaggaaaaggaagctggtattggtttctgtctgaagtcagatctaacttttacgaagacaatagtttcagatcagaatcaaataaatttcagaactcagtttgagagaaaaggaaaaactttagttaaaatctttacaataaaataattntgactatnaatctctttagttaaatatgtacacattacatggtatttgtataaagannggnaanngttantntttttctggcnaatcttatgcncaaatacaccatcttttagagtataatgtccgtttatcattcgttaacagctgtgttagacagtggctctgctttgtgcaaaacgtgataaacaaaattaggaaaaattctgcaaaattntttagttccccaaggaaattactnnnntngnnaatggcannagannnnnnggttgcacnctgnngcttgnttgtntnctcaggctacaatgaccagcnctgntgtnacccccntatntgntaantaattgggtagatttagtatgaagtaaaaaatgnagtaatagaaattgtgatttttatgaagaaaaatggaaaatanggtngatnttgtantnaagatgaantaaaaaatattaaataatattttgagnagngngangggtntttagaataantaaatttttgaaattttatattaaatgagggatagtgaggtaatgggaagtagatcaagagtng

SEQ ID NO: 684901 - DNA, 431 bp, Homo sapiens
gagcacaacagcatcattcagcgcatggtgcttggggtcatgacatgcctaaatgggcggcttgatatgctcgggcttgtcagagtctggtcgtatcgctttcactggttttctctgcaggatcctgtcagccagcaggaagtatgtggcgtgtgatatggtctatacgctgtatggaaaccagggcttctacaatggcgtctcgatccgcttatgtccccaagcaccatgcgctgaatgatgctgcttgtgctcctcttccgagagcattcgtgtatgacacaaggggaactgtgatactttgtagctggtgaagggtccagtaccctgaagccaaggatgatttgcaatctcttctaaagaagcccttctcttgggatctctctgtagcatccgtgtgattaggtcttgacactctattagacacatgg

SEQ ID NO: 684902 - DNA, 835 bp, Homo sapiens
gtggtgaaaccccctctctactaaaaatacaaaaagtagccaggcgtggtggcgtgtgcctgtaatcccagctactcgggagggctgaggcgggagaatagcttgaacctgggaggtggagcttgcagtgagccaagatcacgacactgcactccagtctgggcaacagagtgaaactcagtctcaaacaaaaaagaaaagatttttttaaaaaggcggggcacagtggctcatgcctgtaatcccagctactcaggaggctgaggctgaggcaggaggtggaggttgcagtgagtggagatcacgccactacactccagcctgggcaaactcttgtctcaggaaaaaaaaaagaaaaaaagctcaaataaaaggactcagggctagggaagaaggggtccaaaaatttccctggggggtttcccagaggctcaatttcaataccctcattcaacgggtccattttccactaaactcgtgggtatcatgagcttaccatctcttggcttgaaggtgagtacatcgcccttgcacttcagtttgtgtttcattcacccaaagattatttcacccaggtttcactatgtggggccttccattccagtccttgaccaattttttttgggcgttagttataaactagggcctggttaaggctccgggatccagggcaaacaaaaaaaaaaatctctggccaatggactacttccgggaaatcttggcaataatcacatgatgctttctggtcgggatttgcctggaaacacaggacgcgcaagcgcggaagggcaaacaggatcttgcgggaacaccgcatggacaagccaaggccgga

SEQ ID NO: 684903 - DNA, 427 bp, Homo sapiens
  misc_feature (14)..(14): n is a, c, g, or t
  misc_feature (57)..(57): n is a, c, g, or t
  misc_feature (68)..(68): n is a, c, g, or t
  misc_feature (73)..(73): n is a, c, g, or t
  misc_feature (115)..(115): n is a, c, g, or t
  misc_feature (208)..(208): n is a, c, g, or t
  misc_feature (211)..(211): n is a, c, g, or t
  misc_feature (230)..(230): n is a, c, g, or t
  misc_feature (249)..(249): n is a, c, g, or t
  misc_feature (313)..(313): n is a, c, g, or t
  misc_feature (342)..(342): n is a, c, g, or t
  misc_feature (398)..(398): n is a, c, g, or t
aaaacctatttatncccccgattagagtggaagtggccaccctatttaagggggccnggattttaagnccagnttttatggagatataagtcatgccagtaaaaccccttaaganaaaatcgattgcccgacgaagtattgtgtgtagtcctggttcagtaatgccttgtgccacagtaaagccttgagagtcaccttagcctaaagnaancccaaaaggaagtctgtantttgggcatcctatactantttgtctttaagatatttatccagtccttagcaatgaaagggagatgggtatacaactaattgntcctgtttatttgcctctgtatctatagnacatattagtttgttaatataactaagtgagccgagattgtgctgctgcaggccancctggcgacagagcgagactctatctcat

SEQ ID NO: 684904 - DNA, 454 bp, Homo sapiens
  misc_feature (5)..(5): n is a, c, g, or t
  misc_feature (14)..(14): n is a, c, g, or t
  misc_feature (55)..(55): n is a, c, g, or t
  misc_feature (114)..(114): n is a, c, g, or t
gccantttgtgtgnttttggaccttgccctgaaaagtgagtggtttggacctccngataagtaatagttttaatttatgttccttagtacagtcggtccctctatcctccgggntcccacatcctgtggattcaacgaacccatggatcaaaaataattcagaaaaaacaaatgatggttgtgtctgtactgaacatgtacaaattttttttccttgtcattatttcctaaacaatataacaactatttacatagcatgtacatttattaggtattttaactaatctagagatgatttaaagtatatgggagatgtgcttaggttatatgcagataactattttatataagggactccagcatccttggattttggtatctgagggattcatggaaccagtcccccacagatactgacgaaagactgtaattttggattgactgagaaaaaaaa

SEQ ID NO: 684905 - DNA, 187 bp, Homo sapiens
  misc_feature (139)..(139): n is a, c, g, or t
gacggtccaggtggaggtgatcaatctgatggagaatgcagtcaaagagatcactggtggtggatgcttcattcattaaacgctgtccccagcatctactttctcatactgtgtacacacagcactgtgattcttcgangatgacagctatttttagtgtctgttcggaataacgtactatttgcat

SEQ ID NO: 684906 - DNA, 224 bp, Homo sapiens
cacgagggttacttaacctctccaggaccacaatttccctaactgtatgatagctactgcatagcgtgactgagatcagtatatatgcacgtatatgtggagtacttacgacagtccctgatacaaattagctcgtcagtgagtgatacgttgcattaatatgtacaatgaagcatcaagcatctgccatggctctggcatgataccgatgaatggaccatgaa

SEQ ID NO: 684907 - DNA, 241 bp, Homo sapiens
catctgttactttttttatttttttatagccattctgactggcgtgagatggtatctcattgcagttttgatttgcatctctttgatgattagtggttttttcatgtttgttggcagcttgcgtagtcttcttttttttttttttttttgggagaggggttcccgcttctgtgtgccccagggtggaagttgcggtggttgcaatctctcagctctcatgtgaaaggctcccgcctccccg

SEQ ID NO: 684908 - DNA, 165 bp, Homo sapiens
  misc_feature (114)..(115): n is a, c, g, or t
ggtcgacacttagttggtattcctataatgtatatttctgggctacgatgtctctatctttactaggtgtgtctttgtatcccaagcctctctgctttccaaggcatctctatnnttcttcatgacccccaaaggggagctatttgataggttttgatgggttaa

SEQ ID NO: 684909 - DNA, 170 bp, Homo sapiens
gtgatagatgtactgtcttgcagacaatgatgcaaataacaatgaggcatgggctaatggatttgaagctggcagggactcatcgtcgatgttcttggcgaagagctggaccggcgacgggagacggtcgcttgacggggcacgggtgctgggctggaccactggttgca

SEQ ID NO: 684910 - DNA, 1974 bp, Homo sapiens
  misc_feature (901)..(901): n is a, c, g, or t
accaacgtgtacgcggacgctgtggggggatgcgtggttccggacgcgtgtggtagagggacgagggccggagtataaggctcggagggccaatggatgcgagggctaagacagcgaggaggacgtagcggagtgggagccatgggcatgaggtcaagcacaggattccatcgaatagacggacgcaagacaggatgagaaggacactaggataaacaatcgctacatgcaaggatggaacgtggctgtgccaagcatacaaaggcacatatgtgatgctccccccccccgtcaatggccttgatcgactgataacgtccacgtgacttgttgggaaacaaatgggccatgaacagagaaatataatccttgacacgccacaaggacgaacgagacgcattgacgcgcgatggacccggggagagacgagaagcgtaggaaaggattacgaacaccatataaatgcgtatgacagggcagaagaaccacaatgggagtccataggatgcaagagacacgtgccccaatggcaggttaaaatcataccaccttgacgaggaaggaagtggagacaaaagccacacggggaaaagtgacatagagaggcagacattggggatacagttaatggatgaaacgcgaaaaggattgtgggcatagggagtagcaaattagaatggaatagaaaagaggagggaggaaggacgaggaaaagattagattcagaacaaatagggggaagcatatggaagaatgggtaggaagaaggcaaattaggtacaatggaaatatcgaggacgtaatacggcgagtagtggaacaaggatataatagaaagagagaagtttgacacgacattaaagggagcgaagaggggagaattcacacacagtacaacagntgaacgtatttgtgtcgaatagtgataggcacccgattcgatactaagatttgggagaggaaataagagggtgcgaatagggaagatagcgacacgagtagaaagaggaaaaggaggcgcaaagactgacgatcaaagaaagtatgggcgaaagcaatttagaattaagagcagatatgggaggatattggagacagagagagcggattaatagcagtaagagatagcgaacattgggagaatatggaggagagaaagaggttgataaagtagaaaaagatttatgatgagaaagataacgggtaaaaaggagccgaacagcagacgaaaaaaagcaaaacaaagaagaggaaccaaggagcacgaggaccgagactacgaaaagacgtagcaacacaacaaccgaagtgaagggggaccacaaaacggctaacgacgaggagaagagcagcgaggagtatgataagtgtgaagcaaaaacagcacgagaaaccacataagaaaaagagacaagtagaggacgaaaaagcaaaggagacagtgaacgaaagacaagagagagcagtcacagaatccacgaaagagaggcgagcaagaaagcagctaggcagaagaacccgggcgagagacgacggccgacgagtagcaccacgcatgagcaagacgaagcagcgaccgagcagcaagcggaggcgagggagacaacacagggagaagcagaccaaaaaatgatgcaccgagaagcaatgacagaggaggcagagcgaaggaacaggacgcaaacagacaagcacacgcaacgatggcggagcaaaacgacgagaggagagcgtaacagagagcgcagagagaagaatgaaaacagaatgagagagaaaagacgtaggatgacagagaacgcagagaacgacgagcgaacggaagggctggacagaagtaagcgcgaccaaaagaggcgaaaccagaagaagaacgaaaggacgaaagagtaagatacaagagagagaaaggcagacgagagagaaagaagagaaacagcaatatacaccgaaaaaagaagacgagacaacaag

SEQ ID NO: 684911 - DNA, 374 bp, Homo sapiens
ctcaacaacatccgtctacaacttctttatattgtaattaaacgagttaatccagccagctcctcctaagagatcagtattggcgatttccactcttgcatcagagcactcgttaacaacggtccttgcctcggagaacattagaggctacagaagcattgcagagaagagaagaagaacaccgaagagggaaagataacttgggctctcaccatcatgcacttttttagcaacacaaaattaaaaaccacatctaatacacttttctctatactttagtggttgacacaagtgactcaaatatcctaagagtacaaggaacagcctaaaaacagctgttttaaggtttgtctctaagattatgataccgcgaa

SEQ ID NO: 684912 - DNA, 866 bp, Homo sapiens
  misc_feature (20)..(20): n is a, c, g, or t
acttccgggctgccaggcantgctgtggctccaggatgatggagacagagcgacttgtgctaccccctccagatcccctggacctaccccttcggccgtggagctcggatgcacggggcactgggagctgctgaacttgcctggagctccagagagtagccttccccatggcctccctccttgttgccccagatctgcagcaagaatgcatgaacagttgtttcttgtcatccccagcctggctgactctgcatggtgtggagcactcagccctgaaaatggcagagtgaatgactgtgatccctgtgtctctttttggctgtcctggagatgccccagtcccatccgacactacatgtgcccaaatgacacccaaccacatgtgccagatactggtgttacaaagaggtcttgcttggagaacacaaatctctcgtgcctacaacctccttgtctcttcgcctgtgcctccagtggccagcctcccagtccttatggggaaatccaactcgtgtatcccttctggccagtgggggatggatgaacaccaccataacatgatctgaacacacgggaggaggctgaggaggagatagactatagacaaagatccttcttactattccaccttggtttcaagaaaggcatggactttgcaccaaaagattgtccaaactccagctccttggactactaagacctaagctgtctgttggagcctctggatttggctgcgcgggtgacgagattagaatgagcagtaggaccccatgtgtccaaagggacactgttcaactatccctcatgcccctgccgaccacattaaaactattgtgagaactacgtttcccaagccaacatcagga

SEQ ID NO: 684913 - DNA, 894 bp, Homo sapiens
aggggctatccccgaagggtggtacaaccccctcggttacgccccgggctcccccagaggaggctctgcccccccggggaaagattgtgctccggccccgcgtcccgtgagcgcccgctcccgcccagtgggaaccgccaccaccgaaaaaccttgcccaccccgaagttggggcccgaccaacctctgggggccccggcgctctccaacctccccaaaggcggggccccccaaaagccgtcttgcgaccatttccccgatgagcacaaacccgtcgcccatttctgtcctcctccgcgggcgccctgactgtcttgaacatcatagggccccccccaagagtcatccaagccaaatcccaccagagaggggcccccccacaacggtctcctcctcaagggcggagacatcacctgctaccctcccgatagggggggccaccccccaaacaactttcaacaaagggcaaaaatgatgaaacggtcccgagggccgaccgccagcaattctgtgtctatcatgcctggtccactgcagagagaatcgctcactcgcccccatgggccgccccccgccccgagcctcagaacgcccgggcgatctcaccctcgcatgctgcagaagccccccccccaaacgcatgcttcgcactggagcacccccctatatcttaccctgcctcatgggggcccacagcgatagacactaggagtggccactttagaaaccaacggggagcacacaaaccgcacatgtgcgcaagggcgggcaggagaatggagatagcccgagggaataattgatacaaaacacaaagaccaaaaaaacaagacaaagaacatatgagagtcgggcccccaaaaaagccttttcttttttcccccacaataacaa

SEQ ID NO: 684914 - DNA, 809 bp, Homo sapiens
tgtttttatttaaaaacatgacatttggggccaggcgcggtggctcacgcctgtaatcccagcactttgggaggccaaggcaggcggatcacctgaggtcaggagttcaagaccagcctgcccaacatggtgaaaccccatctggactaaaaatgcagaaatttacccaggcacggcggcggacgcccatcatcccagctacttgggaggctgaggcaggagaattgcttgaacccgtgaggcggaggttgtagtgagccaagatcgcaccattgcacaccaacctgggtgacagagcaagattgcatctcaaaacaaacaataataataaataataaaaacctgatatttggctgggcgctgtggctcatgcctgtaatcctaacactttggaggattgctggagacaggagtttaagaccagtctgggcagcatggcaagaccctgtctctacaaaaaaggcaaagattagctgggcgtggtggcttgtgcctgtagtgccagctatctgggaggctgaggcgggaggatcacttgagttcaagctgacagtaagctatgattgcaccgctgcactccagcctgggtaacaaactaagacccatctctctgtctcaaaaacagtgatacttcgcaaagatgcttagactccaagaagctttggcatctctttccaaaccagacactgaggtactgtgtagcctcctccttgaataactaacctggtgagctgagatagagccattgcaatccagcctgggcaaacaagagcaaaactccatcacatttaaaaaaagaacaaaaaagg

SEQ ID NO: 684915 - DNA, 493 bp, Homo sapiens
  misc_feature (57)..(57): n is a, c, g, or t
  misc_feature (339)..(339): n is a, c, g, or t
gctgccccagctccacacagggggcatacctggagcctcagagccaggctgcctgcncctcccttctagagctgcagccttgctctttcctctttctgtccttgtgctgctggctgtctcacttccctccctgccagccacaggactcagtgccactgctcaaggtctccatggctgagcctgggggctcttacaacaggctccatgccgaaggtggcagatgtggaaccatcagagagggcacagagctcatggtttatggtgtaggggctgggagcttggagggggttgtgtggggggctggactcaggcggccagaggcctgggcacatcatcctnggcacgccgtacctgtcatgcagtctgagtcatgctgccagggcaggtatccagctcccagcctgggagtgccgagagccaaatccactgcagattaggggtgatagtcacggtcccacgtcctctatctgtcagcaatccagtggtgatctag

SEQ ID NO: 684916 - DNA, 361 bp, Homo sapiens
ctctacaggatccccggaggcgttgaatggccttccttcctgggtatggaatcttgtcggcatccacgagaccaccttcaactccatctatgaagtgtgacgtgaacatccgcaaagacctgtttcgccaacacggtgtctgtctgggcggcactcaccatgtatccgggcatagctgacaggatgcataatgagatcaccgccctggtgcccagcaccattaagatcaagatcactcgcatccccttagcgcaattactcggtgtggatcggtggctccatcctggcctcactgtccaccttccagtagatgtggattagcaagcaggagtacgacgagtcgggccattcaacgcctccg

SEQ ID NO: 684917 - DNA, 1539 bp, Homo sapiens
  misc_feature (134)..(134): n is a, c, g, or t
  misc_feature (1303)..(1303): n is a, c, g, or t
  misc_feature (1539)..(1539): n is a, c, g, or t
gttactagatggcctcgtatacagtatcattcgtggcaacgactgatgcggttgtgtctggcaatgggttggccaagggatggcattggcgtatgcacccatctagtcgtgagactactagacgctgtagtccntcacacgagcgcatcgggaacatgcctccaaccgtgacatgggagtatccacaatcggcagtgtaggacaacgagggtcgctattgcatgtaatctcgaatttgcaatactcttaacatacatcctacttccgtctcgaagtcaggggcctttgtcctaacctgtctctctcttctctagcagaactagatcgaagctaacatagctttgtgggtgctattcccggtcatctatgaatccgctgtaagtggccagtttgtatcggtctacattggattgttggcttgccaaaaacgcaccagggctatttgtcgctaggctctcccctctttttagcgtcgaatggtcaaaccaaggaaaagcagtggggggccacgtcttactgaggaccctaggttacgacaaacctgggtatctcaggtagcatatacttatttgaaggatggggggagaccttcgtgcttcgcttcgtgtgtaggattcaaaccttgatcgtgagccattttcaaattagatggacacaagaaaattggtgtcgctacgttgttaccctaggttttagtttaccggtccagggttgcttatagctgtttttgacctttcgctacagccccacggcttatacaattctgtaaagcgacaaatgccatacctgtgagagaaaggctatggcgggcgtgtcttcacaggcatagaacatacactttgatttgaatataggcttctcctgtagatacacaattattcctacagagaaccacattaactaaatagttttcctcgggttgaaattttgcccctcgccctaaataatttgggtaaggttttgcccccatcccttggagaattcaattaactgatggcgaattgacttggttagattgaagggcgggcactttctaagaacccggcgttcaaaagagcgtaggctttgactccacagactccgaaggtcgtggggttaacatactaaattgtctttggccaaacgcaatatgtgccgcgtataacattgtgcctctgttaacgtttctccgggttaaagaagtatttcgccaagagcgaagacgcgaaaaacagaaggttggtttcccagttcgacctttagttcccccatacttgttggttgttgtgttgacccgccccgccttgtacatacaatgtaactngtaatggcatattccaatatctgtagggtgttacggggtccttaggcgtggttacaggcagggcatcaagcttatattgctctacgaacgcctagttgtatgcgcgtgcacagctgtgcatcgtttccaacacaactcacgcgcttgtgccacagcctcacatgggttctgacattgtcgtccccgctcccaagagggagcgagccagaaagagtttagaagcctacaataaaagn

SEQ ID NO: 684918 - DNA, 269 bp, Homo sapiens
  misc_feature (1)..(1): n is a, c, g, or t
ntgtttagtaactcttgctctgtcgtccaggacgatactggctcactgcaacctccaccttccaggttcaagcgattctctcacctcagcctcctgagtagctgggactacaggagcctaccaccacgcttggctaattttcattttttttgttgttgtttttattttgtagagatggggtttcaccatgttgaccaggctggcctaaaacccctgatctcaagtaatctgtctgtttcggcctccaaagtgctggaattacaggcgta

SEQ ID NO: 684919 - DNA, 892 bp, Homo sapiens
ccacgcgtcgctgacgatgccggtgtggatcgctgtgaaatcgtgggctggtccggttctccgcttctccctccatcccctatcatttacctaccctcacctcgcatttctcattgctaacgtcgatatgtatgctatgctgagtggcagatatctcattgaccacctctcatggaccaatctcatacaactacaacgagcaatcgggttagctgttcatataacatggtcgccctacgttccctcctctatatgatagtctacgtaggcctcttatgacaccgccggacgctatagtaagggtaatgaccagtcaatatttattaactaagcgctgaaagattcgtctcagtgctgtatcgtatgcgttctgttcagaactatccttcatgtagatagccactcctggtcatctcactgtactacttcacaaaagactaaaacgtcgtactataactcagttcctatatcagttggctatacattacaaagtctgacatagtccctaatcgtaagactgcgtaggaattgaatgctaaataaactgactttcttacgagcacgagggggtactcaccgggatgattggcccactggggcatggattcttcaaagagcgttccaatccaaacgagctggttactggttttcgtgtgaagctttcgactattctactgggcaaactaacgagccttaggcgccttcaggccttaagcttaatccatgttccccatttgtttgactcttttcacacgctccaagaagggtgacttgcctgtacctgagtgttttttaactagcatggccttccaaataattctgtgtaccctccagagttatacaattttattaccttcaagttggtcgaaactgctgagaattttcagcgcca

SEQ ID NO: 684920 - DNA, 516 bp, Homo sapiens
  misc_feature (39)..(39): n is a, c, g, or t
  misc_feature (341)..(341): n is a, c, g, or t
gtggatgctttggggcaaaggcaaaaagaaagaccatcnaggatggggctaggaggagctgcaggagagaacggtcttacagtggacgcctgcacaaggtgggccagatcgtgtttgagttcgtgggcgagcctgagctcatggacgtgcatgtcttctgcacagacagcatccaggggacccccgtggagaacgacgaaatgcgcccatgctggttccagctggatcagatccccttcaaggacatgtggcccgacgacagctactggtttcccctcctgcttcaaaaaaaaaaattccccgggtacttcaagttccagggtcaggacaccatcctggantacacactccgcgaggtggacacggtttaacgggagcccagggcagcccctgggcaggaaacgtgggtgttgaacaaccccaaaccatcttcccctgggggcattgagtggcgcaaaaccgggtttcatctggaattaactggatggaaaggaaaataaagctatctaacggtga

SEQ ID NO: 684921 - DNA, 129 bp, Homo sapiens
  misc_feature (2)..(2): n is a, c, g, or t
angagtaaagtaataatagaatctggtgttagaatttagatgaactagttttcaatctttatagtatatcagaatcacctaaagagtttattcaaacacagattgctgggcccccacctctagggagtt

SEQ ID NO: 684922 - DNA, 961 bp, Homo sapiens
ccacaggagttaaagttcctcgtaattttcgctcgcttggaagaacttgaagaaggacaaaaaggagctaggcgacggtacagttacgctggggccttgaagatgactgaacgatatgacacttacaaggctggacaggccactgacttattgcggccaccaaggcacaaacttatgcaaacacagaactatatagccctgaaagtagaatgctggacctaaatacccacgaagctcctccgctcagcttagacttctgtaacaacaaacttaatatgaaccggaataaataacttccagctgggcactggctgcgatgcctcggcagccataccagctgcttagcacaaatggcaacaacttcatactagcacttaaagcttgtaccttcaagcagcctaacgacgatcataactgatgctcccaaagaacaactatgacagcttccacaagccaccagacaggcaccaaacactacaaccaacttaatctcacgctggatctcaaaactttgctctctcaacatccaacaacccttcctcacctacactgcctccacctgctcctctgcactctacaccctacatcccaccaactgccacccaactcaacaccacttccaagcttaccacagcacatctcccagccttgcgcttcacaccactgcaccctgcgaaccatccgcctcccgcactcctccttcccacctctccctgctccccacccccacttcactgcttctcccagccgcttcaccccgggccgtcgcacccagcgtggcctcgccgccccctctccgcccgccccgtccctctggtcccgcgtgccccctcgcccgttcctcgccgccctttacatcccttggcctgtctactgcgggcacacttagcatctgtcggcggctcctcccccctcccttgcaccgccgcctgtggctgaacctcgctccccctggcccgtg

SEQ ID NO: 684923 - DNA, 419 bp, Homo sapiens
  misc_feature (52)..(52): n is a, c, g, or t
  misc_feature (167)..(167): n is a, c, g, or t
  misc_feature (192)..(192): n is a, c, g, or t
cgggcgagggatggtgatctcagtcactgactctactcccaggctcagcganctcctgtgtcagctcctgagtagcaggatacaggcacatgcaacgcacccagtaatttttgattttagtagagaaggggtttcgcctgttgaccagtccggtctccagctcctgngctcaagtggtccccttgcctcggnctcccaaagtgctgggattacaggtgtgagccattgtactccgggcctttaagcatgtttctaaatggtcctgttcagttgtgttgcatgtgcaacaacagagtaagtgggtgcaagtcctctgcttcagagagttcactgtttaaaaggtgaaggagtgccaacttccaaagtgaatagaaacacaataatacatatatgggtaagtcccccagtagggcaacagc

SEQ ID NO: 684924 - DNA, 217 bp, Homo sapiens
tcagctccgacccagcgctgagcaaacaggagtattctggcttagactgacttgaagaagctccctgtacttttctgattcactgtctttcatacctatgtttcggcctcttcagattgcagtaagggtttgtggaattttttttttttttttttggaaaaagggtattgctttgccgcccagcctggagggcagggaaacaaatctcgcccttcca

SEQ ID NO: 684925 - DNA, 1448 bp, Homo sapiens
gtcaccccgactcaacgtgagacgcaccgcccggactcaccatgcgtgaatgcactctcagtccacgtgggagcacggcatggtgtccagatggtgcaatagcctgctgggaggctcttattgcttgcgaactatggtgattcagacctgagtgtgtgcacgatgcccagatggactaaagaccattggcttggatggggcacgactccttcacctaccttcttctgtgaaactgggtgctggaaaacactgtaccccggtgcagtttttgtggatctggatcctacgggtcattgcatgatagtccgtaagatggtcccatacacagaccagactcttccatctcactagagtcacgctctagtctacttggtggagaagaagtgactgctgactcaggctaaacttagtgtcctcgtgggtcatctaatactcaatatgcgtcacaccgggaagaatctatttggaccactaagtgtctgtgcatctggacctcccccgtctaaacgtcataggtcctttgaacccgaagattgtctacctacgcggaacttttcgagaggagtcgtttcccccttgcggttgtttgccttatccaagcccttttatggggttggggtgtgagcccatctttgggccctccctggtgggcttttcccacccctccaacgtaccccttgtagttgtggaagtcggggcctttcatacgtttggtttgggaactttatttgtgctagacagaaacaattcccgagagacgttggcaaattttctacgctaatacttatatctcaccaaggacccacctctcggaggggttgggtccttaacctagggctccgctggcgttcccggaacagtccccccttttaaccatagggttcccttaattctcgttgaagcacaacactcaaacaagcgcaaaccccctttgcgtaaggcgaacttccacgggaaactttggttaggccctgttttccaacctggggttggggagccaaaaactcgataaagagcgaaacgctcctttaggtggaacactaattccttggcgccctggtccctagaagaattaaacccggtaaagtaaactcaatttccggtgagggccgggcccccaaaaattccgttaagcaaacgccaataatcccttctaaagattgccggccctttcctaatttacaaggcgcccaaagagatagtgggtctcctttgcccgtctccctaagttccgacgcaaagggctttttccctttcggtggcgcgcgcgtttgttggggaccgcgcgtggggacaccccccttccggaacgttgggtgtgggcgaaccccctggtgtagccacgggagcgtttttccccgcagggaagcccgagagccccccttgtggctgggggcccgcttataaacgcgcctttcggggcgagtttcccggacagtttttttcca

SEQ ID NO: 684926 - DNA, 268 bp, Homo sapiens
aagaggatccccccttgttcctgtcttcttgaaatctgccaagtgctcaccgtaaggcctttggtcatatcgctgaagatttgatggagaagctctattacactcgtcttgaataggctaaaggttggtcttcaggttgtggcagtccaggctccagggtttggtgacaatagaaagaaccagctttaagatatcgctattgctactggtggtgcagtgtttcaagaagcaggaactggccagttcctgttcaagaagcaggaactgg

SEQ ID NO: 684927 - DNA, 198 bp, Homo sapiens
  misc_feature (23)..(23): n is a, c, g, or t
  misc_feature (43)..(43): n is a, c, g, or t
  misc_feature (55)..(55): n is a, c, g, or t
  misc_feature (112)..(112): n is a, c, g, or t
  misc_feature (157)..(157): n is a, c, g, or t
  misc_feature (171)..(171): n is a, c, g, or t
gtcaaataggtttggagattaanccttttcctcaacttgtgcngtttatatagcnaagcttccgtcaataaggcatcattgtgacctttaacaaacattatcttcccacatnccaggaactattggacatttattttacatgggaaaaattatttgnaataataaagcagnaacttttcctgaagttgcaatttaaaa

SEQ ID NO: 684928 - DNA, 1644 bp, Homo sapiens
ccgtcgtctgtctcgtatgggtgagtactcgaccgcatccccgcttgtgttgtgttccgcacacagccgcgcggttggtgtggaggagagagaattgtttggtagtagttcgcacgtatcaggtgggtgttcccctccccccgccccgcctctcctcgtggttccaccggagcgggggcgccacactcggattatggtgaggtgggcggtcgcggctgcgaaaagtagtgcgccccgcctttcttcttgggggggtgtttgggtggtcccaaacaagcgagcggcccaccatttggttaggatttagctgttggtgtgcgttttcgataaagaagactccgctctggtggctttttattaggaagtttttgtggtcatccacccgcgcaacaacaaatatttggggggccacctaattttcctcgtgagaagttggtgttattgatgactcccccgtcgccgcacccatcaccagggggggccgccgccttctggacgaggaagaggtctctgggacaataagaggccgccgcaccaccaccacacgggcgttcttattttgggtggtggtggacgcccacaacaaagagacggtcgatgatccttcggtggagaaggaggatgtggccccccccgcgcgttgttgtcaacattagtcttgtgtctgggagagcgttgttgttcactcgtgggtggtcttaatcaggaggcggtcgctctacatggtggggggaggatattgccgcaacaccgcgccccccctcgttgttgacgacgatctggtgccgctggcgggccgccttcaagaggaggcggttgttgtcggccgccccgtcggcgttcgcccaccccccacgtccttgatgaggaggcgtcgcgtctgaagatgaagcccaccacaagagatgtgtttctcctcacgtgtggggcgacgaccagaggagtctgaccgcactcttctctggtgttgtcttgtcgtggccacataagaggtggtgatgaacatcgttgtggtgggacgccacaacatcttgtcagaggaggacctgtggggcgcgacatctcccacacgacacatctgtgcagaaatacattttgggggcccaacagggccacacacaacttcataatctctacagagagtgtttgctccccgctctcacacacacacacactctcgccacagtgtcccacacacaccactctcttttaaggtgtatcacctctgttcttgtccactccacacactagcgccgctctttttccacaggcgctccctcccacactttataggtgcctctaatagatattcttgttctcttttgtcttcttcttactctctccgtgtttcttctgtcttgtctgtcttctccctgtctgcctctctctcttctttctccctcttttcttcttttcttctccctctcttcttctcctcttgtccacagaagtaaaggatataaatttcttttctaactaaaagccctcggttttcacaaactcttttggttctcacagagccccaccttcttaagaaatttgaaggatttccaagagactttgcttatattttgttcttttgatacttaccctactagaaatttaagcgaatacctttttataaataaatacacctgcccacca

SEQ ID NO: 684929 - DNA, 381 bp, Homo sapiens
  misc_feature (288)..(288): n is a, c, g, or t
  misc_feature (374)..(374): n is a, c, g, or t
actgcttcctaaatggccaaggataaaggggaataatcccaaccttaatgccgcagtgtaagtcaccttgattccctccctgctcagctctacctgaagacactaaaacacagtatatattccaaaggaaaaagtcacagtatttccctggacagaaccagaaagaggggagaaatggtttgaagcttactgatgatcaaactgtaaaagactcagaacttgactttaaaaacactcttcttggccagtcgggtgtggtggctcatgcctgtagtcccagcactttgngaggccaaggcaggtgaatcatgtggtcaggagttcaagaccagcctggccaacatggtaaaaccctgtctctactaaagagacanaaaatta

SEQ ID NO: 684930 - DNA, 142 bp, Homo sapiens
acataactagaatggtactggcgcttgagaagcaatcatagagcatcttcctgaaatcccagcagttcttttttttaggttttttttttgagatggagtctcgctctgtcgcccaggctggagtccagtggcgccatctcgg

SEQ ID NO: 684931 - DNA, 818 bp, Homo sapiens
agcagtggggtgtgagagacccggggagatccatcaagaatcgacccatcaggacgccagagactgtcttcagtcggatgaccacgcttctccctctaacacattcttccgttcttcacaaatggaccatgtgagacgaaggctcaagggggagccgtctgtgccctggcgctgtccccagtgcctccggagggtttgcatctatcgagggtggcggctgtgccgtgggcgtggctggccgtggttcctccggcttgtgggggctcgcgcgctagagttcccggggtctcacaattgacaagcataccccaaggcgttggctgccagagattggccgatcaaccgggcgggctcctggcatagcagcacaggacgctctctcgtcaccagacaccaggaatgaagatggcacggagcggggcgggtcagtttgggcttgcagagtcaggcgcgattgttctggcatagctctagtccgagtgcgcgaagacggaggcaggagcggggttggaaggctcattactgcattgaagtctggcgcgtccagtaagatgcattgtactacctcggcctctattgccctcctcacaacgttgccttgtgttgtggaaggagacgcggaagggcctaaggcgtctgcggagcctgttactccaagactatacgttaggaacgttatgcagggtgggcgtctcccctgggtaagtcttggacttaggactctggatcaccatgtgtggaggacaactggtggcaccaaatgggtcgcgaccacaactctgtcattggcaccagattggtctcgggccatggtatcc

SEQ ID NO: 684932 - DNA, 82 bp, Homo sapiens
atgatcctaaacaaagctctgctgctgggggccctcgctctgaccaccatgatgagcccttgtggaggtgaaggcattgtgg

SEQ ID NO: 684933 - DNA, 117 bp, Homo sapiens
tgagctgaggatgagctgaagatagctgagctgagctggggatgagctgaagatgagctgaggatgagcaggggatgagctgaggatgagctggggatggctcattgggttccgatg

SEQ ID NO: 684934 - DNA, 717 bp, Homo sapiens
ctcgagttggcatgtgcaggtcatggcaggagccagagctttgacccagacccatgagttgcgcaggaactgaggggcgaactctagcgactgacttactgtgaagcctggggcaagccccgttccaccatcgtctgggcctcgagttatccttagaacttcaacatgacagtacccattcgccgtaagatagagagccatagcgtgtcgttctgggatggcgtctgcttccagaatcgcaggcctttcagcatctttctttggaggaagattggaggctggtgctcactgtccaggcctcagactctggggcagagagggggattctcagagcctgaggccctcccttgcagccctggcgccctcaccgcgcgcaggcagtgggctgagcacctgcatggctgtgggccctgcggggacgctggcagcatgcgctgctgtgggctggcccagcggtagcacgctggagtcagtatggctgatcgcgtttccgagctggcgtggccggagtaccacgcatggtgccatgccgtggcgcctgtggccacgaaggagttcgaagcaagtagggcatcgagcgccacagggcaccggaaacgcattctacgcctgctacagacaggcaccgaagagggctccctggatcccaaatcagatagtgccatggaaaccatccaccaggccaggccccgacaaggcacaggccacctagagacc

SEQ ID NO: 684935 - DNA, 349 bp, Homo sapiens
  misc_feature (4)..(4): n is a, c, g, or t
  misc_feature (111)..(111): n is a, c, g, or t
  misc_feature (123)..(123): n is a, c, g, or t
  misc_feature (144)..(144): n is a, c, g, or t
  misc_feature (173)..(173): n is a, c, g, or t
  misc_feature (225)..(225): n is a, c, g, or t
  misc_feature (286)..(286): n is a, c, g, or t
  misc_feature (306)..(306): n is a, c, g, or t
  misc_feature (318)..(318): n is a, c, g, or t
cttntcgctaaagatggtatagacagcaggagggggaccatggatggggtcctgggacactcagtgttaacaggttagggagatgatagggggccaggacaggatgttganaaggagctcagntaggaggaggaccaccagggngtgtggtcccccgcaatccagcacgtcangggctcctgatggatcaagataatctgatcgagcaaagtgagagtcggtggngtccctggaaagatcagggtgagtggtgtggtggcgcacactcatagatgagtggagtcgngagagtaggggagaagaggnactggcggactngctgttgaggacaggagagagctgggttggt

SEQ ID NO: 684936 - DNA, 265 bp, Homo sapiens
gggtcgtctctagcaggatccccctttggtccgagagaaattagctgtaccaggcccttttggcatcttcagtgccctgggttctgcccgcccggacccccatctctgtgacttcctggtagactcacttcctagattaggaagtgccgcttatcaagaatactgggttaccaccgtgaccaacctcctcagcgcctgggatggcccgtgaggtctgtggctgggcgagctactctcttcgtaaagggctcacgtctcaaggcac

SEQ ID NO: 684937 - DNA, 1011 bp, Homo sapiens
  misc_feature (60)..(60): n is a, c, g, or t
  misc_feature (62)..(62): n is a, c, g, or t
  misc_feature (77)..(77): n is a, c, g, or t
  misc_feature (733)..(733): n is a, c, g, or t
  misc_feature (741)..(741): n is a, c, g, or t
  misc_feature (762)..(762): n is a, c, g, or t
  misc_feature (764)..(764): n is a, c, g, or t
  misc_feature (778)..(778): n is a, c, g, or t
  misc_feature (783)..(783): n is a, c, g, or t
  misc_feature (793)..(793): n is a, c, g, or t
  misc_feature (878)..(878): n is a, c, g, or t
  misc_feature (884)..(884): n is a, c, g, or t
  misc_feature (887)..(887): n is a, c, g, or t
  misc_feature (890)..(890): n is a, c, g, or t
tggttttgatgaggccatgctgagcttgatacactgaatgaagactcatacaaagacagnancctcatcatgcagtncttagagacaactaacacttggacatcagacagtgcaggagaagaatgtgatgcggcaagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtattaagtaatctgaaccagttctgcaagtgactgtgtttgtatactgtgaaaataagaaaatgtagttaattacaatttaagagtattccacataacttcttaatttctacattccctcccttactcttcggggggttcctttcagtaagcaacttttccatgctcttaatgtattccttttagtaggaatccggaagtattagattgaatggaaaagcacttgccatctctgtctaggggtcacaaattgaaatggtcctgtatcacatacggaggtcttgtgtatctgtgncaacaggnagttccttatcatcttattgngngttaagtgcaactnccctnccaataaaantcattacactccgcttgtagtctgtatcattactatgtgatagaagtagcatgtgtgcagaatcaagcatgttggaataagtgcngtattntancantagaagggaatcattaaggcccagtccggctaactttacttccgcattggcttggaaggcctgcaggtgttaaggggcttggggtactcgggccaagcgggagtttcttagaaaatttcat

SEQ ID NO: 684938 - DNA, 742 bp, Homo sapiens
  misc_feature (217)..(217): n is a, c, g, or t
  misc_feature (439)..(439): n is a, c, g, or t
  misc_feature (544)..(545): n is a, c, g, or t
  misc_feature (555)..(555): n is a, c, g, or t
ctccctcatttatgaaagacagctttgctggataaagtattgttggttggcagttgttctcttgagcactttgaatttatcctactctctcctgacctgagggtttatgctgagaactctgctgatgattgtatggcactcctttttatgtgttatgtttcttgcctcttgatgctctcaaaattttttgcctttgatttttgatagtttattatgngttgtggtgtactcctctttgggttgaatttgattggaaacctctgcagttcttgtacctggatgttggcatataccacagattaaggaagttttcagccattatttctttaaatatgctttttggcccctttaaatatgcttttcaggcacctctttctccttctccaaccactattatgtgaaggtttggtctcttgatggtgttccataatctgtaggntttaattttagaaattcttttgttttttttgctcctggctagataatttcaaacgttctgtctcccagcacactgattctttcttcttcttggctgagtcagctnntgaagctttntgttgaatttttcagtctcttgaatttctatcccattcttattgtttctatttgtcaactttctttttagtgtactgttttcaaatttcattaaattttttatctgtatatattaatagttcactgaacttctttatgggtattattctgaattctttgtcagttatttcataaatctccatttctt

SEQ ID NO: 684939 - DNA, 174 bp, Homo sapiens
ttacaactttacttcgcttagatctgaagaatcattatctatggcagctatatctcatgaacatgtatttcttaaataataagacttgaaagttgaaattagccaggcatggtggtgcacgcctgtaatgccagtcactgaggaggccgaggcaggaggaatctcccgaacccg

SEQ ID NO: 684940 - DNA, 985 bp, Homo sapiens
  misc_feature (707)..(707): n is a, c, g, or t
  misc_feature (715)..(715): n is a, c, g, or t
  misc_feature (736)..(736): n is a, c, g, or t
  misc_feature (738)..(738): n is a, c, g, or t
  misc_feature (752)..(752): n is a, c, g, or t
  misc_feature (757)..(757): n is a, c, g, or t
  misc_feature (767)..(767): n is a, c, g, or t
  misc_feature (852)..(852): n is a, c, g, or t
  misc_feature (858)..(858): n is a, c, g, or t
  misc_feature (861)..(861): n is a, c, g, or t
  misc_feature (864)..(864): n is a, c, g, or t
gcggcagtgcatctgcaggtgcctagaggatccccccctcttatggagtggtttaagaatctagctacgttggacatcagacagtgcaggagaagaatgtgatgcggcaagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtattaagtaatctgaaccagttctgcaagtgactgtgtttgtatactgtgaaaataagaaaatgtagttaattacaatttaagagtattccacataacttcttaatttctacattccctcccttactcttcggggggttcctttcagtaagcaacttttccatgctcttaatgtattccttttagtaggaatccggaagtattagattgaatggaaaagcacttgccatctctgtctaggggtcacaaattgaaatggtcctgtatcacatacggaggtcttgtgtatctgtgncaacaggnagttccttatcatcttattgngngttaagtgcaactnccctnccaataaaantcattacactccgcttgtagtctgtatcattactatgtgatagaagtagcatgtgtgcagaatcaagcatgttggaataagtgcngtattntancantagaagggaatcattaaggcccagtccggctaactttacttccgcattggcttggaaggcctgcaggtgttaaggggcttggggtactcgggccaagcgggagtttcttagaaaatttcat

SEQ ID NO: 684941 - DNA, 835 bp, Homo sapiens
gcctggtgtgattccgtcctgcgcggttgtcctctggaggcacgcgttcttttatctccgtccggacttactctcctacctaagtgcgtgccgtcacccgatggaagattcgatggacatggacatgagccccctgatgtccccagtcactatcttttcgggtttgtgagactaacagtgccgacaatgattatcagcttctaaggtggatagactcgactgcaaggatgagcacccagttatcttgaagaacggtcagtttaggggctggtgccaaggatgagtggcgcattgttgaagctgaggcaatgaattacggaaccgcgagtcctattagtgtgtctctggcaactttgacaatgtctgtgcagccaacggtttcccttgggggctttgaaataacaccaccagtggtcttaaggttgaagtagtggttcacgtggcctgctgcatattagtggacagtcactttagtagcctgtggaggaaggatgcacaagtccagaaggatgaagaggatgaaggatgtggaaactccttaacgtatgtaccttggaatagggacggtcttggcccttgaggtggtagtcaaggtccccggacctaacagtaaaactttggctgctgatgaacgatgatgacgatgatgatgcagaggctgatgatgcatcatgacttgacacattgatgatttcgcgctacgggggctgaaaaaaagcgcgcggagattctcataggagactctcagccaaatggtgttcacctaatgaacgctcgaccggttttcaaaccacggacaatctcccagaggaatcggagccaaggcctttgagcg

SEQ ID NO: 684942 - DNA, 1135 bp, Homo sapiens
agggtagtctgtcgtgtgtaatcgccccccgttttaacggggagctttcttaacggatgtttttgaatttcccccttttatgaaagccctattataacggcgcccacttgtttagttgtggcccaagggaatatgccacctggttgtccgcatgaagggtgtgtttgcgtaccccggtagggaccaagatatcagttaggggagcaatttattgggtttgggaagatttggtggtttcccggaaaattgtgttttaatagcgcccggacttctgtggtatagaactcttgttcgtcagaggtttccttttggttgtgagaaatgtggccccaccttcttgggttgtgttctaccttgggagatacccctcggtgcacacaaggattggtgaataggatttgagataattaatggagattaaataagtgtgaaatccccccacgggtgagatattgtataatcgtggaacataatgtttcgtttgtgcggcgaatttttggagattcccccggccccacggtgggtgaccaccttttgggtaaacactgacggttttttctattgggaatttttctgggccacaatagattggccttgccaccttggggcccacattccacacggttgggcccaaaccctgtataaatgcctcttggggaactctctaagaacgctaagaaagagttcccttcagataaaacgcccacaaaatgtatcacaacaccttgaactgcatttcactaaaaatcgtggtgtgtcctcgctatattcggaccacaacccacggtttttatgccacgggaatatgccacgccacattttctaatagcctgtgttggtgaatgaatggccacgtatattgggcgccgtgggagtcagaacttctgaatataaaatatcgtttgtgcctataatcacaaacttatgaggtgtgtttgttgtctcgtgtaaaataaagattaatgtgattcttgctagtaaagggcaccgtaggagcactttagagtttgttctttcagcacttcacatcacggctgagagctgaaatgtagtggagtgtttaccttgtttacattttttgtactgtcttcctggctcagactctactgcttttaactaaaaatttatttttgta

SEQ ID NO: 684943 - DNA, 136 bp, Homo sapiens
acccgtattaaccacaggctctatctatgtgccttccctagcctatatattaataccagctctgactgattgataagcggctacctagaatgctgggctaaacagattttaaatctacttggactctccctgggaa

SEQ ID NO: 684944 - DNA, 277 bp, Homo sapiens
aggagtatttcaagtgtagtagtatttgcagagtgagagagaactagggaagtcgcctacaccgggccatctgcggggccagatgggggctgctgtatgtctgggctgccgaacgggcaaggtgacataggcttcatagccgaagaggcacgtagcgattaggcccagtacccctgcgacgatttgggagtggattcctctctcaacaaggacaacaattgaggtgatcaggtagagattgccgctatagggtcggaagaatatccggccgtgataa

SEQ ID NO: 684945 - DNA, 229 bp, Homo sapiens
taggctgtgtaagaaaccggccacagccctgctttaccgcgctcacctctagggcattccagcaagaggctgatgcaggacaatggccacctccagaggacatttaacagagtttttgggttattccgcctgtttgttgctgctgattgcttactttctttattggccctgctgaggcccactcaagagccagtacttgccaagggcccatgccgtcagcttctacaca

SEQ ID NO: 684946 - DNA, 111 bp, Homo sapiens
catggtcttcaggcaacccctgtagtctcgatgctccagcatacctgccatacgcagaaccccagaatcacacagctccacctcagtcatgccctgcataagtctacgcac

SEQ ID NO: 684947 - DNA, 167 bp, Homo sapiens
atctgtgaaagactggcatctgaaccgggggactgagtaagaagatccctcctcgccaggtggggcaccatcactcaatctgttgaaagcccggacagaacaaagagacagaggcagaggcaggcaaaccctccctctgcaaaagctgggacatccaggctgggcgc

SEQ ID NO: 684948 - DNA, 109 bp, Homo sapiens
tgtcaggggcacatataatgatcgggaaccaagcagagggcgctggggacgcggatgtcaccatcactggttctccggtctcatctgcctggcccaagtagctcatcac

SEQ ID NO: 684949 - DNA, 232 bp, Homo sapiens
tctctggcaggctgtgtcatgacagagctcctcttgttacggttgtccatagcctgaagtcagatgtccaatgaatatgtcagctgctagttcaagtgctaactaagaaaggtaatcctctcaggagctagagaagctggcatcaaggtattgcctcaggcaggcatgcgaacccgtaatccttctaatagctatcctcttcaacaatatactctccggacacgaatgttca

SEQ ID NO: 684950 - DNA, 312 bp, Homo sapiens
cagtagagataaaagggagaaacagaatcatctagaaggtcaggaactatagaggattaaagaagcatcgggccacaaatgagaatgaaccaatgcaagaactctgactactcaaaaagttagagtgtcttctttcctccaaatgaccatgccacctctgcatcatgggttctgaatcaggctgcgatggctgaaatgacagaaataaaatttggaatatggataggaacaaagatcattgaggagtatgttgaaatccaaaccaaggaagcctaagaatcacaatgaaacaatgcgggagctgatagacaa

SEQ ID NO: 684951 - DNA, 219 bp, Homo sapiens
actctagaggatctctcggggcattctggactcataccaatgacaggtctctgaagaggcctgtattgtaatatgtcgccagtagctcgccgagtggtgggtaatggataattgtgcgcctgtggcttccttggatgtggtagccgtttctcatgctccctctccggaatcgaaccctgattccccgtcagccgtggtcccatctctagagtcacgagt

SEQ ID NO: 684952 - DNA, 353 bp, Homo sapiens
tgcaggatccccctcgggaggtgtcttgatattatcatccactgagggtggaaggtgacgctgacgatatgttgcacacttgtgtctcggtcttgcagtatgagaatgtgctctgtgcgtgtagccactgctttcctagaatgtcaagtacatatttttacactttgtagtttaacagcaattactatcagactgagatcttgtatgccagactttaatctgcttttataatttcaggctgaatgtgtgaaaatcctaagaggatttcatattgaatatatgatacactatcttaactatcgtggtgcacagcatactactattatttattattatatctaccacacgtcata

SEQ ID NO: 684953 - DNA, 493 bp, Homo sapiens
ctagagacttcaaaaaatctaaagttaaggttttagtgttgtctctagaataacatatttaaaaaagcaatttacaaatcatgtaattgaaagtgataagagtcattgccccctgtgttaagggacaccacacagcacacacacaacacacacacacacaacgtcttggattaagacgggcacccctgggagacaagtaggggaaaaaaaaggcttacctccctcttagtcttcaacttgtgtgtcggaaggacttgaagggaaggcaaaaaccctctcctggaatgttgagtgttgtgtaaaaggtaggagtcaagtgtggtctgctgaaaagaaccctttgattctaaagcacgattcattggctactcaagaccctggaaacttcaatcttttagccagcatatctttcatgcagtagatgggtcggaggaacaaagtgtctgtaaagttgcaggcgcttttttttatttccccctcttcttctggatac

SEQ ID NO: 684954 - DNA, 268 bp, Homo sapiens
atatcgattacacgaacaggctcctctagagggatatgaagcaccgccagttcctattgagttttaagcttgtggctcgtagtgtactaggcgagcagtttttgttgatttaacttgttgaggtttagggctaagccatagtggggtatctaatcccagtttgggtcttaagctattgtgtgttcaagatatgttaaagccactttcgtaggtctattttgtggtcaactggagttttttacaactcaggtgagtattagctttattg

SEQ ID NO: 684955 - DNA, 410 bp, Homo sapiens
cgggcgactctagaggagacacggaggaagggtgaaaacagcttctaaggagctgtaatgtttctggacagaaataaggttaggcctgtaagattgtggtagagtttcaatacagcagataggtagttattgggcttttgtaaaaaggtaacttttaacatagctgctcagggagtaaatcaggaaggaaaacccattcggactccacatactgctacaaagaaatacatcggtggttatattgagctgcaggagatagtacactttaaacttaagaaagttaaatgtttcacaataacattgcaatataatcttcagctactctctttccattgggaaaatctctgatggggtgaaaactgtttgccaacctacgaaacccatatctggaagaaacaccaggttccggg

SEQ ID NO: 684956 - DNA, 394 bp, Homo sapiens
  misc_feature (251)..(252): n is a, c, g, or t
  misc_feature (262)..(263): n is a, c, g, or t
aggttagagtctaaattattcaacataatgctatgcaccagagatgctatgacatcattgtagcctctagtaggaagcggtcaatcttcaagttagaggtaaggctggactcaaacagtatggcttcctcacatctatctgtcagtatcagttcaaggttctagtcttgttccagcatgtttggttacggaaatggttctgtagcttgcctttgggaatatgtgttcttttcttctcttttcttttctttnnttcttttctnntcttttcttttcctttctcaaatccccaaagaagaaaacacaataggaacattgaagttaaaataatcactttaaactctttttaaaataacaggttaagataataggaacattaaagtattggtcgacgc

SEQ ID NO: 684957 - DNA, 644 bp, Homo sapiens
tatcacaggatcttgagtgggcatcatctatcttgtgttggggcatggcctaagactcgcctggcagggtcctggtttgccccgcctgcccagcgtaattagcagccccctttacactttacaataacgtcttgcttgcattgtggaagacagcgtggccattccttaaagacctagaggcagaaatgccatttgacccagcaatcccatgactgggtatgcacccaaaggaatagaaataattccaccataaaggcatgcacgcgaatgctcattgcagcacgagtcacagtagcaaagacatggaatcaactgaagcgcccatcaatgatagactcgataaaagaaaaacgcgggtacatattcaccatggaatactatgcagacacagaaaggaatgagatcatgtcctttgcagggacatgggtggagctggaggccattatccttagcaaactaatgctaaggataattgggtggaggacacaatcacacaaggcgctgtcccttgcacggccacggaagagggaatgacgaggctcctctttgcattggagccctgggactccctcctgttttccacatccctcctcggtgtgtacataggtcaggagccagctccaacctcccagctctggagacgg

SEQ ID NO: 684958 - DNA, 135 bp, Homo sapiens
tttggaagaatgtgccaggctgagttacatactgaaataccttagtacaaatgtctagttagaactgaggtgcagtaacctcttgagactgaccgctcattgacatagggatacaaagaaaaagttgattgtgat

SEQ ID NO: 684959 - DNA, 831 bp, Homo sapiens
gtttgtcccctggctggaagcgcggaggccaggcacgatgactgtggagttactgtgaaagacgtgtaaccattcaggagttctgtcattgagctctgtcaaacttcctcaaacaagtccggcgaagctgaagtgtccccggaatgggtggattaccgtcaagctcgggcaagactactataaagatgccttgcctcccttacagagtgatgaacgtggtgctactatcgcttagctgggttttcaacagcttctggcacgctgtacctcgcggggtggggctggaggattggctccattgaccaagatttatgctgtggacgtcactacgaaacggttgtcatgcccagtcagtttcatgcggaggctccgaagagtgtggccctgacgggtgttctcatgctggtggaggggcgtgcaaatggtgtgaattgaggaacgagatggtgggacgtgtgaatgacggcctcggggacagaagatatctggaaagagtcgaatcggagtggtggatgatgttcaatcgatgaaggcattagaaaaactatgttgtgttaagatagttgcgtcatttcgtataaaatgggtggacgatatgtgggctggatcgaatcataatcgtgccgggaagagcaacgcaggtttaatgaaatagtgtttcgcgatcgtggctgcgcaaggatatatagcacagatgattggcggcgggcgcatggggagcaaggaaagaggttgtggtcaaggaaaaggggggaaatggggttggcgaaaataagccggggggtgacctcggaaagcaaagggagggcaaggttttaacaggggaggcgt

SEQ ID NO: 684960 - DNA, 290 bp, Homo sapiens
acacccaggacctgatgcccctcactaagccccagtgtcccccagtgcccccgtccagatgcctcctccagtgcccccgtcaagatgccctcccgactgtccttccacacacactgcctcagtctcccttctgtgcctcagcccttcccactggtgttgtactcagtggccatccccagccccttgctgccaccctggcaccccgggtggggggctcctagggaaacaagcgctgttccccctacttctgtccccagctctggcaagggctggggtgggccggtcctccg

SEQ ID NO: 684961 - DNA, 294 bp, Homo sapiens
tctgcttgaacttctttactaggcctagtttagatgtcactgcctgtgtggcgatcgggttgagtatttggtaggtgagtatcgatgcatctctctctctctcgtcttgcgctctctctctgctctcttgctctctctctcttgctctctctcttggtctctctctccctctctttttctttctctctttctttcgtgacagagtctcactctgtcacccagaggggagtgcagtggcacaatctcggctcactgcaaccaccacctcctgctgttgaaacttctaacactagg

SEQ ID NO: 684962 - DNA, 317 bp, Homo sapiens
tttgaggctcaacatgaatcggtaatagtgctccagtactgcgcacacagattaagcataattcagaacagatgttttacactcatctgcatttcttttaaaaaacaaaaaaagtaaaatgtttagttacttctgagcatctatttctagtgcatgcattgatatgataaaagactgcttctagaaaagtattttgtactgcaattgaattaagctgaaatgctcagttgggcaccatccaaggtcaagctcctccagatattgcacatccagaagtcagttctgctattccattctcagtaatatgcttacatccc

SEQ ID NO: 684963 - DNA, 947 bp, Homo sapiens
gcactggttgaatcagaaccccagactagcgtctccaaattatcacaaatgagacagaccccctggatacgaggaacattgccttcttttcaaccaattgtgttgaaggcaccgcacgtggtattgtcgtctacactggtgatcgcactgtgatggcgacagacattgccacacttgcttctcgtgctcggcaacggaggcctagacccccattgctcgctagaacattgaacattttatccacatcatcacgggtgcttgcgctgtgttcctggcgtgtgctcgtctctcttcactcctttctctcatccttgcagtacacctgtggcttgcacgctgtcttcttcctcatcggtatcatcgtaggccaactgtgcccggaaaggcttatgcttggccactgttcacgggtccttgtctgagcaacgttgacttgcctagaacctgccatcgcgcaaggcataagaagctcgctctagtcggaacgcaactctcagtacaggctcgatggaagaacgctatgcgtggtaccaacgctccaaccccagtctgctccttgattaacatacctgtgaagcgtcttgacctccagtaaaccggagtgaccagctggcccgacagtgctgggcttggacgaagtcatacattcctgtgaacaccatgaatacgaccagagcaagtcacgagatggatgctctcctctttgaccacagaccttcaggcataccataggacttgactcttgtcccacgaaatttgccagtgtcttttgtaaccagaggacagtgtatcacgggctaacccaggaaaaaccttaaccttattcctttaacgcagggcaacgttggcagcggaagaattgcctcttgagtccaggaacctctttaaaaggtgcattagaaccctgtgcttgtggttcccgtgaaaggcaaactcacagaaacgaa

SEQ ID NO: 684964 - DNA, 260 bp, Homo sapiens
atgctcaatgcatctgcctgcctcagcctcccacagtgctgggattatagatgctgggattacagatgtgagccactgcacccagcctctgatttctttctttcccgccccccccagaaatggagtcttcctctgtctcccaggctgtagtgcagtggcctgatctcggctcactgcaacctctgccacctgagttcttcgattctcctgcctcagcctcccgagtagctgggattacaggtgtacaccaccacgatctt

SEQ ID NO: 684965 - DNA, 321 bp, Homo sapiens
tgtggtgcaacaataaggaagggtccccaggttggggagagccccaagttgagaacaataatgaacaattagtgtatgaagctattgttagaaacagctaatcacaaacaacctgcgggcacaatgacctcattccacacgtagcacccttcagcaggaccctataaaactttcctccagcccttgcctcttggcaggtagccccttctctgctgagctgcccactgcaacatattttcacaatggctctagtaattctgcccttctttacctacaagtatcttggtgaatggctttaccacctgcaaaacttaccctagg

SEQ ID NO: 684966 - DNA, 466 bp, Homo sapiens
  misc_feature (9)..(9): n is a, c, g, or t
  misc_feature (15)..(15): n is a, c, g, or t
  misc_feature (87)..(87): n is a, c, g, or t
  misc_feature (150)..(150): n is a, c, g, or t
  misc_feature (158)..(158): n is a, c, g, or t
taccttgangccttnggtgggtttccttaaacttcctctgactgaagtttgtttcaaacttcccctagaagagataatacatgcttncatagctttgttgtacagatcaaataaaataacagatatgaaatattttatagccctataagntgctgtgnaaattttaagatggggctaggcgcagtggctcatgcctgtaatcacagcactttgggaggccacagcgggccgattgcctgagctcaggagttagagaccagtctgggcaacatagcgaaaccccatctctagagaaaatacaaaaaaaaaaaaattagccaggcatggtggcacacgcctgtagtcccgggagggactgaggcaggaggattgcttgagcccaggaggtaaagcccagtgagccatattcatgccactgcactccagcctgggtgacagagccagaccccatctctaagaaaaaaaa

SEQ ID NO: 684967 - DNA, 139 bp, Homo sapiens
ggaaaatgtccaaaaaatcaaccccaacggatagggggttaacattccggggaagaaatgaaaatgggttggttttaagtattaagggtagaggcccccatcccagcaaaggtattggcaattatggggttgaggcttt

SEQ ID NO: 684968 - DNA, 202 bp, Homo sapiens
tctgagcaagctgggaataatggataaatgtaggttcatcagttgtaaatgtactactctgttgtgggatgttgataatgagggagtttatgtatgtgtggggacaggagttacatgagaaatctctgtaccttcctctcagttttgttgtgaacctaaaactgctattaaaaaagagtctatttttagaaaaggaattgtg

SEQ ID NO: 684969 - DNA, 306 bp, Homo sapiens
gaactcagtaaccagaggactcccctttacgttattgtccattagttcttgggggtatcaattcctttggaaagccacacaggtaatcgtctctctctctctgcagatgaagtctcagtatatgatgcctacttcttccttgctatctcttacgacacttgaacagactctcttcgacacccgggaaacacatctccttttgttgacatcaccgtgaaggttgacgtccgctgtcaggaacatgttataaggactctcaattgccctgtggactacggtccgtgtcacatgttaaccggaactaac

SEQ ID NO: 684970 - DNA, 880 bp, Homo sapiens
  misc_feature (35)..(35): n is a, c, g, or t
  misc_feature (120)..(120): n is a, c, g, or t
  misc_feature (152)..(152): n is a, c, g, or t
  misc_feature (334)..(334): n is a, c, g, or t
  misc_feature (421)..(421): n is a, c, g, or t
  misc_feature (551)..(551): n is a, c, g, or t
  misc_feature (560)..(561): n is a, c, g, or t
  misc_feature (565)..(567): n is a, c, g, or t
  misc_feature (569)..(571): n is a, c, g, or t
  misc_feature (573)..(573): n is a, c, g, or t
  misc_feature (599)..(599): n is a, c, g, or t
  misc_feature (603)..(603): n is a, c, g, or t
  misc_feature (691)..(695): n is a, c, g, or t
  misc_feature (697)..(698): n is a, c, g, or t
  misc_feature (702)..(706): n is a, c, g, or t
  misc_feature (712)..(713): n is a, c, g, or t
  misc_feature (749)..(749): n is a, c, g, or t
  misc_feature (753)..(754): n is a, c, g, or t
  misc_feature (756)..(756): n is a, c, g, or t
  misc_feature (758)..(758): n is a, c, g, or t
  misc_feature (770)..(770): n is a, c, g, or t
  misc_feature (862)..(862): n is a, c, g, or t
  misc_feature (864)..(864): n is a, c, g, or t
  misc_feature (874)..(874): n is a, c, g, or t
ggatgtttgccactagctgaagatattactaacancctctccaaatgctgtgagtctgcctctgaagattgcatggccaaagagctgcctgaacacacagtaaaactctgtgacaatttntccacaaagaattctaagtttgaagactgttntcaagaaaaaacagccatggacgtttttgtgagcactatacatacatgccagcagcccaactccccgagcttccagatgtagagttgcccacaaacaaagatgtgtgtgatccaggaaacaccaaagtcatggataagaatacatttgaactaagcagaaggactcatcttccggaagtatncctcagtaaggtacttgagccaaccctaaaaagccttggtgaatgctgtgatgttgaagactcaactacctgttttaatgctaaggnccccctactaaagaaggaactatcttctttcattgacaagggacaagaactatgtgcagattattcagaaaatacatttactgagtacaagaaaaaactggcagagcgactaaaagcaaaattgcctgangccacaccnncggnnntnnnanagctggttaacaagcgctcagacttngccnccaactgctgttccataaactcacctcctctttactgtgattcagagattgatgctgaattgaagaatatcctgtagtcctgaagcannnnnannaacnnnnnccaganntggagccacccaggggaatgatctctgatgacctancctnngnanaccactgagctnctgggaagacaactaggatactttctactttttctagctacaatatcttcatacaatgacaagtatgatgatttgctatcaaaataaattgnangttttttttnaaccat

SEQ ID NO: 684971 - DNA, 769 bp, Homo sapiens
tggggcatggcccctggccccgcgtgctttccggcccgtttcgcggggaacctcaggtgacccctgcgtgccccccgcaataccacccgtattgtcttccgccgcccaacatggtcggtggacacccgccagtatgcgccgcctcacactatcttgtgggggcctcggttaaatggagcaggggactcctcccttaggcctcccgcgcaggtccttgtgtgcgtccccactcttggtcggcgcccgtgactatgccaccccgctggcactcggccgccagcccctgtcggcaaaaacgaatgggacgacgccccccccgcccccacagacaccaacagctcacgcggtcgttgatcgccccctatagggcaccccgcccttaggggcgaggcatccccgccgtgatagatccacacacccgctgggaggaacccaaggcgcaatcgagcaaccctcgacggcaacacgggggatctgtcatccgctgcgtcatgagcaacacaaaggtcgacacaccccgtgtgtcctcctgcaagaaagctcacgaacaatcaggtcggcagccttcgagtgcagcagtgcagctcgacacagtacgccacagttactacgagggacgggctcgatgccacagaagtaattgcatgtgctgcctcgggggagctgccccggtctaccaccacgaggcgtgtgcagaccaacccacaccgtggatgcccaccccgtgggtagtcacagagaacccagagtcccccgttcaataatgcga

SEQ ID NO: 684972 - DNA, 1305 bp, Homo sapiens
ctttgacaccccgtgtctctttattactgcttcttgtatcgtccgtacaacttttctaccacttctccccgtatggtgctccctgctcctgtttgggtgctttctatgccgtcctctttggtttcgcttaatcgcccatcgctctttcgtcaatacggtgctcctagaacccgtatacttttccacagacgcgtgtttcatagggtaccagtcccctggcgcgacgctgtataccatacttctgccggcgctaacatggggaacctgttctcttctaaatgccgtctaagtcttaactcccgtaagagtgaggtcagttgatgtttggatgtcactctgtttgtgtcacccttttccgaatgttaaatgcatggtcaaatactaatgcttgatcgtaagaggatgtccagagaaccctaggccaaaatctaaggttggtaagtactggaggtgatctagtatggattagagtcctgtaaaatgtatccatgctgaagcaagtaaagagatgccctaagttcatcttgattgaaaatgggtaattttgcaatccgtaagcgtctcctgtattcgacgataaaggaatcctccattaagcgcacctaacaagagtatcgttggtacatactaccagtacttcagaagtaccgagggcacaggtgggtcagcattgttgccacctcggtaagaacatgattattctgtcaaagcagaggctacaagcattactgtagttaagcccttacaggtaagtagtgttgtccgtatggtcagctattcacagtagtgaatcatcttgcagctttgccatctattctgaatcgacaatagtggaataaaggatagcctaacctgctgtattggctcaacagtgttcctacaagggaacaagaagtatcaagtgcctgtggagacaagagcaagtaaagcaaaatgtggctgcagatatcccaatcacagatacagaagcctatcagttgctgaagaaggccacccttcaggataatacaaatcaaactgaaaacaggtttcaataagacagatgccttctgtgtcacacttgtcaggtgtgaatagtggctagcggtgcattcgagacaaagacagcttacgtaaattgcttcggaagactagtttttcatctagtgaaggaagttctttgtacaacggcatgaaaacgattaagaaacccgtgctcaatttaaaatgtaatgaccctctgggatgatgtctgatgacagtaactcataaattgaggctgcttacgccccagaaccataataacgatcaggggatgatttagta

SEQ ID NO: 684973 - DNA, 336 bp, Homo sapiens
agaccaggtagcggatgccgtgggccacgaagcgttgtcgcagctgcgcggtgtcgaccccgcgatcctcgatgccgcgttcgcgctcgatggcgacgcggaagagcatcttgtcggcccgggcgatggccaggtcggtgcgcttggaggcccgaacgtcgaagatgaaggtgccatcccgattgccagaaaacatcaccacgctgttcgcgggcgctcgctcgatcacgtagttcacggcctgggcatagccgtcgacgtactgcacggggtggatttcgagctcggcgccggcgtgcgcgaagcacagcaccggcaccgcagtcatcgcggccg

SEQ ID NO: 684974 - DNA, 183 bp, Homo sapiens
catccccccctgcattttccttgagcaggcaggtgagcacatgagtcgctgtagggataaaatccgactttcgcttctttgattgcatatctgcacgggccgagatcacttaccctagtgtagtcagggactgattgatgttggctccttccttcaggcgcatgccccaagagagtgacggga

SEQ ID NO: 684975 - DNA, 238 bp, Homo sapiens
gagcggtctgatacaactggcagcttcaatttctatgtgaaataggagatacgtgtgttgctggagaaagggagtgagctctaaaggcagcaaggacagtgcaaaacaatggggcaattttctgattgttttgacttgcagttatgactgcttattatgaacaaataaaaaagttggccagagaaggctgcaggcccactgtgactgggcatctagaacagtgattgtctgcatggtg

SEQ ID NO: 684976 - DNA, 353 bp, Homo sapiens
  misc_feature (109)..(109): n is a, c, g, or t
  misc_feature (172)..(172): n is a, c, g, or t
  misc_feature (174)..(174): n is a, c, g, or t
  misc_feature (266)..(266): n is a, c, g, or t
  misc_feature (283)..(283): n is a, c, g, or t
agtgcagaccatccaacagatagaccagagaggaagaatcccgagttgaaaatggctttctgaataaaacaggaaaacaagatgggggaaaaaagatgaaagggatgancaaaacatctgagatatatgggattatataaccgaccaatctatgactgattaatgtacctgnangagatgagattggaaccaacttggaaaacactttcagatatcattcatggattgtcccaacctagccagcaggccaacattcaacttcaggnatccagagacctcagtnagtatgcctgaggtgatcatccccagacacataatcgtcagtttcttgggtcaaataaagtcaattgtta

SEQ ID NO: 684977 - DNA, 399 bp, Homo sapiens
atcatgcctcaacttcccattcttagccagcgcattgtcctggtctcgcgcccgcaaggcgcgctgacacctgaaaactttcgcctggaacgcgtgaacctgccggaattggcagatggccaggtgctgctcaaaaccctgtacctgtccctcgatccctacatgcgtgggcgcatgagtgacgcgccgtcctacgcagctccggtggaaatcgacgaagtgatgaccggtggtgctgtcagccgtatcgagcaatcgcgtaacccgaaattcgcggcgggtgatcttgtggtgggttccaccggctggcagagccatagcatctcagacggaaacaacctgatcccgctgcccaaaggcctggccagcccctcgatggcgctgggtgtattggtcgac

SEQ ID NO: 684978 - DNA, 711 bp, Homo sapiens
agcggaggaagtggtgagttcggagtatgagatggccgcgcttgcgccgttgcccccgctccccgcacagttcacgagcatacagtatcatctgaggatgggtcagagagcatggacaacgccgagaaacccatgtgagtggcttaatttctgtcgtatctataccgcaagtcgcagagcatggcatagtgaaggcatctgataggtaaaacgtcctgaatgtctgaacatttttagtacaaagttagatggactcagttagaagctctaatagaagcagatgggtgactagatgacagctacttcactcatacgaacatagtgggctgtgcccatttggagaacttatgctttggataacatgttctttgtattgcagtacaatgaagatctgtgctggactgatttcacaaaaacatgatcaagtccttctatactgcaagtcttttgatagatgtcattaaccgagtatttggagaactcactgatgacaaatgtgaaacagcaggaaagtatgccaggatggaatgggaacatagatccataagttgtttgaaacgaagtggggacgacgtcctcaaggctaggccgctgttcggcaacttgaagtaagatgagatgcatctgtgcacgcaacatgacagatgctggagcagcctctctggccactcagccaaggtcagccatcatcatcttgcaagttatgagcac

SEQ ID NO: 684979 - DNA, 224 bp, Homo sapiens
  misc_feature (10)..(10): n is a, c, g, or t
  misc_feature (28)..(28): n is a, c, g, or t
  misc_feature (38)..(38): n is a, c, g, or t
  misc_feature (43)..(43): n is a, c, g, or t
  misc_feature (45)..(45): n is a, c, g, or t
gtaaagtgtnctttgttatgtttgaggnacagcaaggnatatnangtagttttaaagagtgagcaagctggagagagcaagtaagaggtgacattatcagaggaagggggagagaggtgggtagggtgggtatcagatcatggaggtcccgtagccattatgaagatttaggctttgactcttaagtgagataggaagtcactggagtatttgggtagaggagt

SEQ ID NO: 684980 - DNA, 233 bp, Homo sapiens; identical to SEQ ID NO: 516957

SEQ ID NO: 684981 - DNA, 1895 bp, Homo sapiens
  misc_feature (141)..(141): n is a, c, g, or t
  misc_feature (203)..(203): n is a, c, g, or t
ggcaacatgggtccacgttcgcggccagatagccgtgaaggagtgcgtaccatgagatcatcgatatcatgaagtgacgtgagcacagtcgcgcgtgggacacaccgcaggtgtcgcaggaccgagaccaatgtcgacagntaggttgccgcaaggtatgcattctggccaatgtaatacctcgcaagctagagagaatgctncgcagcgtgggacagtacttccacgtgtttattcgcttcaacggacaactcttcgcacatgagaagacggatactaccaagaggaatgcggcccaatattacacgtaggggctactactcccgatcacagtcgtagaccagagcactgcacgcgcatgatggaaggaatacgcgaacggaagcatataatataattcgtgctcggtgatcggctcgtcgaagacgcgttcgtggaattccacctggacgtatctaactgtgggcacaggttgacttagtgccatctgcacctaccttgaaaggggaatagaattggcgtcgaatacggcgtctatttcgggaagcgtaatcccgttggcgaagctacctcgctttgccagaagcccttgtgcaaggtggttgcgaacgtaccaacgcctcggttaaccgacggcctttggcggttgagactcggaagacctcttgtgcacagaaccacttgggcccccctttcagttgggcataaaggcacggttggcttcccggaagacaactcctcctactgtaatctcttcggttccaggctcgggacattaggtagaggtccaaaagttggcatcttacaaagctatatacacagggttccgtaggccgacgggaaccaagaaaactttacaccatttagtcaacaaccgcgcccttcgggccgcttcacggacaccgcaatcccccaagagtcgcaacaccccttattggaggtaaagacgaagtcgccgccccggccgcgcaagagcaaacccaaccttgcgggcggaagcacaggcccctcctcgaaaatctaatagatgggcccacagaagaattaggcgccttcggcgtcaacaaccgcggcggagagcattggcggcccactggctggaagccacatcgggcgtggcctccttgtcgcggtctcgccctactggcgcagagccgccaacgtgggggaaacacgggggacccactccgagacgaagcttccctcgcactcatatcaacagaacctcacttttccaacgtcgacaccgccagacaggacaaacttccaccaacgcgtgaacatcttatcatgcaaaagtttccccacacggttggcaattagaaccccccgcgtaacatttcggaagcgtgtcgcgtcaccacccaagcggagaacatatttctccccccctcaaagacacacagacctagggacctgtggcccccccgccataaaccacaggggctttcccttgggggggctcttccaaggcgtggcgcaatgggcccccttaaccttggtgcagctttgtatcaaattccaaccccacaggcgctgcaactcgcgagcagggtcaccgcgacaaccaaccttggtccaacgaggcagactttcacacttgtggaatgctccctccccccatggcatacgcaactctgcaagcgccgcctcgtgacgcgacacttgtcgacgccatcgcacagtctctccaccatctcccccctggtcgtcggcgaaaagcgacatctgtacacttcccccctaagcgccatcgtgtgacccaccacgcgggcaaggtcaaccctcgttcctgttgcacagagacacgcaccacacacagtcaccatgcagaccccaccgcggacaccacgagcccagcatggtcccctctgtaccacacaacagcaaccgcc

SEQ ID NO: 684982 - DNA, 257 bp, Homo sapiens
  misc_feature (51)..(51): n is a, c, g, or t
gacgcacgggtgtgttgtgtgagtgtgctcggtgggtgcaacctggtgtgntacatgtgaacgtgcatctgtgtggatgtgtgagcatgcatctgtgtgtgtacctgtgagcgtgcatctgtgtgagtgcacccagtgtgcatcgtgcaaacgtgcatctgtgtgtgtgagcgcaacctgctgtgcgtatgtgtgagcgtgcatctctgtgtgtgagtgcaacctggtgtatatacatgtgagtgtgcatccgtgtg

SEQ ID NO: 684983 - DNA, 1015 bp, Homo sapiens
  misc_feature (379)..(379): n is a, c, g, or t
ggctgtaattgagaatgcataagatgaagataaaatatcttataggatcaactatcctgagtcctgagtaaatctggaagataaatctcctaatactgacgcaggcatgggataacttatcatcacacaattatggtgaatttcattttcctgggtcgacatagtcggagatgtttcggcattgttcatcgctatgcgctgttcacgtgtatgtgcatcgattgcgcctagcataagcggtgtcttccgggatagaaccaccattcattactctcagccacgtgagtgactcaatgatattacaagtgcgaatgcgagtattgttgactttctcgtagaagcaataattccactccggtctaatctcacacggtcgaangtcaagacgaattgttaggttcgactcgaaaccgtctccatcagaagtcccatttttgacatagttgattcgtttcatattacagtagcttcatagaagggctcataagtgatatatccagtgcgtggtgctttcatcacgctgtgaagaatcgcgaacatgaaggtggtgactactgttgcttagttacccttgttccaaattatctacgaacatctgtaacaatagttcgtaccacagatgatgtcatgttttgtgaagtgtacatggtttcggattttattgttggctaaattggaaataagtgaagccttgtgatttttagtcggtttctaatagggcatgtggtgttgcagtattaactgcatcttccctctttatctcttacacggtatcaccactccttgaagaaccgacatatccataggaactaataacattgcgaatttttaaacttagtccattatctcttcctctggtggtgcttaacaagtgtacaaattccaggtccggttaattaagatacttttcctcagtgcgcgaattcggagaataatggccatggaaagtttagtcgcgaattgacccccgtatgagcttttttcaattgtccaaattcctaatcaatcttgtaag

SEQ ID NO: 684984 - DNA, 637 bp, Homo sapiens
gtatcgagttattatctgtcatggctttcttaagagcaggagagtcgcttgaacctgggaggtggaggttgtggtgagcctggattgagccttgttgctccagcctgggcaatatgagtgaaaagtcccgtctcaaaaaaaaaaaaaaacggttagggtttatcgttttggtatctctgtgtcctttctggtactctaaaggttaaaacttattatttaaaaatttcccttcgggtgaaagtctgtctgtctggctatttccaaaggagattttagggacccgagaatcttaatttctaaattaagattacgtgtccctgggtggcgtaaatcatgtcagttactatttataatctatccaaatggcaaatgggcactctggagatcctagaatgtggtgacggtgaaattgtctgccagttttaataaaagatctggttccgtgaaaacttttttgagtcccttggtgcaactgtcattggacagtgaaagggaggagagctggaatttccaggttctcagcaaatgctgtaaaggtgcttggtaaagtgctctgcaaatgtgagttatacttcctggagatcaatactggtaataggctgcctggtgttaggaatgtaggaaggcgattgaactt

SEQ ID NO: 684985 - DNA, 202 bp, Homo sapiens
actcattaggatgtttcttgttataaaaaaaaaaaaaaaggaaaaaatgtataaaggaacgaaccatggggggggttggcaagggaccatacaaatgggaatttgggcccatcgttaacggaaccgtcaattgttacagatcccaaaaaaaaacgggggggggttttccaaaagttaaacatccacctgagggaaaattttg

SEQ ID NO: 684986 - DNA, 458 bp, Homo sapiens
  misc_feature (296)..(296): n is a, c, g, or t
  misc_feature (340)..(340): n is a, c, g, or t
  misc_feature (346)..(346): n is a, c, g, or t
  misc_feature (355)..(355): n is a, c, g, or t
  misc_feature (365)..(365): n is a, c, g, or t
  misc_feature (367)..(367): n is a, c, g, or t
  misc_feature (375)..(375): n is a, c, g, or t
  misc_feature (382)..(382): n is a, c, g, or t
  misc_feature (396)..(396): n is a, c, g, or t
  misc_feature (405)..(405): n is a, c, g, or t
  misc_feature (409)..(409): n is a, c, g, or t
  misc_feature (411)..(411): n is a, c, g, or t
  misc_feature (440)..(440): n is a, c, g, or t
  misc_feature (444)..(444): n is a, c, g, or t
  misc_feature (447)..(447): n is a, c, g, or t
aatttttttttgttcccctgagaccaaaatttaagttaactgttgctggcagtttaagtgtaaatgttaacagcaggagaagttaaaaattgagcagttttgttgcatgatttcccaaatgaaaaactgccttgggtagagtttgaaaaactaattgagcctgtgcctggctaaaaaacaagcgtttttttgaatgtgaaaagtgtttcaaaggtaggtagttacagaattcctccccaacagcttaaatttttcaaaaaagaattcctgcagcagttattcccttacctgaaggnttcaatcatttggatcaacaactgctactctcggaagactcctntactcncagctgaanaaaatgagcncncccttccncctgttnttcctatcctgaanatgtgatcncctnantggaaataaatagatgtaaataaaattgngttntcntttaaaaaaaa

SEQ ID NO: 684987 - DNA, 437 bp, Homo sapiens
ctgagggtgtgagccaggtgtgtccagtgtcatctctaagtaagaactatttatgactgagatggcctgtcctcccttcgttgttacaatttcttttctcttacttaacaaaaaaaatatgtaggaagcatgagtgcttcccctctctttttctgttctcttccctcgagtgtcacccaccttttagaagttaggcgtggccatgtgactggcttgggacagtgaactatgagcaaaagtgtctctgctgggtagaagcatttacgagccagtatgtgattctccttcttaccttctctctggcatggtgactgatgacattttagctggtagagtctggatctctgagtgatgatggtatggatcagaacctcaaccaacttgtgatggacattagagtgtaggtggggaagatggggaggaaccttcgttggctt

SEQ ID NO: 684988 - DNA, 427 bp, Homo sapiens
  misc_feature (32)..(32): n is a, c, g, or t
  misc_feature (82)..(83): n is a, c, g, or t
ctgttgcccaggctggagtgcagtggtggtanctcagctcactgcaacctccgcctcccgggttcacgtcctgtctcagccnncagtgtagctgggattacaggcatgcaccaccatgctcggctaacttttgtatttttggtagagacggggtttcaccatgatggccaggctggtctcgaactcctgacttcaagtgatccgcctgccttggctcccaaagtgctgggattacaggcgtgcacccacacccagctccaaactcatcttgtctacacacggacaaacgtgtgcacacatggcacaaaccaagctagaagacactgattctctagatggagggactaagattttcttttttcctttatcaacattttacagttattcttccaaatgaacaggtgctgctctagtagtttttaaaatg

SEQ ID NO: 684989 - DNA, 436 bp, Homo sapiens
tctggcttcttctaagcattagaggtcagaacagagaaatggatggctcaagcatgtgggcctccttctctccttgacacatgggatgggtaggggtcagtttagcggagactggttctgccctttctatagaagtcaggtccggctgtacttggtctgggtccaaaccatcctgggtagatgctgccaagactggtgcagcgtgcctccagagaaatggaatggtgcagcagaatacacatcttccttctttacctcattagcaaatgatggtgagcattgaagagtcattctctgaagctgcagttcctggtgaagcaagctcacattcttcctttgtagttctcaggaacatagttgcaggtgtgtcgggtgtcacagatggaggttccacttcatgtggttttgcttcatcttctggctgttgtggcactga

SEQ ID NO: 684990 - DNA, 853 bp, Homo sapiens
tcctcaagacggtcccttctattcccccctgggtttggcgcccctattctccggccattacctgacctgccccggctttctggcccgacatggttgggctcccctaatttaggcgcgtattgaggcttcccccctgtgccgtaattccgcttggccggctatttaggcccctagccatggggtgttacgacccaacaactctgctgccaacaaggcttatattcctcaccgctgccaatgtccctcattcacggcgggcggcacctataccacactcccccttcaacagggggatcctccaatgtttccctccccaaattttcacccccccgcttcgttaagcgttctaatcattgggacgcccccctctttatcaccaggcttcaaaataaggtgtcctccccacatcagtgaccattactcacaatcgggcgcctaacttagttccgcctcaccatttagtacatcacacccgccacacatactgttgtcctcgcctcaagaaagcgtaagacataagatcctagcactttttccatcgcaccctcacaaaagacaggtcgcgcctctaccttagccccgctgatttgactgaagagtggatctcattaatagccggagttataagggtcccctccctgggctatcactaataacatataggaagtggatcgtttgcatgctggggcccgattacgggggcgcacaacacaaagaagaagaaacacggattgcgatattactaatcgccccaacaaccgtgtatatccggccaaactaggttgtggccaaagaatttcttagtaataaagtgatcccccaagggggtccccaaaaaaccccccacatgaca

SEQ ID NO: 684991 - DNA, 427 bp, Homo sapiens
ccttcgcaggacttcccgccgtacagttgcggaggaggcgagcaccatagggagcaccgttgaaaggatcacggatgtgcagattaaataagtggcaaaaccattctcagttgtcaaaaatggccaaaaacacatccctatatttccgtattatagagggcaggagccttccagtcaaagacgtgtaagtatgtcttaattgtacttattcaacaggcagcaattactcctatttgcttatttatgtttctcgtggtgtgaagtactcgtatactaggatgtacacttgtttggaagttaataatacctttgttttacagcacttattgagatattgatggtaaaatgtgactccaagtagcctagacttgacaggtgtttaagatatttctatcaataatgtatttcgcaactggtacggcgtacg

SEQ ID NO: 684992 - DNA, 536 bp, Homo sapiens
  misc_feature (91)..(91): n is a, c, g, or t
  misc_feature (371)..(371): n is a, c, g, or t
  misc_feature (373)..(373): n is a, c, g, or t
  misc_feature (383)..(383): n is a, c, g, or t
  misc_feature (431)..(431): n is a, c, g, or t
  misc_feature (441)..(441): n is a, c, g, or t
  misc_feature (446)..(446): n is a, c, g, or t
  misc_feature (454)..(454): n is a, c, g, or t
  misc_feature (467)..(467): n is a, c, g, or t
  misc_feature (473)..(473): n is a, c, g, or t
  misc_feature (489)..(489): n is a, c, g, or t
  misc_feature (506)..(506): n is a, c, g, or t
  misc_feature (509)..(509): n is a, c, g, or t
  misc_feature (523)..(523): n is a, c, g, or t
  misc_feature (530)..(530): n is a, c, g, or t
accctgatggcgctgatgacaccggccaccgtcacggcctggacagcagccagtaccgcaacgctgcgcgcagcgtggatattttgctggncgactacctgccgggttggctcgaagagggctatcaggtattggttaccgccgaccatggcatgaacaacgaccgctcgcacaacggcctgctggccgaggagcgcgaagtgccgctgttcgtgtttggcgacgccttcagcctggacccggccgccaaaccgctgcagaccgagctgtgcggcaccatctgcgagctgctgggcgccgcgcacgacaaaacggtttgccgggagttgctgaagtgaatggcggcgcccgtggccgctacctggccctgntnttgctgctgncggtcgccgtgtcttcgtcatcttcaagtcgccccgttggctggtggngaacaacaancttgnatcggacnccgctggggattnacaagnttacaaggattcgctncaagtttacttgaggcntgnaaacgaaacttggnaaataanttttgg

SEQ ID NO: 684993 - DNA, 1325 bp, Homo sapiens
ccaacttacctctcttgtttgtgtcgcttgtgtgggggattagttatgtttcgattgttctatgtctgtaccacctcactccagcacataaatgtttagtttgtgtttggtgctcgccgcccactaccccgccagttattctgtatgcttctttgtttgctttttctttaccactgaatttagagtgttgtctgtttcgtcctccgtcgctcggtgtctccagcgagtggatttggcatctttcttttcttctgtcttgttggtttgagggtagctccacacactctttgtgcgcctccgttttgtgttccgcctctccctcgctactcgctcaccctttttcctggtgtgcgtccacatcctgctacgaatagaagcagcggtggtgggggtgtgaaaatagtatggcgcgcagaccgtaagtagtaccgggttgctataagcgagtgtgtgtggtctcgctgtataacaccggatggcgctaccgtccgcacgcgcgtctacttctctgtacgcttatcagtctcagcgtctcacgcgcgcgcggtcgccggtcgctgctggtgtggatagacgactttcgctttcttgttgatgctcgcggtgtggcgatgcgtgggtcgtcgccgcgctcacgcgcgcgcgctctcgtcgctgttgtgtttgggttcgctcgcgcggcgcgccccccgccgcctctgccgttgcgttgtcgcctctcgcctcgccgtcctttgtatgttagtccccgcctcgcgcgctcaccatctctctctctctcccttcggctcgcgctgcggctctgcgcttctcttttctctctctcctctctctctccgagagagcccccgctctcgctggtgtcgtgctccaattaacacccgcctcccgcgctcctgctctcgcctcgctcgctcttctgtgtgtgtcttctttttttttcctctcctctctctctctcgcgcgcctctctctctctctcctcgcgccgcgctgcgcgtggtgagagatgatattatgtggttcttttgttgttttcgtgtgttctctcttctctttttttttttaagtaaagttgctctcttcgcttttttgtttgtgctccttctctctctctctctctctctctctcctcctcctttgtttctctcttctctccgacacacagcagcagcagcagagaggagagagagagagagagagagagagagagagagaagaggaggggggggtcgcctcccccccacaccctcctcccccccctttttttttgttgttctttttgttgtagtgtagaaagtttttttttttctctctctcacaca

SEQ ID NO: 684994 - DNA, 1031 bp, Homo sapiens
  misc_feature (126)..(126): n is a, c, g, or t
  misc_feature (489)..(489): n is a, c, g, or t
  misc_feature (778)..(778): n is a, c, g, or t
gaggaaagagcaggcgggcacaacatactgtgttacttattgcaccatgtagtctggtcgtggtatgttatcctcgcttgacgttctaccctagtgatgcctctgacatgtatacgcttaggtgtncactatgcttgtacacatttatcccctgtggggaatttattgtccgcgactatcgtcactattggttttgtgtaactcgtcgctaccgatgttacacccctcgtctattacgcatacggaacccgttctctggtttgatctcccatgggcgtcttaacttacggcctatcttgtctggtttgcgtcaatctgggtctattattccccctcgtgcggaattgttgtcgatagcatttcgaaaaatgactcctccgtatggacgctcgcctgctgtggcccgcgacccgccattggtttttcccggggcggaaggcgatttttagttattagccccgccgggggttaaactcttccctgattgantgtgtgcgcctgggaactcaagtgtgccaattgtcgttgtgccagctgctgccatgggcaagtataattgcgtccctctctatagagtaagttctgacccatggttctgtactcccactggtacaatgaggtctctgcagcgcagtgtcatggccagacaggcctcgtgcgtcaaacgctgtgccgtcctccccccctccactgttttgacgcaggtggcggaaactagctgctggtatagcaaccccagtttgctcggcgactcaaaacaggatgctctcgtccatcnctgagtgtccggcaaataaggatgctcccgccgcccttgtaacttcccgctgggacatacatgttcgcccaggaacacccaagggggtccatagcccatcccccccacgatgaaacgagcaacatgggacacccgcctttgctccaccggggacacacacaccacttctcgggtttcacaggccatttctccccgcattttcccccatttccccacccccgcattcctacccgggttttcccccaacaaaaca

SEQ ID NO: 684995 - DNA, 150 bp, Homo sapiens
ccctaatgcaaaccccaaacaatacaccagcaaacaccccaaccaacactccagccaacatgaaattagtgccggtggccaacaacagactatttgacatgtcggctggagtgttggttggggtgttggctgacatattgcttggggttt

SEQ ID NO: 684996 - DNA, 278 bp, Homo sapiens
gtggcagacgttctgtaatcccagctactcgggagggtgaggcaaagagaattgcttgaacctgagaggcagaggttgcatgttctttcattgttgctccaaataggaaactaatagtccaatggctaaaaaaaaaggggaccgaggtgttatatgaatactgatataaaggtaataattacctcgcaggtggtgttgacgttggaatgagccattgatcataccattgcactccagcctgtgagacagagcgagaccctcttccaaaaaacaaacaa

SEQ ID NO: 684997 - DNA, 173 bp, Homo sapiens
agccatgtcatgttggtgcgtcgctttgcagtagcttgcttttagcctgcctcgatgttgcgtctggctttaattctttctccttcttctgcttccagtccttgccctctctgcgtcatgtctttccttgtcttcctcgttccactcttggcctttaagttatgctacatgtt

SEQ ID NO: 684998 - DNA, 164 bp, Homo sapiens
ctctcatctgacgacgatgaggtgacagtcacggaggatagatcaatgccctcattaaagcagccgtgtaaatgttgagccttttgggcctggcttgttgcaaaggccctggccaacgtcaacattgggagcctcacctgcaatgtagggcacggtatttcttg

SEQ ID NO: 684999 - DNA, 608 bp, Homo sapiens
  misc_feature (254)..(254): n is a, c, g, or t
  misc_feature (473)..(473): n is a, c, g, or t
cccagtcacagacagctagcaagcaggtagcagagtcggtggatcaaagcacgagtacgttacaactactggtaagcctatgcttctccgcgctcagcccttctgcttactggaagggctatcactgggggtgaacttgaaactcatcatcactcttcggcaaaagctcttcttcctgaagacagacccagcctcttgtgctctcaccctccactctggtaaagctgcacctctgggggaatgaggggctgggnatcctggagagcctggtgcttcacgatgctgctctggtgattcttgtacctaatctggtgtgctcaccaatgagtgaaagggatcgtgggtcagggacaccgagagagtgaggtcacttccacttcaaaccttcagtgagggggtgggatggagagcaatgctgaatcttttttttggacggcaggggtttttctacttgtacaaatattcttagattnaaaagaaccttggttgtttgtggcatataataatatttaaaatgataatgcatctccccagagtattttgtagctgggaaaagaaaaaaggaaaaaaagaaaaaaagattctaacagctgttaaatttataatta

SEQ ID NO: 685000 - DNA, 1140 bp, Homo sapiens
gcggacgcgtgggtttattatttttgggagggactggttctttatttcaaaaagacacttgtcaatattcagtatcaaaacgagtgtgcgactatgggatttgctcatttctccacaattcgtgccccagaagaagaaccacagtaaaaggcagagtacctttaaagccgaagtaagctgcaggatgtacacctaagcagacctcctagaaaccttaccagaaaatggggactgggtagggaaggaaacttaaaagatcaacaaactgccagcccagcggactgcagaggctgtcacagccagatggggtggccagggtgccaaaaggccaaagcaaagtttcagaaataatataaaatttaaaaacgtttggtacataagctatttcaagagtttctccagcagctgagctgatacaaagcacaaattgagatggcacttctagagacagcagcttcaaacccgagaaaagggtcatgagatcgagtttcacatggctaaatcagtggcaaaaacacagtcttcttactttctttctttcacggaggcaggaaagcaattaagtggtcacctacaacataagggggacatgatccattctgtaagcagttgtgagggggtagagatgggaccaaaatttgggtctcagaggtcttagcatcttaatttggtaattctaattgcaacacgcatacagacttggaactacctttatccaagaattttctaacagtgaaaactgtgaacgcgcatatcggggaaaaggacaaggggaaaacaccccgggaacaccacttgggaagacagacatctggagaaaacgatcggttcccaaaaaggaatctccaagagacaaatgggacccacaaaaggagggcaacaaattgagatcctattgaagaggaaaagaattaaagaaggaaagacaacaaacaaggataaagagtaatttatgacagaacggcaaccacgagcgttgacaaagtttgtaaacaacaaagagtaaaatgtagtaaaatgataatatcggagagacacgtcataaatagtcgtcagagcatatcaaagaaagaataataagaggtctttctttcctctttcttcttgtttttttgttttttttctctttcttatcgaggc

SEQ ID NO: 685001 - DNA, 862 bp, Homo sapiens
gagtgcagtggtgcgatctcggtcatgaagctctgcctcccaggttcccaccattctcctgccttagcctcccgagtagccaggactacaggcgccctccacatgcccggttatctttttatttttggtagggacaggagcctctctatgttgcctgggctgtcttgaattcctggcctcaagggatccctctgcgttggcttccaaagtgttgggattacaggcgtgagcccaccgtaccgagctcatacattattccactgtgttccttatttgaagcaaataagaaccagatcatcatcatcatcatcatcattatcatcatcatcatcatcatttatgcgagtgtttataatcttcatatctgtgtcaaagtcattattcccatcttgtactggaaaacaacactaggtttagataggttaaataccttaatggaggtaaggcagttggaagtggtacgatggactatgatcagatgagttcctatatatataactatgtttgtgcttttgtaaatataagcaagatgaaacaggatatttatatcatccagagggttcctctctgtgtctttcattagtattcccagaagatacgtgttggtgaccttgtccctattagatagagttctgtctttgtaatagttaactgtctgacttataaacgtgatcaatacgacgtactttgggtaggtctgggggatgggtcaaaggatcgatggggatataaaggaggggtggaatgggggatcctttactataactttcttgggaaaaactgggcttttggggcaaccgggcactttgtggggccttgtgtccaacttttggcgggctgcttcgggcggggcaaacaaccg

SEQ ID NO: 685002 - DNA, 371 bp, Homo sapiens
  misc_feature (304)..(304): n is a, c, g, or t
  misc_feature (319)..(319): n is a, c, g, or t
taaaaagggtaaccatcaggggcaacgaaaagaaagggttcgtatttccaagttcattattccttattcgtgaagaatagatagggcgagaaattttagagcagaagatagggggtgaagagtgggtgacattatgagagggtggactagtggccacaagtctggtgtctcccagttaatggaattttttaatgtggtgttggtgttaaaggatacattattaaggcttggtagacctataggggacatacaggagagtctccggtgcgaactagttcggacgggagactcttcaataaattanggtatgggagggggngttggtcataaatggctctgatcatttggagataggtcccatcaatacctaa

SEQ ID NO: 685003 - DNA, 488 bp, Homo sapiens
tagatcgagctcggtaccataaaagcttatacgagtagaaaaggacggagatcatgttaatagcaggcatttagttgatcatattagattaagtgaaggtagcggcatacacccgcatacgagacgagacccgcgaaaacttgacatttcattctttttccctcatgggttaaatcggggcttttgagatctagtgtttgaaagtccgttccaatgtcgctcaaatttcgcataaatttaactaattgataagcaaatgggaaaaggctgaatgctatatgtatgtgggagcgctccacatgcgcatggggccgtgtacgagtataagatcgtatacgcgtataggaagaaaggctgagcctgcatgggctgccatccgagtatagcatcaaataacacagaagggcacagaagggcattgaaataaaccatgtttcaaagtttttccgccgtctacacgcagaggtataaatgatacgtatctccgg

SEQ ID NO: 685004 - DNA, 320 bp, Homo sapiens
gggaacacgtacggcctgtaataacagcattgtaatgacagtttctcagtaacagaatcctggtgggccgttaattgggagttttttgccctggcgagtgcagattccttgctatacctccaattctgcccagaagagggggggaatcaccagtgttacaaaattagaagcttgttttggctattttagactgaatatttgaacactgcagcattactagccaccagtgttaaagggcagatgagggggaaaatttgtttttagcagaaattccatgcctcatcttttttaagcgatttgttccaaatgaggccatttag

SEQ ID NO: 685005 - DNA, 767 bp, Homo sapiens
  misc_feature (8)..(8): n is a, c, g, or t
  misc_feature (41)..(41): n is a, c, g, or t
  misc_feature (46)..(46): n is a, c, g, or t
  misc_feature (49)..(50): n is a, c, g, or t
  misc_feature (59)..(59): n is a, c, g, or t
  misc_feature (64)..(64): n is a, c, g, or t
  misc_feature (68)..(68): n is a, c, g, or t
  misc_feature (70)..(70): n is a, c, g, or t
  misc_feature (72)..(72): n is a, c, g, or t
  misc_feature (74)..(74): n is a, c, g, or t
  misc_feature (79)..(79): n is a, c, g, or t
  misc_feature (83)..(83): n is a, c, g, or t
  misc_feature (89)..(89): n is a, c, g, or t
  misc_feature (94)..(94): n is a, c, g, or t
  misc_feature (96)..(96): n is a, c, g, or t
  misc_feature (99)..(99): n is a, c, g, or t
  misc_feature (106)..(106): n is a, c, g, or t
  misc_feature (118)..(118): n is a, c, g, or t
  misc_feature (122)..(122): n is a, c, g, or t
  misc_feature (126)..(126): n is a, c, g, or t
  misc_feature (128)..(128): n is a, c, g, or t
  misc_feature (138)..(138): n is a, c, g, or t
  misc_feature (141)..(141): n is a, c, g, or t
  misc_feature (146)..(146): n is a, c, g, or t
  misc_feature (170)..(170): n is a, c, g, or t
  misc_feature (172)..(172): n is a, c, g, or t
  misc_feature (175)..(175): n is a, c, g, or t
  misc_feature (180)..(180): n is a, c, g, or t
  misc_feature (188)..(188): n is a, c, g, or t
  misc_feature (198)..(198): n is a, c, g, or t
  misc_feature (201)..(203): n is a, c, g, or t
  misc_feature (207)..(207): n is a, c, g, or t
  misc_feature (211)..(211): n is a, c, g, or t
  misc_feature (218)..(218): n is a, c, g, or t
  misc_feature (220)..(221): n is a, c, g, or t
  misc_feature (227)..(227): n is a, c, g, or t
  misc_feature (251)..(251): n is a, c, g, or t
  misc_feature (254)..(254): n is a, c, g, or t
  misc_feature (261)..(261): n is a, c, g, or t
  misc_feature (271)..(271): n is a, c, g, or t
  misc_feature (282)..(283): n is a, c, g, or t
  misc_feature (286)..(286): n is a, c, g, or t
  misc_feature (295)..(298): n is a, c, g, or t
  misc_feature (334)..(336): n is a, c, g, or t
  misc_feature (345)..(345): n is a, c, g, or t
  misc_feature (370)..(370): n is a, c, g, or t
  misc_feature (394)..(395): n is a, c, g, or t
  misc_feature (400)..(400): n is a, c, g, or t
  misc_feature (402)..(403): n is a, c, g, or t
  misc_feature (408)..(408): n is a, c, g, or t
  misc_feature (411)..(411): n is a, c, g, or t
  misc_feature (433)..(433): n is a, c, g, or t
  misc_feature (439)..(439): n is a, c, g, or t
  misc_feature (442)..(442): n is a, c, g, or t
  misc_feature (447)..(447): n is a, c, g, or t
  misc_feature (457)..(457): n is a, c, g, or t
  misc_feature (469)..(469): n is a, c, g, or t
  misc_feature (475)..(475): n is a, c, g, or t
  misc_feature (496)..(496): n is a, c, g, or t
  misc_feature (516)..(516): n is a, c, g, or t
  misc_feature (520)..(520): n is a, c, g, or t
  misc_feature (571)..(571): n is a, c, g, or t
  misc_feature (642)..(642): n is a, c, g, or t
  misc_feature (673)..(673): n is a, c, g, or t
aagctcancgtggacgggctcctgctctacttcccgtaccnctacntcnnccccgaccncttcncctncntncnggacncaancccccnctggncnccnagggtcntggactcctggngatncccncnggccccgggnagncagtntccctgttggccctgatcatggcntnccngacancatatccnctggaggtgnccnnnctcntctnctgctcnannactgtnccagacattgagaaggtgattgangancttcganagttgctccncttctatcaanngcnggagggcgnnnngctgccgtttctgggactggctctcacctcccgccnnnacttgtgtnttccccctgcggtgccccccctgcnctttgggaaggacgtcgatggganntgccncnncctcnccncctcctctgtgcgggcgccgtncccgcntgncaccngcctgccccnctgccgcttctntgaggnatttgatgcccatgggcgtgnggtgcccctccccgctggcntctnccacctggctgacctgcaggccctggggcggcgccagggctggtgcccatncttccttgctcgatactcaatcctgcatgccaatgtggtggtttatagctaccactacctcctggaccccnagattgcagacctggtgtccaaggaactggnccgcaaggccgtcgtggtcttcgacgaggcccacaacattgacaacgtctgcatcgactccatgagcgtcaacctcacccgccggacccttgac

SEQ ID NO: 685006 - DNA, 327 bp, Homo sapiens
  misc_feature (285)..(285): n is a, c, g, or t
tggcgaagtgcaatggctggttcaaactcctggctcaagtgatttgtccacctcagcctcccaaactgctgggattacagatgtgaggcacggcgcctggctttttttttttggaggcacggtcttactctgttgcccagttgggagtttagtggtatgatcccagttttttgcagtcttgacctcctccagcctcatttttggtttttaagtagagacaaagtctcactattttgcccagttgggtctcaaactcctgaactcaagtaatccccatgcctcagnctcccaaaatgctgggataaaagctgagccattgcactccgg

SEQ ID NO: 685007 - DNA, 408 bp, Homo sapiens
tgatttgtggcaccaagtacaggtaccatatacatcagagaaaggaaagccaattccagacctgtataaggcagttgtaatactaagaaggaggatctccttagtgacacataacttaaaagactttttaatagcttctactgcctatgccagattgtcctgggtagactcgtcgatttccatgtcctggtcatcagacgactcatcttctcctaggacatttgcagaattctggtttccgaattagaaagaatagaactgtccccataagggctaatcaccgttcatggcaataaacactggacttcggtcactctctgatatctgagttttccctttccaggcaaggttatatgtagagatttccaatgaagatgctaaattgcagaagtgcccagaaaatccaac

SEQ ID NO: 685008 - DNA, 1769 bp, Homo sapiens
  misc_feature (765)..(765): n is a, c, g, or t
  misc_feature (1353)..(1353): n is a, c, g, or t
  misc_feature (1525)..(1525): n is a, c, g, or t
ggtactattatgcatggtcgacccctaccgtgttcttctgacattgccggtcgcacggctgagacccatgaggactcgcggtcgtcctgtgttgagtcgtgtaatggcggaccagagggttcctgaaagacagtgcagtaaagacttgttcggtgacatctgagcacgtggagcaggaataggcattcggattgataagggattctcgtggcattgtcaactagggaatataatatcctagggggatcttaatacgttgtcaatgacggatggcagcacttgtcgcacggtcggccccactagataggcaacctagcgcttaggctgacatgttccttatacctcgtagcgcgcgcagccacatagttatcgcacacgataggaagcaaaaactttgcaatgacctaaaaatggcaaattaccagggagtttcacttagtgaaccaagtacgtatagcttctcaaatagggaccacacacactgggcctcggagtagtctcacaagattcgaggcaacaaattcgcgatttgccccgaagggtcttatgtttcccaccttcctttgaacaagccctcggtccccttagaaagggaccgctttggaacgcctttggcgttggtgagcgacattttgggggcttcgaaaatgggcgaattgtttcgtcgcttagattgcaatcggggccgagattaccgattggcaccagcatgaacaatgtggccaacttcgccaactttccaattcaaccggtaaggaggcagangcgtcaccccagtcgcggcgcatagcccgccccatcacagcgggcccgatatctacccacgtggaacaaacatttggcagagcagcaacggcacccgtcgcaagagcatctaggatagggaccaagggtgagatgaccaaccttcgaaaatttcacgggcaatcggaaaacctctcgttcagagttagccagagaggaatttccggccataccgtacaatccggtactagccgcagaacacgtgatagcttaagatatcgagcattaacttcccatttctcaaacaccacaaatcgcaacaggaaaagatacagaactggatgcccgacatactaccatctaggggtaaggagcagttccgaaatcgagagattgcgaacaggcgaggcacgcggcaaaccagttgcgaataagagtacggaccacaaagcctgagtatatagacagtatgcacagggtaggcgggtaaacattttctcctctttgagcaggaaacacattgccgctgtactacaaagttggatgggcgactcacattccccgaggcattatgaggccaagagggaccaactatcccccgattcattntaaggcggaggcattttcggcaaacatgtggagaagggaaaatgcacccaatctaggacagtagaccacacggagatcaccaggcaaaatagtgaggcccccatacagagggacctatgcagagaaacatatggccaaaggcagggcgctacagacaggaacagtagacgantgggaacacacacatgagcagacaaacactggaagcacaagcgacgttgcaaacagggcgtaaaaccccagagcgccagcgtgtcgcacagatacgccaatgagaaggacacacatgtagacagaaacccacgcataggcagaagagaacaaaataccaacagagacaagaacaacagcagacaccactaacaacagcaaacgcgagccacaaaacgcaaacagatggaatagagacacgggca

SEQ ID NO: 685009 - DNA, 168 bp, Homo sapiens
tatggcatcctcccactcaggctgctggagtggcagaattaacacgtacagagccccaagccccaggcaggcaccagtcagcgcttgacgccgaggggtccgagagtggccagccagccacggtggacagggcgccaggggtggagtctaggccattcaacgcctccg

SEQ ID NO: 685010 - DNA, 926 bp, Homo sapiens
  misc_feature (28)..(28): n is a, c, g, or t
  misc_feature (30)..(31): n is a, c, g, or t
  misc_feature (83)..(83): n is a, c, g, or t
tccgaaaagcaacagctccttaacaagngnntgcatggccacacattacttgctctaccttcacatcagtatgcaaattcttnggaaccctagtaaccttagtcattttcttttctttttggataaaggaatgacaagagacatgaccatttttccctagcctggaaatgctctgcgtctatgttgaggccaggatgggtcatcacctgttcccaaggggcagtgccctggggaccaggcagggaagacaaggaccctgcatctctgccactccttccattcagcatagccattgtgcagtggagccccttttcagaaaacaggggaggtttctcaggtttattcatcatgccctcacttcgcttttcacccatttatccatcttcatatctcatttcctctggtgccttaattctgctccttatccaaattcgctctcagaaatggatcttaaatcaatggttttcgtgagtgtttgtgtagtgtgcatcttcttccaggggtttgtgtgtctaagcctttcacaaacgcctcctcctctataaaggaattttagtcaccatcaagcaggtaagggaggtattttgatggcaccacctaactgccagcttagagcggtggaaacttcctaggtgtgcagtattaagaagggtttcctgtttttaaaacaaaactgagtaacaggaaacttttccaggatgaaaacagaatctattggtttgtgtcactctaaattactatccagtctttgtcacacatgcatattttcattgttgtggccgctgagggtagactaagtagtatgacaccaccacgtaatttcatgtacctatgtcttttattgacatagagtcacgcacctgcttctggttttggccattgtcaaattgtctgggttttcatttttcataaacagtgctgctttg

SEQ ID NO: 685011 - DNA, 193 bp, Homo sapiens
gatggtggctgtgtatactgtatcagactttggaggcaggcgggtgatcacgagtcaggagtcaagagagctggcaacatgtgaaaccctgttctactaataaagtacaaaaatagctgggtgtggtggtggatgctgtaatcccagctactcagtggaggctgaggcaggagaatcgcttgaacccgggagg

SEQ ID NO: 685012 - DNA, 179 bp, Homo sapiens
ggctcggtaccccttcgttaagctgaacggcacgcgggggtaccgacatgatgcaacacctttttgttaaatatatcaatcatgcaactgcatgggtgtgagtcaatccgaaacgctctttactgtcaagctggccccgtcgtgctctacgttggagcgtcatggccgtttttggggca

SEQ ID NO: 685013 - DNA, 843 bp, Homo sapiens
aatacctaggctccatcctacctgaagtggaacatacgaactgagcaccacagtctaggtatcatgcactgtgaattaatcaatagtagaatccacaggagtgcctaatcctgtgatcttgatctagggatgtcatacatagtatttgacaacataacttgcctctatgtattggtgtagaaaatgtgatcaccttaatctaaagtgggagaagatacatacacagatggaaatggataaaatatgtggatcaatacttttacaagtagaaaagctatccattttatacaatcactgatacagtctatgtcacaaaaaccaacagaccattattcctcttgaagttagttttgatttatctttgtatggttgtctacaatttgttttcctgtaaatgcagatagttacaaatctaaaggatagaatgctttcctaaaacagaacattagcctttaaggttcacatagactttacattgtatctaagttaatctttataaagcactagaatttttggtccaaacgtcaacaatagtattagacctattgacaaattatttgatagctttcataatctcagctttttttgaacttccaccaatttttggaatatgtcataattttttttccctgtttcacaatgttgtcagagcgaacatagaattgtaaaacatcaacaaaaaaaaatttgcgtacataaaatttcctggacctatgtttagtttacttggatctggcacgttttaccaattttggccttacacaggtttcatttgaacacttcaacgggctctttaaaaatgaaaccaactcatatacttttaacatcacttttaagcttata

SEQ ID NO: 685014 - DNA, 611 bp, Homo sapiens
  misc_feature (430)..(430): n is a, c, g, or t
ctgcgcctactactaccatttaaaaaaaaaaaagttaaaatcctctgaagacacatgcacatgtgtttctggtttactggcagcactatttacaatagcgaagacagggaaccaacccacatacccatcaaggatagacgggataaagaaaatatggcacatatacaccacagaatactatgtagccataaaaaggaatgagatcggctcggtgaggtgcacttggggaggctgaggcaggcagatcacctgaggtcaggagttggagaccagccgggccaacatgtagaaaccctatctccaccaaaaatacaaaaccagccaggcgtggtagcacatgaccgcaacccgggccactcgggaagctgaggcaggagaatcgcccgaacccgagaggggggatggcttgagcccaggagttccagaccgncggggcaacatagtgagaccatgtctctaaaaaaattttaaaaattagccaggcattgtggcacatacctggggtcccagctactggggaggctgagcagtagatttctggagcccaggaggtcgaggctgcagtcaggcatgattgaccagtggactctagcctgggaacaagatgagat

SEQ ID NO: 685015 - DNA, 473 bp, Homo sapiens
taagcgtagggtggaataatttcttaatgtagaggtgcacttgctcttcctctctctggtggcgggtcatctgttgtactcactgctctgattacattctctactgattaaatagaccatgacctgtcatggtctggacgtgtggctaattatacttatctcctcatctcgtcttataaaaaagactgatctcagattcttattaccaaaggacgttggcctcctttgtagagaatactttgggaaggatccttctgtggagtttgatcctggggactctgactttagagttcttgctgatctttcctctccctttaagggtaaggattagtatatctgcagacatctccaagcttaagcttagttattgtgggcttatgggcagcagcttagcaaccatttcaaggcactcagctgtctcatgggtctgtctctgcttgtcactgtcccctcttgccctccttctccaccct

SEQ ID NO: 685016 - DNA, 148 bp, Homo sapiens
tagacatgatacgactcgagtcggtaccccgggtgtgtcatgcactgctataaagaattacctgagactgggtaattatttataaaactcaggtttaattgggtcatggttccacaggctgtacaactgaggagtagaggaggggggg

SEQ ID NO: 685017 - DNA, 316 bp, Homo sapiens
tgcgcttagttctctctttatacaaactctggttctacaaactcgcctgcacccgctggctggaccatcacacgctgacggggtccgcctatttacacgcccattgcgggctgtaccttgtgcacctcccggcacggtgctcatctgtgtcgccaaattaaattagggacggccgggtggggctcggcgggaacggcgtctgtacacacaagtgctgggggctcggggcctcaatactgtcgaaggccggggctgtgaacatggtcggggcggccctgcccacccctagtggtcggttacgagcggaagcacagca

SEQ ID NO: 685018 - DNA, 426 bp, Homo sapiens
tcacaggcagcactgtatacattcgtatggacagatgtactcaataggtcatgaagttgaatgtctagttgtcatcttcagtgcgaatactggcatcatgtactaggatatgactctctgtggactctcctaggagtgtcagtgctacaggtcacggtccggtgagcagccatcatatactcacatcgagtgactgttagcttctgacataccggtcttcgtgagccagtgaagtctgtgaccaagtgagcagcgtggctgatgtgaccagctgtatgtgctgcgatgtcgtatcagaggcctctgtccccagctttggcagatgtcaatagtagcactcattgtcctctgcaaacagatcagtagggcagcagacattctcatcaaagcccggtttaatagggctgcaaatcagcaacaggtcgc

SEQ ID NO: 685019 - DNA, 525 bp, Homo sapiens
cccctttttaaccccatttaaccatgaaaaaaaggtagtaggtaggtccagtgtgtgaaacctccaaacaagaagcccttttatccatgaaaatcttttcccaaggacgggatttaaaatcggaagggatcggttggattttttttttaaaaattccagttgagcggcggttttttcccacccaaaatggaaaacccaattgggaaaaaaaaaagtgggtaaaaggccccccctacaaaaaaaaccaattccagggtttggcagccaaaaaaaaaaaaatttaaatggcccggattttatttggaaaagggagaaccaatcatttttttttaagcggtaagggaggaaaaaaagggctttgggcattttaaaaaattggggttcattttttccccaaggtcaaacttttgacccagtggggtttttcaaaagtaccctagttcaggaccacccgaatgttaaaaaaaacggggttttaagtttggggtggcaaaaccaaagggaataaccttgaattgggcccca

SEQ ID NO: 685020 - DNA, 674 bp, Homo sapiens
atttttaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaacttttgggcccctttggcccaagggatttttaatttgggccatttttttcttggggcccaaatttgggcctttttggccaattcccccttttggggggccttttaaaattaacgggcccggtttttaaaacggtgggattgggaaaaccctgggggtccccaatttaaaccccttggaaaaaaacccctttttcccaggtggggtaaatccaaaaaggccccccccgaggggcttttccaaaagttggccaccctaaatgggaaagggaaattttaagcgttaaatttttgtcaaaatccgggataaatttttggaaaaaactgcttttttttaaccaattggcccattttcgggaaaatcccttttaatccaaaagaaatcccccgcaaatagggttaaggggttcttccccctttgtgaaccaaaggccccctttttagacggtggccctccacctttagaggggcaacccttttataggggggcgcccctttttgtgggcccttccccct

SEQ ID NO: 685021 - DNA, 156 bp, Homo sapiens
ttttagaccagcctgagcaacatggtgagatccgtgtctctacaaagaattcaaaaatgggctgggcatggcggtgtgcacttgtggtcccggctactcaggaggctgaggtgggaggatcacctgagcctaggaggccgcggctcccgcacgcca

SEQ ID NO: 685022 - DNA, 104 bp, Homo sapiens
tctagaaggatccccgagctgttcttcagagcacaaacaaatcagtaacaaacaattgaacagcaaagctgctactatgagtaggcagagagacttgtgcatac

SEQ ID NO: 685023 - DNA, 295 bp, Homo sapiens
ccacgctggagtgtaatggtgcaatcatggttcactgtagcctcaacctcctgggttcaggtgattctcctgcctcaaactcccaagtagctgggattacaggcatgcaccaccacacctggctaattttttgtatttttagtaaaaacggagtttctccatgttggtcaggctggcctcgaactcctgacctcaggtgatccacccaccttggccacccaaagtgctgggattacaggcgtgaaccactgcgcctggctgaaataaattgtttcaatttaattaagtaacaaag

SEQ ID NO: 685024 - DNA, 396 bp, Homo sapiens
  misc_feature (156)..(156): n is a, c, g, or t
ccccctcctttccgcctccggggataagggccctggccccactttaaaagccccatcccccctgcccccgggcgatccctgctgtgagccgaagctctccctgcccccccctggccatgtggttgtgttggggacaaaccctatttgtgtgggtgntggttccccaaaaccgggggccccccccaaaggccccttcccaaggaccctacctgggggtcaggcctgggccccccccgttcccggttggtcctgggaactgccccccccgtcccctcagaaccttggaagctgctgctgctgcttacagaattatattttttttttttgaaaagttttaaaaagttgtaaccttttgtgtcttgtcctgtcagagaataaattaatttttttagtaga

SEQ ID NO: 685025 - DNA, 174 bp, Homo sapiens
  misc_feature (69)..(69): n is a, c, g, or t
  misc_feature (112)..(112): n is a, c, g, or t
gcacatgcacatatgtgtatgcatgtatacgtccatacagacatgcacacacagactctactccatagntatacatatccctccctcttcacaaccccctgtcacatatccnttcaaggagggtgacacgttgtcttaggttgtcatctatcccagacacatcgtgcctctggg

SEQ ID NO: 685026 - DNA, 441 bp, Homo sapiens
taaggggtgacacgggagtaatctacacagcggggaacacgaaggccacgattaaggattcacctagctttacagcagtacaagcgcgattgagatcttctggtccatgtgcttgacatgcatgtgttatgcctgggaatttctttttaatgggatccttggagctcgcatagatcattatactttgcagaggtgctagttctggtgcccacaaaaaaaacatcaactcttcttttctggattcttttgtttcaagagcttgcatcatacaaagcatagcgacaatcttttgcaggaagcattcccacaaaatgcttgaaaggatcagttatggttacaccaacatctccaaccaagatctcttggccttcttctacaatgatgcacttttcgtctgcactgagacaaaaaatgacagccttctttcttttcttgatttct

SEQ ID NO: 685027 - DNA, 489 bp, Homo sapiens
ataaaggatcccgcctgttatcgcccaacacgcctgacctaatttttgtatttttagtagagacggagtttcaccatgtaggtcaggctggtctcgaatgcctgacctcgtgatcctctatgcttgggctcccaacagtggtgggattattaggacttgaaccatcgcgcccggctgagaggagcactcttacagctgcttctgcactctccaagacatctgctctggttttgaagataaaatcttcagtttggtctcccagctttccttttcaaatttccttcctctcgagtcccaagacacagcttctctaatgaaatatccagatatacttacctcatttttcctaggatatctagaggaatcatatattaatgttttataaacctttgagagctgattgttaacccttatatgatctttgtccttaaattgtaagtgaaagaaagaaggcaatcttttccctttttcatgggtgttgggcgataa

SEQ ID NO: 685028 - DNA, 176 bp, Homo sapiens
  misc_feature (10)..(10): n is a, c, g, or t
agtatctctnatttctgaagatgtacaaaaaaatatagacttcatatatctggaatgagcactgagccataaaaggttttcagcaagttgtaacttattttggcctaaaatgaggtttttttggtaagaaacactcatttgttcttatgtattgaggagtgtcttttatatatgat

SEQ ID NO: 685029 - DNA, 386 bp, Homo sapiens
aatttacaggcaatgcaattcactcattgagctgtacaattcaatagcacagaactgttgtcagtctatcaccacacatcccattttagaacatttcttatcacctctaagagaaattctgcccttctgagacatcactgtcagtcctcatttccctggataaccactcatctactgtttctttttctttttgttttcttagagtctcgctctgttgtctaggctgaagggcgggggctctctctcggctcactgcactctgcggcctcccgggttctagcatttctcctgattcagcctctcgagtagctggggctataggtgtgcatcaccatatccagctgattgcggtatgtttcgcgaagatggagtttccccaggtcggc

SEQ ID NO: 685030 - DNA, 178 bp, Homo sapiens
tcaccagtatgttactaaatggcagttacctaatggactgtcacctaaatggctgttacctaaatggctgttacctaaatggctgtacctcaaatggctggtacctcaaatggcaactcgtgcatcgccaacatccagcggccattaaggtaacagccatttaggtagggtacctgtt

SEQ ID NO: 685031 - DNA, 104 bp, Homo sapiens
atcccgatattcagttctctccagcctggggtaaatacactgagcaatcacatctcggagttttttccaatggcaacattggaatcctcggctccattctcatg

SEQ ID NO: 685032 - DNA, 1296 bp, Homo sapiens
  misc_feature (1010)..(1010): n is a, c, g, or t
gtgttccacccctctcttttgttatgtgattgtgttctggtgacatcattgtgtggtgctaggcctatcttgtgtacgcccgctaggggtgttttggcagtaatgctccaacacccagggcgcttttggggcgctctttcgtggtgggctctgatacatcctctgttgggtcttcggtgtgcactcctattgtactagcgtttgtgtttttcctcactaactgtggctgtgtagcgtatatcgtgtgaccctttcttctctcttcttgggtgccaattcttttcccttctctctgtcgctctacctggggggtctactcgctcacctttttagtgtcgccaatcaaggtggagccgccttcgccttcttttatatgtgtgtgcctcgttttagacttgtggggttccttttttcatgctgccttctacccttcttctttttttttgcaccgtggtcgcacaaatgtctattatccctctgcttctttggtgtaccacatcatctattcatctttgtctgtgtggttgacccaccaccagcgtggtgtcctcttttgtggggtgctttctgttggttctccactctattgtaccccccctcttggtgatgctatacccacactcttcttgtggaggaagaaagttttgttggtcctctggtgactccgtgtcttgatatagataagtggcacccttgttctcccccgttcgtcttttcttttttatggtggtcgccgcagaagtattcacacacttacctgcgctgggtgttgcgtgctcgctggtagataccccccttcgtgtaggacccccccccacccacgcgccagaactagggtcgtttttcttctgactgtagcacacacacacacctctctctgtcgcccacctccacaccaagagaggattatattaatattgaggcgatatattaaaataaataaggaggggtgataagaagagaagtgacctctttgtggggtcggggccccacacacacacacccactcngagataagagagccacctcatagatatatttttccccaccttttgttattgaaacttctacggcagtggcgccccaccatctcgtgtagatagcggtctggcgctcttcaacgtagggcaacgggtcactttgcgaatagtagtggtgcccccccaaaaagagggggcagatacctcccccccggctctggggaaaacgacacacttttggggggtccccccaaaaagggcgcccctttttttaaaaaggggtcccacccccccctttatttttttctttagggga

SEQ ID NO: 685033 - DNA, 179 bp, Homo sapiens
aaggcccaggggtggggcccatggggtttttgcattttcagttgtttgtcccaagtcctgctcctttttgcccagcctgctcagcaggttgaatgggttttcagtggtccccttcctcaggtcaggtgggccactccttttcaccccccccatggagacaataaacagctgaaccatga

SEQ ID NO: 685034 - DNA, 227 bp, Homo sapiens
cgaacggagtgatgcggttggtgagtggtgggggttggctatacgtccagtggtggaagcactgtgagccccgttgacatctggcctgggagggcatgacaagggacgagggtcacgctaggtcttgcttggtgctctgtggcgctggagtataggcacatgacacagtggtacactccgctctcaaaaaaaaaaaagcccacccggcagtgtagcacagtggcagg

SEQ ID NO: 685035 - DNA, 363 bp, Homo sapiens
aaaaaaaaatgggtgatttattttttaaaattaagattggcggaatacagaaaattattttttttacctttacatatttattggtaaggcccaagcaaagggtaacaattagaagaactcttttcaaactaccaaaatgttttcttttggggaaattattcaagtcacaaatgcttagtaaataaatgtacttcaaaatacgtgaagggtaaaacaagtttgaaaacagggatcttaaacaatggattcctttcacaaaaactaccccacaaacaagaagcaaaaaaaaaaggttgtcaggtttgaccgaaaaaaataaatcaaatgttttgttggttgggattgttaaactaaaatctttaa

SEQ ID NO: 685036 - DNA, 401 bp, Homo sapiens
gatgatacacacacacacatacacacacacacacaggtatagacagtcttcatccattaacaaagcagcgacgtgatgctagaacagtgggggggtgcatgaacttgcgtctgcgccgacgagtctactctagaaggcacctgtccaactataaattataaaagaacattctaaaaatacccagtgaaggaattaggtgtgtactggaacatacggcgctatgacagagccaatcacggttttgcgtagcacaaacaaccaaagggagaacggtttctcaggagaggactctgactacgcaggatattttttcatcgtgtggggatctggatctgcttgagcatcagacaagcgtggtatcttctgaggacggtgcccgagagcagcaggggaagacagga

SEQ ID NO: 685037 - DNA, 116 bp, Homo sapiens
gaccgtgtcgcatgtggtgactgcaacgctccattggcagaagaaccggagactacttgtgtgtgacaacgtagatatggactccgaaaggacaccccagggtgttgtcacaacac

SEQ ID NO: 685038 - DNA, 995 bp, Homo sapiens
  misc_feature (152)..(152): n is a, c, g, or t
  misc_feature (593)..(593): n is a, c, g, or t
ttttgactgctgagaagtttctatgtacaaaacttcatttaaaaggtttttctactgaatccaggtattctgaagatcgaagcctgtgttcaaatgcttaccaaattggccaaaaagcaacgaatcaaaccagttggatttttgactttccnagaaaaaaaaacaaaaagtaaaaaaaaacaacttttgtgggcgcgcgcgcctcggcgccctcggaaaaagtttttttaaacaccatttgcgtgtttgggcggcggcgggccccaatagggtaagtgggactattgggcctatagctgtggtccccaaggaaacacccggggcctcggactaggtggctggggtttctcccacaatataaaaaaaacgcgccgggggcgacaccggacgctgttcctggacaaatccccacataggggcgtccggcgcagccaaaaccggggatcataccaacagagggattccaaaggcgagcgctgcagatatactaattaaaaccgccccgggtcggtgtggaatacagatctaacgaagcatgctaccaagccagcaatccagagattcaacaagacacatgtaggagatgatggatngaaattacaccagacgagagaagacaagacatcaagctaaaacaagacatagcatagaggcgacacatagcactaacaactaaccagacacggtgagatatcgcgacgccaagcgaggccgacagagaagcgcgaagaagaacacaacaagaagagacgagagatgaggcagagacaaagggagagacagcaagaaagagatcggaacgaactgcagagagcgggcacagcagacacggagacggtgatgaaagcaaagaggcaagagaagcgggaggcatatcgtcgcaggatcggatatgaggggaggcggggaggtatagacgggggaaggagcgcaagaagcaggcggacgggggctggcaacgctagcaggatagatcatgctttgacacgagcctc

SEQ ID NO: 685039 - DNA, 1083 bp, Homo sapiens
ccttttttggcccccccggtgtggcgcccaattcccgggggctcacgcccgggagccccctggggccccccaaccgtgtggtccccccggcgcggccccctttgttgcgtccgcccaagatgggaaaggagccctccgtgggagcccgggtaaactttcgcccaacagccaaggaaacaaggtggccccattgggggggaaaaggaaacttgctccccagaaaaaagaagaaaagggtggttcaatagacaccatgccccccccgcgacgagtgaccacaaggacttgtccaggttccgccccttaaaaggaagttaaggggggtaacaccagaatctcttgggtaatttgcaagaaggtggaataatagttgtaccaaacccaagggcaaccagtgatccccccgtttggaccaacccccttaaagtgttccgagcattctctgggccagcgaaacacctgtgttcacccccttacccacggtccactcgccttgaggaccccaagccaccgcgctgacccacgagaaatgggctatccccacgccactttcgttaaaaccccacgccttgtgtggccgcgaatatagttctgagactaggtttataaggaggactcggccgcaatagcttctgcccacaaccacaatctgtggaatggagaaagcacccacctgtggctatactgtgagagagggaatgaatgtaatgaatgaaagttcccacgagttcttgttggagagaaatttctgaatgaggctttccccggaatggaggccaaactggaattggagtccaactttctggaagaataaaacacctcggaagagaagatttactggggagactgcttatatttataatattatgactcgcttttttaagagaaatattttgtttatggatcttgatataaatcttagatctcttaatatttttaagccccagccccttggaccacatgccagctctttttccagtttttgcttataccaccaattccattcttttgccagctaattaagcccgaagaagcctggggatccagtttgaaaccaagattaataaagttctttgcctagta

SEQ ID NO: 685040 - DNA, 332 bp, Homo sapiens
  misc_feature (67)..(67): n is a, c, g, or t
  misc_feature (286)..(286): n is a, c, g, or t
  misc_feature (311)..(311): n is a, c, g, or t
  misc_feature (323)..(323): n is a, c, g, or t
aaaattatatctcccttctactactgcagctggcaagtcttgaaagcatcacttcctcgctagagcncaatgaactcaagccactacagcaactcagaacaactctgccccagagaaggagaatacaacaggtaattctaccacctgcacaccctagctaactagaggtcctgagtctatccttgtgacaacttcactgctaacataaccagcattcaagaaaaccagtgcactaaattacaaccaagggactcccacagagtccactttactcccctgccacctncatggggtcaggttctggttatccntgggttggggantccttaggg

SEQ ID NO: 685041 - DNA, 867 bp, Homo sapiens
gtttatcagtttggacactgacaggagtggaacagtagacccacaagaatggagaagggcctggacaacaatgggatttaggttgagtccccaggctgtgaattgcaattgcaaaacgatactggagcaatggaaagatcacccttcgacgactacatcgcctgctgcgtctaactgagggctcttacagacagcttttcgaagacgggatacgtgctcagcaaaggtgttgtgaatttcccagtatgatgatttcattctaatgtgtcatgagtgttgaaatcaagaggaagctgcaatgaggtgtaatcaacgattccaactggagctcgttcctttgcttgtgctctaggccttcggtagatatgtataaggtgacatcacgactttgtcttaacagctgttgtaaagtgtattactttatgtacaagatgaagttagtgaagtttggataatgaaattcttggaactttaattaagatctagtctgtgacaccatttagaactttccctgagtcatgatcagtcatgcttattttctgctaaaatctatgtaaatttcagtatgcaacagttcaagtcgccattatttatttttcatgtgtgaggggccttacaatgtaactcagactacggtgttaactttccctctgctacaaaagattttcccacattaaacttaggtgactgcctaaacgccctggctgattacccgcaaaggtttccggaacccggcgggtaccctgaaagttgaacggcctaaaccgggtatgggggacatctgggccgccctggttttagacggaccctaatcggttacacataaaaaaaggcaaggctgtaccctttgcgggcacactccctctc

SEQ ID NO: 685042 - DNA, 155 bp, Homo sapiens
  misc_feature (69)..(69): n is a, c, g, or t
gatcccgatcacgtgcattgtgggtctctgtggatatgcgggtctctctgaatctgctgtgattcaggngctgccaatttgagaatcatacatagctcaaactcctttaggctgggcacggtggctcacggcctaatttttgtatttttatgaga

SEQ ID NO: 685043 - DNA, 279 bp, Homo sapiens
  misc_feature (29)..(29): n is a, c, g, or t
  misc_feature (66)..(66): n is a, c, g, or t
  misc_feature (78)..(79): n is a, c, g, or t
  misc_feature (86)..(86): n is a, c, g, or t
  misc_feature (151)..(151): n is a, c, g, or t
  misc_feature (257)..(257): n is a, c, g, or t
ttaccagcagacggtatgttgggccacancatccggagttgcacaacctctgtggtcgcgtagagnccatcatgaggnnggccctnggaagaatttgccattttcagtggaaaacaagtggtcgttactagctaagatgtgtttgtacttnggatctgcatttgctacacccttccttgtagtaagacaccaactggctaaaacataaggagtttgcagttgcctccatttaacagatatgaagagcattttaagangtggcagcctctggaagtggat

SEQ ID NO: 685044 - DNA, 317 bp, Homo sapiens
acttagcccttgaactttaaaaagttatttccaaaggtgtaaataggccgggcatggtggctcccccctgtaatcccagccctttgggaggccaaggcagggggttcctttaggtccaggagttttagacgcctgggccaaaatggtgaaaccctgtttttcccccaaaaattagctgggggtggtgatgggggcctgtaatccccagctactcgggggggtgaggcaggccagttgctttaacccgggcaccaaaggttccagtgagccgagattgtgtccctgccctccagcctgggggccagaggaaggctcca

SEQ ID NO: 685045 - DNA, 185 bp, Homo sapiens
gtctctagaggacccctatgtgacgtaaaccttactacaatagaaaattcacatggaaaagaaaccctacaaaaggtgaagaaggtggcaaagcttttaagtgggtcctcaaaccttacggaacataagaatattcatacggaagagaaaccatacaaatgtgaagaaggtggcaaagcttttaa

SEQ ID NO: 685046 - DNA, 1566 bp, Homo sapiens
gtgttccctgcctgaggccagccgcactcctgtgacgtgtgccgagggagccaggccgtcctcccaccagaccaccccatccgcgaacagccgaccagtacctactgcggtaccgccgggatggacgtacctgaccacctgacccgacctacgaccatgcaccgtgacctgcccatatagcctggcacctgtcactgactgacatccagaacacacagaccacgtgagcgccgtggatattgcaagctgctaccaatgtacggactatgacgacgcagctgcatataatactaagtgtgcagaccgactgatacatcgagacgctatactatacactatacttgcggaccttggaccccgtgacggatgtgccgagacgcgagtaatgagagtagtagagccacaaaccattgggcagcagagagccaaagcaatcagagaactcatctgatagatcacccataggacacggggcacacaaactgcattggaggcccgagagcaaagatacatagaaaaatgcgggcgcaaagcaatccaccagccacagcacagagccacctgaggtagaaacctttggtaagaacggggcacgcggagtaccccggcgagaaggccacgattacccccgtaagtggggcggtacgtccgaggatgggatggaagggcgccaaactacgacccgaccagctcgattcacccggtggcggatcgtcaaatgtgggcataactgagccagcggactccacgcaggacacaaggcccaccaaaggccagggccatggacacagtggcctaacgagcaagccccaaccgcggagcccctcggcgacaaaacccgaggccaccaagagacaacagagcaaacacaacacaccaggaccggaggcccaaggactgggaaccaccatggagaaacccacctcctattgaccattcacaacagccaccaccaaacaacaccgggactcgggggctcaaacagagacttcccacagcacgcatggatctgcagcaaacccagctgggaacaacgagcatcgggcacacatgagcgacagcacaggcacagagcaccacgacataacaacagaggacaagggagccaggagcgccagcagaagggggagcaagacagaggcggcatatagacccacccgacgacgaaaaccgccacacacacacagtcacccaccaaaaccaaagcgccaccgcaaccagacgcagcacacctgccaaaaacacacacaaaggaggacggcacctcacccgagacgacgacccgacaacccaaaggcgggagaggacgggccacgcaggaacacccaaaacggacaacgccaggggaagatgagcacgccaccacctgagccgcgccggcagccagacaccagcagcaacaggaacaccgagacgaccggaacgaagacgacgggcccacacgccagccacgacccatccaacaggagcagacgaagacaacgcccgccacgacccgaaagaaaagaaagaagagagacgactgtcggacggacaacaccgactagtcagacaacagacaacaac

SEQ ID NO: 685047 - DNA, 894 bp, Homo sapiens
ccgccgagggaggacatgcggggcctggcgctggcgccgagacgccgcttagcggccgccactggagacactccctcccgcctcccgggtctcctggcggcggccggagtgatggctgacagctggggaacctggtgagacccctcctgccctcccccgcggtggcatgcgggcctgatcccctgcgctcctggctgctgatgggactggcctgcgatgctgctctggcctgagtgttaccctggccctggcccttcctcgcttccctcgactattccacttgctgtctcctgctgccccggctgtcatcctgctgagtccctctgactggtgagtggaacgattgggcttgcactggggatgcttgtgcaagggactgatgcattgtggccccagcatgtgcctgagtgatgtggctcgtgccctgtgctttgcgtgggacacagttgcttctcggtgtctgtgcctacggggctttcttgctgtcaacctgaatgcttgtgtgccttctgaccttgtgggtgccttgtggagcctgaaactggggtacccccggcttggtggttgatccttgggttggggcactttggctgctgctcgtggtgcttgcttgcttgcttgttctctatgcatagtgagcttaccgagctgtgggcacggctgggcaatggcaggccagggcggcccctgcaaaaaaagcgggaagagaggccctgccccacgacaaaggcggggggaggggatggcctgggttagggcctgttgcctgggcctgggcggcccccacggaaagaccttggggcattggctggaagaaaatataccgggaaggcgaggggaacaacgaaacgaaagcaaggaaccgggaaggacaacttggcggagaaggtcaaa

SEQ ID NO: 685048 - DNA, 113 bp, Homo sapiens
taaaaaacttgctctgtaacaaaagggaatggttaatttaattttattttatttttttttcgagatagagtctcgcactgtcgcccaggctggagtgcagtgggcaatctcgg

SEQ ID NO: 685049 - DNA, 192 bp, Homo sapiens
ccgttgggcacgcccgttgtaacaaacatgtagtggctgggcgcggtggctcacgcctgtaatcccaacactttgggaggccgaggcgggtggatcacgaggtcaagagatcgagaccatcctggctaacaaggtgaaaccccatctctactaaaaatacaaaaattagccaggcacggtgcgttggcccaa

SEQ ID NO: 685050 - DNA, 230 bp, Homo sapiens
gcccccttttgttttgggtttttttggggggaattaaggaaaaataagggggggcaggtttggaaaactgcttcccggggatagtttataaaaatcctgcccaaaggagggcccccttttctgttgggataaccaaagggccctttggggggggggggggggcccctttccccctgggggtttttttggggaaggttctccccgaatttcaataaaccgggggccggtga

SEQ ID NO: 685051 - DNA, 171 bp, Homo sapiens
  misc_feature (53)..(53): n is a, c, g, or t
  misc_feature (82)..(82): n is a, c, g, or t
  misc_feature (98)..(98): n is a, c, g, or t
  misc_feature (153)..(153): n is a, c, g, or t
  misc_feature (168)..(168): n is a, c, g, or t
agagaacccaccatggtgctgtttcctgccgacaagaccaacgtcaaggtcgnctggggtaaggtcggcgcgcacgctggcnagtatggtgcggaggncctggagaggatgttcctttccttccccaccaccaagacctacttcccgcacttngacctgagccacggntct

SEQ ID NO: 685052 - DNA, 170 bp, Homo sapiens
aacagaccaacatagagctgctacaactactcaaagtagctgtgcggactattgtagatgctgtcccacaaccctatttggtcccattactgagccgtacgcacgaccatgcagcaagtgaacgctgacctccgcactcagcgcattatggttgactactttagtactcc

SEQ ID NO: 685053 - DNA, 663 bp, Homo sapiens
  misc_feature (87)..(87): n is a, c, g, or t
  misc_feature (91)..(91): n is a, c, g, or t
gtttctttaataaacagcttaaaagagcaaggctagactgggaagagggtcaactcttgctattgttatgctataatgctcaggtcnaagnaatcaatgaagtctaacagtgtctacatatagcagtgataggtgtagtattagacatatagatgtatagatatataaagtacatggtatgaaaagcatgccgtgctaatatgaacagatataaagtatgtcacttctcgtgtactaccatcataaagatcgatttccagtatgcctgtcgcctggcatcattaacacactcctcatatggtctatgttgaccatgaatcatcacccggtgatgccaggagactccgcatatgtgtagattcagcgcctagaggtccgccctaccctgtgtgctgtgtgttaccatgactccagaaataatgaatcgcaacctgcattattaagtccacagctgagtgtcaaatctgactagccacagtagcagcagaggcacatgacgcggcagtttgttataatagcaacaagatttcttataatgcttccagttcaagtcagaattaaggtgacattaggtcccagcagcttaacagagttgtgaatgttatgctgttgttctttcaaatgtacccatcctaaagtaacttgaaactttgtaagatgtac

SEQ ID NO: 685054 - DNA, 355 bp, Homo sapiens
gttagctcttcacaaagattagcttttctcacataaaaccatttcagaatcctaatcctgaggccgggcacggtggctcgcgcctgtaatcccagcactttgagaggctgaggcaagtggatttcttgaggtcaggagttcaagaccaacctggccaacatattgaaatcctgtctctactaaagatacaaaaattagccaggtgtaggggtatacgcctgtaatcccagctacttgggaggctgaggcagaagaataacgtgaacccgggacgcggtgatcacaccattgcactccaaccccgggtgacagtgcaagactctatctcaaaaaaaaaaattgatgttagtgagaa

SEQ ID NO: 685055 - DNA, 341 bp, Homo sapiens
  misc_feature (263)..(263): n is a, c, g, or t
cacctagaggaaaaacggcgcctatcgaagctatctgttgtttatcgccgccaccaaccaacaagattctcaaggtcactcaataaacacttgttgacttgagcgaccttgagaaacttgttggctggtgggagagtttgacgcgccccaagattttttaaaattacaatgaaaaaatatattagaaaataaaatacctaatagaagtcattaagagaaatcttaatcactaagaggaaggagcctcacagcactccattgantttttgccttctctcatattgcctaattttaggaaagaatatcatcacccacaattcttaggaaaaatgaaatgggct

SEQ ID NO: 685056 - DNA, 98 bp, Homo sapiens
tttttttttccaaaaacttgggctttaggggtagttcccaaataatgaattttccccggatgggcagaagtcttgtaaaaaaaagcatgtaaagtgta

SEQ ID NO: 685057 - DNA, 161 bp, Homo sapiens
tgctagccatatgaagtacatgactaggaactgttgttggtgtgccatgtcagtcaatatactctgtcagcctatatgttgggaaacgtataagtgatcacatgattactatggggtatagttttgtaggtacgaggtgaggtggggataggagcggtagg

SEQ ID NO: 685058 - DNA, 540 bp, Homo sapiens
gagctctccaggtctcccagcaccaggttcctgttctgagggaaaaacccaaaagggtcaaaagcagttcttgcaaaagagagaagacccccaagtgccctcccctagaagagcggccaaagacaaacacaaagacgaagattcggagctggttggtgtttacgcctggagaaagggacaagctctggtgaggtcgctgcttgggccccctcccgtcctccgcaggcaccatagcaaggatccctcgagagacccggctctcaccgtggacttaggagacagcgagaaagtcatagctgccaaggtgctcaccggtttgtgcccagttgcccgatgccacctccgcccacagtgaccagcaggtgtctgggaacacacccagcctggcttccttcgaccagccagcgaccatacagacggccatggccatcctacaagacctgcgccagcaaatccaggctgggctggagctggcccaggcccgcaagggagggcaagagctcgggccatcaaagcggaggctgcaggacgtggcaggga

SEQ ID NO: 685059 - DNA, 363 bp, Homo sapiens
gtcagtaacctcaatggaacccccgtgctggaaatcacccagggattgggctttcctgcattttgtatcctgggcagaggggtcctgatcattttttcacaggacttggggtttttttcacctacctggaaaaatagattcctccctgactttggtgtcctaatagttcccatgggagcccctttgaccatttggggttcatttatcccccttgagcttctcgggggaattatttttgggggaggggtgttggatcaaataaaccgaaggagggcctgctatgccaggctgcctttcctaaaaatccttgaaaaatttttggacatcagtttagaatcagaatacaatccagccctttcctga

SEQ ID NO: 685060 - DNA, 928 bp, Homo sapiens
  misc_feature (928)..(928): n is a, c, g, or t
aggagaggactggatgcgcctgcagggatcggaagccgtgtagctgtgtgagaggtctactcgcatctcaggggagatccttcaagcaatcactatgtcaatagacacaggtgtgacccttccttcatatgaggaatgactcaggcatcaaaattcattcgatgcgctaaagaggcaccatgtcgaacccgttgtaatagcgggtttggccagcaagtgttgcatatgggtgatattgatgctgaagagctgggtgaaatagctcaggaatgtccatttcatcgtgatccacatgctgtgtgggagggccagtgcgcttgtggtaggagcaatgagtgtggtatgggctatgccatgtatcgggaatacgtagagtgaaaactagagaccttaagactgaagaggatgctgtcgttggtcctggttggagaggagcttgaattaagtgaagatgtctgattatgtaagttgcctattatttgttgggcaataagactattttgtatgggtgtaagatggttacatgggattttgtagtatggggttccatatcttgcagggtttgatttgctgtgggggaccgagttatgagtgaatagtttagtaaacaaggtcattcagggaagtcaggtgagtaaactgttcctaaatgcacttgagggttgtggccttgctacctcgtaaattttagatgacctggctaaggaaaataacgcccaaccgtaggtatcccgttgcggggcagtggaaatgggggcgcaaaggccatatgccggataccttgtgcggtttgagggtgcgcttgtaaccgccacagaggataaaggggcccagggattttgtttaccccgtgaacagggattaaacggaaatcagtggattccaaaacaaatactcttttcctatgtaagtattacattatatattn

SEQ ID NO: 685061 - DNA, 199 bp, Homo sapiens
gattcggcacgcggagagaactaatgctgccacttcacatccactcaccacatcccacctacagactaccaccttcgagatcaggacaacctggaaaatgcagagttggtatgctttcagcattgatttggcagcacaaccctgagggccgtcagctggttagtttctactactcgagtgtccccctgccccacagatt

SEQ ID NO: 685062 - DNA, 965 bp, Homo sapiens
acatcaacgcacgggcgaggaggatgtggagcctgagtgcatcatggagaaggtggccaacggcttcaggtgccacactacagctttcatcaaggagagtggccgcttccaggacgtgggaccccaggccccagtgggctctgtgtaccagaagaccaatgccgtgtctgagattaaaagggttggtaaacgacagcttctgggccaaagcacgagaaggaggaggagaaccgtcggctggaggaaaagcgggggccgaggaggcacaagcggcatgcgtggcagcaggagccgccgggagcgtgagctgcgtgaggctgcacgccgggagcagcgctatcaggagcagggtggcgaggccagccccagaggacgtgggagcaggagcagaagtggtgtccaaggaaccgaaatgagcaggagtctgccgtgcaggcgagggagatcttcaaggcaggaaggaggagggcatgtcaacaactgcattatccagtcctcaggcctggaagctgaggagccccttctgcagaaggagtcaaccaaccagagacccatgtttggcaagaggagccagctgctgccagtctccagggccgagggcagatcttccctgctgaggagctgggccaaagggagtcctcccatggctgctggcagcgcgaaggaaaggggctgagtattgagcgaagcttcaagaggccgaaaccttgtaagaagaagccccaatggtggcaagcagcacgtggtgggtcttgcgtcaaatttggccacacccttcggggcatgggctcaggggaggggtcttgcccggcctgacactacaggcagcgagaacaagattctttaaccgagaaccacaaggcaagagaagaacaaagaggggatgaaagacggatagcaagagatcccacacaggagctcatgcgcgaaacagcccacacaagacactacacacgagagaaatc

SEQ ID NO: 685063 - DNA, 218 bp, Homo sapiens
  misc_feature (132)..(132): n is a, c, g, or t
ctaattggttcttcgatgacgtctgtttcattccactgcccttcaatttaatgaccctgagttcagtggtagaattgtagaattcaaagtcaaagggttagcattgtggattcccagccattcattatgganttgctttttgtatcctaacaacttctttttcagaaaaaatttattataattgatttacagtgttgcgtcatcgaagaaccaattag

SEQ ID NO: 685064 - DNA, 347 bp, Homo sapiens
  misc_feature (45)..(45): n is a, c, g, or t
  misc_feature (50)..(50): n is a, c, g, or t
  misc_feature (61)..(61): n is a, c, g, or t
  misc_feature (68)..(68): n is a, c, g, or t
  misc_feature (82)..(82): n is a, c, g, or t
  misc_feature (107)..(107): n is a, c, g, or t
  misc_feature (232)..(232): n is a, c, g, or t
  misc_feature (328)..(328): n is a, c, g, or t
  misc_feature (339)..(339): n is a, c, g, or t
cattttcccccagtgtgtgtctcccaaacacttgggaatggtgcntgctntttagtttatnccctggnccgaaagccccacngccaaatttgtatcatgattagggncagcagagaattgtgccctccactagggtagccacagatggccatggtgcacttgaaatgtggctagtgtgactgaaaaactgaattttaattttattttaattttaaaagtgatgtttggctanacacggtggctcgcacctgtaatcccagcactttgggaggctgaggctgacagatgcttgagcccaggagtttgagaccaccctgggcaacaaagnaaaaactcatnaccaacaa

SEQ ID NO: 685065 - DNA, 404 bp, Homo sapiens
gtaatataagtgtagttacttctgctggtttgcagcattgcacttgcatgagatatatttttccacgccttcgctttccatctaagcatgtccttgccagtgaagtgcagttcctctttggcaatatacagttgggtcttgtttatttgtttttttaaatagattaatccactcagtcttttcattaaataatttcatacatttactttccagttaatgactgacaggcaatggcctgctatggacattttgttaagaatttttgcatctatgttcatcagggatattggtctgtagtttttcgtcgtgtaacgtccttctctggctttggtatcagggtaatactggcctcctaaaatgagtttagaagtatttcctcctctttagttttttagaagagtttg

SEQ ID NO: 685066 - DNA, 115 bp, Homo sapiens
  misc_feature (3)..(3): n is a, c, g, or t
tgntatattggtgagctgattggtaggggtgctaggaacttgtaattagtattaggaggggggttgttagggggtcggaggaaaaggttggggaacagctaaataggttgttgtt

SEQ ID NO: 685067 - DNA, 1117 bp, Homo sapiens
tggtataaaaacagatccatttctgggtaatcaaagcacatttgttgggtcttcctccaacccttggcatttgatttctaaacattccttcatatgcctttaatggaaagccagcaattaatcccaggggccctacttggaatttatctggaggcagctacagattggccctgcaagatgagttttgggagataaatgaaatacctgggacacacactcacacaagtaacaccacagcaaaccctcggagtacgtgctaaggtataccgtggtgctcaaactccgcacaggactcaatatagcaattaactctctggagtgtatgcaatgtgcccattggataataattatttaacagagcacactaataattggataatacgacttactactatattcaagaactcctggggatagtggatttatacaccattcctccccagtgggggcaacaccttccttccccttccctaggaagggcgaaacctgcgaacacaataaaacacgcctgcaggccggacagaccttgggcatctcccactcatagcgaacgccaccctcctaaaacaaccacaaacgctgaacaagaacgcgccccagcggcgctgaatttctcacccatggcgtcgcccaagaaatccacaggctactaaccaggctcggcactggcgcacacgtcgcaccgctcaacacgtagcagagtaactcccatgggtatcccacagacaggagcccactcaaaaactacccgtggaacctggacctaatctaacgcctatacaacaagaggttgcacgactcatcaccccgaggacaaacacatacccttctagcccccccgtgtgtctaaaacaacctcccaaaaaactacaatcaaccgccccacacataatacacgaaacaaactctccacgacaaccagacagatacccaccatcaaccacatccaaccagggcatcagcaaccagctactacataaccacccacatagcggcatagtacataccaaacccccaaatacaaccagagcgcatatcaaccaacgtcgcgcaaacaacacaaaaaaaacacaaaagaacaagacagcgggtcccccccaccgacgaaagaaccccc

SEQ ID NO: 685068 - DNA, 580 bp, Homo sapiens
  misc_feature (331)..(331): n is a, c, g, or t
  misc_feature (426)..(426): n is a, c, g, or t
  misc_feature (478)..(478): n is a, c, g, or t
tctttcaggggacaggattgggcaacagtatagggtgacttcataggttctgtttcttatgccaggaggggatgtccacgtagttagttacttgatgataaaactttatttatttatttatttatttatactccagcctgggcgacagagcgagactccatctcaaaaaaaaagaaaaataaccttggctagaaataggtcatttgattcttggctaattggcaactctacagtttttgatatacaatgttcaatctgatgtgcaaggcaattgtatctcgcaaagaatttgagaatttgaaatgtcgcacacattttaccacacaaacangtgaattaaacttttacagaatagtaaaaaagcattgttgagcaaaataaattaaatgaaaagacataaaggaataactagtgatgaaatagcantaagaacgggaaacatgaaagagctgcttttaaagcaatgttagaagcacanaataactgattttttagaatcgtactggagtccaaatcacttttaccacatctaatttacatagtgaaagattgtaaacggatcatgatgcacacttgcacg

SEQ ID NO: 685069 - DNA, 317 bp, Homo sapiens
gggtatacggtatttaagctctaggagatacctatagaggctacatcctatgcgtcaccgccacatagtgaggaggtctaggtattgacgcaaagcggacgctcgaaatggtgagcctatttaaaagcaaagatttagaagaaaagaaagaagaaaagatactctatgtgactgatccacaaaaaggtgcccacgaaagtgaactctttgctagtagcactatctgtacttacaaaagaagcatgactgtgcgactaatgccagagaacagtgagaacatatccaaaaagtgttatctcctgacagccaaacggaac

SEQ ID NO: 685070 - DNA, 302 bp, Homo sapiens
  misc_feature (282)..(282): n is a, c, g, or t
  misc_feature (289)..(289): n is a, c, g, or t
aaatatgattcacataccattcactttatttattgaaatctgcaattcagtaggttttagaatattcacagagctgtgcatcgatcaccacagtcacttttagaacctttcattaccctatagagaaatccataccccttagccactacctcctactctccccacctaccttcacccccagccttaggcaaccattgattaatttttttgtcactataggtttgcctaatctgggacaaataggaattgtacaatatgtggatcctttgtgggctttttttncctgttnggacagtgttttc

SEQ ID NO: 685071 - DNA, 423 bp, Homo sapiens
ccaagcaaaggttacgggggggcctataaaatggcaaaaggtttaaaggtctaagctcccccgttggggcgagaataaaaaaaacggcccctggggcaaataaccccccccccccccggcccatgggctggggccttgtctctgggaaataaatatttaaaaggacggcatgggcctcaacctccccttaaaggcctttaaaaccaaaggaaaccgaaattctttccccccccgtggagagttttccaggaaactttttttcccttaaggacattccccgtgagcctttataaaaaaagggttttaggtcccccccttttcccccccccattttcattgggactttcagttttcctttttaaacccccccccctccccttagccatgttttttgggaagtaaaaaacttggtttagggccggg

SEQ ID NO: 685072 - DNA, 160 bp, Homo sapiens
actggctcaagtcatgaaagcaggcattcagcaaacaaacaccaaacaccaaaaccagtcaaacagcaaaaggccccaagcagcagccaacagcatcaccttttgcaatcagcaggttccagcaccagcagcacatcagcaacaacccaccacatcagtg

SEQ ID NO: 685073 - DNA, 259 bp, Homo sapiens
gtactatgtctggactgtatgtcatggtgaccctgtcactgccctgatttacagaaataaatttgaaaaatcggcagtctgatcaataaaatattgtgataaaaaagagccccaatatgggctctttttttgacctttttgccatttaggcagtcaggcttttacggatttcatcttcaatgatactgatttcaatctggctaaatttgcggatttcgccttccgcatgtttttccagcatgccgccgacctaatggca

SEQ ID NO: 685074 - DNA, 228 bp, Homo sapiens
ccaattaaaagacttggacttggcaaattggataacgagtcaagactcatcagtgtgctgtattcaggagaccctatcttatgtgccaagacacacatagggttcaatataaaggggtggagggataatttaccaggcaaattgtaaagcaaaacaagggccagggattgacatcctagtcttcgaacacaccagcacttgaacccaacacaggtccaacacggacaa

SEQ ID NO: 685075 - DNA, 476 bp, Homo sapiens
  misc_feature (173)..(173): n is a, c, g, or t
  misc_feature (182)..(182): n is a, c, g, or t
  misc_feature (197)..(197): n is a, c, g, or t
  misc_feature (202)..(202): n is a, c, g, or t
  misc_feature (210)..(210): n is a, c, g, or t
  misc_feature (213)..(213): n is a, c, g, or t
  misc_feature (216)..(216): n is a, c, g, or t
  misc_feature (218)..(218): n is a, c, g, or t
  misc_feature (223)..(223): n is a, c, g, or t
  misc_feature (228)..(228): n is a, c, g, or t
  misc_feature (231)..(232): n is a, c, g, or t
  misc_feature (234)..(234): n is a, c, g, or t
  misc_feature (236)..(236): n is a, c, g, or t
  misc_feature (250)..(250): n is a, c, g, or t
  misc_feature (430)..(430): n is a, c, g, or t
aggaattttcttgaagatggagaaagtgatggctttctaagatgcttctttcttaactctgggtggattttaagtataaattttgttctattggtgatggtattggtttggatttgttgtgtaactgttgctatagctgtggagcagtatgtttcttttgaaagctgagtatntatggtganttggagtttatgaangaaanaaagttanaanagnanatcangtttnttnntntngtggttgttagatntaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatcnaataaagttactcaaatctgtgaagactgtatttgctataacttat

SEQ ID NO: 685076 - DNA, 287 bp, Homo sapiens
agtgatgacgagcccggccgctctacgttcctccccgaacgaaacgaaagcctgccgccatgagcgcaaccgccacagccacgcctacagacggccgcgccgtcggtacggccatcgcctgctacaccctgtgggggctgctgccgctgctgttcatggccatggccgctcatgggttcacggcgcctgagatattggcgcaccgggcggtctggtcggtgttcatcgccgccatcgtcctgctgctggcgggccagtcggccgaggcgcgcaaggccctgtccaat

SEQ ID NO: 685077 - DNA, 473 bp, Homo sapiens
gctcggacccactttccgagtagctattatactagcgtttaccatctcacttctaggaatactagtatatcgctcacacctcatatcctccctactatgccaaggtggggataagtgtggtttccaagaagatataaaatatgaataatactatcgctggtcattatagctactctcataaccctcaacacccactcccttttagccaatattgggcctattgccatactaatctttgccgcctgcgaagcaacggagggcctagccctactaatctcaatctccaacacatatggcctaaactacgtacatagcctaccccttccttggactatccctatgaggcataattataacaagctccatctgcctacgacaaacagacctaaaatcgctcattgcatactcttcaatcagccacatagccctcgtagtaacagccattctcatccaaaccccctgaagcttcaccg

SEQ ID NO: 685078 - DNA, 468 bp, Homo sapiens
  misc_feature (219)..(219): n is a, c, g, or t
  misc_feature (267)..(267): n is a, c, g, or t
  misc_feature (353)..(353): n is a, c, g, or t
  misc_feature (365)..(366): n is a, c, g, or t
  misc_feature (369)..(369): n is a, c, g, or t
  misc_feature (372)..(372): n is a, c, g, or t
  misc_feature (383)..(383): n is a, c, g, or t
  misc_feature (399)..(399): n is a, c, g, or t
  misc_feature (401)..(401): n is a, c, g, or t
  misc_feature (410)..(410): n is a, c, g, or t
  misc_feature (449)..(449): n is a, c, g, or t
ttggtagagccaaaaattcaacaagggagtaaagaagttcctccaaggtgggttttgctcaggacaggcagacatttcttgtggctagaagtgagtggcaacaggtcctccggcagtgatgagctacctggcctcaggagcattcaagtagaccgaaggccatgggaggttccagaagctggagcaacaggccaggcttggatcattgtgaaggccttnctggggcagcaggtgtacactctgcttcatgagaagaaagtccctgangggagaagtgagttttgtccaaggagtttggaagagaaaccttcagggacagaggacagccaacaagtttacttctgaacttgggntcgtttgaaaannttnaanggccaaagccnttcctttttattgccncntttgttttnagaaaaaaggggccttttttgggccccaaaaaccggttnttaaaaaaaaaggcttggg

SEQ ID NO: 685079 - DNA, 166 bp, Homo sapiens
  misc_feature (16)..(16): n is a, c, g, or t
ggggtccccaagggcncccgggccccccaaagggttttgggttttttttttttccccccttgggggaaggggggggggggggcccccccccccccccctggggtccctttttttggggggggggggcccctttttttttttttttcaataaccctgggggggggga

SEQ ID NO: 685080 - DNA, 889 bp, Homo sapiens
ggccaccgtcggtccgctaagtctgagtcctgtgctttctctctccccgagtacagcatgagcttcacctactcgtctccaccttctccgtcaagtaccggtccctgggctctgtccaggcgcccacgttactgccgcccggagcgggttccagcagctgcggggcccgctgtctatgctaaggcgctggggtgctcgtggttcccggattctccgtgtcccgctccggcctggcttcagtgggtcgggatggggtccggggggcttggtcgcgctgggatagcgcgggggtctgggcggaattgggatgcgtccgagcaatgatgataggagagcatgtcgagccttggtcgaacgactggccctctttcactctaggacaggagtagaccggagcctggcagaccgagaatcggactggctcggagagcagacagactctccgggagcactgttggagaaaggacagggacccacagggtctactagactgggagaccattagcttctgagatgctatgcagagtggacactagacgggctcaggatctatctgccaagagtaactgtaggacagatagtcctcggcatcagtaccttgcgagcattgtagtggagccctgtcttgcatgctggatgagattccatggagtcccgtcatgagacatgaactggccgatgcgccagatctgtggacgagctgacttccatggtggtccgacataggatcgtggatgatgccaagtgtcatacgagtgaagctggaagacagacgaatcgcggctctcaaggaggagctgctcttcattgaggaagaacccgaagaggacgtaaaaagggggtaagaggccaaaatggcaggtctgggttgaccggaaggaagatggcc

SEQ ID NO: 685081 - DNA, 386 bp, Homo sapiens
ctccaaaattcaaaaaaaaaaaaacctcaaaagttgggacctggtattatccattccattccacctattctatttcaatcaataagggattccctgagcaccaacggggatggcaagcacggtgcttaagtgtcgaggataaaaagagaacaacactttctggccactaaaagaaagccttatagtccagaacaagaaatgagactttttccctttcccatgtccagtccctaggattatctttaatattttctcttttcccaattcttttttcctgggtggggggggcagggtctggctggtttcacccagtcgggagtgcaggggagagatcagggctcacggtagccttgacctcctaggctcaaaggatcctcccaattcag

SEQ ID NO: 685082 - DNA, 524 bp, Homo sapiens
attctcagaagcattcttgctggcatgtccatggctgtcatcctggcactctgctcactagtggtggactccttcagcagagtagtagatgatgttggacagatatgtattcttgagtaatttatgcagacacgtcagaaatcaatatcagtcataagatactcatagctgtcagcaacttgcaactggtattaagggcaaaagatgggcttttcttctcgtcttataggcagcatgacagacctagaattcattaacagatgatggagccttcatcaaattcatatccagaatttagtaattcaagggcaatgactgacgcatctccaatagtggggggctttcttcccacttccttgaatgccaccagaaactggtcagaatgagtcctataaagtatgcctctgatatagtcaccaattccaacaagcatcacttctttcccagctgctgttagtgtagcaaactcgctaatccatctgttaagcaatggaggaatgaatagaaccacacagtcctcgatc

SEQ ID NO: 685083 - DNA, 907 bp, Homo sapiens
tgtagtggctcacacctgtaatctcagcactttgggaggccgaggccggggatcacctgagattaggagttcaagaccagcctgaccaacatggagaaaccccgtctccactaaaaatacaaaattagccgggcgtggtggacattcctgtaatcccagctactcgggaggctgacgctggagaatcgcttgaacccggggggcggagggttgcaatgagccaagattgcgccattgctctccagcctgggcaacaggaggcaacaaacctctgtctcaaaaaagcgcagagtaaggcctcaaatataacagggccattattcctctatgtcttctgtatgaaaggccacaaaggaaactgcttaagaagttcaggacctctattttacatcaagaatcttatacattttcaatcagatgcagtaccggaatctgcgaaacagtccgtgaatcccacatgccaagagatgttgagaagaaccgccattcaaatgtggcacacggattgaaacagacacttctcgggagacgacattatggagccacaaacaatgaaaaagctccacttacctgattcatcagagaacatgccaatcaaaaccacaatgagatacatctcatgccagtagaactgggccttattaacacgtcaaggaccatgatgctgtgtaggcgtgacaactcgactgtttaacccgtggtggtaaagttataatcaccctgtgagcagaatgcaaccacaggttgacccgaatcactggccaacaccctttggttttccaggaagatcttccttataatcacagtggatcgcatcacaacattccaccgcctgtaggtaaaggcttcaacggtcgcacaaagagttggtggagagcaccaccacacatcgtaaaaacatgtgctc

SEQ ID NO: 685084 - DNA, 5097 bp, Homo sapiens
actttagctctctggccggcgcctctgttgcccggaagggaggcaagcccccttagagttgccagtaacggacatggctgcggcccccggaggaggggacgtgaagtgaggagggggttgggaggggagaggacgcgggcgaggaagaccagccccggggccccgatgttgtgactgtgacagactcactggggtttgtacatgctggggaggagccttcctttcaggggtgaccacattcatctgggcatgcctgcagtactcttggcccatggacctgaaggagaagcacctgggcgagcctccctcagccctgggcctgtccacgcggaaggccctcagcgtcctgaaggagcagctggaggcagtgctggaaggacatctcagggagcggaagaagtgtctgacgtggaaggaggtgtggagaagcagcttcctccaccacagtaaccgctgctcctgcttccactggccgggggcctcactcatgctactggccgtgctgctgctgctgggctgctgcgggggacagccagccgggagccgtggggtggggctggtgaatgcctcggccttgttcctgttactgcttctcaaccttgtgctcatcgggcggcaagaccggctgaagcgtcgggaggtagagcggaggctgcgagggatcattgaccaaatccaagatgccctcagggatggcagggagatccagtggcccagtgccatgtatccagacctccacatgccttttgcgccatcctggtccttgcactgggcctacagagacggacacctggtcaacctgccagtcagcctgctggttgaaggagacatcatagctttgaggcctggccaggaatcgtttgcttctctgagggggatcaaggatgacgagcacatcgtcctggagccgggagacctcttcccccccttctcccctccaccctcaccccggggagaagtggagagagggccacagagcccccagcagcaccggcttttccgtgtccttgagacccctgtgattgacaacatcagatggtgcctggacatggccctgtcccgaccagtcactgccctggacaatgagcggttcacagtgcagtcggtgatgctacactatgctgtgcccgtggtcctggccggcttcctcatcaccaatgccctgcgcttcatcttcagtgccccgggggtcacttcctggcagtacaccctcctccagctccaggtgaatggcgtcctgcccatcctccccctgctctttccagtcctctgggttctggcaactgcctgtggagaggcccgtgtcctggcccagatgagcaaggcctcacccagctccctgctggctaagttctcagaggatactctcagcagctatacggaggctgtctcctctcaggaaatgctgcgctgcatttggggccacttcctgagggtgctcggggggacatcgccaacgctgagccacagttccagcctgctgcacagcctgggctctgtcacggtcctgtgctgtgtggacaaacaggggatcctgtcatggccaaatcccagcccagagactgtactgttcttcagcgggaaggtggagccccctcacagcagccatgaggacctcaccgatggcctatccacccgctccttctgccatcccgagccccatgaacgagacgccctcctggctggctccctgaacaacaccctgcacctttccaatgagcaggagcgtggcgactggcctggcgaggctcccaagccccccgagccctattcacaccacaaagcgcatggccgcagcaaacacccatctggctccaacgtgagcttcagcagggacaccgagggtggtgaagaagagcccagcaagacccagcctgggatggagagcgacccctacgaagcagaggactttgtgtgtgactaccacctggagatgctgagcctgtcccaggaccagcagaacccctcctgcatccagtttgatgactccaactggcagctgcacctcacctccctcaaacccctgggcctcaatgtgctgctgaacctgtgtgatgccagcgtcaccgagcgcctgtgccgattctccgaccacctgtgcaacattgccctgcaagagagccacagcgccgtgctgcccgtccatgtgccctggggcctctgcgagcttgcccgcctcattggcttcactcctggggccaaggagcttttcaagcaggagaaccatctggcgctgtaccgcctccccagtgccgagacaatgaaggagacatcgctggggcggctctcctgtgtcaccaagcggcggcctcccctcagccacatagatcagcctcttcattaaagacaccaccaccagcacagagcagatgctgtcccatggcaccgctgatgtggtcttagaggcctgcacagacttctgggacggagctgacatctaccctctctcgggatctgacagaaagaaagtgctggacttctaccagcgagcctgcctgtctgggtattgctctgccttcgcctacaagcccatgaactgcgccctgtcctctcagctcaatggcaagtgcatcgagctggtacaggtgcccggccaaagcagcatcttcaccatgtgcgagctgcccagcaccatccccatcaagcagaacgcccgccgcagcagctggagctctgacgaagggatcggggaggtgctggagaaggaagactgcatgcaggccctgagcggccagatcttcatgggcatggtgtcctcccagtaccaggcccggctggacatcgtgcgcctcattgatgggcttgtcaacgcctgcatccgctttgtctacttctctttggaggatgagctcaaaagcaaggtgtttgcagaaaaaatgggcctggagacaggctggaactgccacatctccctcacacccaatggtgacatgcctggctccgagatccccccctccagccccagccacgcaggctccctgcatgatgacctgaatcaggtgtcccgagatgatgcagaagggctcctcctcatggaggaggagggccactcggacctcatcagcttccagcctacggacagcgacatccccagcttcctggaggactccaaccgggccaagctgccccggggtatccaccaagtgcggccccacctgcagaacattgacaacgtgcccctgctagtgccccttttcaccgactgcaccccagagaccatgtgtgagatgataaagatcatgcaagagtacggggaggtgacctgctgcctgggcagctctgccaacctgcggaacagctgcctcttcctccagagcgacatcagcattgccctggatcccctgtacccatcccgttgctcctgggagacctttggctacgccaccagcatcagcatggcccaggcctcggatggcctttctcccctgcagctgtcagggcagctcaacagcctgccctgttccctgacctttcgccaggaggagaccatcagcatcatccggcttatcgaacaggctcggcatgccacctatggcatccgtaagtgcttcctcttcctgctgcagtgccagctgactcttgtggtcatccagttcctttcttgcctggtccagctgccgccactcctgagtaccaccgacatcctgtggctgtcctgcttttgctaccctctgctcagcatctctctgctggggaagcccccccatagctccatcatgtctatggcaacggggaaaaacctccagtccattcccaagaagacccagcactacttcctgctctgcttcctgctcaagttcagcctcaccatcagctcctgcctcatctgctttggcttcacactgcagagcttctgtgacagctcccgggaccgcaacctcaccaactgctcctccgtcatgctgcccagcaacgacgacagggctccagcctggtttgaggactttgccaatggactgctgtcggctcagaagctcacggccgccctgattgtcctgcacactgtcttcatttccatcacccatgtgcatcgcaccaagcccctgtggagaaagagccccttgaccaacctctggtgggccgtgacagtgcctgtggtgctgctgggtcaggtggtccagacggctgtggacctgcagctgtggacacacagggacagccacgtccactttggcctggaggacgtgcccctgctgacatggctcctgggctgcctgtccctggtccttgtggtggtgaccaatgagatcgtgaagctacatgagattcgggtccgagtccgctaccagaagcgacagaagctgcagtttgaaactaagctgggcatgaactctcccttctgagccactggctgtggtggctgtagttgcccccgtccctggggctaaagccagacccatttctgaacaggggagtttgtatcatgaatgtttccaggtttgctcctgcacccgtggcactggaaacccagctccccgtgtcagaccccgctgtcttcctgagccctggggctcactgtggaggagctgacggcctgggcccttggccagtcctggctcttccctgggcctcaccagggacactcttgaatgtatggcctcaggcgctccctagagggggcctaaaccccctcacctgtgagctaccccctttagggatcccttgcccccttggagatcccttgccccccagtgcctctgctcgtgggtccctggacacggccttgaagccaaccttctttggaggagcaacagcagcagccttggccgacgcgtccaactcccaaggctgccgtggagggcaggggggtggtgcttgcctggatgtggccccgagtgcctcccctccctccctctgtgggggagtctcccgcctgaacctgaagatggagcagggcccccgcttcgccctggagcctcttcctgtgcctggctcaagctggctgcctgtcagtcttggggaatctggcccaggtctcctcagcctctgccccagttctgggagaagtttctactggtgtatattttttactggaaatgagccttttaggaatgaatgtagactggtttgtattaaaatgtgtcaattgctaagaaa

SEQ ID NO: 685085 - DNA, 864 bp, Homo sapiens
attagtcccctggacccaatccgtcatctactctacgcatggctttgcagggcacactgcatcagagcgctaatgctcgcactgattgtttgacctgagtaggcctgaagaaataaacatgctagcttggattgccagtattctaaccaaaagaataaacgcctcggttccgacaggaaggcgggcatcagagtatttccatcaggcaagcaagcgcatccagtaatccctttctagtatgctatcctcttcaacaatatacgtctgccggacaaatgaacgcagtaagcaatactaccagagtcgaatacgtcatcatctaataatcatgaatggctatagcaataaaactaggaagtagccgcctttcacttcggacgtcccagaggttacccaaggcagcccctctgagatcgcggtctgctacttctcacatgacaaaaactagcccccatctcgaatgcatatgaccaaatcgtctccctgcagtaagggtaagccttctcctcactctctcaagcttatccatcatagcaggcagttgaggtggattaaaccaaaccgagttacgcaaaatcttgagcatactcctcaattgacccacataggatgagtaatagcagttctgaccgtaacaaacctaaaaataatcattcttaatttaacgtattatattatccgtaactactaagcggattcctaataactcaatataaatcagcaccagacctataatattcgactgaaaaagtaaaatgattacacctattcgtcacttcttcctagaggcggccgtaacggtttgccagggcttgaaatccaaaaaggttttcccattaaacaaaccttaccatttcaaagata

SEQ ID NO: 685086 - DNA, 584 bp, Homo sapiens
  misc_feature (20)..(20): n is a, c, g, or t
  misc_feature (28)..(28): n is a, c, g, or t
  misc_feature (65)..(65): n is a, c, g, or t
  misc_feature (77)..(77): n is a, c, g, or t
ccaatccctccttcctcctngggggccntgcccggccccttgtttaaggatctttgccaacctgnactttattctcntgccccaccagggtccgagtccgctaccagaagcgacagaagctgcagtttgaaactaagctgggcatgaactctcccttctgagccactggctgtggtggctgtagttgcccctgggtccctggacacggccttgaagccaaccttctttggaggagcaacagcagcagccttggccgacgcgtccaactcccaaggctgccgtggagggcaggggggtggtgcttgcctggatgtggccccgagtgcctcccctccctccctctgtgggggagtctcccgcctgaacctgaagatggagcagggcccccgcttcgccctggagcctcttcctgtgcctggctcaagctggctgcctgtcagtcttggggaatctggcccaggtctcctcagcctctgccccagttctgggagaagtttctactggtgtatattttttactggaaatgagccttttaggaatgaatgtagactggtttgtattaaaatgtgtcaattgctaagaaa

SEQ ID NO: 685087 - DNA, 147 bp, Homo sapiens
tttgggggcccccccctatgggacccggggtcgaaggggcctgtaccctttgtcatttcctttttagcccctgcatttcccacaagtccaaggtgacagctggtgctaggggggtggggttaataaatggcttttccttttctccca

SEQ ID NO: 685088 - DNA, 101 bp, Homo sapiens
gcactctgcccattgatgagtcaacacatccacttgaaggtgattgagcagcggccagaacctccggtggcccaggagtatgatgtacctgttttacaaag

SEQ ID NO: 685089 - DNA, 832 bp, Homo sapiens
  misc_feature (740)..(741): n is a, c, g, or t
  misc_feature (761)..(761): n is a, c, g, or t
  misc_feature (763)..(763): n is a, c, g, or t
  misc_feature (766)..(766): n is a, c, g, or t
  misc_feature (772)..(772): n is a, c, g, or t
  misc_feature (776)..(776): n is a, c, g, or t
  misc_feature (784)..(784): n is a, c, g, or t
acggctaggtacgaggctgggtgtgaatcggccgaggcgtaagtgcttcctcttcctgctgccataggtggcatgccgagcctgttcgataagccacctatggcatccgtaagtgcttcctcttcctgctgcagtgccagctgactcttgtggtcatccagttcctttcttgcctggtccagctgccgccactcctgagtaccaccgacatcctgtggctgtcctgcttttgctaccctctgctcagcatctctctgctggggaagcccccccatagctccatcatgtctatggcaacggggaaaaacctccagtccattcccaagaagacccagcactacttcctgctctgcttcctgctcaagttcagcctcaccatcagctcctgcctcatctgctttggcttcacactgcagagcttctgtgacagctcccgggaccgcaacctcaccaactgctcctccgtcatgctgcccagcaacgacgacagggctccagcctggtttgaggactttgccaatggactgctgtcggctcagaagctcacggccgccctgattgtcctgcacacttgtccctggtccttgtggtggtgaccaatgagatcgtgaagctacatgagattcgggtccgagtccgctaccagaagcgacagaagctgcagtttgaaactaagctgggcatgaactctcccttctgagccactggctgtggtggctgtagttgccccgtcctggggnnaagccgaccttctgacgggngntgntctggntgtnccggttgncctgccggctggacctcccggttaccctttctctcccgggcctggggc

SEQ ID NO: 685090 - DNA, 981 bp, Homo sapiens
cctcctgagaccctgtagatgtccaggacccagcaccccaaggctgcaggcctcaccttgagtcggccaaattcacaggccaggtccaggggcgtcttcttggccttgttgaccaggcatgggttggactgatgctggaggagcatttctgacacctcataatgtccatactgtgcagccaggtgcagggggatctgtccgtccagcgaggcggcattgacagccgcagaggcgcgcagcagcagcctcacaggctccagccggccctgccaggctgcgtagtgcagcgggcgcatgccattgctgtccttgatgtcaacagtggcctgagcctctagcagcaaggctatgagctccaggctgccccccaaagcagcgtggtggagggcagagaatccatcagcatcctggtagttcacgttgagcctctttgtggagcccaggagctttgtcttgtggccttgaccttcgccaccagtttctgcacaccggtcacatctccattcttgacggcgaggatcaggtcctgttcacgacccatactggctcctgggctgagctctacactcaggagtccagggcaaaggcaggcaacgggtccaagctggggcgtcagggcgccatgccacagccccttggagggctcccggttccgggggagcaagtctggtgtcccaggcagtgggctcctcgtcaggtactgagggatactcccaaaggtgctccgtgaactgccaccacacgaaggaaagctaatctttgagggggtgaaggctacatggaaatctggatggatatcagcttgtggcttccgacagctccaggatgggctgggactgggcacaccaatcttcccggcttggctgtggaacaccagtgcccacccagagagcagccagcattcccttgggcctcaggcagcagcggtgcactggtctcagggctctctcccgccgcccgccgggtccggctgcctgctcg

SEQ ID NO: 685091 - DNA, 221 bp, Homo sapiens
ttacatatacgactcgagctgtagtacccctcggatagggccaataagatggttattatagcttgtattccatatgtgccatgagattaagtagagacatgaaaagtattttttagaagactgaaaatgggccgggtgcagtggcgtcatggctgtaatcccagcactttgggaggccgaggtgggcggatcacttgtgaagctatattggccttatcgag

SEQ ID NO: 685092 - DNA, 826 bp, Homo sapiens
  misc_feature (782)..(782): n is a, c, g, or t
  misc_feature (804)..(804): n is a, c, g, or t
  misc_feature (812)..(812): n is a, c, g, or t
acacactctcagctgtctccgtctcttctctcctcttctctctctctctcttttcaccctccccgcttcgagggaggtgttggaagttcttgcagctgactgcttgtggctcagactctggcccatgctctttaagcaggcagagctatggatgccccatcagggcaaaggcaacaaaggcgagcctccctcagccctgggcctgtccacgcggaaggccctcagcgtcctgaaggagcagctggaggcagtgctggaaggacatctcagggagcggaagaagtgtctgacgtggaaggaggtgtggagaagcagcttcctccaccacagtaaccgctgctcctgcttccactggccgggggcctcactcatgctactggccgtgctgctgctgctgggctgctgcgggggacagccagccgggagccgtggggtggggctggtgaatgcctcggccttgttcctgttactgcttctcaaccttgtgctcatcgggcggcaagaccggctgaagcgtcgggaggtagagcggaggctgcgagggatcattgaccaaatccaagatgccctcagggatggcagggagatccagtggcccagtgccatgtatccagacctccacatgccttttgcgccatcctggtccttgcactgggcctacagagacggacacctggtcaacctgccagtcagcctgctggttgaaggagacatcatagctttgaggcctggccaggaatcgtttgcttctctgagggggatcaaggatgacagcacatcgncctggaacccggaaaacttttncccccttntcccttcaacctta

SEQ ID NO: 685093 - DNA, 380 bp, Homo sapiens
gcatccctggcacctgtgtctgcatctgtagttttgagagcttgcaccctgcctcccttccttaagcatttacatcacgcccttgcaaaaagctcccctcatcccaacattaaaataaaaaaaaaaagacacaggcttgtggggggagataaaagcctgtcctcctaggctgggctcccaaataacctcccgccccctccccacccccgctccctctttttattctgatcactcgccttttcttcaaaggcctcctttctggaagaggaattgtgcatactttgtctcaaacatgctgtattttttgttaacagcagcactgcaccaaaagagatcaaatggggggcagggaaaaaagaaaaaagaaccccccccccaca

SEQ ID NO: 685094 - DNA, 10133 bp, Homo sapiens
actttagctctctggccggcgcctctgttgcccggaagggaggcaagcccccttagagttgccagtaacggacatggctgcggcccccggaggaggggacgtgaagtgaggagggggttgggaggggagaggacgcgggcgaggaagaccagccccggggccccgatgttgtgactgtgacagactcactggggtttgtacatgctggggaggagccttcctttcaggggtgaccacattcatctgggcatgcctgcagtactcttggcccatggacctgaaggagaagcacctgggcgagcctccctcagccctgggcctgtccacgcggaaggccctcagcgtcctgaaggagcagctggaggcagtgctggaaggacatctcagggagcggaagaagtgtctgacgtggaaggaggtgtggagaagcagcttcctccaccacagtaaccgctgctcctgcttccactggccgggggcctcactcatgctactggccgtgctgctgctgctgggctgctgcgggggacagccagccgggagccgtggggtggggctggtgaatgcctcggccttgttcctgttactgcttctcaaccttgtgctcatcgggcggcaagaccggctgaagcgtcgggaggtagagcggaggctgcgagggatcattgaccaaatccaagatgccctcagggatggcagggagatccagtggcccagtgccatgtatccagacctccacatgccttttgcgccatcctggtccttgcactgggcctacagagacggacacctggtcaacctgccagtcagcctgctggttgaaggagacatcatagctttgaggcctggccaggaatcgtttgcttctctgagggggatcaaggatgacgagcacatcgtcctggagccgggagacctcttcccccccttctcccctccaccctcaccccggggagaagtggagagagggccacagagcccccagcagcaccggcttttccgtgtccttgagacccctgtgattgacaacatcagatggtgcctggacatggccctgtcccgaccagtcactgccctggacaatgagcggttcacagtgcagtcggtgatgctacactatgctgtgcccgtggtcctggccggcttcctcatcaccaatgccctgcgcttcatcttcagtgccccgggggtcacttcctggcagtacaccctcctccagctccaggtgaatggcgtcctgcccatcctccccctgctctttccagtcctctgggttctggcaactgcctgtggagaggcccgtgtcctggcccagatgagcaaggcctcacccagctccctgctggctaagttctcagaggatactctcagcagctatacggaggctgtctcctctcaggaaatgctgcgctgcatttggggccacttcctgagggtgctcggggggacatcgccaacgctgagccacagttccagcctgctgcacagcctgggctctgtcacggtcctgtgctgtgtggacaaacaggggatcctgtcatggccaaatcccagcccagagactgtactgttcttcagcgggaaggtggagccccctcacagcagccatgaggacctcaccgatggcctatccacccgctccttctgccatcccgagccccatgaacgagacgccctcctggctggctccctgaacaacaccctgcacctttccaatgagcaggagcgtggcgactggcctggcgaggctcccaagccccccgagccctattcacaccacaaagcgcatggccgcagcaaacacccatctggctccaacgtgagcttcagcagggacaccgagggtggtgaagaagagcccagcaagacccagcctgggatggagagcgacccctacgaagcagaggactttgtgtgtgactaccacctggagatgctgagcctgtcccaggaccagcagaacccctcctgcatccagtttgatgactccaactggcagctgcacctcacctccctcaaacccctgggcctcaatgtgctgctgaacctgtgtgatgccagcgtcaccgagcgcctgtgccgattctccgaccacctgtgcaacattgccctgcaagagagccacagcgccgtgctgcccgtccatgtgccctggggcctctgcgagcttgcccgcctcattggcttcactcctggggccaaggagcttttcaagcaggagaaccatctggcgctgtaccgcctccccagtgccgagacaatgaaggagacatcgctggggcggctctcctgtgtcaccaagcggcggcctcccctcagccacatagatcagcctcttcattaaagacaccaccaccagcacagagcagatgctgtcccatggcaccgctgatgtggtcttagaggcctgcacagacttctgggacggagctgacatctaccctctctcgggatctgacagaaagaaagtgctggacttctaccagcgagcctgcctgtctgggtattgctctgccttcgcctacaagcccatgaactgcgccctgtcctctcagctcaatggcaagtgcatcgagctggtacaggtgcccggccaaagcagcatcttcaccatgtgcgagctgcccagcaccatccccatcaagcagaacgcccgccgcagcagctggagctctgacgaagggatcggggaggtgctggagaaggaagactgcatgcaggccctgagcggccagatcttcatgggcatggtgtcctcccagtaccaggcccggctggacatcgtgcgcctcattgatgggcttgtcaacgcctgcatccgctttgtctacttctctttggaggatgagctcaaaagcaaggtgtttgcagaaaaaatgggcctggagacaggctggaactgccacatctccctcacacccaatggtgacatgcctggctccgagatccccccctccagccccagccacgcaggctccctgcatgatgacctgaatcaggtgtcccgagatgatgcagaagggctcctcctcatggaggaggagggccactcggacctcatcagcttccagcctacggacagcgacatccccagcttcctggaggactccaaccgggccaagctgccccggggtatccaccaagtgcggccccacctgcagaacattgacaacgtgcccctgctagtgccccttttcaccgactgcaccccagagaccatgtgtgagatgataaagatcatgcaagagtacggggaggtgacctgctgcctgggcagctctgccaacctgcggaacagctgcctcttcctccagagcgacatcagcattgccctggatcccctgtacccatcccgttgctcctgggagacctttggctacgccaccagcatcagcatggcccaggcctcggatggcctttctcccctgcagctgtcagggcagctcaacagcctgccctgttccctgacctttcgccaggaggagaccatcagcatcatccggcttatcgaacaggctcggcatgccacctatggcatccgtaagtgcttcctcttcctgctgcagtgccagctgactcttgtggtcatccagttcctttcttgcctggtccagctgccgccactcctgagtaccaccgacatcctgtggctgtcctgcttttgctaccctctgctcagcatctctctgctggggaagcccccccatagctccatcatgtctatggcaacggggaaaaacctccagtccattcccaagaagacccagcactacttcctgctctgcttcctgctcaagttcagcctcaccatcagctcctgcctcatctgctttggcttcacactgcagagcttctgtgacagctcccgggaccgcaacctcaccaactgctcctccgtcatgctgcccagcaacgacgacagggctccagcctggtttgaggactttgccaatggactgctgtcggctcagaagctcacggccgccctgattgtcctgcacactgtcttcatttccatcacccatgtgcatcgcaccaagcccctgtggagaaagagccccttgaccaacctctggtgggccgtgacagtgcctgtggtgctgctgggtcaggtggtccagacggctgtggacctgcagctgtggacacacagggacagccacgtccactttggcctggaggacgtgcccctgctgacatggctcctgggctgcctgtccctggtccttgtggtggtgaccaatgagatcgtgaagctacatgagattcgggtccgagtccgctaccagaagcgacagaagctgcagtttgaaactaagctgggcatgaactctcccttctgagccactggctgtggtggctgtagttgcccccgtccctggggctaaagccagacccatttctgaacaggggagtttgtatcatgaatgtttccaggtttgctcctgcacccgtggcactggaaacccagctccccgtgtcagaccccgctgtcttcctgagccctggggctcactgtggaggagctgacggcctgggcccttggccagtcctggctcttccctgggcctcaccagggacactcttgaatgtatggcctcaggcgctccctagagggggcctaaaccccctcacctgtgagctaccccctttagggatcccttgcccccttggagatcccttgccccccagtgcctctgctcgtgggtccctggacacggccttgaagccaaccttctttggaggagcaacagcagcagccttggccgacgcgtccaactcccaaggctgccgtggagggcaggggggtggtgcttgcctggatgtggccccgagtgcctcccctccctccctctgtgggggagtctcccgcctgaacctgaagatggagcagggcccccgcttcgccctggagcctcttcctgtgcctggctcaagctggctgcctgtcagtcttggggaatctggcccaggtctcctcagcctctgccccagttctgggagaagtttctactggtgtatattttttactggaaatgagccttttaggaatgaatgtagactggtttgtattaaaatgtgtcaattgctaagaaatacctgtggctggtctgtaaggccactccagggtctgcccacccccggcggtggctggcaaagggaggcctaaaccttcctccatctacgcgggtgggtccctcaggtctggctcaggcgagacccctagggtcaggggtccccatgtcacagaggcaaacacacagcccagtcacgtggaatggtgttttcattggtgttagttgggggaagaggttaatggttacagagccagggcctgggccaatggggtcaggctctccctgccctcaggtgggcagtcggggctcctgctgtggtccgaagcccctcccccattgtgtcctctcaggcagttgatagaataaattccatttaaaatatatgcatttctctctgcttagaaaataacatttacaattgaaaagttaggacttgtgggatctgttaaccccactgcctcccacccctgctagccctgcctcagtgagggaaggcgggggcaggagctgcctgggcaccaccgctgtgtatttacatgtcctctgtacacctacggagagggggcccggccagacacacgcctcctccagcctctcagggcctgggcaggatggtgggtggcaagaggcattcccttggcacaacttgggacatgggctggggggtacagagaaagcacccccaaagccccacccctacttcctccctgaggagagagctcttaccagggtccctgtccaggagcagggctgtcctgctcaatcgatcaaaccctgggaggggctttgctgagatgcagcggaggtccctcgctagtcaggttctaaggtgggctgccccacaagagctgtggtgcccacagccgcgggctgagtgggaaggggccctgctaggaggggcacttcagcctgaccagcccttggcccgtccctagggtggcaggggcctcttctgtgctggggcaaaggcagtggacttcggcaggtcacagtgggcactgctggagggctcagtccagcatggcgtccagctggtcagccagggcgtcgaacatggtgctgatgtcatccagaatgtgcttggtggaggcgctgggggtgccctcttgctccttggtgccaatgctcttctctgcggctctcagtgcagctgccagggacgagctggtctgctccagtctctgctgggcctggcctgggcccacagtcccagtgctctcaggccgtggaggaggcactgggcgggggccgagccggggcgctagcttagggccagaaaatgccagctgggtgcaggccaccgacacaggcttgggggctgttcctgctccgggcaccttgaggagggcagcaggggcggccgggggttctgtctccccattccaccgactagctgctgagctttccagacctggccctgggcagggcggcactggaggctgcatggcggggctgggagcaaggggggttggaactccttgggctggaaggctgctgggctcgggctggggaaggctagaagctggaggagactcgccaggagttggggaaggcagtggggcagcggggccaggcgtggcactggccactccgaaggccagcagtgcggtctgcagtggctctctctcccggcacttgggcctccgcttaacagtgtctgattccgtgaggttgaaatcgaggccggggggcacgggtgtctctcggggcggggggccagcgggcttcgggcgctgtttgatggtcaggttcccttcctctgcaaacggcagcccttccccagagctgccccgagatgggggcgtcccctcagggcctggctcctcctcctccgtgtctgacgcgggcccagccggggcaggtgggccagggggctctgaggggccagcaggttcactcagtgttcgccttcggggccctgtggccccttccttgggccctgggctcccatctagtggaggtggctccgggctggggccagagacggagctgaggcgcttggggggcgggggcggggggcctttgcgccgggcccgcagggcaaaggactggctgcgaggagtcccccgagctggggttggggtcacgctaggactggtccggacaagggcactgcgtcctggccgccgggtaagggtagcataactgcctagggtgctgcccactggcccttcggcctccccctcagcatccccctctgtgggccaggcggcttaggctgtgggaccggcgcttaggtcgaggcgggtctgggggagtggcagggggcccggccaagtaggagaaggcccagggtgcgccaggaggtggccctggggccgggctagagggtgagccctgggggtacataaaaacatagggtgggggtccttggccaggaagtgaagaacaaagcttaggggccgctctgtgccctctgggaggttcctctcctggggggggctgggatctccaccgctgggctgtggggcaggctgttcctgtgagtggccagacccccgtgagcgtgccccgatgctctcctggctgggagagcgggcaggtgggagggggagtggttcagggccaccccctgccatggccgcctgtagctctgggcttagttcgctgccctggaaggtgaggagccgtgggccagctgtagctgggccttctccgttctccagtccctcgatggccatcagctccggacccttggccagccggcgcccgccttcgctgagggcctccccctgcagcaggccccgccgaagctccgccagccgcttcacccccagcatgagcttcttctgatgcccgagcttgttgaccccaatctcctgcagctcctcccaggtgaggtcggccaccagccccatggagtcgtagccgctgctcaccagctgcttgtggtactgtggcagccccagtgcacacagccactccagcaggtccgttgggatgtagctgggcagccactcggcgatgctgagctgagcgatctctgaggcgatcttcttcctgtgcccaggcttggtcaccccgatggccgtcaggtcctcaggtgtcatgcggctgatggtaggcacatcatagccggcctgcagaaagtgggcagtgtagccctccagctggaactcgcttagccagttatgaatggcctgcgcgtccttcccctccagcagctgttctggccgcacgtcctgggtgaagatctgctccccagagcggcagttggccagagggcggtggctcaggttgtctgccagggacggcgggtggagtcctggcagcacctggtcctctccagcagagggcagtggctgggcgttctcaatcaggaggccagggccatggccattagtgccctcagagctctgcccgctgccggcactgcggatgctgcccacgctgccctcactgcccacactattcctgtcacctgctgggctgtctgggctgaggcccacccgaggaagctggctgtaggtaagagggtgcgggggttcttcggcaggaggctgcggtgtccgggagaagcctgggcgcaggggggtgggtgcggaggggaggcgggctgcagggatgcccacccgcttgctgaccacctcgacaatgcccggggggaagtagcctatgcggtctgtgcccctctggctctcgtggatgtggcccttccagcggccgtcgggatgctgttctagcaccgtgatgacatcccctgcccggacattgagagcagtgggatcgtggaggttccagaaatccttgagcgctcggaccttcaggatccctgaggcctcccgcagtagctgcttgatttcccggctggcctgggaggtggtgaactgattcactatgtccagcgccgtctggttatacgtattccggatgttcacgtccacacctccctccagaagcagccgcaccacctcggtcttgccatacagtgcggcctcgtggagcgccgtacccgtcttggtctggcggttgatctcgatcccagctctcaggagctgcctgatgacttctctgtggccattcttggcagccaagtgcaggggcgtggtgtagttggggtcacacgggtctttggcctcaccctccagcagtgccacacataagtggctgttcagaagcagctgggccaccttgagtcggccaaattcacaggccaggtccaggggcgtcttcttggccttgttgaccaggcatgggttggactgatgctggaggagcatttctgacacctcataatgtccatactgtgcagccaggtgcagggggatctgtccgtccagcgaggcggcattgacagccgcagaggcgcgcagcagcagcctcacaggctccagccggccctgccaggctgcgtagtgcagcgggcgcatgccattgctgtccttgatgtcaacagtggcctgagcctctagcagcaaggctatgagctccaggctgccccccaaagcagcgtggtggagggcagagaatccatcagcatcctggtagttcacgttgagcctctttgtggagcccaggagctttgtcttgtggccttgaccttcgccaccagtttctgcacaccggtcacatctccattcttgacggcgaggatcaggtcctgttcacgacccatactggctcctgggctgagctctacactcaggagtccagggcaaaggcaggcaacgggtccaagctggggcgtcagggcgccatgccacagccccttggagggctcccggttccgggggagcaagtctggtgtcccaggcagtgggctcctcgtcaggtactgagggatactcccaaaggtgctccgtgaactgccaccacacgaaggaaagctaatctttgagggggtgaaggctacatggaaatctggatggatatcagcttgtggcttccgacagctccaggatgggctgggactgggcacaccaatcttcccggcttggctgtggaacaccagtgcccacccagagagcagccagcattcccttgggcctcaggcagcagcggtgcactggtctcagggctctctcccgccgcccgccgggtccggctgcctgctcg

SEQ ID NO: 685095 - DNA, 10085 bp, Homo sapiens
actttagctctctggccggcgcctctgttgcccggaagggaggcaagcccccttagagttgccagtaacggacatggctgcggcccccggaggaggggacgtgaagtgaggagggggttgggaggggagaggacgcgggcgaggaagaccagccccggggccccgatgttgtgactgtgacagactcactggggtttgtacatgctggggaggagccttcctttcaggggtgaccacattcatctgggcatgcctgcagtactcttggcccatggacctgaaggagaagcacctgggcgagcctccctcagccctgggcctgtccacgcggaaggccctcagcgtcctgaaggagcagctggaggcagtgctggaaggacatctcagggagcggaagaagtgtctgacgtggaaggaggtgtggagaagcagcttcctccaccacagtaaccgctgctcctgcttccactggccgggggcctcactcatgctactggccgtgctgctgctgctgggctgctgcgggggacagccagccgggagccgtggggtggggctggtgaatgcctcggccttgttcctgttactgcttctcaaccttgtgctcatcgggcggcaagaccggctgaagcgtcgggaggtagagcggaggctgcgagggatcattgaccaaatccaagatgccctcagggatggcagggagatccagtggcccagtgccatgtatccagacctccacatgccttttgcgccatcctggtccttgcactgggcctacagagacggacacctggtcaacctgccagtcagcctgctggttgaaggagacatcatagctttgaggcctggccaggaatcgtttgcttctctgagggggatcaaggatgacgagcacatcgtcctggagccgggagacctcttcccccccttctcccctccaccctcaccccggggagaagtggagagagggccacagagcccccagcagcaccggcttttccgtgtccttgagacccctgtgattgacaacatcagatggtgcctggacatggccctgtcccgaccagtcactgccctggacaatgagcggttcacagtgcagtcggtgatgctacactatgctgtgcccgtggtcctggccggcttcctcatcaccaatgccctgcgcttcatcttcagtgccccgggggtcacttcctggcagtacaccctcctccagctccaggtgaatggcgtcctgcccatcctccccctgctctttccagtcctctgggttctggcaactgcctgtggagaggcccgtgtcctggcccagatgagcaaggcctcacccagctccctgctggctaagttctcagaggatactctcagcagctatacggaggctgtctcctctcaggaaatgctgcgctgcatttggggccacttcctgagggtgctcggggggacatcgccaacgctgagccacagttccagcctgctgcacagcctgggctctgtcacggtcctgtgctgtgtggacaaacaggggatcctgtcatggccaaatcccagcccagagactgtactgttcttcagcgggaaggtggagccccctcacagcagccatgaggacctcaccgatggcctatccacccgctccttctgccatcccgagccccatgaacgagacgccctcctggctggctccctgaacaacaccctgcacctttccaatgagcaggagcgtggcgactggcctggcgaggctcccaagccccccgagccctattcacaccacaaagcgcatggccgcagcaaacacccatctggctccaacacccagcctgggatggagagcgacccctacgaagcagaggactttgtgtgtgactaccacctggagatgctgagcctgtcccaggaccagcagaacccctcctgcatccagtttgatgactccaactggcagctgcacctcacctccctcaaacccctgggcctcaatgtgctgctgaacctgtgtgatgccagcgtcaccgagcgcctgtgccgattctccgaccacctgtgcaacattgccctgcaagagagccacagcgccgtgctgcccgtccatgtgccctggggcctctgcgagcttgcccgcctcattggcttcactcctggggccaaggagcttttcaagcaggagaaccatctggcgctgtaccgcctccccagtgccgagacaatgaaggagacatcgctggggcggctctcctgtgtcaccaagcggcggcctcccctcagccacatagatcagcctcttcattaaagacaccaccaccagcacagagcagatgctgtcccatggcaccgctgatgtggtcttagaggcctgcacagacttctgggacggagctgacatctaccctctctcgggatctgacagaaagaaagtgctggacttctaccagcgagcctgcctgtctgggtattgctctgccttcgcctacaagcccatgaactgcgccctgtcctctcagctcaatggcaagtgcatcgagctggtacaggtgcccggccaaagcagcatcttcaccatgtgcgagctgcccagcaccatccccatcaagcagaacgcccgccgcagcagctggagctctgacgaagggatcggggaggtgctggagaaggaagactgcatgcaggccctgagcggccagatcttcatgggcatggtgtcctcccagtaccaggcccggctggacatcgtgcgcctcattgatgggcttgtcaacgcctgcatccgctttgtctacttctctttggaggatgagctcaaaagcaaggtgtttgcagaaaaaatgggcctggagacaggctggaactgccacatctccctcacacccaatggtgacatgcctggctccgagatccccccctccagccccagccacgcaggctccctgcatgatgacctgaatcaggtgtcccgagatgatgcagaagggctcctcctcatggaggaggagggccactcggacctcatcagcttccagcctacggacagcgacatccccagcttcctggaggactccaaccgggccaagctgccccggggtatccaccaagtgcggccccacctgcagaacattgacaacgtgcccctgctagtgccccttttcaccgactgcaccccagagaccatgtgtgagatgataaagatcatgcaagagtacggggaggtgacctgctgcctgggcagctctgccaacctgcggaacagctgcctcttcctccagagcgacatcagcattgccctggatcccctgtacccatcccgttgctcctgggagacctttggctacgccaccagcatcagcatggcccaggcctcggatggcctttctcccctgcagctgtcagggcagctcaacagcctgccctgttccctgacctttcgccaggaggagaccatcagcatcatccggcttatcgaacaggctcggcatgccacctatggcatccgtaagtgcttcctcttcctgctgcagtgccagctgactcttgtggtcatccagttcctttcttgcctggtccagctgccgccactcctgagtaccaccgacatcctgtggctgtcctgcttttgctaccctctgctcagcatctctctgctggggaagcccccccatagctccatcatgtctatggcaacggggaaaaacctccagtccattcccaagaagacccagcactacttcctgctctgcttcctgctcaagttcagcctcaccatcagctcctgcctcatctgctttggcttcacactgcagagcttctgtgacagctcccgggaccgcaacctcaccaactgctcctccgtcatgctgcccagcaacgacgacagggctccagcctggtttgaggactttgccaatggactgctgtcggctcagaagctcacggccgccctgattgtcctgcacactgtcttcatttccatcacccatgtgcatcgcaccaagcccctgtggagaaagagccccttgaccaacctctggtgggccgtgacagtgcctgtggtgctgctgggtcaggtggtccagacggctgtggacctgcagctgtggacacacagggacagccacgtccactttggcctggaggacgtgcccctgctgacatggctcctgggctgcctgtccctggtccttgtggtggtgaccaatgagatcgtgaagctacatgagattcgggtccgagtccgctaccagaagcgacagaagctgcagtttgaaactaagctgggcatgaactctcccttctgagccactggctgtggtggctgtagttgcccccgtccctggggctaaagccagacccatttctgaacaggggagtttgtatcatgaatgtttccaggtttgctcctgcacccgtggcactggaaacccagctccccgtgtcagaccccgctgtcttcctgagccctggggctcactgtggaggagctgacggcctgggcccttggccagtcctggctcttccctgggcctcaccagggacactcttgaatgtatggcctcaggcgctccctagagggggcctaaaccccctcacctgtgagctaccccctttagggatcccttgcccccttggagatcccttgccccccagtgcctctgctcgtgggtccctggacacggccttgaagccaaccttctttggaggagcaacagcagcagccttggccgacgcgtccaactcccaaggctgccgtggagggcaggggggtggtgcttgcctggatgtggccccgagtgcctcccctccctccctctgtgggggagtctcccgcctgaacctgaagatggagcagggcccccgcttcgccctggagcctcttcctgtgcctggctcaagctggctgcctgtcagtcttggggaatctggcccaggtctcctcagcctctgccccagttctgggagaagtttctactggtgtatattttttactggaaatgagccttttaggaatgaatgtagactggtttgtattaaaatgtgtcaattgctaagaaatacctgtggctggtctgtaaggccactccagggtctgcccacccccggcggtggctggcaaagggaggcctaaaccttcctccatctacgcgggtgggtccctcaggtctggctcaggcgagacccctagggtcaggggtccccatgtcacagaggcaaacacacagcccagtcacgtggaatggtgttttcattggtgttagttgggggaagaggttaatggttacagagccagggcctgggccaatggggtcaggctctccctgccctcaggtgggcagtcggggctcctgctgtggtccgaagcccctcccccattgtgtcctctcaggcagttgatagaataaattccatttaaaatatatgcatttctctctgcttagaaaataacatttacaattgaaaagttaggacttgtgggatctgttaaccccactgcctcccacccctgctagccctgcctcagtgagggaaggcgggggcaggagctgcctgggcaccaccgctgtgtatttacatgtcctctgtacacctacggagagggggcccggccagacacacgcctcctccagcctctcagggcctgggcaggatggtgggtggcaagaggcattcccttggcacaacttgggacatgggctggggggtacagagaaagcacccccaaagccccacccctacttcctccctgaggagagagctcttaccagggtccctgtccaggagcagggctgtcctgctcaatcgatcaaaccctgggaggggctttgctgagatgcagcggaggtccctcgctagtcaggttctaaggtgggctgccccacaagagctgtggtgcccacagccgcgggctgagtgggaaggggccctgctaggaggggcacttcagcctgaccagcccttggcccgtccctagggtggcaggggcctcttctgtgctggggcaaaggcagtggacttcggcaggtcacagtgggcactgctggagggctcagtccagcatggcgtccagctggtcagccagggcgtcgaacatggtgctgatgtcatccagaatgtgcttggtggaggcgctgggggtgccctcttgctccttggtgccaatgctcttctctgcggctctcagtgcagctgccagggacgagctggtctgctccagtctctgctgggcctggcctgggcccacagtcccagtgctctcaggccgtggaggaggcactgggcgggggccgagccggggcgctagcttagggccagaaaatgccagctgggtgcaggccaccgacacaggcttgggggctgttcctgctccgggcaccttgaggagggcagcaggggcggccgggggttctgtctccccattccaccgactagctgctgagctttccagacctggccctgggcagggcggcactggaggctgcatggcggggctgggagcaaggggggttggaactccttgggctggaaggctgctgggctcgggctggggaaggctagaagctggaggagactcgccaggagttggggaaggcagtggggcagcggggccaggcgtggcactggccactccgaaggccagcagtgcggtctgcagtggctctctctcccggcacttgggcctccgcttaacagtgtctgattccgtgaggttgaaatcgaggccggggggcacgggtgtctctcggggcggggggccagcgggcttcgggcgctgtttgatggtcaggttcccttcctctgcaaacggcagcccttccccagagctgccccgagatgggggcgtcccctcagggcctggctcctcctcctccgtgtctgacgcgggcccagccggggcaggtgggccagggggctctgaggggccagcaggttcactcagtgttcgccttcggggccctgtggccccttccttgggccctgggctcccatctagtggaggtggctccgggctggggccagagacggagctgaggcgcttggggggcgggggcggggggcctttgcgccgggcccgcagggcaaaggactggctgcgaggagtcccccgagctggggttggggtcacgctaggactggtccggacaagggcactgcgtcctggccgccgggtaagggtagcataactgcctagggtgctgcccactggcccttcggcctccccctcagcatccccctctgtgggccaggcggcttaggctgtgggaccggcgcttaggtcgaggcgggtctgggggagtggcagggggcccggccaagtaggagaaggcccagggtgcgccaggaggtggccctggggccgggctagagggtgagccctgggggtacataaaaacatagggtgggggtccttggccaggaagtgaagaacaaagcttaggggccgctctgtgccctctgggaggttcctctcctggggggggctgggatctccaccgctgggctgtggggcaggctgttcctgtgagtggccagacccccgtgagcgtgccccgatgctctcctggctgggagagcgggcaggtgggagggggagtggttcagggccaccccctgccatggccgcctgtagctctgggcttagttcgctgccctggaaggtgaggagccgtgggccagctgtagctgggccttctccgttctccagtccctcgatggccatcagctccggacccttggccagccggcgcccgccttcgctgagggcctccccctgcagcaggccccgccgaagctccgccagccgcttcacccccagcatgagcttcttctgatgcccgagcttgttgaccccaatctcctgcagctcctcccaggtgaggtcggccaccagccccatggagtcgtagccgctgctcaccagctgcttgtggtactgtggcagccccagtgcacacagccactccagcaggtccgttgggatgtagctgggcagccactcggcgatgctgagctgagcgatctctgaggcgatcttcttcctgtgcccaggcttggtcaccccgatggccgtcaggtcctcaggtgtcatgcggctgatggtaggcacatcatagccggcctgcagaaagtgggcagtgtagccctccagctggaactcgcttagccagttatgaatggcctgcgcgtccttcccctccagcagctgttctggccgcacgtcctgggtgaagatctgctccccagagcggcagttggccagagggcggtggctcaggttgtctgccagggacggcgggtggagtcctggcagcacctggtcctctccagcagagggcagtggctgggcgttctcaatcaggaggccagggccatggccattagtgccctcagagctctgcccgctgccggcactgcggatgctgcccacgctgccctcactgcccacactattcctgtcacctgctgggctgtctgggctgaggcccacccgaggaagctggctgtaggtaagagggtgcgggggttcttcggcaggaggctgcggtgtccgggagaagcctgggcgcaggggggtgggtgcggaggggaggcgggctgcagggatgcccacccgcttgctgaccacctcgacaatgcccggggggaagtagcctatgcggtctgtgcccctctggctctcgtggatgtggcccttccagcggccgtcgggatgctgttctagcaccgtgatgacatcccctgcccggacattgagagcagtgggatcgtggaggttccagaaatccttgagcgctcggaccttcaggatccctgaggcctcccgcagtagctgcttgatttcccggctggcctgggaggtggtgaactgattcactatgtccagcgccgtctggttatacgtattccggatgttcacgtccacacctccctccagaagcagccgcaccacctcggtcttgccatacagtgcggcctcgtggagcgccgtacccgtcttggtctggcggttgatctcgatcccagctctcaggagctgcctgatgacttctctgtggccattcttggcagccaagtgcaggggcgtggtgtagttggggtcacacgggtctttggcctcaccctccagcagtgccacacataagtggctgttcagaagcagctgggccaccttgagtcggccaaattcacaggccaggtccaggggcgtcttcttggccttgttgaccaggcatgggttggactgatgctggaggagcatttctgacacctcataatgtccatactgtgcagccaggtgcagggggatctgtccgtccagcgaggcggcattgacagccgcagaggcgcgcagcagcagcctcacaggctccagccggccctgccaggctgcgtagtgcagcgggcgcatgccattgctgtccttgatgtcaacagtggcctgagcctctagcagcaaggctatgagctccaggctgccccccaaagcagcgtggtggagggcagagaatccatcagcatcctggtagttcacgttgagcctctttgtggagcccaggagctttgtcttgtggccttgaccttcgccaccagtttctgcacaccggtcacatctccattcttgacggcgaggatcaggtcctgttcacgacccatactggctcctgggctgagctctacactcaggagtccagggcaaaggcaggcaacgggtccaagctggggcgtcagggcgccatgccacagccccttggagggctcccggttccgggggagcaagtctggtgtcccaggcagtgggctcctcgtcaggtactgagggatactcccaaaggtgctccgtgaactgccaccacacgaaggaaagctaatctttgagggggtgaaggctacatggaaatctggatggatatcagcttgtggcttccgacagctccaggatgggctgggactgggcacaccaatcttcccggcttggctgtggaacaccagtgcccacccagagagcagccagcattcccttgggcctcaggcagcagcggtgcactggtctcagggctctctcccgccgcccgccgggtccggctgcctgctcg

SEQ ID NO: 685096 - DNA, 10271 bp, Homo sapiens
actttagctctctggccggcgcctctgttgcccggaagggaggcaagcccccttagagttgccagtaacggacatggctgcggcccccggaggaggggacgtgaagtgaggagggggttgggaggggagaggacgcgggcgaggaagaccagccccggggccccgatgttgtgactgtgacagactcactggggtttgtacatgctggggaggagccttcctttcaggggtgaccacattcatctgggcatgcctgcagtactcttggcccatggacctgaaggagaagcacctgggcgagcctccctcagccctgggcctgtccacgcggaaggccctcagcgtcctgaaggagcagctggaggcagtgctggaaggacatctcagggagcggaagaagtgtctgacgtggaaggaggtgtggagaagcagcttcctccaccacagtaaccgctgctcctgcttccactggccgggggcctcactcatgctactggccgtgctgctgctgctgggctgctgcgggggacagccagccgggagccgtggggtggggctggtgaatgcctcggccttgttcctgttactgcttctcaaccttgtgctcatcgggcggcaagaccggctgaagcgtcgggaggtagagcggaggctgcgagggatcattgaccaaatccaagatgccctcagggatggcagggagatccagtggcccagtgccatgtatccagacctccacatgccttttgcgccatcctggtccttgcactgggcctacagagacggacacctggtcaacctgccagtcagcctgctggttgaaggagacatcatagctttgaggcctggccaggaatcgtttgcttctctgagggggatcaaggatgacgagcacatcgtcctggagccgggagacctcttcccccccttctcccctccaccctcaccccggggagaagtggagagagggccacagagcccccagcagcaccggcttttccgtgtccttgagacccctgtgattgacaacatcagatggtgcctggacatggccctgtcccgaccagtcactgccctggacaatgagcggttcacagtgcagtcggtgatgctacactatgctgtgcccgtggtcctggccggcttcctcatcaccaatgccctgcgcttcatcttcagtgccccgggggtcacttcctggcagtacaccctcctccagctccaggtgaatggcgtcctgcccatcctccccctgctctttccagtcctctgggttctggcaactgcctgtggagaggcccgtgtcctggcccagatgagcaaggcctcacccagctccctgctggctaagttctcagaggatactctcagcagctatacggaggctgtctcctctcaggaaatgctgcgctgcatttggggccacttcctgagggtgctcggggggacatcgccaacgctgagccacagttccagcctgctgcacagcctgggctctgtcacggtcctgtgctgtgtggacaaacaggggatcctgtcatggccaaatcccagcccagagactgtactgttcttcagcgggaaggtggagccccctcacagcagccatgaggacctcaccgatggcctatccacccgctccttctgccatcccgagccccatgaacgagacgccctcctggctggctccctgaacaacaccctgcacctttccaatgagcaggagcgtggcgactggcctggcgaggctcccaagccccccgagccctattcacaccacaaagcgcatggccgcagcaaacacccatctggctccaacgtgagcttcagcagggacaccgagggtggtgaagaagagcccagcaagacccagcctgggatggagagcgacccctacgaagcagaggactttgtgtgtgactaccacctggagatgctgagcctgtcccaggaccagcagaacccctcctgcatccagtttgatgactccaactggcagctgcacctcacctccctcaaacccctgggcctcaatgtgctgctgaacctgtgtgatgccagcgtcaccgagcgcctgtgccgattctccgaccacctgtgcaacattgccctgcaagagagccacagcgccgtgctgcccgtccatgtgccctggggcctctgcgagcttgcccgcctcattggtacaggtccccatggcaggggatggctggctggacccgcctcctagaagaggcccagtaccaactcctcacgggacttaatggacctggcagggtattgccagggcatggccctagttcctgttccccgccctgcaggcttcactcctggggccaaggagcttttcaagcaggagaaccatctggcgctgtaccgcctccccagtgccgagacaatgaaggagacatcgctggggcggctctcctgtgtcaccaagcggcggcctcccctcagccacatagatcagcctcttcattaaagacaccaccaccagcacagagcagatgctgtcccatggcaccgctgatgtggtcttagaggcctgcacagacttctgggacggagctgacatctaccctctctcgggatctgacagaaagaaagtgctggacttctaccagcgagcctgcctgtctgggtattgctctgccttcgcctacaagcccatgaactgcgccctgtcctctcagctcaatggcaagtgcatcgagctggtacaggtgcccggccaaagcagcatcttcaccatgtgcgagctgcccagcaccatccccatcaagcagaacgcccgccgcagcagctggagctctgacgaagggatcggggaggtgctggagaaggaagactgcatgcaggccctgagcggccagatcttcatgggcatggtgtcctcccagtaccaggcccggctggacatcgtgcgcctcattgatgggcttgtcaacgcctgcatccgctttgtctacttctctttggaggatgagctcaaaagcaaggtgtttgcagaaaaaatgggcctggagacaggctggaactgccacatctccctcacacccaatggtgacatgcctggctccgagatccccccctccagccccagccacgcaggctccctgcatgatgacctgaatcaggtgtcccgagatgatgcagaagggctcctcctcatggaggaggagggccactcggacctcatcagcttccagcctacggacagcgacatccccagcttcctggaggactccaaccgggccaagctgccccggggtatccaccaagtgcggccccacctgcagaacattgacaacgtgcccctgctagtgccccttttcaccgactgcaccccagagaccatgtgtgagatgataaagatcatgcaagagtacggggaggtgacctgctgcctgggcagctctgccaacctgcggaacagctgcctcttcctccagagcgacatcagcattgccctggatcccctgtacccatcccgttgctcctgggagacctttggctacgccaccagcatcagcatggcccaggcctcggatggcctttctcccctgcagctgtcagggcagctcaacagcctgccctgttccctgacctttcgccaggaggagaccatcagcatcatccggcttatcgaacaggctcggcatgccacctatggcatccgtaagtgcttcctcttcctgctgcagtgccagctgactcttgtggtcatccagttcctttcttgcctggtccagctgccgccactcctgagtaccaccgacatcctgtggctgtcctgcttttgctaccctctgctcagcatctctctgctggggaagcccccccatagctccatcatgtctatggcaacggggaaaaacctccagtccattcccaagaagacccagcactacttcctgctctgcttcctgctcaagttcagcctcaccatcagctcctgcctcatctgctttggcttcacactgcagagcttctgtgacagctcccgggaccgcaacctcaccaactgctcctccgtcatgctgcccagcaacgacgacagggctccagcctggtttgaggactttgccaatggactgctgtcggctcagaagctcacggccgccctgattgtcctgcacactgtcttcatttccatcacccatgtgcatcgcaccaagcccctgtggagaaagagccccttgaccaacctctggtgggccgtgacagtgcctgtggtgctgctgggtcaggtggtccagacggctgtggacctgcagctgtggacacacagggacagccacgtccactttggcctggaggacgtgcccctgctgacatggctcctgggctgcctgtccctggtccttgtggtggtgaccaatgagatcgtgaagctacatgagattcgggtccgagtccgctaccagaagcgacagaagctgcagtttgaaactaagctgggcatgaactctcccttctgagccactggctgtggtggctgtagttgcccccgtccctggggctaaagccagacccatttctgaacaggggagtttgtatcatgaatgtttccaggtttgctcctgcacccgtggcactggaaacccagctccccgtgtcagaccccgctgtcttcctgagccctggggctcactgtggaggagctgacggcctgggcccttggccagtcctggctcttccctgggcctcaccagggacactcttgaatgtatggcctcaggcgctccctagagggggcctaaaccccctcacctgtgagctaccccctttagggatcccttgcccccttggagatcccttgccccccagtgcctctgctcgtgggtccctggacacggccttgaagccaaccttctttggaggagcaacagcagcagccttggccgacgcgtccaactcccaaggctgccgtggagggcaggggggtggtgcttgcctggatgtggccccgagtgcctcccctccctccctctgtgggggagtctcccgcctgaacctgaagatggagcagggcccccgcttcgccctggagcctcttcctgtgcctggctcaagctggctgcctgtcagtcttggggaatctggcccaggtctcctcagcctctgccccagttctgggagaagtttctactggtgtatattttttactggaaatgagccttttaggaatgaatgtagactggtttgtattaaaatgtgtcaattgctaagaaatacctgtggctggtctgtaaggccactccagggtctgcccacccccggcggtggctggcaaagggaggcctaaaccttcctccatctacgcgggtgggtccctcaggtctggctcaggcgagacccctagggtcaggggtccccatgtcacagaggcaaacacacagcccagtcacgtggaatggtgttttcattggtgttagttgggggaagaggttaatggttacagagccagggcctgggccaatggggtcaggctctccctgccctcaggtgggcagtcggggctcctgctgtggtccgaagcccctcccccattgtgtcctctcaggcagttgatagaataaattccatttaaaatatatgcatttctctctgcttagaaaataacatttacaattgaaaagttaggacttgtgggatctgttaaccccactgcctcccacccctgctagccctgcctcagtgagggaaggcgggggcaggagctgcctgggcaccaccgctgtgtatttacatgtcctctgtacacctacggagagggggcccggccagacacacgcctcctccagcctctcagggcctgggcaggatggtgggtggcaagaggcattcccttggcacaacttgggacatgggctggggggtacagagaaagcacccccaaagccccacccctacttcctccctgaggagagagctcttaccagggtccctgtccaggagcagggctgtcctgctcaatcgatcaaaccctgggaggggctttgctgagatgcagcggaggtccctcgctagtcaggttctaaggtgggctgccccacaagagctgtggtgcccacagccgcgggctgagtgggaaggggccctgctaggaggggcacttcagcctgaccagcccttggcccgtccctagggtggcaggggcctcttctgtgctggggcaaaggcagtggacttcggcaggtcacagtgggcactgctggagggctcagtccagcatggcgtccagctggtcagccagggcgtcgaacatggtgctgatgtcatccagaatgtgcttggtggaggcgctgggggtgccctcttgctccttggtgccaatgctcttctctgcggctctcagtgcagctgccagggacgagctggtctgctccagtctctgctgggcctggcctgggcccacagtcccagtgctctcaggccgtggaggaggcactgggcgggggccgagccggggcgctagcttagggccagaaaatgccagctgggtgcaggccaccgacacaggcttgggggctgttcctgctccgggcaccttgaggagggcagcaggggcggccgggggttctgtctccccattccaccgactagctgctgagctttccagacctggccctgggcagggcggcactggaggctgcatggcggggctgggagcaaggggggttggaactccttgggctggaaggctgctgggctcgggctggggaaggctagaagctggaggagactcgccaggagttggggaaggcagtggggcagcggggccaggcgtggcactggccactccgaaggccagcagtgcggtctgcagtggctctctctcccggcacttgggcctccgcttaacagtgtctgattccgtgaggttgaaatcgaggccggggggcacgggtgtctctcggggcggggggccagcgggcttcgggcgctgtttgatggtcaggttcccttcctctgcaaacggcagcccttccccagagctgccccgagatgggggcgtcccctcagggcctggctcctcctcctccgtgtctgacgcgggcccagccggggcaggtgggccagggggctctgaggggccagcaggttcactcagtgttcgccttcggggccctgtggccccttccttgggccctgggctcccatctagtggaggtggctccgggctggggccagagacggagctgaggcgcttggggggcgggggcggggggcctttgcgccgggcccgcagggcaaaggactggctgcgaggagtcccccgagctggggttggggtcacgctaggactggtccggacaagggcactgcgtcctggccgccgggtaagggtagcataactgcctagggtgctgcccactggcccttcggcctccccctcagcatccccctctgtgggccaggcggcttaggctgtgggaccggcgcttaggtcgaggcgggtctgggggagtggcagggggcccggccaagtaggagaaggcccagggtgcgccaggaggtggccctggggccgggctagagggtgagccctgggggtacataaaaacatagggtgggggtccttggccaggaagtgaagaacaaagcttaggggccgctctgtgccctctgggaggttcctctcctggggggggctgggatctccaccgctgggctgtggggcaggctgttcctgtgagtggccagacccccgtgagcgtgccccgatgctctcctggctgggagagcgggcaggtgggagggggagtggttcagggccaccccctgccatggccgcctgtagctctgggcttagttcgctgccctggaaggtgaggagccgtgggccagctgtagctgggccttctccgttctccagtccctcgatggccatcagctccggacccttggccagccggcgcccgccttcgctgagggcctccccctgcagcaggccccgccgaagctccgccagccgcttcacccccagcatgagcttcttctgatgcccgagcttgttgaccccaatctcctgcagctcctcccaggtgaggtcggccaccagccccatggagtcgtagccgctgctcaccagctgcttgtggtactgtggcagccccagtgcacacagccactccagcaggtccgttgggatgtagctgggcagccactcggcgatgctgagctgagcgatctctgaggcgatcttcttcctgtgcccaggcttggtcaccccgatggccgtcaggtcctcaggtgtcatgcggctgatggtaggcacatcatagccggcctgcagaaagtgggcagtgtagccctccagctggaactcgcttagccagttatgaatggcctgcgcgtccttcccctccagcagctgttctggccgcacgtcctgggtgaagatctgctccccagagcggcagttggccagagggcggtggctcaggttgtctgccagggacggcgggtggagtcctggcagcacctggtcctctccagcagagggcagtggctgggcgttctcaatcaggaggccagggccatggccattagtgccctcagagctctgcccgctgccggcactgcggatgctgcccacgctgccctcactgcccacactattcctgtcacctgctgggctgtctgggctgaggcccacccgaggaagctggctgtaggtaagagggtgcgggggttcttcggcaggaggctgcggtgtccgggagaagcctgggcgcaggggggtgggtgcggaggggaggcgggctgcagggatgcccacccgcttgctgaccacctcgacaatgcccggggggaagtagcctatgcggtctgtgcccctctggctctcgtggatgtggcccttccagcggccgtcgggatgctgttctagcaccgtgatgacatcccctgcccggacattgagagcagtgggatcgtggaggttccagaaatccttgagcgctcggaccttcaggatccctgaggcctcccgcagtagctgcttgatttcccggctggcctgggaggtggtgaactgattcactatgtccagcgccgtctggttatacgtattccggatgttcacgtccacacctccctccagaagcagccgcaccacctcggtcttgccatacagtgcggcctcgtggagcgccgtacccgtcttggtctggcggttgatctcgatcccagctctcaggagctgcctgatgacttctctgtggccattcttggcagccaagtgcaggggcgtggtgtagttggggtcacacgggtctttggcctcaccctccagcagtgccacacataagtggctgttcagaagcagctgggccaccttgagtcggccaaattcacaggccaggtccaggggcgtcttcttggccttgttgaccaggcatgggttggactgatgctggaggagcatttctgacacctcataatgtccatactgtgcagccaggtgcagggggatctgtccgtccagcgaggcggcattgacagccgcagaggcgcgcagcagcagcctcacaggctccagccggccctgccaggctgcgtagtgcagcgggcgcatgccattgctgtccttgatgtcaacagtggcctgagcctctagcagcaaggctatgagctccaggctgccccccaaagcagcgtggtggagggcagagaatccatcagcatcctggtagttcacgttgagcctctttgtggagcccaggagctttgtcttgtggccttgaccttcgccaccagtttctgcacaccggtcacatctccattcttgacggcgaggatcaggtcctgttcacgacccatactggctcctgggctgagctctacactcaggagtccagggcaaaggcaggcaacgggtccaagctggggcgtcagggcgccatgccacagccccttggagggctcccggttccgggggagcaagtctggtgtcccaggcagtgggctcctcgtcaggtactgagggatactcccaaaggtgctccgtgaactgccaccacacgaaggaaagctaatctttgagggggtgaaggctacatggaaatctggatggatatcagcttgtggcttccgacagctccaggatgggctgggactgggcacaccaatcttcccggcttggctgtggaacaccagtgcccacccagagagcagccagcattcccttgggcctcaggcagcagcggtgcactggtctcagggctctctcccgccgcccgccgggtccggctgcctgctcg

SEQ ID NO: 685097 - DNA, 10223 bp, Homo sapiens
actttagctctctggccggcgcctctgttgcccggaagggaggcaagcccccttagagttgccagtaacggacatggctgcggcccccggaggaggggacgtgaagtgaggagggggttgggaggggagaggacgcgggcgaggaagaccagccccggggccccgatgttgtgactgtgacagactcactggggtttgtacatgctggggaggagccttcctttcaggggtgaccacattcatctgggcatgcctgcagtactcttggcccatggacctgaaggagaagcacctgggcgagcctccctcagccctgggcctgtccacgcggaaggccctcagcgtcctgaaggagcagctggaggcagtgctggaaggacatctcagggagcggaagaagtgtctgacgtggaaggaggtgtggagaagcagcttcctccaccacagtaaccgctgctcctgcttccactggccgggggcctcactcatgctactggccgtgctgctgctgctgggctgctgcgggggacagccagccgggagccgtggggtggggctggtgaatgcctcggccttgttcctgttactgcttctcaaccttgtgctcatcgggcggcaagaccggctgaagcgtcgggaggtagagcggaggctgcgagggatcattgaccaaatccaagatgccctcagggatggcagggagatccagtggcccagtgccatgtatccagacctccacatgccttttgcgccatcctggtccttgcactgggcctacagagacggacacctggtcaacctgccagtcagcctgctggttgaaggagacatcatagctttgaggcctggccaggaatcgtttgcttctctgagggggatcaaggatgacgagcacatcgtcctggagccgggagacctcttcccccccttctcccctccaccctcaccccggggagaagtggagagagggccacagagcccccagcagcaccggcttttccgtgtccttgagacccctgtgattgacaacatcagatggtgcctggacatggccctgtcccgaccagtcactgccctggacaatgagcggttcacagtgcagtcggtgatgctacactatgctgtgcccgtggtcctggccggcttcctcatcaccaatgccctgcgcttcatcttcagtgccccgggggtcacttcctggcagtacaccctcctccagctccaggtgaatggcgtcctgcccatcctccccctgctctttccagtcctctgggttctggcaactgcctgtggagaggcccgtgtcctggcccagatgagcaaggcctcacccagctccctgctggctaagttctcagaggatactctcagcagctatacggaggctgtctcctctcaggaaatgctgcgctgcatttggggccacttcctgagggtgctcggggggacatcgccaacgctgagccacagttccagcctgctgcacagcctgggctctgtcacggtcctgtgctgtgtggacaaacaggggatcctgtcatggccaaatcccagcccagagactgtactgttcttcagcgggaaggtggagccccctcacagcagccatgaggacctcaccgatggcctatccacccgctccttctgccatcccgagccccatgaacgagacgccctcctggctggctccctgaacaacaccctgcacctttccaatgagcaggagcgtggcgactggcctggcgaggctcccaagccccccgagccctattcacaccacaaagcgcatggccgcagcaaacacccatctggctccaacgtgagcttcagcagggacaccgagggtggtgaagaagagcccagcaagacccagcctgggatggagagcgacccctacgaagcagaggactttgtgtgtgactaccacctggagatgctgagcctgtcccaggaccagcagaacccctcctgcatccagtttgatgactccaactggcagctgcacctcacctccctcaaacccctgggcctcaatgtgctgctgaacctgtgtgatgccagcgtcaccgagcgcctgtgccgattctccgaccacctgtgcaacattgccctgcaagagagccacagcgccgtgctgcccgtccatgtgccctggggcctctgcgagcttgcccgcctcattggcttcactcctggggccaaggagcttttcaagcaggagaaccatctggcgctgtaccgcctccccagtgccgagacaatgaaggagacatcgctggggcggctctcctgtgtcaccaagcggcggcctcccctcagccacatagatcagcctcttcattaaagacaccaccaccagcacagagcagatgctgtcccatggcaccgctgatgtggtcttagaggcctgcacagacttctgggacggagctgacatctaccctctctcgggatctgacagaaagaaagtgctggacttctaccagcgagcctgcctgtctgggtattgctctgccttcgcctacaagcccatgaactgcgccctgtcctctcagctcaatggcaagtgcatcgagctggtacaggtgcccggccaaagcagcatcttcaccatgtgcgagctgcccagcaccatccccatcaagcagaacgcccgccgcagcagctggagctctgacgaagggatcggggaggtgctggagaaggaagactgcatgcaggccctgagcggccagatcttcatgggcatggtgtcctcccagtaccaggcccggctggacatcgtgcgcctcattgatgggcttgtcaacgcctgcatccgctttgtctacttctctttggaggatgagctcaaaagcaaggtgtttgcagaaaaaatgggcctggagacaggctggaactgccacatctccctcacacccaatggtgacatgcctggctccgagatccccccctccagccccagccacgcaggctccctgcatgatgacctgaatcaggtgtcccgagatgatgcagaagggctcctcctcatggaggaggagggccactcggacctcatcagcttccagcctacggacagcgacatccccagcttcctggaggactccaaccgggccaagctgccccggggtatccaccaagtgcggccccacctgcagaacattgacaacgtgcccctgctagtgccccttttcaccgactgcaccccagagaccatgtgtgagatgataaagatcatgcaagagtacggggaggtgacctgctgcctgggcagctctgccaacctgcggaacagctgcctcttcctccagagcgacatcagcattgccctggatcccctgtacccatcccgttgctcctgggagacctttggctacgccaccagcatcagcatggcccaggcctcggatggcctttctcccctgcagctgtcagggcagctcaacagcctgccctgttccctgacctttcgccaggaggagaccatcagcatcatccggcttatcgaacaggctcggcatgccacctatggcatccgtaagtgcttcctcttcctgctgcagtgccagctgactcttgtggtcatccagttcctttcttgcctggtccagctgccgccactcctgagtaccaccgacatcctgtggctgtcctgcttttgctaccctctgctcagcatctctctgctggggaagcccccccatagctccatcatgtctatggcaacggggaaaaacctccagtccattcccaagaagacccagcactacttcctgctctgcttcctgctcaagttcagcctcaccatcagctcctgcctcatctgctttggcttcacactgcagagcttctgtgacagctcccgggaccgcaacctcaccaactgctcctccgtcatgctgcccagcaacgacgacagggctccagcctggtttgaggactttgccaatggactgctgtcggctcagaagctcacggccgccctgattgtcctgcacactggtgagagggctccctgggagggcgtggatgatggtgggaaaggagccccactgtggaagtctgacccccacatcgccccaccttccccagtcttcatttccatcacccatgtgcatcgcaccaagcccctgtggagaaagagccccttgaccaacctctggtgggccgtgacagtgcctgtggtgctgctgggtcaggtggtccagacggctgtggacctgcagctgtggacacacagggacagccacgtccactttggcctggaggacgtgcccctgctgacatggctcctgggctgcctgtccctggtccttgtggtggtgaccaatgagatcgtgaagctacatgagattcgggtccgagtccgctaccagaagcgacagaagctgcagtttgaaactaagctgggcatgaactctcccttctgagccactggctgtggtggctgtagttgcccccgtccctggggctaaagccagacccatttctgaacaggggagtttgtatcatgaatgtttccaggtttgctcctgcacccgtggcactggaaacccagctccccgtgtcagaccccgctgtcttcctgagccctggggctcactgtggaggagctgacggcctgggcccttggccagtcctggctcttccctgggcctcaccagggacactcttgaatgtatggcctcaggcgctccctagagggggcctaaaccccctcacctgtgagctaccccctttagggatcccttgcccccttggagatcccttgccccccagtgcctctgctcgtgggtccctggacacggccttgaagccaaccttctttggaggagcaacagcagcagccttggccgacgcgtccaactcccaaggctgccgtggagggcaggggggtggtgcttgcctggatgtggccccgagtgcctcccctccctccctctgtgggggagtctcccgcctgaacctgaagatggagcagggcccccgcttcgccctggagcctcttcctgtgcctggctcaagctggctgcctgtcagtcttggggaatctggcccaggtctcctcagcctctgccccagttctgggagaagtttctactggtgtatattttttactggaaatgagccttttaggaatgaatgtagactggtttgtattaaaatgtgtcaattgctaagaaatacctgtggctggtctgtaaggccactccagggtctgcccacccccggcggtggctggcaaagggaggcctaaaccttcctccatctacgcgggtgggtccctcaggtctggctcaggcgagacccctagggtcaggggtccccatgtcacagaggcaaacacacagcccagtcacgtggaatggtgttttcattggtgttagttgggggaagaggttaatggttacagagccagggcctgggccaatggggtcaggctctccctgccctcaggtgggcagtcggggctcctgctgtggtccgaagcccctcccccattgtgtcctctcaggcagttgatagaataaattccatttaaaatatatgcatttctctctgcttagaaaataacatttacaattgaaaagttaggacttgtgggatctgttaaccccactgcctcccacccctgctagccctgcctcagtgagggaaggcgggggcaggagctgcctgggcaccaccgctgtgtatttacatgtcctctgtacacctacggagagggggcccggccagacacacgcctcctccagcctctcagggcctgggcaggatggtgggtggcaagaggcattcccttggcacaacttgggacatgggctggggggtacagagaaagcacccccaaagccccacccctacttcctccctgaggagagagctcttaccagggtccctgtccaggagcagggctgtcctgctcaatcgatcaaaccctgggaggggctttgctgagatgcagcggaggtccctcgctagtcaggttctaaggtgggctgccccacaagagctgtggtgcccacagccgcgggctgagtgggaaggggccctgctaggaggggcacttcagcctgaccagcccttggcccgtccctagggtggcaggggcctcttctgtgctggggcaaaggcagtggacttcggcaggtcacagtgggcactgctggagggctcagtccagcatggcgtccagctggtcagccagggcgtcgaacatggtgctgatgtcatccagaatgtgcttggtggaggcgctgggggtgccctcttgctccttggtgccaatgctcttctctgcggctctcagtgcagctgccagggacgagctggtctgctccagtctctgctgggcctggcctgggcccacagtcccagtgctctcaggccgtggaggaggcactgggcgggggccgagccggggcgctagcttagggccagaaaatgccagctgggtgcaggccaccgacacaggcttgggggctgttcctgctccgggcaccttgaggagggcagcaggggcggccgggggttctgtctccccattccaccgactagctgctgagctttccagacctggccctgggcagggcggcactggaggctgcatggcggggctgggagcaaggggggttggaactccttgggctggaaggctgctgggctcgggctggggaaggctagaagctggaggagactcgccaggagttggggaaggcagtggggcagcggggccaggcgtggcactggccactccgaaggccagcagtgcggtctgcagtggctctctctcccggcacttgggcctccgcttaacagtgtctgattccgtgaggttgaaatcgaggccggggggcacgggtgtctctcggggcggggggccagcgggcttcgggcgctgtttgatggtcaggttcccttcctctgcaaacggcagcccttccccagagctgccccgagatgggggcgtcccctcagggcctggctcctcctcctccgtgtctgacgcgggcccagccggggcaggtgggccagggggctctgaggggccagcaggttcactcagtgttcgccttcggggccctgtggccccttccttgggccctgggctcccatctagtggaggtggctccgggctggggccagagacggagctgaggcgcttggggggcgggggcggggggcctttgcgccgggcccgcagggcaaaggactggctgcgaggagtcccccgagctggggttggggtcacgctaggactggtccggacaagggcactgcgtcctggccgccgggtaagggtagcataactgcctagggtgctgcccactggcccttcggcctccccctcagcatccccctctgtgggccaggcggcttaggctgtgggaccggcgcttaggtcgaggcgggtctgggggagtggcagggggcccggccaagtaggagaaggcccagggtgcgccaggaggtggccctggggccgggctagagggtgagccctgggggtacataaaaacatagggtgggggtccttggccaggaagtgaagaacaaagcttaggggccgctctgtgccctctgggaggttcctctcctggggggggctgggatctccaccgctgggctgtggggcaggctgttcctgtgagtggccagacccccgtgagcgtgccccgatgctctcctggctgggagagcgggcaggtgggagggggagtggttcagggccaccccctgccatggccgcctgtagctctgggcttagttcgctgccctggaaggtgaggagccgtgggccagctgtagctgggccttctccgttctccagtccctcgatggccatcagctccggacccttggccagccggcgcccgccttcgctgagggcctccccctgcagcaggccccgccgaagctccgccagccgcttcacccccagcatgagcttcttctgatgcccgagcttgttgaccccaatctcctgcagctcctcccaggtgaggtcggccaccagccccatggagtcgtagccgctgctcaccagctgcttgtggtactgtggcagccccagtgcacacagccactccagcaggtccgttgggatgtagctgggcagccactcggcgatgctgagctgagcgatctctgaggcgatcttcttcctgtgcccaggcttggtcaccccgatggccgtcaggtcctcaggtgtcatgcggctgatggtaggcacatcatagccggcctgcagaaagtgggcagtgtagccctccagctggaactcgcttagccagttatgaatggcctgcgcgtccttcccctccagcagctgttctggccgcacgtcctgggtgaagatctgctccccagagcggcagttggccagagggcggtggctcaggttgtctgccagggacggcgggtggagtcctggcagcacctggtcctctccagcagagggcagtggctgggcgttctcaatcaggaggccagggccatggccattagtgccctcagagctctgcccgctgccggcactgcggatgctgcccacgctgccctcactgcccacactattcctgtcacctgctgggctgtctgggctgaggcccacccgaggaagctggctgtaggtaagagggtgcgggggttcttcggcaggaggctgcggtgtccgggagaagcctgggcgcaggggggtgggtgcggaggggaggcgggctgcagggatgcccacccgcttgctgaccacctcgacaatgcccggggggaagtagcctatgcggtctgtgcccctctggctctcgtggatgtggcccttccagcggccgtcgggatgctgttctagcaccgtgatgacatcccctgcccggacattgagagcagtgggatcgtggaggttccagaaatccttgagcgctcggaccttcaggatccctgaggcctcccgcagtagctgcttgatttcccggctggcctgggaggtggtgaactgattcactatgtccagcgccgtctggttatacgtattccggatgttcacgtccacacctccctccagaagcagccgcaccacctcggtcttgccatacagtgcggcctcgtggagcgccgtacccgtcttggtctggcggttgatctcgatcccagctctcaggagctgcctgatgacttctctgtggccattcttggcagccaagtgcaggggcgtggtgtagttggggtcacacgggtctttggcctcaccctccagcagtgccacacataagtggctgttcagaagcagctgggccaccttgagtcggccaaattcacaggccaggtccaggggcgtcttcttggccttgttgaccaggcatgggttggactgatgctggaggagcatttctgacacctcataatgtccatactgtgcagccaggtgcagggggatctgtccgtccagcgaggcggcattgacagccgcagaggcgcgcagcagcagcctcacaggctccagccggccctgccaggctgcgtagtgcagcgggcgcatgccattgctgtccttgatgtcaacagtggcctgagcctctagcagcaaggctatgagctccaggctgccccccaaagcagcgtggtggagggcagagaatccatcagcatcctggtagttcacgttgagcctctttgtggagcccaggagctttgtcttgtggccttgaccttcgccaccagtttctgcacaccggtcacatctccattcttgacggcgaggatcaggtcctgttcacgacccatactggctcctgggctgagctctacactcaggagtccagggcaaaggcaggcaacgggtccaagctggggcgtcagggcgccatgccacagccccttggagggctcccggttccgggggagcaagtctggtgtcccaggcagtgggctcctcgtcaggtactgagggatactcccaaaggtgctccgtgaactgccaccacacgaaggaaagctaatctttgagggggtgaaggctacatggaaatctggatggatatcagcttgtggcttccgacagctccaggatgggctgggactgggcacaccaatcttcccggcttggctgtggaacaccagtgcccacccagagagcagccagcattcccttgggcctcaggcagcagcggtgcactggtctcagggctctctcccgccgcccgccgggtccggctgcctgctcg

SEQ ID NO: 685098 - DNA, 132 bp, Homo sapiens
taaggtcagatctagaggcccccgtacattccagcgtatgggttctagtttaatgttcttagaagctatacttgaggagggtgacgggcggctgtgtacgcgctgtcacggcacctgtacaactaaagcact

SEQ ID NO: 685099 - DNA, 985 bp, Homo sapiens
ggttttatatgataattgttgtgatgaaatgatggccctaataaatcggtgcccccgatatggcgtccccgcataaacaaataagcttctgactcttacctccctctctcctactcctgctcgatcgtgctatagtggaggccggagcaggatcaggttgaacagtctaccctcccttagcaggaaatactcaacaccctggagcctccgtagacactaaaccatcttctcacttaaccgtagcaggtgtctcctctatctttagggggccatcaaacttcatcacaaaccaattatcaatataaaaccccctgtaaatagtcgccaaatacacaaaaagccccatctacgacgtgaatcgcgtcataaataaaagggaagttcgcttatttcttggtatatctccagttccatagtgttggttgtcactatacttataaagagagccgtgtgactctacaagaagagagcgttcttggaaccccgaacggaagaaggagaagctgagtttgtattagcaaaaggatatttgattttgaggacaacctgtgagttgtatattcgtagtttacaagggttgtgaaagtaagtctagaattgttagttgagtagtcagggaaagaaaggaaacatatggaagaaatagggatgtggcgggaactagctacagatgggtgctagagtacggggtggaaacccaatatgtaaacgaaggactaacgtgagtagagagagactgaaacttcggaagaaaagttatagagcacaggtcggacaggaatatgagctacagccaaagaacactgaggcagtgacaagcagccaaagatcaatacacacagggagagaggacagaacacagctaagatagcacgcacgaaggtggcaaccacctagagagagcagaagccagtccaagacagacacacaaaaactgctgaacacagaaggaggaccacctagttgtggataatcaacactttcc

SEQ ID NO: 685100 - DNA, 9083 bp, Homo sapiens
acggagcaagactccgtctcaaaaaaaaaaaaaagaacacctctttcccttcctgcccctgagagagctggcccttcctgcccagggaatggccgtggggccagggcagcccttcccttccctcctccccaggcccggagctcaggagccatctgtgtggtccgctccttcccaggtgaatggcgtcctgcccatcctccccctgctctttccagtcctctgggttctggcaactgcctgtggagaggcccgtgtcctggcccagatgagcaaggcctcacccagctccctgctggctaagttctcagaggatactctcagcagctatacggaggctgtctcctctcaggaaatgctgcgctgcatttggggccacttcctgagggtgctcggggggacatcgccaacgctgagccacagttccagcctgctgcacagcctgggctctgtcacggtcctgtgctgtgtggacaaacaggggatcctgtcatggccaaatcccagcccagagactgtactgttcttcagcgggaaggtggagccccctcacagcagccatgaggacctcaccgatggcctatccacccgctccttctgccatcccgagccccatgaacgagacgccctcctggctggctccctgaacaacaccctgcacctttccaatgagcaggagcgtggcgactggcctggcgaggctcccaagccccccgagccctattcacaccacaaagcgcatggccgcagcaaacacccatctggctccaacgtgagcttcagcagggacaccgagggtggtgaagaagagcccagcaagacccagcctgggatggagagcgacccctacgaagcagaggactttgtgtgtgactaccacctggagatgctgagcctgtcccaggaccagcagaacccctcctgcatccagtttgatgactccaactggcagctgcacctcacctccctcaaacccctgggcctcaatgtgctgctgaacctgtgtgatgccagcgtcaccgagcgcctgtgccgattctccgaccacctgtgcaacattgccctgcaagagagccacagcgccgtgctgcccgtccatgtgccctggggcctctgcgagcttgcccgcctcattggcttcactcctggggccaaggagcttttcaagcaggagaaccatctggcgctgtaccgcctccccagtgccgagacaatgaaggagacatcgctggggcggctctcctgtgtcaccaagcggcggcctcccctcagccacatagatcagcctcttcattaaagacaccaccaccagcacagagcagatgctgtcccatggcaccgctgatgtggtcttagaggcctgcacagacttctgggacggagctgacatctaccctctctcgggatctgacagaaagaaagtgctggacttctaccagcgagcctgcctgtctgggtattgctctgccttcgcctacaagcccatgaactgcgccctgtcctctcagctcaatggcaagtgcatcgagctggtacaggtgcccggccaaagcagcatcttcaccatgtgcgagctgcccagcaccatccccatcaagcagaacgcccgccgcagcagctggagctctgacgaagggatcggggaggtgctggagaaggaagactgcatgcaggccctgagcggccagatcttcatgggcatggtgtcctcccagtaccaggcccggctggacatcgtgcgcctcattgatgggcttgtcaacgcctgcatccgctttgtctacttctctttggaggatgagctcaaaagcaaggtgtttgcagaaaaaatgggcctggagacaggctggaactgccacatctccctcacacccaatggtgacatgcctggctccgagatccccccctccagccccagccacgcaggctccctgcatgatgacctgaatcaggtgtcccgagatgatgcagaagggctcctcctcatggaggaggagggccactcggacctcatcagcttccagcctacggacagcgacatccccagcttcctggaggactccaaccgggccaagctgccccggggtatccaccaagtgcggccccacctgcagaacattgacaacgtgcccctgctagtgccccttttcaccgactgcaccccagagaccatgtgtgagatgataaagatcatgcaagagtacggggaggtgacctgctgcctgggcagctctgccaacctgcggaacagctgcctcttcctccagagcgacatcagcattgccctggatcccctgtacccatcccgttgctcctgggagacctttggctacgccaccagcatcagcatggcccaggcctcggatggcctttctcccctgcagctgtcagggcagctcaacagcctgccctgttccctgacctttcgccaggaggagaccatcagcatcatccggcttatcgaacaggctcggcatgccacctatggcatccgtaagtgcttcctcttcctgctgcagtgccagctgactcttgtggtcatccagttcctttcttgcctggtccagctgccgccactcctgagtaccaccgacatcctgtggctgtcctgcttttgctaccctctgctcagcatctctctgctggggaagcccccccatagctccatcatgtctatggcaacggggaaaaacctccagtccattcccaagaagacccagcactacttcctgctctgcttcctgctcaagttcagcctcaccatcagctcctgcctcatctgctttggcttcacactgcagagcttctgtgacagctcccgggaccgcaacctcaccaactgctcctccgtcatgctgcccagcaacgacgacagggctccagcctggtttgaggactttgccaatggactgctgtcggctcagaagctcacggccgccctgattgtcctgcacactgtcttcatttccatcacccatgtgcatcgcaccaagcccctgtggagaaagagccccttgaccaacctctggtgggccgtgacagtgcctgtggtgctgctgggtcaggtggtccagacggctgtggacctgcagctgtggacacacagggacagccacgtccactttggcctggaggacgtgcccctgctgacatggctcctgggctgcctgtccctggtccttgtggtggtgaccaatgagatcgtgaagctacatgagattcgggtccgagtccgctaccagaagcgacagaagctgcagtttgaaactaagctgggcatgaactctcccttctgagccactggctgtggtggctgtagttgcccccgtccctggggctaaagccagacccatttctgaacaggggagtttgtatcatgaatgtttccaggtttgctcctgcacccgtggcactggaaacccagctccccgtgtcagaccccgctgtcttcctgagccctggggctcactgtggaggagctgacggcctgggcccttggccagtcctggctcttccctgggcctcaccagggacactcttgaatgtatggcctcaggcgctccctagagggggcctaaaccccctcacctgtgagctaccccctttagggatcccttgcccccttggagatcccttgccccccagtgcctctgctcgtgggtccctggacacggccttgaagccaaccttctttggaggagcaacagcagcagccttggccgacgcgtccaactcccaaggctgccgtggagggcaggggggtggtgcttgcctggatgtggccccgagtgcctcccctccctccctctgtgggggagtctcccgcctgaacctgaagatggagcagggcccccgcttcgccctggagcctcttcctgtgcctggctcaagctggctgcctgtcagtcttggggaatctggcccaggtctcctcagcctctgccccagttctgggagaagtttctactggtgtatattttttactggaaatgagccttttaggaatgaatgtagactggtttgtattaaaatgtgtcaattgctaagaaatacctgtggctggtctgtaaggccactccagggtctgcccacccccggcggtggctggcaaagggaggcctaaaccttcctccatctacgcgggtgggtccctcaggtctggctcaggcgagacccctagggtcaggggtccccatgtcacagaggcaaacacacagcccagtcacgtggaatggtgttttcattggtgttagttgggggaagaggttaatggttacagagccagggcctgggccaatggggtcaggctctccctgccctcaggtgggcagtcggggctcctgctgtggtccgaagcccctcccccattgtgtcctctcaggcagttgatagaataaattccatttaaaatatatgcatttctctctgcttagaaaataacatttacaattgaaaagttaggacttgtgggatctgttaaccccactgcctcccacccctgctagccctgcctcagtgagggaaggcgggggcaggagctgcctgggcaccaccgctgtgtatttacatgtcctctgtacacctacggagagggggcccggccagacacacgcctcctccagcctctcagggcctgggcaggatggtgggtggcaagaggcattcccttggcacaacttgggacatgggctggggggtacagagaaagcacccccaaagccccacccctacttcctccctgaggagagagctcttaccagggtccctgtccaggagcagggctgtcctgctcaatcgatcaaaccctgggaggggctttgctgagatgcagcggaggtccctcgctagtcaggttctaaggtgggctgccccacaagagctgtggtgcccacagccgcgggctgagtgggaaggggccctgctaggaggggcacttcagcctgaccagcccttggcccgtccctagggtggcaggggcctcttctgtgctggggcaaaggcagtggacttcggcaggtcacagtgggcactgctggagggctcagtccagcatggcgtccagctggtcagccagggcgtcgaacatggtgctgatgtcatccagaatgtgcttggtggaggcgctgggggtgccctcttgctccttggtgccaatgctcttctctgcggctctcagtgcagctgccagggacgagctggtctgctccagtctctgctgggcctggcctgggcccacagtcccagtgctctcaggccgtggaggaggcactgggcgggggccgagccggggcgctagcttagggccagaaaatgccagctgggtgcaggccaccgacacaggcttgggggctgttcctgctccgggcaccttgaggagggcagcaggggcggccgggggttctgtctccccattccaccgactagctgctgagctttccagacctggccctgggcagggcggcactggaggctgcatggcggggctgggagcaaggggggttggaactccttgggctggaaggctgctgggctcgggctggggaaggctagaagctggaggagactcgccaggagttggggaaggcagtggggcagcggggccaggcgtggcactggccactccgaaggccagcagtgcggtctgcagtggctctctctcccggcacttgggcctccgcttaacagtgtctgattccgtgaggttgaaatcgaggccggggggcacgggtgtctctcggggcggggggccagcgggcttcgggcgctgtttgatggtcaggttcccttcctctgcaaacggcagcccttccccagagctgccccgagatgggggcgtcccctcagggcctggctcctcctcctccgtgtctgacgcgggcccagccggggcaggtgggccagggggctctgaggggccagcaggttcactcagtgttcgccttcggggccctgtggccccttccttgggccctgggctcccatctagtggaggtggctccgggctggggccagagacggagctgaggcgcttggggggcgggggcggggggcctttgcgccgggcccgcagggcaaaggactggctgcgaggagtcccccgagctggggttggggtcacgctaggactggtccggacaagggcactgcgtcctggccgccgggtaagggtagcataactgcctagggtgctgcccactggcccttcggcctccccctcagcatccccctctgtgggccaggcggcttaggctgtgggaccggcgcttaggtcgaggcgggtctgggggagtggcagggggcccggccaagtaggagaaggcccagggtgcgccaggaggtggccctggggccgggctagagggtgagccctgggggtacataaaaacatagggtgggggtccttggccaggaagtgaagaacaaagcttaggggccgctctgtgccctctgggaggttcctctcctggggggggctgggatctccaccgctgggctgtggggcaggctgttcctgtgagtggccagacccccgtgagcgtgccccgatgctctcctggctgggagagcgggcaggtgggagggggagtggttcagggccaccccctgccatggccgcctgtagctctgggcttagttcgctgccctggaaggtgaggagccgtgggccagctgtagctgggccttctccgttctccagtccctcgatggccatcagctccggacccttggccagccggcgcccgccttcgctgagggcctccccctgcagcaggccccgccgaagctccgccagccgcttcacccccagcatgagcttcttctgatgcccgagcttgttgaccccaatctcctgcagctcctcccaggtgaggtcggccaccagccccatggagtcgtagccgctgctcaccagctgcttgtggtactgtggcagccccagtgcacacagccactccagcaggtccgttgggatgtagctgggcagccactcggcgatgctgagctgagcgatctctgaggcgatcttcttcctgtgcccaggcttggtcaccccgatggccgtcaggtcctcaggtgtcatgcggctgatggtaggcacatcatagccggcctgcagaaagtgggcagtgtagccctccagctggaactcgcttagccagttatgaatggcctgcgcgtccttcccctccagcagctgttctggccgcacgtcctgggtgaagatctgctccccagagcggcagttggccagagggcggtggctcaggttgtctgccagggacggcgggtggagtcctggcagcacctggtcctctccagcagagggcagtggctgggcgttctcaatcaggaggccagggccatggccattagtgccctcagagctctgcccgctgccggcactgcggatgctgcccacgctgccctcactgcccacactattcctgtcacctgctgggctgtctgggctgaggcccacccgaggaagctggctgtaggtaagagggtgcgggggttcttcggcaggaggctgcggtgtccgggagaagcctgggcgcaggggggtgggtgcggaggggaggcgggctgcagggatgcccacccgcttgctgaccacctcgacaatgcccggggggaagtagcctatgcggtctgtgcccctctggctctcgtggatgtggcccttccagcggccgtcgggatgctgttctagcaccgtgatgacatcccctgcccggacattgagagcagtgggatcgtggaggttccagaaatccttgagcgctcggaccttcaggatccctgaggcctcccgcagtagctgcttgatttcccggctggcctgggaggtggtgaactgattcactatgtccagcgccgtctggttatacgtattccggatgttcacgtccacacctccctccagaagcagccgcaccacctcggtcttgccatacagtgcggcctcgtggagcgccgtacccgtcttggtctggcggttgatctcgatcccagctctcaggagctgcctgatgacttctctgtggccattcttggcagccaagtgcaggggcgtggtgtagttggggtcacacgggtctttggcctcaccctccagcagtgccacacataagtggctgttcagaagcagctgggccaccttgagtcggccaaattcacaggccaggtccaggggcgtcttcttggccttgttgaccaggcatgggttggactgatgctggaggagcatttctgacacctcataatgtccatactgtgcagccaggtgcagggggatctgtccgtccagcgaggcggcattgacagccgcagaggcgcgcagcagcagcctcacaggctccagccggccctgccaggctgcgtagtgcagcgggcgcatgccattgctgtccttgatgtcaacagtggcctgagcctctagcagcaaggctatgagctccaggctgccccccaaagcagcgtggtggagggcagagaatccatcagcatcctggtagttcacgttgagcctctttgtggagcccaggagctttgtcttgtggccttgaccttcgccaccagtttctgcacaccggtcacatctccattcttgacggcgaggatcaggtcctgttcacgacccatactggctcctgggctgagctctacactcaggagtccagggcaaaggcaggcaacgggtccaagctggggcgtcagggcgccatgccacagccccttggagggctcccggttccgggggagcaagtctggtgtcccaggcagtgggctcctcgtcaggtactgagggatactcccaaaggtgctccgtgaactgccaccacacgaaggaaagctaatctttgagggggtgaaggctacatggaaatctggatggatatcagcttgtggcttccgacagctccaggatgggctgggactgggcacaccaatcttcccggcttggctgtggaacaccagtgcccacccagagagcagccagcattcccttgggcctcaggcagcagcggtgcactggtctcagggctctctcccgccgcccgccgggtccggctgcctgctcg

SEQ ID NO: 685101 - DNA, 332 bp, Homo sapiens
gaatacttaagcactttgaaggctccacattacaatgccaaatcctatcaaagggtattggctgcctgtagtgctttagtgcagattatgaggcctacttgaggctctgagaaaatagaggagttctgagattgactactaatgtctgccatggaagtgagaggagcagttatggtacgagtgtcatatttttgccagttctgactgaaggctctgacttcaaagcccaggatctttctagcctctacccagtgtcactgactttctagctcattgccctagtgaaattggcttgccaaaatatattgacaaaagtcattgtaaaaaaaaaa

SEQ ID NO: 685102 - DNA, 116 bp, Homo sapiens
  misc_feature (11)..(11): n is a, c, g, or t
gtgtgagactntggggctttcagttagtggaagagctgcggtccctccagctacaaggtgggcaccatggcggagaattttgactgccactactgcagggatcccttgcaggggaa

SEQ ID NO: 685103 - DNA, 231 bp, Homo sapiens
gtactggttgctcggctctatctgtgtctctcggtctacctttatctcgggtctaccttgtccctcggatcttgcttgtgtctcggctctagcttgtctctcgcgctctaacttgtctcgtcggctctgaccttgtgtctcgggtctaccttgtctctcgtgctcgaccttgtctcccatgacgaagggcactccgcaccggaccccggtcccagacaaggtagagccgag

SEQ ID NO: 685104 - DNA, 582 bp, Homo sapiens
  misc_feature (484)..(484): n is a, c, g, or t
  misc_feature (526)..(526): n is a, c, g, or t
  misc_feature (528)..(528): n is a, c, g, or t
gattgtgaagatggtcagcattgacttgatcggagaggcccacggagtcatggaatcagggggtcccagtgtttgggttacttttaaggcagttgtgagctggtcagggcatcgaggggtatgggtatcgtaaaggcggcgaggtatctgaaagatgtcgctgtacaggaacaggtgtgtagcgttccgcggttacaatggtggagttggcaggtgtgcgcaggtcaagcagtggggctggctcaaggtcggtggcccaaagagagtgatgaatttgtgctgcagatggttataaacgcagagagtgatgctgaagttaagggtttagatgtagattgtggggtgattgagcagattcaagtgaacaaagcgcctaagatgcgccggtgggcctggagagctgatggtgggattaacccatacatgagctctggctgccgcattgagatgatcgtttcggggaaggaacagtttgttcgtaaancagaagaggaggttgggcagaagagaagggtgtgggaggagntnttgcagccccacttctttcctgccccagctccactaaattccctcctgcctaga

SEQ ID NO: 685105 - DNA, 120 bp, Homo sapiens
  misc_feature (52)..(52): n is a, c, g, or t
tatcggtccccctaggctgggaactccatataccacaagtgaggccctaaanaagcagaaaaaatgttatcaacttaagagagctatattttgggagttcccactgtggctcagccttct

SEQ ID NO: 685106 - DNA, 260 bp, Homo sapiens
  misc_feature (63)..(63): n is a, c, g, or t
cgggaatgttgggcttttgtttggttttagttggaaaaaaggttttatgtaaaaggcctgttnctgttaatttaaaaaattccaaaaatggcccctactttatgttgtgttgtgacaaatttggctatatttttagtccattgaaaaatgaaactttaaaagtttgtttttaggtaatccaaaagaaaagtgtttatactttttaatatattagccccagcccaaataaaaattttttttaagtaaacctttttccggga

SEQ ID NO: 685107 - DNA, 391 bp, Homo sapiens
ttcgagctcgtacccgaatccggcgatgggattacaggcacccgccatcatatctggctaatttttgtttagatgggatttcaccatgttggccaggccagtcttaaactcctgacctcaggtgatccgcctgcctcggcctccaaaagtgctgggattacaggcgtgagccactgcacccagcctgttacagtgcttttaatcactagtatttctctttgattctttcttagaatttccatctctctgcctgcattatccatctgtccttgcatgttgtctcctttatccattggagtccttagcatattaatcatagttgttcccagaatgataattccagcacgcctgccatttctgactctggttctgatgtttgccctgtctcttc

SEQ ID NO: 685108 - DNA, 247 bp, Homo sapiens
  misc_feature (126)..(126): n is a, c, g, or t
  misc_feature (130)..(130): n is a, c, g, or t
  misc_feature (243)..(243): n is a, c, g, or t
cgcgtaccgaatctttaaagaacatcagataatcaatgtgatcggtgtacaacgaatcctgaatgctcttctgatcatcatacaaaacgaaagctgttttcggtgccacatggctgcccctaaatntagnacctttccggcacatcaaagctgacaccgccactcagcagcgttgtcaatgagcccatctccacacgcatcccctgctgacgtcagatcaaccggcaattgccactaatcttnccaa

SEQ ID NO: 685109 - DNA, 238 bp, Homo sapiens
ctctagaggatcttgaggagtcactcaataaacaaactgatgcagaccctggaaggacactgtgttcgtgcatgcgggccttttgctaacattgctcacggcaactcttcagttgttggcttgataaaatttgcctgaaactgggttggttgaagaagggatttgtacgtgaccggaagcttggcctttggtcgctgacactcggaactggagaaacttcttcaaccatcaacgtgcc

SEQ ID NO: 685110 - DNA, 260 bp, Homo sapiens
cccatacagaggtatgtctcaatacatcatccagcagctcggggtatctcaccgaagaagctctgactaaagtgaagaggtttagaattggggcttataagctagagacgtgacaccataatctctgctcaaggaatgttttgaccatcttaaagtcaatgaggaaatggcacctgtcccccctatttggctgcgaagatgaaaatcaatcaaagtgatatttattaaacaacttcagaattcttggaatttcagaagga

SEQ ID NO: 685111 - DNA, 817 bp, Homo sapiens
  misc_feature (344)..(344): n is a, c, g, or t
ataacaactttaactacgggaaaggactggacgaacctgaagctgcgtgagacctccgaccacctcctgaatagtgggagactgcacccagagccctgaagcttggttccttcggtcattaggaattctctgagggcagggcagcaggctgcctttggcttcgctattcaggtcatgtacggcagaatacctagcctccccgtatctgctagttaaggccctgatgaatacagggccctacgggggaagccactcgaagtaaacgcctttactggcacgtgctaaccataccaaatgctcggattactgttctatacggtgaggagtttggccatctgttatcncttggtgctgcgtgcagagatgcgtctatcacggcaaaggcacagtagatggaccacgggtcttgccgtctaggtattcgatcggatagagacctatcaacgggtctggaagctagccccctgcgaaagaggctatgtcgatcggaactttccctcgtcaagtttgactaagacgacattgtccgtactgtgctacaaagcataattgtctccgtcgaagatgttaatcgcttttccaggggcgaaacttttcagagggagaccgggggtttaaaatggtgcgaaataaagggacttctttatgaggtcaagggtttattgtgcaactattcgattaaagagggttgccaaattcggtctacgagcgttggggaaacgacgtacgtgatgaagtggactgtcttctttgtacaagacttggagtaggcaggatgagcaagcttacacacattttgaaagcttgatttattaac

SEQ ID NO: 685112 - DNA, 139 bp, Homo sapiens
gtgtcgaacatacagaattgagtgtgcatgtaacataacttattgtaccactttccctgaagttcgtcagagcacctggatcagaactccgatcttctgaattgagtaattttctagaataggttatattaacagttga

SEQ ID NO: 685113 - DNA, 226 bp, Homo sapiens
cttgagtgatccccagcacatgaggatggttgacatgcacatgaggaggttgctcagtgcctgtaatcccagcacttctgtggaggccaagacaagagtgatcacttgagtgctgtaagtttgagacctcctctgtgctgtcaacctcctctgtgctgtccagctcctctgtgctgtccacctcctctgtgttgtctatgtgtccaacctcctctgtgcttgtcca

SEQ ID NO: 685114 - DNA, 347 bp, Homo sapiens
gtatctatctacactatctcagttaaacaacgcaagctcgtactttgacatctaatccatgaattctccctcccaataagatagagaggtagggttccaaagactgagaaagtttgcatcacataaattttcatataactgtaacaataagcatccgtcttctattctctatcaaaccctgtcgaatccttttacctttggtcacattcatttaatacctgagacttcatccaatttgcttaattaagccatcccaaatgtaaatcaataaatgatgacagtgtgtaagatggcataaagaaactcttgagcattagcatagatcactggcagaattctcactacag

SEQ ID NO: 685115 - DNA, 114 bp, Homo sapiens
gtatggtagtctgagtttggcagggcatcaaaacatttgaagaaaacacttctacatcacatacccccttaatcccacccaactacttacatacttccagacgttcttgcaaga

SEQ ID NO: 685116 - DNA, 1225 bp, Homo sapiens
  misc_feature (231)..(231): n is a, c, g, or t
  misc_feature (1225)..(1225): n is a, c, g, or t
aaaatggaatgtgatttcataacctatagattatgtgtaaattgtcattccactcagattacataaatggacagattctatcatcgagcaagtcattatctgaatctcaccgctagcgaatcttaacttgtacaacatcgtgcgtgctcttcaatatggcaccatagtcgatactacgagtagtactgaacacactaatctagttacaggaatagcgattgcgattgatanaccgatatatcgctaccgtgctccattactcggtcttcgagcaatacatcatgtgacatgaaaggcttggacgaatgtgtcatgcggtcacactctgactctgatggtagcaacgtcctggatcaagtggtaggaaaattgtcattcaatgagtatcagaacctggaagttctgtgccttttgctttctcttcaaagattgaggaggttagtcagacacagttcactttgctgaagtgtgcgggtgtcatctcatcctaatgtgaactgtgatccttcgtgtttatgcaatcatcttatattcaccacttcctaatttacaaaaccacatttaactttttagaagagttaacgcaatctacgttgtagttgatgtagtacatagagttgtcgaatgcagtgctcctaattagggtcccaacatctatgggtacgactttcgtttattagcatatttatgctacgattattattcattgcataaaatagtgtgccgtgcaccgtagaccagggtaggaaagcgacttgctggcagttgtaagttcactaggtaaaggctctaattgaaacttcttctattgcttgtacgcgacctactggtggccccgtagacagcattggatatttacttgacgcgtacagttgagcatgggttctaacgtgtaggtcacccaatggcgcctcttgttttgaaccagcgagtgtccttgtagcaatttgaacagtgagcgctataacatgtgttccctttaaacttttggtgaacctccactccggggtgcgcctttttagtgggaaagtaatttgccccattggcgagccattaaacagatttgtgtggcgtttagaggtgcggactgactccttcagaagttagcaatgtgaaccacccttttttccttccctgtgaaggacatgtgttcaactagcccgataagacagcttcgtgcgcagtgattgaacaagctgggggtgtaaaggaaatatcactcagn

SEQ ID NO: 685117 - DNA, 322 bp, Homo sapiens
ggagtgaaccttgattatgatagttgatatagaggatcccttggtaggacactagtgattagttgagtatctgtgcataacatagttactagtggtgggcaaagtaataaaccccaacgcaccaattgtcatgtactatgttacacagcacaattacatatgaagggggaattacgagtgcagatcacattactgttgctcatcagatgagcttaacacaagattatcctggagtatctactgagagcacatgtaattaccagcatcctttacaaacctgtaagagggacgtgcgaaggtttacgaaacacgagacggtggg

SEQ ID NO: 685118 - DNA, 382 bp, Homo sapiens
gacctctgtgacagcaaatgctcttgtgccctcctcaaatctttcaagcacacccttatgccacacttggaaaactactaggttcctggcccctgggatccttgacagtccacccttcctggtaaaggctccctcaatgcccacctggaaaagcatgtcgtccaggtaatagtccctcgaaatgatactctttggcagttagagtctcacctatctctctgaactccaaagagtctctcccgcgcttcaggctctctgtgtacagatatgccttccacttcctccctcgtgtcttgctcagggagtatagagagtgctctggcatcgtctgtgttcttcagctcccccgcggcacagcacatcgccgtgtcccgagtgtgcg

SEQ ID NO: 685119 - DNA, 164 bp, Homo sapiens
tgtagatttcagatgagtctgcagacgcgtggggtacccctgagaatgggtcggccctgggtccccgaaatcccaagtcccagacttgcggggggtgtggggatatccagaattggttgcaaatacgatccatatttgatgattaaacacaaacagtcctcaga

SEQ ID NO: 685120 - DNA, 797 bp, Homo sapiens
  misc_feature (120)..(120): n is a, c, g, or t
  misc_feature (129)..(131): n is a, c, g, or t
  misc_feature (136)..(136): n is a, c, g, or t
  misc_feature (142)..(143): n is a, c, g, or t
  misc_feature (161)..(161): n is a, c, g, or t
  misc_feature (193)..(193): n is a, c, g, or t
  misc_feature (224)..(224): n is a, c, g, or t
  misc_feature (226)..(226): n is a, c, g, or t
  misc_feature (232)..(233): n is a, c, g, or t
  misc_feature (315)..(315): n is a, c, g, or t
  misc_feature (332)..(332): n is a, c, g, or t
  misc_feature (359)..(360): n is a, c, g, or t
gacgagccctcaggcgaacctctcggctttcccgcgcggcgccgcctcttgctgcgcctccgcctcctcctctgctccgccaccggcttcctcctcctgagcagtcagcccgcgcgcggncggctccgnnnatggngacccnnagccctggcgtcgtgatnagtgatgatgaaccaggttatgaccttgattnattttgcatacctaatcattatgctgaggantntggaanngggtgtctattcctcatggactaattatggacaggactgaacgtcttgctcgagatgtgatgaaggagatgggaggccatcnacattgtagccctctgntgtgctcaaggggggctataaattctnngctgacctgctggattacatcaaagcactgaatagaaatacgtgatagatccattcctatgactgtacattggatctagactgcacgagctacttgtaatgaccagtcaacaagcgggacagtaaaagtaattggtggcagatgatctctcaactttaacgttgaaagaatgtcttgatcgtggaagatatcctcgacactggcatataaactgctacttagcttaaccttggtcaggccctgtaatccaaagaataggtcaagacgcaagctgtatggcgaaaagggaacccaccaagtgtcaggatcatgaccagacatcgaacgacgcagaaaacttgcagaacagttagatgaagcattagccctggactattcactgaaatcgtcacggacattggaaccacggcacggaacaataaccgaactgggaaccc

SEQ ID NO: 685121 - DNA, 1350 bp, Homo sapiens
  misc_feature (1)..(1): n is a, c, g, or t
  misc_feature (542)..(542): n is a, c, g, or t
  misc_feature (572)..(572): n is a, c, g, or t
  misc_feature (1020)..(1020): n is a, c, g, or t
  misc_feature (1024)..(1024): n is a, c, g, or t
  misc_feature (1026)..(1026): n is a, c, g, or t
  misc_feature (1056)..(1056): n is a, c, g, or t
natccccttctctcttgatgttgtattggtatgtgctgccgcgccaaattttatatccaattgacccctcttgtatgggtgtgtgcgaaaaagcgaacgaagacgccggggatttttttagggggggggacacccccttatgagagggaaaccctcttggaagggggattccccccccccacgaagggtttggtcgccccaacgaaaaatacctccagggccgttgtgtgtttataaaacctgtccctggtgcctcttctctttgttaccttgaatttttaccccggcggttcccccctataaaggggtttctcctcgtagaggcccccctcgtgggtttgtgcccgaaatttttctcgggcgcatcctctagagccctcaagaaaaattttcaagagaagatttctcacccggggaggatttctccacaccaagagagagcacacggagctgtggcgccccctctatgggaatagcgaccctagtttgggtgttttttgtgggagagcctcccacgcgcgtttctgtgtcgacacgctgtnaatagagagagcgcccaaaaaagagagggnctctgtgatatagagacaccactgcggacactctgggtaaaataaatatgtgggtgaccccacacaataaaaagagtgtgtgttatatatgtgtgtctctaacaatatcatagagagatatatatagagatagagataaataagtagtgtaaaagagaggtggttaactcttagtagaataggcgcaccccacactgggcgacacacactgtcgtctcttagagcccctcacacatacaccgtctctccttatattgtgtggggtaaagagagatactccacacccctctctcactactgtgtgtgtgtgtgcctcttgtgtgtgtgaaaactactctgtgtgttttagaggggtacacacagagataagagagtctcacttgtgaaatattttgtgagagaataacacttctctttgtatacacacctctccacctttgtgtggggngttntnttgtggagagaagaggttaactctcacaanaaattctcacagggaagagcacaccaccacttttataatattatttgttgcttctggagagtggctggacaccccacagtgggataccctgggcacacaaggtacaccacacccgaggagagtgtttaagacggttccagagtggaaggtgggggtgaaaaagagttacatacacctgttccagaggtttgtgtggttacaccccccgtaaatgggggaccaaaagtattgttgggaaatattttgggaccttttatgaagttaaaatttattaacaccagaatttttcaccca

SEQ ID NO: 685122 - DNA, 124 bp, Homo sapiens
ggatttgctggtgcagtacaactaggcttaatagggatagggatcgaattcgaggctcgaattcgagctcgaattcaagcttctaacgttagaagccttgaattcgagcggggaggtagtgaca

SEQ ID NO: 685123 - DNA, 761 bp, Homo sapiens
  misc_feature (264)..(264): n is a, c, g, or t
ggggccaaggggacggggtaagcataggacgaagaccaacgtgtgctgtcaaagcaatagcggggccctgtcggacgagaagaccggagggtgatgggctcaggagggtcgcgtggtcacaaagaaagcaaggcaaatacgagatgcagccgtgagggaacaccgcgcaacagaggacccgtgcgaaccccatctcttcttggaaagcgccacatatactagtggcaacatgtggtgagacccatcgtttgtgtggaataatcnggacaacatgcgcgcagatcatgtattcggtgtagcttccaagccttagtgaccactgcgttgactggggctagctaaggaatgcagaagccgctcctcaaatatgacgattctgagctaggaccctggcttcacggtctagcgcgatttggctcttgtaacaagccacaacttggacgaagtactgctaggcatgcgaatagagggccgtacgcctggagtctagcaggcacgctgtcaagcgggacgccaagcagcttatggaacacgcacgtgtcggttctctgccagaagatgctgtgcgcagtgaccgtggtctctgaagagcacgacaagcgcaaccagcccgctaggactgctgctggagcatggagcacgtcctacttaaggaaaatgcattttaatcagcgtatctctttgctacttaatgtggaaagacacgcctatgtcccccgtcggccaactctgggggcctggaaatgctgcagtggggatat

SEQ ID NO: 685124 - DNA, 127 bp, Homo sapiens
  misc_feature (60)..(60): n is a, c, g, or t
  misc_feature (76)..(76): n is a, c, g, or t
  misc_feature (114)..(114): n is a, c, g, or t
aggatgccctaaagccccacccagtccggggggaatgggagcagttccaagaccaccccncccctttttgtaaatnttgttcattgtaaatcaaaaacagcgtctttttcactntgaaaaaaaaaaa

SEQ ID NO: 685125 - DNA, 480 bp, Homo sapiens
agatcggaacatcggttaaagtctatgcacgtttataatgtctgctgtccatgtaagagtgcaataattattgattttgttacaaatagcattttatcaagtaagtaaacttacaagtacagaatacacaaataatgaagatcaattctgtgttagtgtatgtgtaatgtacagttaaacatatacatgtatatatatatacatattcgaatgtgcacaaaacattcgttggctggccaggcgcagagacacacatctgtaatcccagcactttgggcaggctgaggcaggtggatcacctgaggtcaggagttcgggaccagcctgaccaatatggtaaaatcccatccccactaaaaatacaaaattagccgggcatggtggcgcatgcctgtaatcccagctactcgggaggctgagacaggagaatcacttgaacccgggaggtggaagtcgcagtgacccaagatcgtgccattg

SEQ ID NO: 685126 - DNA, 659 bp, Homo sapiens
tatagttaaaagttaaaggtagtccccaaatacttttcatattgacaatcttacattaaatgtcccaaaacacaggggcgtaatctcgtgggacccgtcactagcgggctaagggcttaaaggcagagacgtggtgactggggtctctcgggaggggcctctgggttctccccggggctcagggctggctggggggctgggggcgccaggggctcgggcggacctagagggtggtgggacggcacacgctgcagggagggccttctcttaaccctccgagaggtggggactgggagaagattccctctggaatgtcccaaagagagggcccggtggcccagggggacctcctcctgggcctcccaggtgggggtgggtggcaagctgggctctgggccatggctccagggctcgggtggggcccaggggtgtgccactccagtgtgctgcgtgcttgtgaacactggcctgttctggggaccagccccggggctcttccaccagagtattgggggggggtcccccttgtggctctcaagagaagccccgtgtgccctggaatggtccgtggggggcagggacccctgtggctggggaagggtttgccacagggggaacccgtttgcgcctggtgcctgatgatggtaacccgtgtacgg

SEQ ID NO: 685127 - DNA, 561 bp, Homo sapiens
tctggcttttgggataagactaatgtccatgtcaaaatgattcttgataaaagcatcctagatgttaaatatttattttaagctaaatgttctacttctgagaggttaaaaaacaaatgcctttccatgcagagccttttgccagtcaatgtttgagtttctttaggcttttttatttggctctgcagcagctagctaaccaactgcattcctgagatgagctgacaaggaggcagaaatgaagaaataaacaaaaagccatgttaatttcaagcttcagtaggaatacaaagagaaatattaacatttgctgaatgacaaataatgaaatggctggaaaattttaatgcttctagcatgcttttataagctctcctggaattttccccccatcaggtattgcacatttataaccagcagtgcaccatgtaaaggcagttcgataggttgtttaatttaaagattggtatttctgagcatatagtgttcctaatgcaattcctaagcccatttacacttctctgtctacccgaagtacccacatcttcttagcataatctt

SEQ ID NO: 685128 - DNA, 925 bp, Homo sapiens
  misc_feature (176)..(176): n is a, c, g, or t
  misc_feature (180)..(180): n is a, c, g, or t
  misc_feature (191)..(191): n is a, c, g, or t
  misc_feature (209)..(209): n is a, c, g, or t
  misc_feature (214)..(215): n is a, c, g, or t
  misc_feature (250)..(250): n is a, c, g, or t
  misc_feature (253)..(254): n is a, c, g, or t
  misc_feature (285)..(285): n is a, c, g, or t
  misc_feature (308)..(308): n is a, c, g, or t
  misc_feature (313)..(313): n is a, c, g, or t
  misc_feature (317)..(317): n is a, c, g, or t
  misc_feature (319)..(320): n is a, c, g, or t
  misc_feature (335)..(335): n is a, c, g, or t
attgtaattgcttagtgcttggctaatttccaaattattgcataatatgttctaccttaagaaaacaggtttatgtaacaaagtaatggtgttgaatggatgatgtcagttcatgggcctttagcatagttttaagcatcatttttttttttttttttggaaagtgtgttagcttntggntactcaagggntaagacagacaataatanttcannggaatataataatcttaactagttaacctcctcgngtnntggccaccggataaggggatatctttccttnaagggaccctaaatggttggaantttangatntnnttcaaaaacttattncatttagggcacatcggtttggcggtttggagcaggggtgcagttaggggtccatggataatatcttggacccacttggtgtaacactctggagttggccaatatttttaaatctctttagaaaatataccaatttgttgtttggacacgctattcttattgggattaggggtctcatacaatatgggggttcaggactcttacaaaaaacctctggggctatctattaaattcaattaccctttagaggggtatggtattaagtagggggttcctggacctgggaggatgttggaacggttaaaattggattgtgggtacccaagggacggattaggggtcttcctatataaaccaaggttttcttagtaacctagatggcaagtacagggctgtttgttgtaggactcagtacaaaaggttggtttttaaaaattacttcccagggtgaattggtcaaattcgtgttacgaactgtatttttggggaggttggtcttttaacaggggaattttaaggaggattatttggattaattacgggctaaacatttgggggattgaggattgggggtttcctcaggttaagga

SEQ ID NO: 685129 - DNA, 584 bp, Homo sapiens
tcggacaggaggtaaggacaccatcaaggaacggtataagcctataagagcagagggaaccaactacagaacagtttaagataaagcggggcaggcagagggacaagtgaaagaaggttaccagtctcatcgtgacaccatcgtgcttttatgtaagccagagcctgagctgaaggctgccatcccttctgctaatccagcaaagaccaggcagggcagggaggtggtaaatgtcttaaaatccttatggtcaaatctggatgaagtaaagaaggaaagagagggtcgggagaatgactggaaatctgtgaatttggacatgacaagcaagttttggacagcccgtggctcaggagggtgtgataaatgaagaagctctttcggtaactgaactagatcgagtctagggaggtcttacaactaaagtccaagattctctaaagaaaggggagggacttcttaaaaatatgcaggtctcagatcaggaatttgcgaaaatgaaacaatctaataaggaagctaacttaagagaagaagttgggaagaatttagctagtgcatatgacaagtgtggtgaacttgta

SEQ ID NO: 685130 - DNA, 286 bp, Homo sapiens
ctcggtcctgtattgtggaagctgatatgcagcggcgggattaaatctacggacgcgtttgtttaaacaatcgtcggtgcaaagaacatttttgcctgacacttattgagcacccacaccagttctgcttcccgccaggaaggcaacagcggcacggaaactgcaccgattttcaggcatgcaagatagataacggtaaattcacaccagccaggcagttgaaatgcgatgcgatcgcctgattcaatacccttcgctaacatccagtttgccagacagctcgcgg

SEQ ID NO: 685131 - DNA, 316 bp, Homo sapiens
  misc_feature (251)..(251): n is a, c, g, or t
  misc_feature (285)..(285): n is a, c, g, or t
  misc_feature (309)..(309): n is a, c, g, or t
acgtgaaaaaatgctcaatatcactaatcatcagataagtgcaaatcaaaactgcaatgagttaccatctcttaccagtcacaaagttggagatggtggtgagcctgcagaggaaaagaaacagacactgttggtgggaaagcaaacttgttcagccgctatgggaaagcagtttgggagatttctccaaggaacttaaaataggaactaccattcaagcctggcaatcccactactcggggatatatccncaggggaaaggatttcatttttttcccaaaaggncacctgcacccatttggttcattncagtggc

SEQ ID NO: 685132 - DNA, 271 bp, Homo sapiens
cgacagtcttgcctttatgacctaatcaccttccagagcccccacctcctaatgccctcactggggggctaggtttctccatatgaattctgggggggacacaaacattcagaccatggcaggcgttctctttccctcaaccgagtggctggctctacaactacaacaacacggcccatggctcacttccaaggagactttctgtggagtgtgtccttggacacagaggttgcatccggcctcagtgtttagttgcataggttcaccctac

SEQ ID NO: 685133 - DNA, 1130 bp, Homo sapiens
gggcaaaatacaaacatagactttattaaatgctgctcaatcccccaatgaagatctttcattacaaaacagttttccacacaacgtgcaagtttaagaaatgtggaagtggtactcgtgattaacaaaagagtgtgtgagaaatacttgaccaagttaaaaacattacaagaaccctctattttaggtcaacctttttcagagcttcttacagaaggaagcctacgtggagtttcctttaaattaaagccaggcaggtgacaactagtgtgcctcgtgttttcaccacacgtggtgggacctcaaagccctccatcccgtgggttcaggaggggaccttaggtgtgaacggaacaggttgtggtgaggaccgtggaaagggcccgtgccttcagcctttgtgaaaggaaagagagaggacattgaattgtgaaacggcaaagcgtgggataattcaccgtgagcgtgccttcttacccattcttgtttaccacttcgtggaaaatttgcgaagaggaaggggggaatattcagtgaggaacaactctgaaaaattttgggggttaccttctcccaagactttaatttactattttgggaggcttataaaagagcctgggagaatttagagcggtttgcgcgctaaaattttccagaagttaacaggtaaggtggatttcaatgtgagggcaagggggatcaaggggccagggttaaattccgcccccaatcgaatatttccccggagggctgatggaccaaacggagcaacggggtacacggcgatgacttaccctataggctcatcacatctcagggaaacgatatatatcactacccccttagggaattgttacaccctacaggggtttcggcccccacgtgcttgcaacaaaaggccccactttttcttatcaccaagggggggaacacccaattttatcacgagcgagcgacaactatacccgaactatcctactgggtgcgaccaccccaatggtcatacaagaagcaaacctatcacaccgtgctataaagtgcgttaaaacacatcccccgataattgatcagctgcgccacaatcacccagcaaggcagaaaacaaatcaataaatacgtggcagaaacat

SEQ ID NO: 685134 - DNA, 875 bp, Homo sapiens
ggtcatctactctaccatctttgcaggcacactcatcacaggcgctaggctcggactgattttctacctgagtaggcctacaaataatgatgctaccttggattccagttctaaccaagaaaataaacccctcgtaaccacaggaagctgccatcaaggtattctccgtcacggcaatctgaccgcatcccatcaactcctctccaaatatctatccgtcttcaacaatatcactcgtccggagcaactgaaccagtaatcaatattaccaatccaatatgtcatcattaataatacataactggcatatatcacatagaacactaggcaatagccccctttcacttctgcagtcccacaagtttaccctaaggcaccccatcctgcatcgatcacgcgtccatgcattccttcctcgacgattgtacaatagaactagcccccagtcgtcatattcatagtaccacaagtcgtctcccctcactaaactgtaagccttctcctcacgtctctcaatcttatccatcatagccaaggcgagtctgagcgtggcctaacaccaaacccacgcctatccaaaatcttatcatactcctcaattacccacataggatgaataatagcagttctaccgtacaacgcctaacataatccattcttaactttaactatttatattatcctaactactatcgcattcctactactcaacttaaagtccatgcatcctaacctactactatctcgcacctgaaacaagctaaatgactaaaccttaattcatcacctcctctcctagaggctgccgcgtaccggttttgcccaatggcatatcaaaattccaacaatagtctatccacattacccatactcta

SEQ ID NO: 685135 - DNA, 162 bp, Homo sapiens
cagaaatgtttgaaaaagtggctggacgcggtggtgcacacctgtaatcccaacactttgggagcgggaggtggcttgatctgggagggggaggtgggtggatcgcttgagctcaggagtttgagaccagcctgggcaacatagtgagaactcatctctgtt

SEQ ID NO: 685136 - DNA, 161 bp, Homo sapiens
ggactactggttaacgaaattaccgaatgctgagggtgctccccgatttaacccctgtgtctgtgcgacacctttatccttaatcctttcactgggtgttaacttccacttactattaagatgtcgggagagatctttggaaatccatactcctgtgttcg

SEQ ID NO: 685137 - DNA, 100 bp, Homo sapiens
tggcgacggaatttgagtgtcctagtcgcaagtccaggtgtgttagcttggagacaagtcacttggtctggtgaggccaggacggcaactgagggatggc

SEQ ID NO: 685138 - DNA, 911 bp, Homo sapiens
ggtctgtattacacggcttaccaaacggttaccacgttcgtgttaacagaacctatgtttgttgcggcttactatataggcgcagacagtcccccttctgggtaaaagccccttgtgccgtcatccctctgttggaacttgtcctgcagacattcttctcggtgtgggatctgctgttgccgcgcagcaccgtgtcaggacattctgagagacttttgcgaaaaacacgagcacgaatactcagggcatttttcccggccgcgccctgtgacaggagttctgtacgggccacctatacttcctgcacgaggtggtcgcgcaagacagcaatggaccagcatggtggggtgggttgtacacgccaccccggctcgagcggagccgccaaactgggttggcttgttcagaaggaaaatcgacacagagcttgggagggacgaaagagtttttatgcagctaactgctgcacccacgcctgtcgcgtctcaatactctcccgctggtggtagggatgtctctttctccaactcttcccaccaggacgcctgtttggtcctcactccgctccctcagaaatccgggggaaaaaagccggctgtgcggacgacaataagaccaccaaagcgtcgtccgaacacttccagaggtaaccaaaattcctcctccaattgctgccaaataattaaccttaatgctggatacttgagggggtaaaaatttgtaaaccaatagactgtcttgtgagacaccgagcatccaacacgcctttcgtccaagatgttgtctgctcataatacatcttttcaagaagaccacgttgggcatggcgatacacggcttggtttgtcatcgcgccgccccaaaaaaaagtctttaggggggaaaaaaaaaatgaaaacgcccacaaaaac

SEQ ID NO: 685139 - DNA, 938 bp, Homo sapiens
cttaactatacacagaaatacttgcaaatcacatatataccactaaacccatactaagcacatccccagctcatctttgtctttagcctgatttcaaacatgcccacagctattccagcaccacctaacagaaaacaagtcagagttgacagaaaataaacaactacaaattatcaaaatatcttgcaaatttcacaaaaacctatcaccatgtgaagataccattggggaccttcccaggatgttgggagagacccccctagcttaaacagagaaaatccacctttacccatctgctttccactttccaacactttattgaaaccatctgtcttctgtcatctcctctatcccacatccttaaggtattacactgttttatgcttttactgttattttagagaagtttcaaaaaaatagactcatgttcacatcatacttacctacaagtcttcattttattcagccttttggtatcaattccaattaattccataatatgtacaataacttttatcattaaactactgacctcatttcattataactatcaattgcaccttgtttttaaaacagtataaacaggtatctacaaaagtacaatgttcattcaaggactaagaagtttactagtggccctttacccacacaagtatagaatctttacctctcccacaataagcttctctgtctgcaaaataatctgtatacccatacctgaggagggcttggggtaggcctccgttacatttacattcatcctttcaccattacgaggtgggcaaacagactaatcttctctcagtctaagtaatatgatctagacaacgctcacctccagccaccttgtgagccccaagccgtgagacattcgcgcggcactgactctcgtgtatactgtccagccctcaccacccagaggtacacgataatcatac

SEQ ID NO: 685140 - DNA, 323 bp, Homo sapiens
tcagccatggtgatgctagtatagtacgggtgccagtattgcccagagtggctagtattccacagactagccagacattgcacaggtacccagctatggaacagataatagcattgcacacgtatccagtacttataacatatgttaagcctgtcccctctggcatctccatcacctcatttcttaggataatgagaaagtgggacacgagtcccatactgcattttatgaccttttctgaaacacttgcctgacttctaacacagccttattttggtctcatgttctcacattggcactggatggcttttcgacctgagaag

SEQ ID NO: 685141 - DNA, 494 bp, Homo sapiens
gggtctcataaacaaaggggaatggatcttcttggatcatttatttggtccttggcactaaatttcatctttatacttaaggttatttaataaaataatcagctatttaaggggaaacaattataacataagctatacatggcaggtagcaaggaataatcacataactacagatatgaggaagaccgtatggtctcagaagctggattggggctcagagatataagcagcatataaaacccatttctcagaagccggtgtacactaaagcagagatcccaaacaagggaaacagtttttttctatttaaccctaataaggatatccattccagcagatccttagggaaatctaccagaaaaaactggctcatcaaatccgggtggggtggaaagtgatactggtggggggcacatacagggctcttttacatcccatggagccgtgaggtgggctcagattcatcacaagaccctggtctggtcattcacctc

SEQ ID NO: 685142 - DNA, 164 bp, Homo sapiens
cacgagggaaatcaatatgaaagaaaacgtgacaaggcaccaaagcttaccgtgacaatcagagctttgttgcacaacctgaaggaaaagatcgcccttttgaaggacttattgctaacagctgtgtcaacacatcagataacacagctttgaaggggaccgaa

SEQ ID NO: 685143 - DNA, 151 bp, Homo sapiens
gtattaccgcacggtgctaagaacttaccactatttaagactctcataatggctggtgaaataggtgggcttattagttaccatattacagatgaggctgtattctagctgtcactgctacttcctctgtctatgctgttcttctccctct

SEQ ID NO: 685144 - DNA, 426 bp, Homo sapiens
  misc_feature (190)..(190): n is a, c, g, or t
gcgcgcagtgcttggccgttactttggttgtgggccttcgttctttgtgttatgcccaagttgccgtgtagtggggcggcgctgccttggcacgtcagtcggctggatgtggcctccgccccagcgcctgttctttggtacggttccccggagggccttcgtgtgtggtttccccaccgttagctcctcngagtggtcgtctgacgcgccctcgcgcctcggctgtcttcgtactatggtcccacgcctcctccccctcccgttgagttgttcccccttcggatcccggcctttccgacttccgcggcaccgatcgtgacgtcaaaggcaggccgtgtggtatcgcccgcggaccgttcttgttgttgtttgtccggcgtgtgtgttgggtcatccttgatgtgtgttgctccgcaccgaacaaga

SEQ ID NO: 685145 - DNA, 442 bp, Homo sapiens
  misc_feature (12)..(12): n is a, c, g, or t
  misc_feature (70)..(70): n is a, c, g, or t
  misc_feature (72)..(72): n is a, c, g, or t
  misc_feature (81)..(81): n is a, c, g, or t
  misc_feature (96)..(96): n is a, c, g, or t
  misc_feature (156)..(156): n is a, c, g, or t
  misc_feature (159)..(159): n is a, c, g, or t
  misc_feature (168)..(168): n is a, c, g, or t
  misc_feature (184)..(184): n is a, c, g, or t
  misc_feature (187)..(187): n is a, c, g, or t
  misc_feature (189)..(189): n is a, c, g, or t
  misc_feature (217)..(217): n is a, c, g, or t
  misc_feature (226)..(226): n is a, c, g, or t
  misc_feature (257)..(257): n is a, c, g, or t
  misc_feature (265)..(266): n is a, c, g, or t
  misc_feature (273)..(273): n is a, c, g, or t
  misc_feature (312)..(312): n is a, c, g, or t
  misc_feature (323)..(323): n is a, c, g, or t
  misc_feature (330)..(330): n is a, c, g, or t
  misc_feature (344)..(344): n is a, c, g, or t
  misc_feature (346)..(346): n is a, c, g, or t
  misc_feature (353)..(353): n is a, c, g, or t
  misc_feature (406)..(406): n is a, c, g, or t
aggggtgaattncacggtgtaaacaaaaggtatataaataaatggaggcttcctctgggttagggtgggntnagctaagcngtatccccctctccntgggccaagctgctcttgtgggagtaaagtggtggaaggctactagggagagagggatcnctnggccctttntagtgtaggagggtcnctncnccagtggctgagatggagggcaggaggngcccaaggnacatgacagggttgggggagggagttataanggaggggnnagggtgnattctgcacccgagccaagaggtggagaatggacctgtntctatttgtcnctttcancctctgttcctgcncnagaaatncagggcccagcctgcgcgccatcttgacctggtacaaggatggggtttatgangctagttatactctggaggtgcatcacacagcatta

SEQ ID NO: 685146 - DNA, 655 bp, Homo sapiens
taacccctctttagttttttgggctcaaaaacacaatttaaacccccccccccttgtaaggggggggcaggaggacaaaaggaaagagaaccgcacagaacgccaggcggggaagaccaacacaggttcggtgcccccggacaaattaatctcgcgcccgtgagtgggatttggggttttcacatttcttgcccctgtgtggggcgtgggagtgagaagttgagaggggtggagacgccctcagtgggagggagcaagcggggcccaagtgtggaggccccctttgggggagacagagtctctgaagagagggggtgagagtgtgggggagaagagcgcccaactgtgtctcgcggacgcggaggatctctgcggggggggacacagccggtgggtgtgggtctctcacgagagaaaaatgtactcgagagagtgagggcgagaaagggggagggttgttggcgggcagagggggtccctcctcaacgagggtttgtccacgggagagtgggtggtctccggggaggccccacagagaagaggggcgtctgcctcggggtatgggcacctagaaaggttgggccgcggagagggagaaaagaggggccaaccgggttgttggtaaccacaaggaggtgtccccaccaaggcaggg

SEQ ID NO: 685147 - DNA, 119 bp, Homo sapiens
gttactgaaagttcgtgatccagcaaaccctcagtctagacaaaccagcactgttgatccccctacctgcctctgtgcccatatgctcaggctagcttgtttgtttgttcatttgtttg

SEQ ID NO: 685148 - DNA, 368 bp, Homo sapiens
ggaaatactgtggttgtggttgtaagtagctaagatgaggtcatactggagcagggcaggcccttaatccaatatgactggtgttccttataaaagaagatagggcggggatggtggctcacgcctgtaatcccagccctgtgggaggccaagccaggcaaatcgcttgaggctgaggagttcaagaccagcctggccaacatggcgaaaacccatctctactaaaaataaaattagccatgcgtggggcttgtaatgtcagctacccaggagtttgaggcccaagaatccctcgaacctgggaggtggaggttgcgagatcccccccctgccctccagtgtgagcaacagaacgagactctgtctca

SEQ ID NO: 685149 - DNA, 148 bp, Homo sapiens
cccctcacaaacctgttaaattccgagatcaacgaatcgtagcgcgtcaggttggtatggccgtagacggcagaagcaggaggcataagcaggaagcagaagctaggaggcaaaaccaggaggcagaaacaggaaacagggtctggtg

SEQ ID NO: 685150 - DNA, 264 bp, Homo sapiens
  misc_feature (38)..(38): n is a, c, g, or t
acgacccccacacaacccggggcgcatagggaaccggntaaaaaaccaaaaggatagatccattaatgaggaacaaatgtggcctcatgttgggacagaacaggcccaaatggaaaagaatgaaagagaaagacagatagtcacacacacacacacacacacacacacacacaccctgcctgggcaactagggcactgatttcttacagcaaaaattagtttctcccatttcagaacttcatataaaagcacgcaatgtgtatt

SEQ ID NO: 685151 - DNA, 231 bp, Homo sapiens
  misc_feature (80)..(80): n is a, c, g, or t
atacaaagattaactcaaaatggatcatagacctaaatggaaaaacataaactataagatttttagaagaaaacataggncaaaaaaaaaaaaaattttatgcccgggtctaaggcaaggggtccttagataagacggcaaaggcttgatcctttacacaggaaaacggataatttagactcttcatccaaattttaaaactcttgggtcttggtgacaagaccttgggtt

SEQ ID NO: 685152 - DNA, 351 bp, Homo sapiens
  misc_feature (9)..(9): n is a, c, g, or t
  misc_feature (43)..(43): n is a, c, g, or t
  misc_feature (96)..(96): n is a, c, g, or t
  misc_feature (107)..(107): n is a, c, g, or t
  misc_feature (175)..(175): n is a, c, g, or t
  misc_feature (181)..(181): n is a, c, g, or t
  misc_feature (260)..(260): n is a, c, g, or t
  misc_feature (280)..(280): n is a, c, g, or t
  misc_feature (301)..(301): n is a, c, g, or t
  misc_feature (323)..(323): n is a, c, g, or t
ccaagcccngaatcccatgaaggcatgcaattaaatgaagggnctaacagcttaagttagttaaagtgtagggttaaaatatttaagcgatcaaanagattaaccgnagggattaaagccttgaatccatgcccaggagattgcgtcttttaaacctagttacgcatttactaancgcagncgaaatggaaagattaattgggagtggtaggatgaacaatttggagaagatagaagtttgaagtggaaaactggaagcngaagtccgggaaggcgaagnaaagaatagagaagatagggnaattagaagataaaaacatacntttagaagaaaagataaatttaaacctg

SEQ ID NO: 685153 - DNA, 334 bp, Homo sapiens
tttacagggtggaccgtaacagggtggaccataacagggtggaccgttacagggtggaccgtagcagggtggaccataacagggtggaccgttacagggtggaccgttacagggtggaccataacagggtggaccgttacagggtggaccataacagggtggaccataacagggtggaccgttacagggtggaccgtaacagggtggaccgttacagggtggaccgtaacagggtggaccataacagggtggaccataacagggtggaccgttacagggtggaccgtaacagggtggaccgttacagggtgaccgttacagggtgggtcgacgc

SEQ ID NO: 685154 - DNA, 595 bp, Homo sapiens
atcaggcgaatagtgtggcatgcgctgatatgctttatggtgccgagtcccatatccgaatgattaagagtgggagaaagtggcatgatagtttgcgcgggcttcttacaaaaaacaaccggatggacttgggtccagtctaatgcacgcctgctttatagaaatggaagaccagataatatcattgtaactcagagaccactaacagatgaggccggcacagagcatttacgaaaacgaaatacgaagtttgcttttatgtatgccactggagacgctgtgttgttctgaggcaaaccaaaccttctcctgccataatggctcccttaccactagggactagaaatggctctaggtggaaccgactctgctaccacatccagtctaggcaaggactctctcaatcctagttccctccggggtgccatgatgccaacgagatgagtctatttatctctatccggctacaagtagttcaggtaccgcaccttttgaaaacaactttttcaaccgaaatctatgcatgactgcagatattggcaagataatactgcaccgatgggacatgaactatactgtaacatgagcaaattgc

SEQ ID NO: 685155 - DNA, 749 bp, Homo sapiens
cattaccctcactaaagagcattgagcagctccgctaagatgctaactgggcagtctgtatggtcacctgagaaagtcttagcagagaatttttggattcccacccagaagccctctcagccactcaaatgcctatcttctccagtctacaagttacatggtccccacccagcattacagttcttgaacctgttatttctccacttactggtttaagttggttttagtcactggataagtattataatagagttacttagctgtggttttaatacccttctgttaacaatttggcaggcaaattaatggccttttctaacatagtacaacccaccaaagacctcgacaccatcgttaccttgaaaccgattatggatcatgcccacaaggatccaagccaatggctgcatcgaggtaaggggtgaagggtctgtgctagatcaaaaggcacggggtggcgatgtggcaaagaagttgcttgtggggagaccttgcttttaacaggcttctggaaaagctagggaatagtggttgcccgctttccccctttccctccccttcaagcaccgcttgagatttgggctttattattaagagctctttaaaacagctggttaattgtaagagaagccatggttctccagcttcttcgatgctcccccgaagagggttgggcgtctcttacataaatggggggtgctttctggctagtataggtttgctctcccgaggcggttcctagccggcta

SEQ ID NO: 685156 - DNA, 1191 bp, Homo sapiens
gctgctgcctgcctgcttctgggaccctgactggtgcctgcgcctcttgtcagcctgcctgacgacccaggcctgtgccgtgcccccaaccatgcatgccctgatggtcttcttgcaaccagattttcataaacaatgaatggcactgatgcctgtcagcaggaaaacattccccaccgtcaatcctgtccactggatgaggtcatcttgtcagtgtacgctagaatgtgtggacaatggaatgattgtgtgacaatggcagttgaagtgcctgccctgtggcctgccttccaagctggtgctcacctatggacgccgcatggactgcatcacacgagcgggcctggcttgcttgaacctgccatgtgcctgatcttgatctgagcagtggcacctgtgaccataccaaggctgtgccttgtgagcacacctggacaattggacaagccctaatgtcatactccactaacctaggatggattttgagacataggtacctacaaactgctctcctgagtattattgcccggcttggtgcttgataacgtagccacggcgacacaaccatccccatttgaccggatgacttctatcagcatacacactgccatgaacctcgtgcgcacgagtgtgcagggcaagatcatacctgttgcgacatttcccgcatccttgatgcaatgcattggaacgctgggcccaagacctttcggcaacctggcaaacctgctgcatgtagactagacaccgccagcctcgacccaagaacaaccacctcaacgagcactctactgtggccaaaccttactcacaacggacgactcgactataccccacttgtagtgccccacacactagcagccactggcacacagcggcacccacagacactgaggacaccacaacaaatgcactcaccaagaacgcactaccgcacaacccggcacacaccacgccacacccacactgcaacactggccccggccaccaacccgacgacaagcagggcaccaaactacaccccacaaccaacaacacccatcaacacgcgaccacaccaaggccagagacaaccaagcaccaccacaccaatgcaaacacgcacacaacaaacacccaactccaccacaccaccaacacacccccacaacaacccaaagcacccaaagcaaacaccccacaaaccgccga

SEQ ID NO: 685157 - DNA, 194 bp, Homo sapiens
ccattccattccattccattccattccattcctgttcattccattcgatgatgattcctttcatttccattcgatgatgattccatttgtttccatccgatgatgattccatttgattccgttccatggttattcccttcgggtcccttgggacgatcccattcgattccattcgatgatgattgcattcgagt

SEQ ID NO: 685158 - DNA, 358 bp, Homo sapiens
agccctgggcggggcgggtgggcaggaaggtgtgccttcggtgagaggcaagagtgtgtgttgggtttgtgtagcccactggggttgcacctcctcctaaaggttgggcttcttgcctctgctgccaccatcctgtttgcgccggggtctgcctggaaaatgggcaccctcctcagtattgtacttgtggaagcttaagctggagctacctcagtgcacggatgggaccggcccttccagccctgggtgggctggtgacccagcaaggggtgagcagggacgatcacactcccagcttcaggtcagctttttatacctcagattttatttgcaataaagatcctatagccaccctgca

SEQ ID NO: 685159 - DNA, 695 bp, Homo sapiens
  misc_feature (32)..(32): n is a, c, g, or t
  misc_feature (90)..(91): n is a, c, g, or t
  misc_feature (173)..(173): n is a, c, g, or t
  misc_feature (244)..(244): n is a, c, g, or t
  misc_feature (278)..(278): n is a, c, g, or t
  misc_feature (294)..(294): n is a, c, g, or t
  misc_feature (345)..(345): n is a, c, g, or t
  misc_feature (376)..(376): n is a, c, g, or t
  misc_feature (405)..(405): n is a, c, g, or t
  misc_feature (434)..(434): n is a, c, g, or t
  misc_feature (437)..(437): n is a, c, g, or t
  misc_feature (461)..(461): n is a, c, g, or t
  misc_feature (485)..(485): n is a, c, g, or t
  misc_feature (599)..(600): n is a, c, g, or t
  misc_feature (676)..(676): n is a, c, g, or t
caaatttttagtttaagttaaattaatcacgncaaaaacgttgtggcatctgatcccttcttcgttcaatctgaagacgtgaattgggcnncccctgttgatggagacttcaagtgctgcgaggtgagtttctaccaagggttcatgtgtcaggtactatggtgctggtaagnggacactaagaggtctgcgtggctggaggctctgggaggtcctacagagagtgcctgcgcgagcaaggggntcattctggtcttcgatctccaggatctgtctcngaaaggcctcaaagcncatagctgccatcattctccggcgagcccctcaggtagctgcccatctccnggtttgcacccctcaagtttcaccccctggnaattgatgcattcttcgagctcctgcgcncagcgtctggatgcaggttgtgggtggcnggntgagaaaatccaaaaaagtcagcnccagctggaagcaggttaggcatnagtttccccatagtagtgcttatagtcctgagcagttctgcatgacaagcatctgcagaagagctgacaatggcattctgggggtcatcttcaggaacaatttcaaactgaggnngcacaccaccatccttgatctgacaggtatatagacacttctggtctgggcacttcatgctggcatatattcgagnactgcaatagcccacgggg

SEQ ID NO: 685160 - DNA, 469 bp, Homo sapiens
  misc_feature (55)..(55): n is a, c, g, or t
  misc_feature (355)..(355): n is a, c, g, or t
  misc_feature (362)..(362): n is a, c, g, or t
ttgcgggggagcacagacagcccgggccctcccggctgcaggtcccgggctttcnccgcgcggttgccggctccgcccagaggagccgcgcccggcggaggggtaagaaaggcagggtcgcggcgtcaacgcggcggccgtctcgagtccagggcccgcgtcctccccgacctcccgacgccacctcacggcctcagggggactgggctcccgggaaaccgccggccacctggcggacgaacacaggcagtggcgggcagtggagacgccagggaccaccgcgctgagagcgatcactcatccgccagccccgccccgcgagccccgccccgcgagccccgccccgccccgcganccccgcnccgcgaccccgcaccgccggccccgcaccgccagccccgcgagccccgccccgccccgcgcgctcctcgcattggccgagtccccgcggccacaccccctaccagat

SEQ ID NO: 685161 - DNA, 506 bp, Homo sapiens
  misc_feature (55)..(55): n is a, c, g, or t
  misc_feature (392)..(392): n is a, c, g, or t
  misc_feature (399)..(399): n is a, c, g, or t
ttgcgggggagcacagacagcccgggccctcccggctgcaggtcccgggctttcnccgcgcggttgccggctccgcccagaggagccgcgcccggcggaggggtaagaaaggcagggtcgcggcgtcaacgcggcggccgtctcgagtccagggcccgcgtcctccccgacctcccgacgccacctcacggcctcagggggactgggctcccgggaaaccgccggccacctggcggacgaacacaggcagtggcgggcagtggagacgccagggaccaccgcgctgagagcgatcactcatccgccagccccgccccgcgagccccgccccgcgagccccgccccgcgagccccgccccgcgagccccgccccgcgagccccgccccgcganccccgcnccgcgaccccgcaccgccggccccgcaccgccagccccgcgagccccgccccgccccgcgcgctcctcgcattggccgagtccccgcggccacaccccctaccagat

SEQ ID NO: 685162 - DNA, 143 bp, Homo sapiens
cgacggcagtgcaccttgattctgcaggtgactctaaggacccctgcgcgcaagaaccgcccaggcgaattcgagtgtttaattaagatacaaagcattcgtcgaaggccctggggacggagtgtttgacagtctgatgttga

SEQ ID NO: 685163 - DNA, 626 bp, Homo sapiens
  misc_feature (212)..(212): n is a, c, g, or t
  misc_feature (244)..(244): n is a, c, g, or t
tctccaaaatctttcccagaatatcccatctctatgcgtggtttccgcctccatgtgatactcgaattgctagcaaaagatgtccacccacactcttggattcccctttcaagcatacttttctgacaggaatatcctacttttaatgtctttataatatagaagcctgagaattgtcaaaccaccaaggtcttggctctatttttgcttancaattctttccctctgtctatttcttccctcnagcattgtaatatacccagcaagaagaaatcagtccacatcttcaacacttggctgggaaatctccttagctaaatatccaagcttatcccttataagttattctatccatctagctctaggacaccattcagcaaaaatttctgccactatataataaggatccactttcctcaagtttctgatattacatttttcatttctttctgagtttttatcatctgtgcctttaatgttcatatttctactaacagtcttcatgattctttaaaacaatacagtctcatctgtcatactcctcctttctttttgaggtgtcgctagcaaaatcattaatatctgcatttctactaacagtctgctcaaggcaatctaggcttttt

SEQ ID NO: 685164 - DNA, 246 bp, Homo sapiens
ctccccgtatatgctcagcaatgggcatcaatgagagagagcagaggagaagttaagagggaatggagtgggagggtgtagatcatgagggcctcaggccgcttaagatagctgggattacaggcttcccaccaccacgcccagctaatttttgtatttttagtagagatggggttcaccatgttggccaggctggtcttgaactcctgaccactactcctgagtccagtactcctgagtccacta

SEQ ID NO: 685165 - DNA, 1607 bp, Homo sapiens
  misc_feature (1009)..(1009): n is a, c, g, or t
  misc_feature (1280)..(1280): n is a, c, g, or t
gactcctcccgttcgacacagacacgctagtagagagccagccaagagaggacaagaacagcgaacagtgtgtttctgcttgtctactctcggagttgtgtcgttcttcccttttgtacacgctcttttttgaagtacaccgagggttgtgttcactcccctcctctcctgtggggctatttgtttctgcctccacacatgcggttgcctcccccttttgactggagtagtaggtctttcgtgccctattctttcgccccgtctctgcctctgatgatatcttcgtggtgtcttctacttttctcgtcttcgatgggccgccgtaacccactcgtcttgtgtgggggcaccagcaatgggcagcctctcttctgtggtgtgccccactttatttgctgctgtggacttctgttctgcgcacccgcgtgctggtggtgtgtgatagcttatatcttggttttttggggacatcgctgtgtccccacgggggaagatgttgccccctgtgttgccacaggtcgccacagtattgtgtgtccaggtggtgcgtttctgcagggcccccatgttgccgcccttgaggttgtgtcgctccaggttccctttgggaagcccccaacttgtgggggtcccatcactgtcgtgtccccaatggccccctttgtccctttcttttttgaaccccaaggtttttgggaatgcctcctctcgcgggggttggggccatagtggaataatatgggcccccaatacgtgcgcatcttactcgcccgagaaaatcgcatgtgccccttgtttggccgggcgccctccaaggccaacatcacaccagtggttatccagagagggtggttcacagagagtatattgtcccccgggcgccttttgggtgtgttctccgggtccaatttgcgtgaaatgtggagggagaaatctcccaaaaatgttggcgtctaatatattgccgcaaaaagcccttgtggccccccttgtgggctcactctcaccncagtccaatagagatgaggcctctctctctctcctcgtggctcggccaacccactgcgagagccccccttcgggtggaatatactctctctctttctccgcactagggggatatccgcgcgctctttaagagaaaatatattcgccgcgcttatagggtttctttctctcgcgatagccccactcggggacacaagaccaccctccagcgagacccaggcaccagaattatattccagatgaagactggacccaaataccaaatgggcccncggggaatgtctcggtggctgtgccaggacccaagaggtccaatacccgcacacaatattgtccaccttcactgatatgctggccatacccaccacatcatagcccaggaccattggtgcaccagaagacttgacacccagttccggagccctcgatagtacttctggggagactttaagatttgagaaagaagaaacctcctccagaccccgagtggaagagtggccgtccctagcccccctttgtatgagaacaccgcttttttgtaaaagggatcccagcacccctcccccggtttttttttccaataaaagtttagaaagata

SEQ ID NO: 685166 - DNA, 761 bp, Homo sapiens
  misc_feature (125)..(125): n is a, c, g, or t
  misc_feature (152)..(152): n is a, c, g, or t
  misc_feature (503)..(503): n is a, c, g, or t
  misc_feature (511)..(511): n is a, c, g, or t
gtaattcgagcccgggtacccggaaaatgtagccgacgctaggcgtatacttcaccctcctccaagcctcagaatattacgaagcaccattcacaatttccgacggagttgtatggatccacttnctttgtggctacagggttctcacgggnttgcacgtaatcatcggatctactttcctagcagtatgcttactacgacaactaaaattccacttcacatccaaccaccacttcggctttgaagccgcagcctgatactgacacttcgtagatgtagtttgactattcctttacgtatcaatctattgatgaggatcctactcttttagtattaagcagtacaattgacttccaatcaatcagtttcggtaaactccgaaaaagagtaataaatattatactaacactattcacaaacgtaaccctagcctccctactcgtactaatcgcattctgactaccccaactaaacacatattcagaaaaaacaagcccatatgnatgtgganttgaccccatagatcacaccctcccattctcaataaaatttttcctagtagccattacattactcctttaagatctagaaatcgccctcctccttcccctaccatgagcatcccaaacaaacaatctaaaaacaatacttacaatagcactattccttcttacctactagcagcaacctagcatacgaatgaacccaaaaggctagaatgagcagatatgatattaggttaaacaaaacaatgattcgaa

SEQ ID NO: 685167 - DNA, 730 bp, Homo sapiens
  misc_feature (125)..(125): n is a, c, g, or t
  misc_feature (152)..(152): n is a, c, g, or t
gtaattcgagcccgggtacccggaaaatgtagccgacgctaggcgtatacttcaccctcctccaagcctcagaatattacgaagcaccattcacaatttccgacggagttgtatggatccacttnctttgtggctacagggttctcacgggnttgcacgtaatcatcggatctactttcctagcagtatgcttactacgacaactaaaattccacttcacatccaaccaccacttcggctttgaagccgcagcctgatactgacacttcgtagatgtagtttgactattcctttacgtatcaatctattgatgaggatcctactcttttagtattaagcagtacaattgacttccaatcaatcagtttcggtaaactccgaaaaagagtaataaatattatactaacactattcacaaacgtaaccctagcctccctactcgtactaatcgcattctgactaccccaactaaacagattcgaaataaacctattagcaataatcccagtattaataaaaaattttaacccacgagccacagaagcagccacaaaatatttcctaacacaagccacagcctccataatactaataatagccatcatcatcaacctcctatattctggccaatggaccattacaaagatatttaacccagtagcaataacaataataaccatggccctagccataaaactaggactctcacctttccacttctgagtcccag

SEQ ID NO: 685168 - DNA, 570 bp, Homo sapiens
  misc_feature (125)..(125): n is a, c, g, or t
  misc_feature (152)..(152): n is a, c, g, or t
gtaattcgagcccgggtacccggaaaatgtagccgacgctaggcgtatacttcaccctcctccaagcctcagaatattacgaagcaccattcacaatttccgacggagttgtatggatccacttnctttgtggctacagggttctcacgggnttgcacgtaatcatcggatctactttcctagcagtatgcttactacgacaactaaaattccacttcacatccaaccaccacttcggctttgaagccgcagcctgatactgacacttcgtagatgtagtttgactattcctttacgtatcaatctattgatgaggatcctactcttttagtattaagcagtacaattgacttccaatcaatcagtttcggtaaactccgaaaaagagtaataaatattatactaacactattcacaaacgtaaccctagcctccctactcgtactaatcgcattctgactaccccaactaaacaggccccgaaaaaactggctacatggtccatgtctatcaagtgctcattagttacagaaacaaaaattctgtcatttgccagaaccacaaatatcg

SEQ ID NO: 685169 - DNA, 1110 bp, Homo sapiens
tgcataactagaggtcaaatatgtggtggaccccgagtgaaagttctgtgaggaaacgactcaatcgccatctgtgtggaagccttctcctggtctgcaggtcgaggcgggctcgagtatcctccagagaatatgaacgaagacacatgaccggccgaataacgtgatcagactgtctcagatccaggaaaagatggccagagagaagcttggcatgaaataggattggggtgacattttggggttatattagaagaagggttacgccacagagtgtgaatagtgtgaaaaaccttcagcatatggaaactgaatgatcttcgtgacctgacacaattgtgtgtacctatggtgcttagtttggagaagttcacaaagcgctctggaagacgggagcaggagactgtcgtaggggatcctcaatgccaaccccatgaagcccaaggatggttcagaggaggtgtgtctactctatcgatcatcctcagaaggtcttaattatgggtgaagctcttgacctgggaacctgtaaagccaagaagaagaatggagagccgtgcacgcagactgtgaactatgcgtgactgtgagtactgtcagtaccatgtccaggctcagatacaacgacagctcagtgcaatgctgtgcgggatctgcagttcaagctatctctgggagcaacgaattccacaagacagttggcccgcagaaggcagccagacatcaaagaactggatgtgccaagcatggcttcacactacgagacggcagaatacattacatgcactacggaattgcagaatataaattggcttcacggcatgatgtgttccttaatcaaaggtacggaatctaaaaacacactgttgtggaacaaaccagggagtctcacacggagtctcaagacgttgatactccacgggctaaacgtcgctacaacattcctgtaatgtaaccccgtagaaaaacactgtaaaatgacaaccgagaacgagccttcagcttgaacacatgaatagacagtgccccaacgtttgtgtggatcagcgaaaacaaacaccacagcctatggatcgcgtcacctcaatacagtgggtcgtaaccacatcc

SEQ ID NO: 685170 - DNA, 83 bp, Homo sapiens
aatcgctaatcctaaccgaaaatacccaacaaccagtgggcagtatgtcgtaatgggcaactcatgcagaggaaacaactact

SEQ ID NO: 685171 - DNA, 171 bp, Homo sapiens
caaaagggagggcaaggcggcgaacaaggcgagatcaaagggagacacgacggccaaagccacagcgcgccggcgaggagcgaacgagggcagacaaagcgacgaggcgaacagaggacagaaagaagaaaacgagcacaggaggacacatgtggacgcgcgcactaggga

SEQ ID NO: 685172 - DNA, 142 bp, Homo sapiens
atacatttaatgtgcggctgccaggaatctagaccagcctgggaacttggtaccaccttctctctacaaaaaatatttaaaaattagctgggtgtggcggtgcacacctgtggtcccagctacgcaggaggctgacgcaggg

SEQ ID NO: 685173 - DNA, 252 bp, Homo sapiens
ctctacggcttcatccatttcactatcatattcatcggacgtatatctaatctattcgtctccgcacaacactttctcgagcctatccggtaatgcccctgatgtatcgtcggtagctacccctgatgcatactccacatgaaacatcctatcatctgttggctcattcatttctcttacagcaatagtattaataattcccatgatttgagaagccttcgcttcgaagcgaaaagtccagaatagccccta

SEQ ID NO: 685174 - DNA, 394 bp, Homo sapiens
  misc_feature (135)..(135): n is a, c, g, or t
attctcttgtctgactctcttttcagactcagccgcctgcaccaggtgaaataaacagctgttgcccacacaaagccgttggtggtctcttcgcaggacgtgagtgaaatttgggtgccgtgacttggatcaggngaacctcccttgggagatcagttccctgtcctcctgctcttggctccataagaaagatccacctatgacctcaagtcctcagaccgaccagcccaaggaacatcacaccaattttaaatcaggtaagtggcctctttttactctcttctccaacctctctcactatccctcaacctctttctcctttcaatcttggtgccacacttcaatctctcccttctgttaatttcaattcctttcattttctggtagagacaaa

SEQ ID NO: 685175 - DNA, 383 bp, Homo sapiens
agcatagaacattgaaaacattacataagtgtttaacgggtccttctgcataaaaaagttgatcaagatatagatattaagctacaacagcttgaatacattctgagatgttgtctgcaggtcacatcaatgtgagtacttacattttcccattttgtagctcactcatcccttcattgcatgtccattgtctgtgtctaataacactcttaacatgctagaggtatttcatttgatatttagcttctgaaagccctttgttataaagggacgtgattttctaaatttggtagcagcttgaaaacaagcaccacaaatgtaaaattgcatggttcttattttactaatataatttttaagccaagttatgtgctagcaaaatg

SEQ ID NO: 685176 - DNA, 494 bp, Homo sapiens
  misc_feature (442)..(443): n is a, c, g, or t
  misc_feature (457)..(457): n is a, c, g, or t
caatgattgtcagtgcatcaacttgtggtgctaagaatttacagcaatttgaaataatgagttttgattttaagcaagcagcgacagttaatgttaagtatgttgatacaaaaggtaatcaaattgctcaaggtgaggttacttatccaaatggcgctaatgttaatggtacttatactacaggacaattagaaatttccaattataagtttgtaagaatggatgatggtactgccactggagcaaaaagtttgccagcgacgggtactctaacaaaagctggagataatgggacggttatttatgtctatgcagaggatgcaccaacagtcacaactgaaagcaagacagttaatgagacattcattatcaaggcgctggtaatcaaactcctgctgatcacaccgctcaagtgaccttgacgcgtcaggctcactgacgnntaactggggaaagncgtatggtccttggtcagcagatcaaagctttgacgc

SEQ ID NO: 685177 - DNA, 139 bp, Homo sapiens
gacccaagtcggcggaccttcctctcctcccacctcccataagataggtatccataaagcagagatttctaagcagtgcgagacttcagtattttagattagattctgggttataatagaataagatcattagtagtag

SEQ ID NO: 685178 - DNA, 460 bp, Homo sapiens
ccgcctactactactactaaattcgcggccgcgtcgacgtgcctccaagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaatggaaattgt

SEQ ID NO: 685179 - DNA, 464 bp, Homo sapiens
gaccacgcgtcgggacgcgtgggtcgacccacgcgtcgccacgcgtcgccacgcgtcgaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaatggaaattgt

SEQ ID NO: 685180 - DNA, 235 bp, Homo sapiens
catgtccgtcatgcatgtggatggttgtatgacagaagctatttccttagaggaccagataatacacagcacaaattctcagctgggcacagtggctgacacacacacatacacacacacacacacatcacagacgaggcgtttgcgagtagaatataccgtgtgtgtatcgtgtcttttatatgctcaagtgttctctctctggtgtgtcgccagtgtatgagctgcgtgcggg

SEQ ID NO: 685181 - DNA, 860 bp, Homo sapiens
  misc_feature (54)..(54): n is a, c, g, or t
accaaagaacaacccatggcagtgatgaggccgtgcggctaagcgggcacgagngccaagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaatggaaattgtacttaaaaaaaaaaaaaaaaaaaaaaaaaaaaaaaaacaaaaaaaaaaaaaaaaaaaaaaaaaaaaaaaaaaaaaaaaaaaaaaaagggggggggcataaaaaaacgccaggagggcgcaacaacgcacagacaacccgcctaggagaaaaaggggaccacaagagagggacaatacaagcaacgaaagccagaccagaaaacccccccacgaggaaaacaacgcgcccgaaacacacgagagaaaaccaaaccccagagagggagcaaacaaaggagcacacacacaacgacagacacaacacaacagaagcacaacaccaccaggagagcacaggaaaaacaagcgaacgccgccacacaaaaagaccagaaaaaaaaacaaatcgg

SEQ ID NO: 685182 - DNA, 859 bp, Homo sapiens
  misc_feature (464)..(464): n is a, c, g, or t
  misc_feature (468)..(468): n is a, c, g, or t
  misc_feature (470)..(470): n is a, c, g, or t
ccgcctactactactactaaattcgcggccgcgtcgacgtgcctccaagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaatggaaattgtaaanaaananaaaaaaaaaaattgggggggggccggggccgaaaaaagttaaacaccactgggggggggggggggccccaggggaggtgaaaccgtggccaaagcggtcccagagaaaacccgggccagaacagagggcgggggttcctcccacaaaaaaaaacgcgcggcggggaccggaggggttttggaaaaaaacccagagagggcggtcgggaggcgctacggacctaccaaaaggagccagggacggaataaacacgccccgcggagcgagggaagaacaagacaacgaactaaacgaaagacgaagaagaaagcaggagacaaaagcaagtcaaagtgaaaacacaagaaggaaacagagagaaacaccaagagagagagaacagataacac

SEQ ID NO: 685183 - DNA, 962 bp, Homo sapiens
tacgtcgcccttacacgccggcgggtttagccgacaagtgctcggtgccgagagctacggaagggtgtctaaaacggagaaatgggccgaatcaaattgggaggggttcttaacgccaccttcacggcggttaaaatcttggggcctccccgaacccggcgaaataaggcccttgcgctttggagggaaacaaatggtcccgggcatcaagaccacaatacggggggggttcctttacccttaggcgcgaggaccccccagatgatccgtcggaacagaatccccccacggggcttcctgaacatgattaaataaccaggtcccccctgcgtagggtcacaatcacacgccaccacaccaaccgccggggttctaaaatgagggtccttccgcaaaaagctctttgggtaaaaacagtcgggggggcccccccacccaaacagggagcaccacccgcgagtaatatttaattctttgtggtccacaggcgatgcgtccaaccgatggagagatcgagcacccacacaggctctcggggggactaaccggaggagaaaaatcgtcaatcacgtggtgtcacacaccacacgcacatggcgaactggggagatgaataggcaacccacccccaggtgggtttatcatgtggaggtgagtcccccggcgaggagcgatcacccaaaacggttccacccaactgactccaaataggatgcccacgtgcgcagaattattacccccccacacgaggggggaaaaccaaggcgtcgtcccacttgaaacgacatcaatcgacaattgtgagtacgcaatcccactcgtccagaaagcaggtctcacaagcgatacatgtcttagtgattggccaagagcccctgcaagggagagaagacgtggtggggcgtccccagaaaagtattttgaggttcccttacaaaaaaattctcttcccaaaaataaca

SEQ ID NO: 685184 - DNA, 567 bp, Homo sapiens
attcgcggccgcgtcgaccttcagcatgagcatcaaccagtatccttgtcaggtggcccccattcctctacattcctggatggtttgggatcccacagaactctaatgattacataagaagagtggcccgtcctctctccggtccgtgcctccaagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaatggaaattgt

SEQ ID NO: 685185 - DNA, 953 bp, Homo sapiens
attcgcggccgcgtcgaccttcagcatgagcatcaaccagtatccttgtcaggtggcccccattcctctacattcctggatggtttgggatcccacagaactctaatgattacataagaagagtggcccgtcctctctccggtccgtgcctccaagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaatggaaattgtgtacttaaaaaaacaacatttgagatggcatatgccaagagaattttgttggcgggccgaggggcccgaaaaggttctaaagacaaccttagtgggcgtccacggccggccctaactgggttacgtggcaccggtgtcccaacgcggtgcccagaggagaaactggtatctggaaagagggttgggagtgtccaccaccaataaagaaaggccgggcgccaccgcgacgtcgttggaaagaaacaccagggggggatcaggagggcacaacgggtacttcaccaggggcacgaggaggcgaaaatgagacggcgcgggggacaaaagcacaaacagacaccaacaaaggcatcagaggagcagacagaccgagaaaggacacaaaa

SEQ ID NO: 685186 - DNA, 978 bp, Homo sapiens
ggagagagagaactagtctcgagtttttgggttttttttttcccggttgcggcgccgcgcgggaggttgtctattccacgctcgaagccatgccgtccaaggttccgttgcatcggtgcaggtcttcggacgcaaaaaaacagcgacatttttggcgcattgcaaacgcggacaatggtctcttcaaggtagaacgggtggccctttgtgagatgattgagccgcgcacgctacattacaagctgctggacgccagtttctgcttctcggcaaggacgcagatttgctgttgtagacattccggtgttccggtgttaaggggttggttggctcacgtttgcccaaattttagtgcatagtcgcgtcagctccactcttccaaagcccgtggttggcctattttaccagaaattttgtggatagaggtttccaaaaaggagatcaaaggaatttcctatatcacagttattgaccggaccccttgcgtggatagcttgaccctcgttcgttggcgagttccaaaacagttttgagcaggcccctttgttgccccgtgcctcgtttaaccgagaaaattccttaccggatataagcccaactcgcttgacctctcaaaaatctccacttgtgtttttatctaagcccagttctttgcgagggggaacttttaccacataacatcaacacataacagcaactacaactatacaccctctgcgggcgcactctcttaatgactacggggtggtcgtctgccagcaaacaacgcgggggtctttttcacacatagtgttggcgccatcgtggtgcaatctattcatgcgtctgtctctcccttgtacaccccgagttttctcgtggcacctaacgttgtgtataaaaatttctccggcggtgtttcccacacatatatagatgaggcgtagtataataaattccgctatatcaccacgcgttgtaaaaccggctgattaagag

SEQ ID NO: 685187 - DNA, 780 bp, Homo sapiens
gacatcttcctcaaaaatgattgcaaagcttaggtaggctacgaggtgacaccaagagaatcagcccaaatgatgggcccctgacatagatgagaccaaatcactataaatctatccctgaacatcaattatgttgtgtaaaagataatgaattaactggctggggacccatagccataattttacccgatacctgcatttatatctgtattctatatacctataacacgtatttagatctatttagttcacaatctcagaatcagatggtcgagacatttaaagattaagctaatacaaacttgtcctctggacaaaagagaaaactggagccggcatgtgcttcgtattgtatcacgataccgctaatatctagaaatggaaagccaacacattatcttacatattctaatgttgcctcgttatatactaccagtgtcagtgctcctatgtattttgtagtacttctcttcaatatggtgtgtagaaagaaaatgtgaagccccgagtttaattcaattgtaacctgggattgacccggaaaaaccatgtgttgcaatcccaatacacaaggagggtcatctggggtgtgccatgtgcatttggatggacatactggttactatatgttgctgctacatgctgatttgcactcagtcgtgtaggagagaagaatggagttatattaaatttctagagaatgagtcaaattaagagatggacattgggagtcagatggttggtgttgcatgtttatctttagtatatatgggtcatatt

SEQ ID NO: 685188 - DNA, 360 bp, Homo sapiens
agccgtacttagagtatcccccccgaaacacgctatgatcttcacggaccaatgcctagtgagtggagcaacagctatatcagctctcccatagaccagttccccaaccatgccgattccatattttagtctctggatcccttgcaccatatatcccgtcaccaacgatcgacaatttgtatttgactccttacatgtgtggctatttcataggctaagtctacacaatagccttcatatcgtccatgtccttccagttgctcatgggttccgcttgtacatgacatatggtgattccgagaatggtagtcactactatggtccgattctctgaggatgccctgtcataactttttcctg

SEQ ID NO: 685189 - DNA, 440 bp, Homo sapiens
  misc_feature (8)..(8): n is a, c, g, or t
aagaattncgcacgagggtgcctcccaagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaatggaaattgt

SEQ ID NO: 685190 - DNA, 782 bp, Homo sapiens
  misc_feature (12)..(12): n is a, c, g, or t
  misc_feature (68)..(68): n is a, c, g, or t
  misc_feature (127)..(128): n is a, c, g, or t
  misc_feature (132)..(132): n is a, c, g, or t
  misc_feature (137)..(138): n is a, c, g, or t
  misc_feature (172)..(173): n is a, c, g, or t
  misc_feature (183)..(183): n is a, c, g, or t
  misc_feature (226)..(228): n is a, c, g, or t
  misc_feature (236)..(236): n is a, c, g, or t
  misc_feature (276)..(277): n is a, c, g, or t
  misc_feature (290)..(290): n is a, c, g, or t
  misc_feature (295)..(295): n is a, c, g, or t
  misc_feature (343)..(344): n is a, c, g, or t
  misc_feature (351)..(351): n is a, c, g, or t
  misc_feature (375)..(375): n is a, c, g, or t
  misc_feature (397)..(397): n is a, c, g, or t
  misc_feature (404)..(404): n is a, c, g, or t
  misc_feature (409)..(410): n is a, c, g, or t
  misc_feature (422)..(422): n is a, c, g, or t
  misc_feature (442)..(442): n is a, c, g, or t
  misc_feature (447)..(447): n is a, c, g, or t
  misc_feature (662)..(662): n is a, c, g, or t
  misc_feature (669)..(669): n is a, c, g, or t
  misc_feature (677)..(677): n is a, c, g, or t
  misc_feature (687)..(687): n is a, c, g, or t
  misc_feature (691)..(691): n is a, c, g, or t
  misc_feature (703)..(703): n is a, c, g, or t
  misc_feature (721)..(721): n is a, c, g, or t
  misc_feature (776)..(776): n is a, c, g, or t
tcccatttttcnttcattatttaattttttatctctttttatgctcatttcttcagctgccccaagcngccagactgtccctttttctcttccattccctttctctttcttttattttatttttctnncagntcttnncatggaggagaagatctgctgcagggcctctctnnggaggggttngccaagtaggcattcaccatcttcatgatctcttccacctttnnnctcttcantattatctttctctctcccaccctcaattccatttttttnnggcccattatctngcagncggccacatttccatatctgacactttggatgggctccgtctcccctnnccggganagggacatggcctttgctcccaancccaggcacagcttctttttancaccccnaccannctccgttctcanctccagaacttcatacctancatcncctaaccccgtacacttctcctccatttccatttattcttccatttcctcatctcggcccatgccccgtagccgcttccagccgcccagcacggcagctgccgtgccggcgccgcctcctccctcgcgggcaatgcttcccgcagtgcggccggccccgccgcgccgggcccgctccgcccgcctcttggccaggcccgggctccagagcgcccnggccagnagggcagnggaagggggnggcntgggggtcgggncgggcgggtcttcgcgcngcggggccggggcgggacagggcggtccacgcggggcaggggcaccgtcggaganaactcc

SEQ ID NO: 685191 - DNA, 803 bp, Homo sapiens
  misc_feature (560)..(560): n is a, c, g, or t
ggccagatacttctgagtcttaaaagcataataggccgggcgcggtggctcacgcctgtaatcccagcactttgggaggccgaggtgggtggatcacaaggtcaggagttcaagaccagcctggcccaaatggtgaaaccctgtctctactaaatatacaaaaattagctgggtgtggtggcgggcacctgtaatcccagctactcaggaggctgaggcaggagaatcgcttgaacctgggaggtggaggttgtggtgagccaatatcatgccactgcactccagcctggtgacagagtaagactccgtctcaaaaaaaaaaaaaggctataatattttattacttcccaattttttaaaatttggagtgccttggcagtggggagggtccctaaaatgggtatagatttagggcccagattggtggtgtaggtcctgaatctgctctaaacatacagggactgtctgtttgggacattatgaggcataagtagccagtatctatagtgagaatctacaaggcctcctttgtggcccctgtagactagaaatatactgtnatgtggcggccttcgagtgtatctctacgggccaaaggtgctgttcaagccacattcagaatacgggtggaccattctttgtccatccctggggggtccatgtacatttcattaattacgtccaagcacatacgaattaaggaaaggactgccttaaagaaagagcgtcacggcatgagagaaatttaacatctctcggtccctctgtctcaacgtgtcccaaagggcttggcagaatggggc

SEQ ID NO: 685192 - DNA, 471 bp, Homo sapiens
  misc_feature (54)..(54): n is a, c, g, or t
accaaagaacaacccatggcagtgatgaggccgtgcggctaagcgggcacgagngccaagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaatggaaattgt

SEQ ID NO: 685193 - DNA, 1048 bp, Homo sapiens
attcgcggccgcgtcgaccttcagcatgagcatcaaccagtatccttgtcaggtggcccccattcctctacattcctggatggtttgggatcccacagaactctaatgattacataagaagagtggcccgtcctctctccggtccgtgcctccaagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaatggaaattgtacttaaaaaaaaaaaaaaaaaaaaaaaaaaaaaaaacaaaaaaaaaccggggggactaatttgggggggggggaaaaagggggtatagaaagggcgcacagtgtggacaaaagcagtatttacatgagacccagattttttgtgtgtacccacggggggaaaaatcgaggcgggtcccctaatataggaggacgccgcctatataatttcacataaacccgggtgtaacccgggcggtatataatacgtgtgcggtagacaaacctcagcaatgcaagccgccgctaatgacagagccggacagagcgtagcgatagcgcgtatgagagagacagggggatgagccgacaaccagtagtatctgctacgcagagcaacaaagccgcgtggcacgtaaagtacgagcacgcaaggatctcatacactggtactatgtagaccagccatataatccaagcgagcttctttcttataggcagag

SEQ ID NO: 685194 - DNA, 233 bp, Homo sapiens
cctaagtagaagctgctccgggtacatgatgccagcgtgggagtttgacgggtgcgtatacacctgtcaaacgcgataacgcacttttgctaaggcgagctcagggaggacacgagacctcccgtggagcagaaggggacaagctcgcttgactcttggttagcagtacgaactacagaccgtgaaagcgggtgctcacgatccttctgacctttcagggtaggaggcaggac

SEQ ID NO: 685195 - DNA, 451 bp, Homo sapiens
ggcttctgcttctgccctctctccggtccgtgcctccaagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaatggaaattgt

SEQ ID NO: 685196 - DNA, 187 bp, Homo sapiens
gttctcacgatgtctgcatgggtggtccttcactccctcaggtcctggcacagcagccccttccagaagcaccctcttgaaatctgcaggccctgaaggtgggtgactccctggtaccgttcttcgcttatctgtttctcgtctagcatttcagacgttctaacatcacccagagttatgcccactc

SEQ ID NO: 685197 - DNA, 228 bp, Homo sapiens
gatgcagcaagagtctcagaaggaaatcagtgcataggtcctgatgagcatgggtttcactgatgaacaggacaccattattaaaggggctatgggccttggtaaggagtttcttctatgttaggaatgcactgtaggggtgcaagagcataagctaggtgaccagtgtagaggctattgtgggagtccagaccagaggtcatcctaatctttaagattaaggtatag

SEQ ID NO: 685198 - DNA, 294 bp, Homo sapiens
ccccccctaggggttcctttgaaaggggggttttccccccggttggtcccgtgttgggaattgtgtccaagggccaagattactttttaaaaaccgtcggggtttccatgtttttggacccgcctattaaaaaattaattttttttgcctttttaattggggggggtggggggggcccccctttttttttagtggggagctttgcccccaaaaattttttaaaagctttttttttcccggtttttttgttttttttttttttttttggccaattaaattttaagggccctgcca

SEQ ID NO: 685199 - DNA, 247 bp, Homo sapiens
ataaagtatttattaagacagaaccggtagacagttatttgttgttccagagagggagcctcgccggagccgccggactcctgttcctctcgtccggtgccagagcaaccggggacaactcagcgacgggtgtatcccgggcaatgttgttgactgcgtggacctgttgagccacgttcttctggacaggattccgtaccaggtccgtctatttgatgttagatgttgtcgtcttgacagacttcca

SEQ ID NO: 685200 - DNA, 224 bp, Homo sapiens
ctctttttcagtaactcatttctaattcagtaactcatttctctcttttttttttaaactgagacagggtctcgctctgttgcccaggctggagtgcagtggcaccatctcggctcactgcaacctctgcctccaggctccagagattctcccacctcagcctcccgagtagctaggaatacaggtgtgtgccaccaccctcggctaatttttttatttttggt

SEQ ID NO: 685201 - DNA, 290 bp, Homo sapiens
tgtttatcgatgccacctccaccagaacgggtgatagtatccacagatgagagacccaaagatggttcacatcacaggactctgtgcagacaacccccagtaccagcctggagctgagtagactcactgggtggctagacctagaagagaatcaacaattattgagtttagctcacaggaagccacatccaagaaaagtgggagaaaactacagcaatgtccattaacagaggaattgactaataccttgatgtacattcccacaagagaatgtggcatcgataaacacc

SEQ ID NO: 685202 - DNA, 394 bp, Homo sapiens
  misc_feature (75)..(75): n is a, c, g, or t
cccccccccccccaggagtgggtgtattccccctcctaaggaggggggcccccccacccttggggttcccccccntttgttgtttaaaaagcgtgtcccttttttgttcccccctacccccctcaccttagaaccctggggcctgggggcaattttaacccccttcccctttttgggggggcccccaaaaccttggcccctgggaaggccaaattgttttttcctttggggcctggggggaggtttctcccctgcccccccccccgccccctccttttttagccatttaaaagccccttttttaaaaaaaaataagcataaaagacaaaaaaaacaataaaataagatcaagacaatacactacagactgggcaaaaaaataaaaatatataaa

SEQ ID NO: 685203 - DNA, 381 bp, Homo sapiens
gatggattccttctttttgccgctgctgtgcccacggcaaattacgtttttggctaaagcagagtattttaatggcacaacgctggtgggtaggctgcagaaatggttttttactagtagcgggtcgcgcccggttaatcgcacatccgccagtgctgggcaagacgctatgaatacggcggttgaggtgctgaacgatggcgatcttttcgggatttaccctgaggggacacgttcgcccgatggtcgcttgtataaagggaaaactggcgtggcgcgcattgcgttggcgtctggcgctcaggttattcctgtggcgatgatcggcacgggagacgtcaacccgattggcacatggtttccgcgtccgggtaaggtgcg

SEQ ID NO: 685204 - DNA, 178 bp, Homo sapiens
  misc_feature (72)..(72): n is a, c, g, or t
  misc_feature (125)..(125): n is a, c, g, or t
tgctctcattaaccttaaaaaaacctagatatagataaaagactgaaacactaaaaatgtaaaagtgatggntataagatgataaaaatgctgttcttcattgtccagattttcactcctgaggnaatagttcttttataataaaaaagcaatatttttcatattaaaaaactacctc

SEQ ID NO: 685205 - DNA, 114 bp, Homo sapiens
tgaggatcccataaatcatatggaaacacatatttgtacctgttacagccccaaagctgaaagcattaaagaataaacacatacagcaagctacgaggtgcgactgtttaggaa

SEQ ID NO: 685206 - DNA, 593 bp, Homo sapiens
atctcaacttagtattatacccacacccacccaagaacagggtttaaaaaaaaaaaataaaaaaaaaaaaaaaaaaaaaaaaaaaaaatgtgtgtggcgggcgcgcgccgcgggcccccgcgaaagaagctttcacagaaaccacattcgcggtgggggcgcgcgggggcccaccagggaggtaaaggcggaaaccgggggccacaagcgcgtggttccctagcgggaaaccgcgggcccagagaacaagagggcggcggggagattctctctcacccaaatataaaaaaagcccgcgggggggaaacaccggagagcggttctgggagaacacaaactcccgagagagggagagttcgcgagagaggggcacaatacgggggggactctatatctaaacgcggaggagctcacaaagggaggagcgccccagagaatcaaaaatattataccgccccggttacggggggtgacaacgaaaacaacaaaacacaacagagaagaaaccaaacacaaacacgtacagagagcaactaagcacaacggaaaaagcgaagcacaaaaaacaagcagaaaaaaaaacagaaacatcg

SEQ ID NO: 685207 - DNA, 692 bp, Homo sapiens
cacctccggacaaggactggaggccttcccggaggagctcaagcacttcgaagccccaatcgagaagcacaacccctacccgaagccagctggagattgcgccacgagaactgaggcaccccagagagtgtgggcgacggcgagcgtgtgagcccccaccccgcgagatagcaccccctgctggaggggcggacccaggagctgggctacacggtgaagaagcatctgcaggacctgtccggcaggatctccagagctcggcaccacgaactctgaaggcactggggagccccagcccggcagggaagaggccagcgtgaaggacctgggctcttggccctggcatttccgtggacagcccgccgtcagggtggctggggctggcacgggttcgaggccaggaaggattgtttctggtgactgcagccgttgccgtcgcgacaccgggcttggtggtggtagccatttgggtctgagatcggccccagctctgactgaaggggcttggcttcccactccagcatccagcgtggccagtcaccacccccgtgaggacctcgaagtccagctgctgtcaggtttgatagtcctctgctaaaaccacacgatttacattaaaaattttacacatctgcccccggagaataccatgcacagagtcctttaaaaatagagtgcagtattttaaccca

SEQ ID NO: 685208 - DNA, 283 bp, Homo sapiens
aacattattttctaagtacttaactatgtattgtatatttgctaagcatgtgatagctattgtctcttgtatgtgctggcctccagttgccttattatatattaatctccagaggtattattattgaggaactcgaagctttagaaagatttaagatttgtacagctaagccaggtgcggtggctgacaccagtaatctcagcactttgggaggccgaggcaggcagatcaccaggtcaggagattgagaccatcctgggcttaacacagtccttgtctctac

SEQ ID NO: 685209 - DNA, 996 bp, Homo sapiens
  misc_feature (227)..(227): n is a, c, g, or t
  misc_feature (235)..(236): n is a, c, g, or t
  misc_feature (240)..(240): n is a, c, g, or t
  misc_feature (242)..(242): n is a, c, g, or t
  misc_feature (283)..(283): n is a, c, g, or t
  misc_feature (300)..(301): n is a, c, g, or t
  misc_feature (318)..(318): n is a, c, g, or t
  misc_feature (376)..(377): n is a, c, g, or t
  misc_feature (407)..(407): n is a, c, g, or t
  misc_feature (414)..(414): n is a, c, g, or t
  misc_feature (451)..(451): n is a, c, g, or t
  misc_feature (496)..(496): n is a, c, g, or t
  misc_feature (501)..(501): n is a, c, g, or t
  misc_feature (503)..(503): n is a, c, g, or t
  misc_feature (513)..(513): n is a, c, g, or t
  misc_feature (517)..(517): n is a, c, g, or t
  misc_feature (520)..(520): n is a, c, g, or t
  misc_feature (537)..(537): n is a, c, g, or t
gtttgaaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttcccaggggggangggaggannaggnanggagggggatcagagcgtgtcccaaagaagggaaagcgggnaggttggaggaggggcnnaaagcagggccggcaanggtggtaccttcataagggggtagtggggggtgggggtcaggcccggaacatcgtccnnactggagaatcggtcaggggaaaaagtcanggggacnaggaggaagagccaggagggccagaggcagagaaganagggagtctaaggggccagggtgagcgaggggtccagggcctaanggtgntnccggggggcngggngantgcagccagggtccccntccccttttcacaccccagatcacagcccgggtctgggctttacatccctctgtcccaaggacagaaagaagttgtggcccgggccaggtcatcagtgatcatagtgtcccttggattgtaccacaacttacaccctgccttatgcgagaacgcattccaccaacatttaccaacacaaacacatagaagacaaagacaacacaaccacacaacccaacgaccacacacaacgccgggcggccaaagaaaccgcagggggcgcacgaacgacgaccacaacggcacagacagacccccaagaaggccacgcaccggcgagggagcgcgcataaaaccgaggcagaacagaaaggaggcacgtgaaaagaacaacagatgggcaccaagcacacacccaagacgcggcgaagaacagcgtcggccacaacccgccccagagcgccgatgaactacaagaa

SEQ ID NO: 685210 - DNA, 435 bp, Homo sapiens
  misc_feature (72)..(72): n is a, c, g, or t
  misc_feature (81)..(81): n is a, c, g, or t
  misc_feature (129)..(129): n is a, c, g, or t
  misc_feature (215)..(215): n is a, c, g, or t
  misc_feature (375)..(375): n is a, c, g, or t
  misc_feature (386)..(386): n is a, c, g, or t
  misc_feature (389)..(389): n is a, c, g, or t
agaagacaatccaattttttaatggacaaaagatttgaatggacatttccccaaagaagatatataaatggntaataagcncaacaaaagatactcaacattgttggccattagggaaatgcaaattanaaccacaatgagatgcttccatacatcctctagaatggctgcaatcaaaaagataggcaataccaagtgctgatgacaatgtagancaactggaactttcatccactagtagtgggaatgcaaaatgctacagccacattggaaaatagcttggcagtttcttatcaagtaagataaatacttaaaatataacacagcaattctattcttagctatttacctaagagaaaggaaaacatattcacncaaaaagttanacncaaatgttcatagtaactttataatattaaaaaagtagaaacaaca

SEQ ID NO: 685211 - DNA, 732 bp, Homo sapiens
gcaatcagataggcatttgtctcacgtgaggagagggatgactttaaattctgtctgttcacaaggaatttccttgtgagcaaattgtgagggaggtatatagctttgtaaaaaatctttgtagttatcttatttaggaatagaacaggaggcaggtttgtcctgcccagcttgacttttcccagcttgacttttccctttggcttagtgattttggggtcgcgagatttttttttttttttttttttaaattttccccccttttaaaaatccttcaaaaaaacgctttttagaagaaaattgagcccttgggcctaaggttggtctgatctcctcagggacataggatgcttaatccctacattgattaggccccgtgtttttaggaaagctcatgttaccaggtttgtgaagttcatgtcctatgaagagaaacgggggaggcaaggggaaaagggccacaacaaacaagaacattccctgggaaattctcttttatgggccattattatctcctgaagtcccatgctagtgaattagcgccgtttataacaagtggcgtcggactgtttttgtaacaagagggggcgcgggaatattcctctctggatagttggtctagctctccagtttggcaggggtttgaaagaaagcgccccagttttaatttttcacaggggaattttacactcgaggggcacacatgtgcggggcaacaaacaggaaagcgaa

SEQ ID NO: 685212 - DNA, 3136 bp, Homo sapiens
tattggcggtctctcattgagtgcgcttaacctatagtgagtgttattcgtagcaggtactgatataatggaacagagaatgccggctccagatatgtctataagaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcagtggcagcggcacgctggtgtccacagtgtgaggacgctgaccccgggcagccgctgctctgaagagcttccgcgccttccccctggtctcgtccgttttcctcctcagctctcgctggtttgttcttgggttgtttttcttttccacctgccccatgccttttggttggtgaccccagactctgtgatcccccagggtccatggtgctgctccatccgccccccctcccctgtgtttacgcgccccatcctgtgtgtcccagccttttgagcagaaactgccaggcaggacctgctgggccgtgcggggcaccctcggcctcaccctgcagtgtctgtggcactcactgcttttctaaggctcgccgtgagccaggtctaaagtttgaagaaaaagaaaaatcttaaaaaaaaaaaaaaaaaaagaaaaaaagaaaaacaggaaaaaggactttttttttcctgaaaaacaaaaaccgatctgcatggactccggtgtgcgctgttatctcgcatccgacttccccggtgcgatggcctctgtccggacagggaaggtgctggggtccctggccgccccggcccctgtggaggggtgcacagagaaagggggctcgtgccaagctcgaggggcctcctgaggaagccggccgctcctgtgagggaggccgggcccgggcacctgagggcttctccctctggacactgcgggccaggtgtacatagagcagcgcggcacagtggcctcacctcccgtcgggcactggcgggagcaaggtcgggggcaggcgctgcccagctggccgcacacggacattccaaagacctccagagaccaccccacccccacattcctttgaccagccttgtgagggcatcgatgctgccccgggctacctggctgctctgggcagggtgtgcgggccgggcccggctgggggagggcagctctgggcacgccgcacccacgccccccacctgggggaaacaggcggttcctgcccggttcttcctaaacgctctcgtctttttgtgtgtcttggtgactttagaaacaaacacagtggactcagtggctactggtattgtctcttcccacactgaactctggggaattgagtgcagggcacagcccggctcagcctgcccgctggtgggagcccctgggaagctgcggcgctcctttatctgatgtggtttagtaaaagcctcccacacacctccccgtggcctgggacgtggctggtagtgtttgtgtgggaagcagctcaagacgcggaccgcgtgacattaaggagagcgcaagggcggaccgggccctgtgtagagacccttccgcgccggcgttcccgctccgctaaagatttcaaatccaggggattccatgctcaatggatgaatgtagacacaaaacagcaacacttgtatgaagatgtaaagtgctgaacatatttttttcctgtttcctttccttttttttaaaaaatctgaattgtgccctgtactgcagttacttgtttgaataaaagttttatttattgcaaaaaaaaa

SEQ ID NO: 685213 - DNA, 382 bp, Homo sapiens
  misc_feature (8)..(8): n is a, c, g, or t
  misc_feature (314)..(314): n is a, c, g, or t
ttaggaanctcctccccgggcccgctcttgtcgggcggaaaattcacacagtggttggtgcggtgccctccctcaccttaccccgaactgcaaagaaatccccaagcacaggccgggcccggtggtttcatgccctgtaatcccagcactttggaaggctgaggcaggcggatcacgaggtcaggagatcaagaccatccctggccaacatggtgaaacctcgtctctactaaaaatacaaaaattagctgagtatgatgcatgcgcctgtagtcccagctacttgggaggctgaggcaggagaatcacttgancctgggaggcggaggttgcactgagccgagatcttgtcactgcattccagcctgggcaacaggcaaga

SEQ ID NO: 685214 - DNA, 106 bp, Homo sapiens
cgctcctgcttctgctgctcctgcttctgccgcttcctgcttctgccgtcaacacaaagtttaaaacttccagtgatgtagggcatggtttcctaagttacggcag

SEQ ID NO: 685215 - DNA, 2813 bp, Homo sapiens
  misc_feature (29)..(29): n is a, c, g, or t
  misc_feature (32)..(32): n is a, c, g, or t
  misc_feature (43)..(43): n is a, c, g, or t
  misc_feature (48)..(48): n is a, c, g, or t
  misc_feature (107)..(107): n is a, c, g, or t
  misc_feature (126)..(126): n is a, c, g, or t
gacgtaaagaggacccttaccaaaagggnttnttggttaccanacaanacaccccccccgcgccgttttattctttaaaaaaccggacggcagtactatacggtctnaggtacgaggctgctgaantgaccactccttgacgggcaatcccggtggacgggtggtctgagtcctgctgtggagggtctgcctgaggccggtaggggctcagcccaagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcagtggcagcggcacgctggtgtccacagtgtgaggacgctgaccccgggcagccgctgctctgaagagcttccgcgccttccccctggtctcgtccgttttcctcctcagctctcgctggtttgttcttgggttgtttttcttttccacctgccccatgccttttggttggtgaccccagactctgtgatcccccagggtccatggtgctgctccatccgccccccctcccctgtgtttacgcgccccatcctgtgtgtcccagccttttgagcagaaactgccaggcaggacctgctgggccgtgcggggcaccctcggcctcaccctgcagtgtctgtggcactcactgcttttctaaggctcgccgtgagccaggtctaaagtttgaagaaaaagaaaaatcttaaaaaaaaaaaaaaaaaaagaaaaaaagaaaaacaggaaaaaggactttttttttcctgaaaaacaaaaaccgatctgcatggactccggtgtgcgctgttatctcgcatccgacttccccggtgcgatggcctctgtccggacagggaaggtgctggggtccctggccgccccggcccctgtggaggggtgcacagagaaagggggctcgtgccaagctcgaggggcctcctgaggaagccggccgctcctgtgagggaggccgggcccgggcacctgagggcttctccctctggacactgcgggccaggtgtacatagagcagcgcggcacagtggcctcacctcccgtcgggcactggcgggagcaaggtcgggggcaggcgctgcccagctggccgcacacggacattccaaagacctccagagaccaccccacccccacattcctttgaccagccttgtgagggcatcgatgctgccccgggctacctggctgctctgggcagggtgtgcgggccgggcccggctgggggagggcagctctgggcacgccgcacccacgccccccacctgggggaaacaggcggttcctgcccggttcttcctaaacgctctcgtctttttgtgtgtcttggtgactttagaaacaaacacagtggactcagtggctactggtattgtctcttcccacactgaactctggggaattgagtgcagggcacagcccggctcagcctgcccgctggtgggagcccctgggaagctgcggcgctcctttatctgatgtggtttagtaaaagcctcccacacacctccccgtggcctgggacgtggctggtagtgtttgtgtgggaagcagctcaagacgcggaccgcgtgacattaaggagagcgcaagggcggaccgggccctgtgtagagacccttccgcgccggcgttcccgctccgctaaagatttcaaatccaggggattccatgctcaatggatgaatgtagacacaaaacagcaacacttgtatgaagatgtaaagtgctgaacatatttttttcctgtttcctttccttttttttaaaaaatctgaattgtgccctgtactgcagttacttgtttgaataaaagttttatttattgcaaaaaaaaa

SEQ ID NO: 685216 - DNA, 3006 bp, Homo sapiens
gcgagtcgagtattctcccagcttgtctgggcaggagacagggttgggcctgtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcagtggcagcggcacgctggtgtccacagtgtgaggacgctgaccccgggcagccgctgctctgaagagcttccgcgccttccccctggtctcgtccgttttcctcctcagctctcgctggtttgttcttgggttgtttttcttttccacctgccccatgccttttggttggtgaccccagactctgtgatcccccagggtccatggtgctgctccatccgccccccctcccctgtgtttacgcgccccatcctgtgtgtcccagccttttgagcagaaactgccaggcaggacctgctgggccgtgcggggcaccctcggcctcaccctgcagtgtctgtggcactcactgcttttctaaggctcgccgtgagccaggtctaaagtttgaagaaaaagaaaaatcttaaaaaaaaaaaaaaaaaaagaaaaaaagaaaaacaggaaaaaggactttttttttcctgaaaaacaaaaaccgatctgcatggactccggtgtgcgctgttatctcgcatccgacttccccggtgcgatggcctctgtccggacagggaaggtgctggggtccctggccgccccggcccctgtggaggggtgcacagagaaagggggctcgtgccaagctcgaggggcctcctgaggaagccggccgctcctgtgagggaggccgggcccgggcacctgagggcttctccctctggacactgcgggccaggtgtacatagagcagcgcggcacagtggcctcacctcccgtcgggcactggcgggagcaaggtcgggggcaggcgctgcccagctggccgcacacggacattccaaagacctccagagaccaccccacccccacattcctttgaccagccttgtgagggcatcgatgctgccccgggctacctggctgctctgggcagggtgtgcgggccgggcccggctgggggagggcagctctgggcacgccgcacccacgccccccacctgggggaaacaggcggttcctgcccggttcttcctaaacgctctcgtctttttgtgtgtcttggtgactttagaaacaaacacagtggactcagtggctactggtattgtctcttcccacactgaactctggggaattgagtgcagggcacagcccggctcagcctgcccgctggtgggagcccctgggaagctgcggcgctcctttatctgatgtggtttagtaaaagcctcccacacacctccccgtggcctgggacgtggctggtagtgtttgtgtgggaagcagctcaagacgcggaccgcgtgacattaaggagagcgcaagggcggaccgggccctgtgtagagacccttccgcgccggcgttcccgctccgctaaagatttcaaatccaggggattccatgctcaatggatgaatgtagacacaaaacagcaacacttgtatgaagatgtaaagtgctgaacatatttttttcctgtttcctttccttttttttaaaaaatctgaattgtgccctgtactgcagttacttgtttgaataaaagttttatttattgcaaaaaaaaa

SEQ ID NO: 685217 - DNA, 3031 bp, Homo sapiens
  misc_feature (2)..(2): n is a, c, g, or t
  misc_feature (4)..(5): n is a, c, g, or t
ancnngtggttcgggtccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataaggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcagtggcagcggcacgctggtgtccacagtgtgaggacgctgaccccgggcagccgctgctctgaagagcttccgcgccttccccctggtctcgtccgttttcctcctcagctctcgctggtttgttcttgggttgtttttcttttccacctgccccatgccttttggttggtgaccccagactctgtgatcccccagggtccatggtgctgctccatccgccccccctcccctgtgtttacgcgccccatcctgtgtgtcccagccttttgagcagaaactgccaggcaggacctgctgggccgtgcggggcaccctcggcctcaccctgcagtgtctgtggcactcactgcttttctaaggctcgccgtgagccaggtctaaagtttgaagaaaaagaaaaatcttaaaaaaaaaaaaaaaaaaagaaaaaaagaaaaacaggaaaaaggactttttttttcctgaaaaacaaaaaccgatctgcatggactccggtgtgcgctgttatctcgcatccgacttccccggtgcgatggcctctgtccggacagggaaggtgctggggtccctggccgccccggcccctgtggaggggtgcacagagaaagggggctcgtgccaagctcgaggggcctcctgaggaagccggccgctcctgtgagggaggccgggcccgggcacctgagggcttctccctctggacactgcgggccaggtgtacatagagcagcgcggcacagtggcctcacctcccgtcgggcactggcgggagcaaggtcgggggcaggcgctgcccagctggccgcacacggacattccaaagacctccagagaccaccccacccccacattcctttgaccagccttgtgagggcatcgatgctgccccgggctacctggctgctctgggcagggtgtgcgggccgggcccggctgggggagggcagctctgggcacgccgcacccacgccccccacctgggggaaacaggcggttcctgcccggttcttcctaaacgctctcgtctttttgtgtgtcttggtgactttagaaacaaacacagtggactcagtggctactggtattgtctcttcccacactgaactctggggaattgagtgcagggcacagcccggctcagcctgcccgctggtgggagcccctgggaagctgcggcgctcctttatctgatgtggtttagtaaaagcctcccacacacctccccgtggcctgggacgtggctggtagtgtttgtgtgggaagcagctcaagacgcggaccgcgtgacattaaggagagcgcaagggcggaccgggccctgtgtagagacccttccgcgccggcgttcccgctccgctaaagatttcaaatccaggggattccatgctcaatggatgaatgtagacacaaaacagcaacacttgtatgaagatgtaaagtgctgaacatatttttttcctgtttcctttccttttttttaaaaaatctgaattgtgccctgtactgcagttacttgtttgaataaaagttttatttattgcaaaaaaaaa

SEQ ID NO: 685218 - DNA, 1003 bp, Homo sapiens
  misc_feature (2)..(2): n is a, c, g, or t
  misc_feature (4)..(5): n is a, c, g, or t
ancnngtggttcgggtccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggccaagggcggaccgggccctgtgtagagacccttccgcgccggcgttcccgctccgctaaagatttcaaatccaggggattccatgctcaatggatgaatgtagacacaaaacagcaacacttgtatgaagatgtaaagtgctgaacatatttttttcctgtttcctttccttttttttaaaaaatctgaattgtgccctgtactgcagttacttgtttgaataaaagttttatttattgcaaaaaaaaa

SEQ ID NO: 685219 - DNA, 120 bp, Homo sapiens
acagcttgagtagcttggagctgattttacacattgcagctattatgcctttgaacaatgtcaatcaacagaacaatttacagtgccctggtagttgcaggaatcctgcaggcggagaaa

SEQ ID NO: 685220 - DNA, 2277 bp, Homo sapiens
  misc_feature (2)..(2): n is a, c, g, or t
  misc_feature (87)..(87): n is a, c, g, or t
  misc_feature (103)..(103): n is a, c, g, or t
  misc_feature (110)..(110): n is a, c, g, or t
gngcttcgctcaatccactgtattcacccatccgggcaagccctgcgtcccccgggtgcccgttctgggcgtttctgccaggggganaccttatgacgcttanagcccgntgcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcagtggcagcggcacgctggtgtccacagtgtgaggacgctgaccccgggcagccgctgctctgaagagcttccgcgccttccccctggtctcgtccgttttcctcctcagctctcgctggtttgttcttgggttgtttttcttttccacctgccccatgccttttggttggtgaccccagactctgtgatcccccagggtccatggtgctgctccatccgccccccctcccctgtgtttacgcgccccatcctgtgtgtcccagccttttgagcagaaactgccaggcaggacctgctgggccgtgcggggcaccctcggcctcaccctgcagtgtctgtggcactcactgcttttctaaggctcgccgtgagccaggtctaaagtttgaagaaaaagaaaaatcttaaaaaaaaaaaaaaaaaaagaaaaaaagaaaaacaggaaaaaggactttttttttcctgaaaaacaaaaaccgatctgcatggactccggtgtgcgctgttatctcgcatccgacttccccggtgcgatggcctctgtccggacagggaaggtgctggggtccctggccgccccggcccctgtggaggggtgcacagagaaagggggctcgtgccaagctcgaggggcctcctgaggaagccggccgctcctgtgagggaggccgggcccgggcacctgagggcttctccctctggacactgcgggccaggtgtacatagagcagcgcggcacagtggcctcacctcccgtcgggcactggcgggagcaaggtcgggggcaggcgctgcccagctggccgcacacggacattccaaagacctccagagaccaccccacccccacattcctttgaccagccttgtgagggcatcgatgctgccccgggctacctggctgctctgggcagggtgtgcgggccgggcccggctgggggagggcagctctgggcacgccgcacccacgccccccacctgggggaaacaggcggttcctgcccggttcttcctaaacgctctcgtctttttgtgtgtcttggtgactttagaaacaaacacagtggactcagtggctactggtattgtctcttcccacactgaactctggggaattgagtgcagggcacagcccggctcagcctgcccgctggtgggagcccctgggaagctgcggcgctcctttatctgatgtggtttagtaaaagcctcccacacacctccccgtggcctgggacgtggctggtagtgtttgtgtgggaagcagctcaagacgcggaccgcgtgacattaaggagagcgcaagggcggaccgggccctgtgtagagacccttccgcgccggcgttcccgctccgctaaagatttcaaatccaggggattccatgctcaatggatgaatgtagacacaaaacagcaacacttgtatgaagatgtaaagtgctgaacatatttttttcctgtttcctttccttttttttaaaaaatctgaattgtgccctgtactgcagttacttgtttgaataaaagttttatttattgcaaaaaaaaa

SEQ ID NO: 685221 - DNA, 686 bp, Homo sapiens
  misc_feature (2)..(2): n is a, c, g, or t
  misc_feature (4)..(5): n is a, c, g, or t
ancnngtggttcgggtccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagggctggccactcgagggaaggtggtacttcaggttcctcgagggagcggcttcggtgctgttctctcaccgtcacgccggcgtcaccg

SEQ ID NO: 685222 - DNA, 370 bp, Homo sapiens
  misc_feature (2)..(2): n is a, c, g, or t
  misc_feature (4)..(5): n is a, c, g, or t
ancnngtggttcgggtccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagtcaatcaatgcaatgcttccatatgtggccagtgcacagttcattctacctgtgagagtataagagttgagatattttttaataccagtgagctggtattgcgcgtcactttctggacctgccatgatttcaatctgtcaaatccgcaaattccgcgagctggtgtccgtcagggaatgtaacactctctgatccgggtcgagctgc

SEQ ID NO: 685223 - DNA, 945 bp, Homo sapiens
  misc_feature (945)..(945): n is a, c, g, or t
gacattttgtatgctagtaggtaccacagccattgtccaggagttttatttgtacctgacaataattgagatgtaatttaaattttttgttgttggttggttggttggttttgacttttcaagacaaggtttttctgtatagccttggttgtgctggaattgttttatagaccaacctggtcttgaactcagagacattcaagcttctatttctggaggcctgggattaaaggtatgtgctactaccaccaacaggattttttgttttatggtctttgctttttgttgttttgagacaaggtctctttatctagctagacctggctgtactggaacttgctaagtcagtggttcccaaccttctgatgcaatgacactacccataaaattatttgttgctacttcataactatagtttgctactcttataaatcataatttagataactgatatgcaagtccaaaggtgtcatggccctcagattgagaactaccatgctaagtagactccaggctggtctacagagtgagttccaggacagccaggctatacagggaaactctgtctcgaaaaaccaaaaaaaaaaaaaaaagatttggtggtatacttccgagttcgggataaggattatcctttggggttttctggaccaagtggttgggtaatcttccagaggggtaccctacttccagcgccctatgtttattaccgtggccgggagcaacgggttggggtactggaagctccaacccaggggaaattccgtgggtgtcaacccatatgggatcaggggaaaggagcccactgcgccataatatagagagatcagggagaaggagaagcaaacaggagatagcccacagagcgaaaaagcgaagcgggacaagagcaacagggcgagacaacaaagaacacgcaagcacacaccgacccaatatcacccn

SEQ ID NO: 685224 - DNA, 367 bp, Homo sapiens
tcaggtcctcaatgaggatcaggtcatttccgagaccgccatgaccaacgggtgggcaccggaggccgaccttccgttggattgcctgagcgacttcgacctggacgacgaagactcgatcgacgaggagctcgaaggactggtcgtcgtggagcaggacccggagcgcgtgtactacggacacgaggtcaaggtccaggccaagttggacgtcgcgcggctgggctatcggttgtttggcgaggtgcaggtgcgcgtcatccatgccaagctcaagtggggcggcgccgatgacgacgaggacactccgccgcctgtgcccatgaaccaggctctcgccgatctgctggggttttctgtcgaagag

SEQ ID NO: 685225 - DNA, 583 bp, Homo sapiens
tacagcttacaaaacataattttatttaaatttgtatagataaaaatctaccaaaatttaaacaaaaattttatccaaatcctttcccacaacaaaatgggacatcatggaaaaaaaaaaacactttcaaatagggtccccatctttctaccataaacgggtagattctggggaggatgaggagtaagagagaaacgaggagagaagatagtgatactaaacacaatttggatcttcagttggtggtctcatcttgaaatatcttaataacagagattcccataagaatcaggattcatttttggacacaaaaattggaagcttccactcccaaaatcacaaataagggcttctgggtattccttattaagtggtgaggtaaacagttattttcaatattagggcaaatgggtaaaaaccactatggatgggttatattaatgcagattattccattattaaatataattggggaatactcacggattttccaaccttttgttagatttagaaccctgtaaaatctgcagaagtgtgtaatagctattggctgaatgtctaagcatgcctttaagtactatag

SEQ ID NO: 685226 - DNA, 356 bp, Homo sapiens
  misc_feature (45)..(45): n is a, c, g, or t
  misc_feature (61)..(61): n is a, c, g, or t
  misc_feature (104)..(104): n is a, c, g, or t
  misc_feature (115)..(115): n is a, c, g, or t
  misc_feature (132)..(132): n is a, c, g, or t
  misc_feature (135)..(135): n is a, c, g, or t
  misc_feature (164)..(164): n is a, c, g, or t
  misc_feature (168)..(168): n is a, c, g, or t
  misc_feature (205)..(205): n is a, c, g, or t
  misc_feature (247)..(247): n is a, c, g, or t
  misc_feature (253)..(253): n is a, c, g, or t
  misc_feature (271)..(271): n is a, c, g, or t
  misc_feature (279)..(279): n is a, c, g, or t
  misc_feature (288)..(288): n is a, c, g, or t
  misc_feature (323)..(323): n is a, c, g, or t
tggcttttcaaccccttttgttaaaaacagactagcaccactgtnacgcgtgccaagaganaccaagacggcccagtcacagaggaaaaacccgaacacgacanaaaactgaggngagtccaggcctgggcnggngggggccacacccgcgggccccggttgcngggnggcatggggctcaggcctgggcgcctcgggccggggnctccgggcctcacttggccggccgcgtgaagaagcgcgttgngaagtngaacaggtcccgattgancttgcgcnggttgcgcncctcgtcctccagccccgtcacacggacgcgcacnggtcctggccgccgagcacgcccttctccatgg

SEQ ID NO: 685227 - DNA, 904 bp, Homo sapiens
  misc_feature (23)..(23): n is a, c, g, or t
  misc_feature (72)..(72): n is a, c, g, or t
  misc_feature (90)..(90): n is a, c, g, or t
  misc_feature (98)..(98): n is a, c, g, or t
  misc_feature (124)..(124): n is a, c, g, or t
  misc_feature (126)..(127): n is a, c, g, or t
  misc_feature (129)..(129): n is a, c, g, or t
  misc_feature (131)..(131): n is a, c, g, or t
  misc_feature (133)..(133): n is a, c, g, or t
  misc_feature (198)..(198): n is a, c, g, or t
  misc_feature (204)..(204): n is a, c, g, or t
  misc_feature (330)..(330): n is a, c, g, or t
  misc_feature (369)..(369): n is a, c, g, or t
  misc_feature (390)..(390): n is a, c, g, or t
  misc_feature (420)..(420): n is a, c, g, or t
  misc_feature (479)..(479): n is a, c, g, or t
aagcgacccattgaaaacaggancctcattctacccagtgtcacgagaaatgaaacaggaccctatcaatgngaaatacaggaccgatanggtggcanccgcagtaacccagtcaccctgaatntnntntntngtccagacctccccagaatttacccttcattcacctattaccattcaggagaaaacctctacttngtcctnttcgcggactctaacccaccagcagaatattcttggacaattaatgggaagtttcagctatcaggacaaaagctctttatcccccagattactacaaagcatagcgggctctatgcttgctctgtncgtaactcagccactggcatggaaagctccaaatccatnacacccaaagtctctgccccntcaggaacaggacatctccctggccttaanccattatagcagccgtgatgtcatttctgtatttcaggaagactggcagacagttgctntcattcttcctcaaagtatttaccatcagctacagtccaaaattgctttttgttcaaggagatttatgaaaagactctgacaaggactcttgaatacaagttcctgataacttcaagatcataccactggactaagaactttcaaaattttaatgaacaggctgatacttcatgaaattcaagacaaagaaaaaaacccaattttattggactaaatagtcaaaacaatgttttcataattttcctatttgaaaatgtgctgattctttgaatgttttattctccagatttatgcactttttttcttcagcaattggtaaagtatacttttgtaaacaaaaattgaaacatttgcttttgctccctaagtgccccagaattgggaaactattcaggagtattcatatgtttatggtaataaagtc

SEQ ID NO: 685228 - DNA, 105 bp, Homo sapiens
tggaagagacaggcgggatctcattctgtggtccaggctggaatgcagtggcgtgactatggcttactgcagccctgacctcttgggctcgggtgattcttccac

SEQ ID NO: 685229 - DNA, 309 bp, Homo sapiens
tttggaacgagaaacgaggtgattttctcggcgagaacgagacttatgagttgatgcggtgtctggaggacttgacgtcgaagaagacgctgtgcatggagaatctgatacgcgagcgagctcgcgggatgatgacgatagagacgcgcgaaggtggaaatgctgagactttcgtctggcgggaaatcttgctcggggaattataagagaaggctcactggaaggttcctgagaactgcttgaatgtggtatgtttgtatggcaatgtatatagattttttaaaagaataaatgttgttttgcaaatgt

SEQ ID NO: 685230 - DNA, 153 bp, Homo sapiens
tgggtcactctagaggatctaatcggtggtcaactgtatccgtatttgggggctgaggcggtgatacgaggtcaggagattgagacatcctggtacatggtgaaaccgtctctattaaaaaaatacaaaaattggcaggtgttgtggcaggcg

SEQ ID NO: 685231 - DNA, 81 bp, Homo sapiens
  misc_feature (78)..(78): n is a, c, g, or t
tggaggagtacgcgcgagaccttgcccatgggaacttgtggatgactgtggtggggcctttacgatgggtaccattangtg

SEQ ID NO: 685232 - DNA, 175 bp, Homo sapiens
ggagctcggcctcttgtcttcgtgtgctccgagccatggtgacgatgacacaccctggtggcatgccgatgtatgttggtttagcgttgtctgcattgttctagagtgcaaccggtgtcatggctgtcactcgttcacacaaatttttaatacatgatccccttagggtgtctcc

SEQ ID NO: 685233 - DNA, 275 bp, Homo sapiens
  misc_feature (204)..(204): n is a, c, g, or t
ggcgcgtgacgtccccgctcagccggacgatgctgcagcgccaccagccgccgtagcccatgtaccacgtcccgtcctatgcgcgccacacctgctggtcgatcggctgcgcgccgttgtgcacgcggtcgatcaggggcctgccgagcaggtccttgaacggcccatccggcctgtcggctaccgcgacgcggacgccgcccnccacgcggtcctgcgaccactcgcccttaagctggatgtcgttggcggcgaagaagaagtcgtagcggccg

SEQ ID NO: 685234 - DNA, 202 bp, Homo sapiens
aggtggttggggtgtcacacgcctatagatcccagactagtggaggcgggggcaggagaatcgcttcaactccggaggcagagttggcagtgagccgagatcgtgccactgcactccagcctgtgtgacacaccaatgactccgtgtcaaaataaataaataagataaaaaccaatacaatgtacaatagcttcataaaaga

SEQ ID NO: 685235 - DNA, 101 bp, Homo sapiens
agaccctgtcccagccacccaccccccactcccaggacttgcggtctgagcctttttggataattaataaatattttacacactaaaaaattaaaaaaaaa

SEQ ID NO: 685236 - DNA, 838 bp, Homo sapiens
tagatcgagctaccctctaaaagcagtgttagagtggtacaaaaagaaaaaaaaacacaccaaaggctcggagccacaaaggggatggaaatttcttctgggacatcctcgtggttctcccggtaactggatcggtctgggtccctagaagtccttcgtgaagctttttattcctaaggaggagaaaatcagtcaccgggcggaaatcggtgctggattacaggagctggggcatgggaattggggagactggactggcctatgaattggctaaacttaaaagcaagcgggttctctggggatataaataaggcatgggactgggaggggaaacagttggccaaattggcaaggggatctggggttgccaagggttcataccttgggggggtagactgggagcaacccgagaagatattacaggtctgcaaagaaggtgaaggcacgaatttgggagatgtgcgtattttaggtaaataatggctgggtgtaagttctatacaatcaagatctggtcgtgctacagcaaagatccctcagatggaacacagagctttgggaaagtcacataggtacctggccactttcggggacctaccaaagggcattttctctcgtgccagtgaacgaagaatcaaccgtggggcctatggtcactcgtggtttcgcgcaagcggggaagtgtctcgggtcccctttcgtaactggggtactggtgcacgcaaatttggctcgcaccggcgggtccccatcacaactttgagccgagtgaactcggtgggcctaccattacggggtccaacaaccttgtccgggtccaaatctgaaaccgtgctta

SEQ ID NO: 685237 - DNA, 811 bp, Homo sapiens
ggtaaatcggtggagtcgagagatggggctcggacggggcgcctgcaccgcctcccaggcgcacctcccccggacagcgacgtccccgagaaccgtgattggccgagcacccggaagcaacaccaggagaagaagagaaaaaaaacagaagacagagagaaagagaaaaagaaagaagataaatgaacagcacaacaagagaaaaaagagaaacagaacaagaaaaaaaacagaagaaaacaacaaaaaaaacaaaaacaggaaagaaaggaaaggagagaaaaggcgagaacgaggaagaaaagacggagaagggaacggaacagaggaagagagggcgcgcagcgaggaggcgagaggcgggaagaacgcagagagggcgcaagagacacagcgagaaaggcaacacacagagagcagccagcaagcgacaacagcagagacgtcagagcacaaggagcgaagggaggggaggagagaaggaagaagaagaaaaaagagaaaaagaagaggaggagaagagacaaagaagaagagaggggaagaaaaagggaaagacaaaaacaagaaagaggaagagaagagagcaaaaaagaaacagagggaagaggaacacaaggagcggaagagaagaagaggggaagcgaaacagaccaagcgaagaaggaggaggagagagaaagaggaggagaagaagccagaaaaaggggacgaggacaagaaagagaaacggaaaaagagcaggaagagaagaagacaagagaaaagaagacaaagagagaacggaggagaaaagaggaaagaaaaacgt

SEQ ID NO: 685238 - DNA, 101 bp, Homo sapiens
gtatccttgtctataattgtaatagtaatttaaatcatctttctttagcaccctagagagcaggtatctcctgataattttgtttttagaactttctgggg

SEQ ID NO: 685239 - DNA, 110 bp, Homo sapiens
  misc_feature (69)..(69): n is a, c, g, or t
  misc_feature (77)..(77): n is a, c, g, or t
aggggaggagaatgtattagactaaatacaaacttgcgggggttgtaaggaagtctaaaaacctcactnaatccttnactccagtaaatggcactgctcacttcctgcct

SEQ ID NO: 685240 - DNA, 100 bp, Homo sapiens
aagatcatgccactgcactccagcctaggtgacagagcaagaccctgtctttaaaaaacaaacaaaccaaaagaaaaaaagatttccatgaatccagtgg

SEQ ID NO: 685241 - DNA, 423 bp, Homo sapiens
tttattcttttattaatcctctcaggagaactctatgcagaagagaaacagtgtgattttcctaccgtggaaaatggaaggattgcccaatattattatacgtttaaaagcttttacttccccatgagctgtagacaaaaaactatcattcttctgtttggctggctatgcaaccgaaagtgggaagcaagaagagcaaatcaggtgcacagcagaaggctggtctccaaacccaaggtgctacaagaaatgtctgaagcctgacctaaggaatggctacgtctccaatgacaaagtactgtacaaacttcaagagaggatgagctacggtttgctcttcagggatacaaaaccacttgggggaaaggacgagggaggtgggtccactgtctttctgcaggggtgggtctttctcaaccggtc

SEQ ID NO: 685242 - DNA, 428 bp, Homo sapiens
ccccaggactctgttctgcagagagcaaaagcaaacccagatcacttctattgcctgagaactctggatcccttacaggcccagtgctgccaaggttccctcctcccccagacctcacagtctgcatgggtaaggggctaggggccgcctttcaaaatcacattcgaactggacttgcgtgtcaaagccagactggccatgttggatcaaggattctgtgctggaacagtgggatcgcacctgcctgttcctgtgtagcataggaaggaaagggggaaagagaggagacaccccctgaatgagtgactcaagggtggtggggtccctacccctattccagagctcctaagttttgtatatatccctttgtacacatattgggacattggccttactacaaagcaaatagaaccaggtctcttttgtaa

SEQ ID NO: 685243 - DNA, 413 bp, Homo sapiens
ctgcgccggcgccgccgggaagcgctaggcctggtccctcttcctaggatagcgttgcgcgcatgcgcctttgacgagtgagccggggagccatggacaactgtttggcggccgcagcgctgaatggggtggaccgacgttccctgcagcgttcagcaaggcttgctctagaagtgcttgagagggccaagaggagggcggttgactctgcataccctctgagcgtgccaaaggctgcatagggggtcctctcccccggaggcgccccacctagagagacagacgggcagacgggcccgcagcgcgtttttccccgagagagagaagagagacccccaacccttagtgcttccttcagcacaatagctgcattcatggactactactcaagtcagtagtgggagatatattca

SEQ ID NO: 685244 - DNA, 156 bp, Homo sapiens
tactctgattagttgaggatgacgatgacgatgaggaggggactctgaagaagaagctatggagactacaccagccaaaggaaagaaagctgcaaaagttgttcctgtgaagccaagaacgtggctgatggacgaaattcgggatcctctaagtca

SEQ ID NO: 685245 - DNA, 292 bp, Homo sapiens
cagagatcgcgccactgcactccagcctgggtgacagccagactccgtatcaaaaataataataataatgaaaatacttggaatagcgccaaatagatatagatacagtttggaaaaatacaaatgtcaaagttataaaaagatatctaaccatacttataattaaagaaacacaaattatagcttctgtaaagattcagagtgggtacttgtaggcggtaggacgccaggaatgctcactcatatttttcagtgcttcttaaccccgagctggtgtgcaaccccgagctgg

SEQ ID NO: 685246 - DNA, 159 bp, Homo sapiens
attcgcggccgcgtcgactgtccgccgtggaccgcaactattacctgaaccggtcggtgtcgttcgacttcagtgcggtgaatctggagttccagaacatagagcgcgacattaccctacgtgtctgacagtttagaccggtggggcagatcatgcgtg

SEQ ID NO: 685247 - DNA, 104 bp, Homo sapiens
agaagatataaatatgattagttctgtggctgtgaatgttacaggcgttcagtggaattaaacccaacacaaaaagatcttgtgtgaagatgcagaatgctttg

SEQ ID NO: 685248 - DNA, 959 bp, Homo sapiens
  misc_feature (546)..(546): n is a, c, g, or t
gaggtgacgcgggcggcgtcccaagatggcggcggcggcggctcccggataggccgcggcggcgttcccggctgcttaaggtgggccccacgtcggctggcagctggacaggctcggtacctacggtcggtaggacgggcggtagccgcctctgcgcggagccggggctgggccgtgcggtggcagcggcgccgggggatgctcttgcgggggcctgtgcctctcccttctcaacttagtggctggcggcgggcccgcgcccctggctcccggggccatggcgctgagggagctcaaatgtgtgtctgctcggggataccaggtgtaggtaaatcggagtatcgtgtggcaggtttgtggaagacagttttgatccgagaatcattaatccaagaataggggcagtcttgttatgagcaagagtgtgcagtacgcaagaatgaggctagataagttcctaatctgggatacaggtggacaagaacgattcgtggcttaggaccaatgtactatcgagggtcggtgcagctatatcgttaggatatnccaaagaggagacattttcaacattagagaatggggtgacagaggttcgacagatggccagctaatattgtacgttgccatttgcaggacatagctgtgatccttatcggatggtagagaaagtcagtggagagagatgccaggactacgccgagtctaattcatgccactctttgtggagacccagggaaaaaacgcgataaaattagtggaatcctttgttaaggaattaggtcggagaaatttccttccattggaggccaacttggggcattgggggggaagcgggtttacaaatcccgaagaaaagggtttaaaagccaaaggggagtgttggttgaccgaaactcagaggtttcagaattgtgagtgcagtgaggtggcctcggagataacaggaggggtgggagccg

SEQ ID NO: 685249 - DNA, 477 bp, Homo sapiens
  misc_feature (26)..(26): n is a, c, g, or t
  misc_feature (46)..(46): n is a, c, g, or t
  misc_feature (51)..(51): n is a, c, g, or t
ttaatatgattaatttgtgtaaaatnccctctaggaacaggcacangttanggatgcccacttttactactcttattcaaccctttaagagtactggaagtccttgccagaacaatccaggtaagaggacaaaatgaaaggcttcaaaattggaaaacaggaattcagttattcttgtttactgatgataagatcttatacctagaaaactccaaagactcgactgaaaaaaaaatcttagatttgataaatgaattcaggaaagtcttaggacacaaaattaatgtacagaaattaggatttttgtatatatacaaatagtgatcttgctgagtaccaaatcaagaagaaaatcccatgaacaatgctacaaaaaaaaaaaacacaataaaaacactagaaatatacttaaccatggaggtgaaaaatctttataaggagaactacaaaacaagatgaaaggaattgcagatgaca

SEQ ID NO: 685250 - DNA, 899 bp, Homo sapiens
tggtacggcgggagtattgtacggctgcgctggctgggataggactgaccgagcgttggatctgactgcccagatctgactgatggggagtgccgagaggattgcctgggccgaggacatgttcagactaaacgtctcaccagtggaacgttcacgaacatgagactgacaggtgctaaggagaatgtagcgacaagttccctctatcggttccagccgagcggtggatcgtggcttgggacgtggacggacatccaagtggacttgttgatgcatatgccgtgtcgaggcatgattaggctgatagacagccctggattggctcagtaagactgaccatgcccgggaccaatgcagttctggggtcccaacctgggtggaaggtctgaactgatgacccacccaggctgaccaggccagcccagctcactgacctcctgacccctgacctcatcacctgtgcagccatggagaagatgtcccgtgtgaccacagtcctgggtggcagcgtgctgacaggccgtaccatgcactgccacctggatgctcccgccaatgccatcagtgtgtgccgctgacgcatgcccaggtggtcgtggcaggccgtagcatcttcaagatctatgccatcgaggaggaacagttcgtggacacagctgaacctgcgtgtggggcgcaagccttcgcttaacctgagctgtgctgacgtggtctggcaccagatggatgagaacctgctgggcacaggcagtccacaatggcgtggtggtcacgtggaacctgggcggccatcccgcaacatgcaggaccagctgttcacagaacacgagcgcacggtaaacacaggtctggtatccacccaacgaagcccacgtgctggtacagtgggtccaggattg

SEQ ID NO: 685251 - DNA, 108 bp, Homo sapiens
cgcatagtcttggagactggtcgtcagtgcacagctgacactacgtcctacctacgtctcctgcacggggtcgactgggactagatctgggcaaggactgtcacaagc

SEQ ID NO: 685252 - DNA, 1607 bp, Homo sapiens
  misc_feature (983)..(983): n is a, c, g, or t
  misc_feature (1136)..(1136): n is a, c, g, or t
attctctgtgtcgctggttgtcgtctcgtgtgctcgctttctgtctgctgtgttgctgttgactgttagttgtcgtggttgtggtgtgtctgtgtggggctgtgcgttgcgttggtgcgcgcgtgttgtgcttgtcttttgctctccgcgcctggtcggtggtggtgtgtttcttaaccggaatctcgtatttttgtgtgcgccctctccggatgttgccccttgggtgggcgcccctcatttcccccacccctggtgttgtgggccccctccccgattgtggagagacttcgccccggggggtcccggatgtccccagcctctccccggcgtctttttgtacgctttacggcccccccgggggcgccggggttcacccgaatggcgtgcccacccacacgggcaacccagcgctttgttgccgccccttgtagccgccctcatttttttaggggcgaacccccctttttttgtgggcaacccacacgggtgtttgtgcaccccccgataaattcgtccccgggccgtggggttatccacccgggtgtccctcggggagatttttctccccgcgggggatttattctcgtgcccggaaccgccccacacgtgccggtgttctctggtggggcgcccatttaatgtgacacgatgttggttggggccttgtccccgcaaagagaagccctgtgccctcaggggagcgcccacgtaaaaggcatattgggtcgaccaacaaaatcgccaaagagtttttgccgtggacacgctctctctttggagagcccttgtcgcgcacacaccgggggcacacccatggtacacgccgccctgttgcgtcgccacaagcgccacaaagtcccaggggagtcctccacctggtaggttcacccccgtgtagaggacccacagggccgcacagtgccactctcacacctctgttgaaacattgtgggatatgccccctcttagaaaggggaganccccattatgagagtggccccttctgagagaaccgccccacagatagtgcgcgtgtgagatacttgtgagaagagagagactttttgtgccccgtcttgagaagcctgcgctatatcctattccccacagagcacacctatttgtgcccgccncctgcaccaggagatgagagagattcactagagaatatatgagaagagagaggagaatatggcgctctgttcacacctctttctgttgagattactcccacagagccctgtcctctacacatgtgtataagatggcgacctctgaccactctgaagagttgcccacacctcaccacggagaagctcgccttggagaaggcgacagagaggaagcacggagttttctttctgccttctttcccaaactgtttcctctccctcgagaccctcgagagggagaactcaattctggattcacctccccttctggttgatacccacctccaaaaggacacactttctgattaagaccgcgttgaaaactagagatggaccacggttatcacacgacaaactttctcagcacttcaccgatgaccctctgaattaaaattgcacaccctccgtgccacccatatattaccccccaga

SEQ ID NO: 685253 - DNA, 198 bp, Homo sapiens
acaatatctgcgtgcagcggtcacttctatgcgctggagttaattcaacagttgcgactgcaggactgcggcgacgtgctgcgcgtcgggatgatgcattacaatacccagcaagaaattgacatgctgtttgaagtgctcgccagcgaaaggtagcggagcatcatacgcaaaaagacttctgtggtaccgagctcg

SEQ ID NO: 685254 - DNA, 1002 bp, Homo sapiens
cttcaagggaatttcccgggcccattgtttcaccgtctggaatgggatttagccccaccccagttaataccggttatggtgaagaggtgtgatttcggtgaaagcaccgtgggggcgtccaacacaggttatgcacgccctaatgtgggaggtctcaccgcccctggccaccgcgtatagtggtgcacccccaggattgtagtggggttagttttcccccgcccaccacacttgtcttctatagtgataccctgcacactctataggtaattctctgtctgtggctttaagtgtgtacccccttacctggtaaaatttgctccccggtttgctccctcgggagagggcacactttagtagatgtgcacgctggagtaaatagtgccccctcccccctatgagatgtcactatggggagggagagttttcttctctaaattttttgagatgggagacaatggagcacactcttgagaggtatagtgaggctttaagccactaaagtgtatactcctcgcgttgggagaatgtttgtgggctatagcccagcgtatggagaaacacactcagattttctggtgtgccctcatagtaagagttaatagagctcggcacttagtgtggctcacattctcgactcttcactcgggaggaagtttaatatcccacccctgttagacccaggggctgaactgaagagtgaaatagggtatatgtgttctctgccgacaaatattaaaatttgatagttttcagaccatttagagccgccgcggatattctttcctcgcttagggggctccagagctcattttaacaaacccaactaatttcccaccatcatcccttgacccatgggggatattttgtctgggtttgtaacccaccccaatgggttggctgttggaccctccaccatccaaagagtttgtagggtggtggggaatggggggttttccatggttatttttaaattaaattaaataaaggtttctgacattt

SEQ ID NO: 685255 - DNA, 200 bp, Homo sapiens
  misc_feature (173)..(173): n is a, c, g, or t
  misc_feature (192)..(192): n is a, c, g, or t
ccagaataggagaggataatagatgggcagccatttctatgtctttccaagtgctgtctggaagtcaatttatgaccacttcttgtcaagtcattagtctgcagcctctcgggtcatgatttccatcatcttcttccggattgggcggacctgatgggtgctgagtcataagnaggtcttccgctatctgangttgtcgc

SEQ ID NO: 685256 - DNA, 300 bp, Homo sapiens
tgtaattcatcagccagcaggtggataaagataatgtgatatatatgcactatggaatactaagccataagaaggaatgaaataatggcatttgcagcaacctaaatggagttggagaccattattctaagtgaagtaactcaagaatggaaaaccaaatattgtatgttctcactcgtaagtgggagctaagctgcgaagatgcaaaggcataagaatgatatagtggactttgaggactcaagggttgaaggatgagactacacattgggtacagtgtgcactgctggctgatgaatt

SEQ ID NO: 685257 - DNA, 399 bp, Homo sapiens
  misc_feature (62)..(62): n is a, c, g, or t
  misc_feature (92)..(92): n is a, c, g, or t
  misc_feature (104)..(104): n is a, c, g, or t
  misc_feature (109)..(109): n is a, c, g, or t
  misc_feature (125)..(126): n is a, c, g, or t
  misc_feature (130)..(130): n is a, c, g, or t
  misc_feature (134)..(134): n is a, c, g, or t
  misc_feature (268)..(268): n is a, c, g, or t
agggctttatgcagacaacctaccatgggtccaagtgccggccccgggccctcaacaacaangcctaacaagatgctctggcctaagatgangttccaatgggntttcngtcctgagatgtgcanncaancccnggctatgcgcattgaggatggaaaaaaaaaaaaaacggccaggctcattttagtcccacccttctgtgtccagatttcctgttcccccatcacagaatttcacaatggccctgaaaaaccatgcagcaggagcnttttatgcagagagataaggttctctaggttggtttcagttgaacacagtgctgattcattggagttttcacattagatattagtgacctccttaagagctcctgtatgaagtaaacattggttattcata

SEQ ID NO: 685258 - DNA, 179 bp, Homo sapiens
gctgatattaaccaagatggtctcgatctcctatatgtcacgtgctactaaccccttgactaatttttgtcttttaagtagagacgtgggttttgccatgttggccaggctggtactcaaactcctgacctcaagtgatcctcttgccttagcctcctgaagtgttggggatcccatca

SEQ ID NO: 685259 - DNA, 215 bp, Homo sapiens
gttcggcccgggggcaatggagcgagactccatctcaaagaaaaaaaaataaataaaaggaaataataataaaatggagcaagcggagacggaccagcggcctcagccaggcgggcaaatccagggcggatgggatgggacatttcttccggtagatgtcatagtcctcgggaaacggtaaaaaatcaaataagcgtgaggggataatattatag

SEQ ID NO: 685260 - DNA, 320 bp, Homo sapiens
cctagagttccaggcaaaactcctacggagcccaggtgtcattatggggttgcagagcagctgttaacggcgaatttgtagactgagctcagagactggtggaggcacgactgcgggcacagcaggagaagataagaggaggtccaccctgaatctttgcagcaaggcacagagcttctggcttgcatctcagaaggggggcagacgcacagcgcccaggaaccaccgggctcctagggcttgtgggcttccgagttgtccctggtgacctgtgaaagccctgaaggggaggctggaaagcctgactacaggatgcccgg

SEQ ID NO: 685261 - DNA, 219 bp, Homo sapiens
acgaagtgcgtgaccgacgctgtgtgttcagtcccactgacagtaggagcagcagggcgtcggcttttgaggtggcttttcctcgggggcaacccaggaagggccccaagagggacaattggattcttggaactcggcccagttgggtagctgtctgtagcagcccccgtctggggctctcacggggagtacaaactagtttatgctcggtgctcgtgt

SEQ ID NO: 685262 - DNA, 252 bp, Homo sapiens
aactacatcatcttcatatagccttataactcatttgtgctattccattttcctctgttccttttattttcacttcccttgtaatgttagtctctttgtactgatttctgaagaggtcatttatgattaaacatggtaacattttggccagaattgccaaaaaggtttttcccaatccatttaccaagggggtttaatttttgggtaatacagaagttgtatattgaaatataatcttgttctgttttatga

SEQ ID NO: 685263 - DNA, 889 bp, Homo sapiens
ggaagccggttggagtgtgagaggtttgctcgctctagggagattcttcaagcagtcactatgtcaacagacacaggtgtttcccttccttcatatgaggaagatcagggatcaaaggagtcattcgaaaagctaatagaggcatcattcgtacccgttgaatagcgggttttgcagcaaattgtggcatatggattatataaagggtgaagagcaggggaaatagctaaaatgtccattcatctgatccaatggcgtgtgtggagccaaggatttgttgtaggagcaatgatgtggtatgggctattccatgtatcgggaatctgggaaaactaggccttagaagaaggagatgctgtcttggtcgtgtggaggagctggctttagttagatgtcttattattaaacgttacctattatgtgttggacataaatcgtaatgtgtatgggttgagatggtaactggatttgagtatgtggcttccttgcttgcaggcttggttgcttgtgtgaccgaattactagtgactagtatactaatctagggtcattcaggaagtcaagtgaacttaaaacattgtcactaaatgcagttgatggtgttgataggttcaacttctaaattggtaagatgactagttccaggaagactaccggcagctgaggaccatcggagctgcgaagtcgaattgggtgtcgtaagagcatattgccaagtacaaattgtgtgcgtggaacggtggatgtaacatgtggacaaggggggacaacgtgaggtccacaggcagattgttgtcccaagagacagggggcgtttagaggaagaaggtgatgggaatggcgaagaggaattaagattgttcatatttattgatcttattataaataa

SEQ ID NO: 685264 - DNA, 770 bp, Homo sapiens
  misc_feature (2)..(2): n is a, c, g, or t
  misc_feature (75)..(75): n is a, c, g, or t
  misc_feature (141)..(141): n is a, c, g, or t
  misc_feature (143)..(143): n is a, c, g, or t
  misc_feature (159)..(159): n is a, c, g, or t
  misc_feature (207)..(207): n is a, c, g, or t
  misc_feature (222)..(222): n is a, c, g, or t
  misc_feature (351)..(351): n is a, c, g, or t
  misc_feature (361)..(361): n is a, c, g, or t
  misc_feature (366)..(366): n is a, c, g, or t
  misc_feature (372)..(372): n is a, c, g, or t
  misc_feature (375)..(375): n is a, c, g, or t
  misc_feature (407)..(407): n is a, c, g, or t
  misc_feature (421)..(421): n is a, c, g, or t
  misc_feature (432)..(432): n is a, c, g, or t
  misc_feature (445)..(445): n is a, c, g, or t
  misc_feature (451)..(451): n is a, c, g, or t
  misc_feature (453)..(453): n is a, c, g, or t
  misc_feature (456)..(456): n is a, c, g, or t
  misc_feature (460)..(460): n is a, c, g, or t
  misc_feature (464)..(464): n is a, c, g, or t
  misc_feature (468)..(468): n is a, c, g, or t
  misc_feature (475)..(475): n is a, c, g, or t
  misc_feature (479)..(479): n is a, c, g, or t
  misc_feature (487)..(488): n is a, c, g, or t
  misc_feature (491)..(491): n is a, c, g, or t
  misc_feature (494)..(494): n is a, c, g, or t
  misc_feature (497)..(497): n is a, c, g, or t
  misc_feature (502)..(502): n is a, c, g, or t
  misc_feature (504)..(504): n is a, c, g, or t
  misc_feature (506)..(507): n is a, c, g, or t
  misc_feature (509)..(509): n is a, c, g, or t
  misc_feature (521)..(521): n is a, c, g, or t
  misc_feature (530)..(530): n is a, c, g, or t
  misc_feature (533)..(533): n is a, c, g, or t
  misc_feature (536)..(536): n is a, c, g, or t
  misc_feature (539)..(539): n is a, c, g, or t
  misc_feature (543)..(544): n is a, c, g, or t
  misc_feature (546)..(546): n is a, c, g, or t
  misc_feature (549)..(549): n is a, c, g, or t
  misc_feature (552)..(552): n is a, c, g, or t
  misc_feature (554)..(554): n is a, c, g, or t
  misc_feature (556)..(556): n is a, c, g, or t
  misc_feature (562)..(562): n is a, c, g, or t
  misc_feature (565)..(565): n is a, c, g, or t
  misc_feature (567)..(567): n is a, c, g, or t
  misc_feature (583)..(583): n is a, c, g, or t
  misc_feature (590)..(590): n is a, c, g, or t
  misc_feature (594)..(594): n is a, c, g, or t
  misc_feature (605)..(605): n is a, c, g, or t
  misc_feature (618)..(618): n is a, c, g, or t
  misc_feature (636)..(636): n is a, c, g, or t
  misc_feature (639)..(639): n is a, c, g, or t
  misc_feature (679)..(679): n is a, c, g, or t
  misc_feature (681)..(681): n is a, c, g, or t
  misc_feature (689)..(689): n is a, c, g, or t
  misc_feature (706)..(706): n is a, c, g, or t
  misc_feature (757)..(757): n is a, c, g, or t
cnttccccgctcaggctctggcccccccccagccttcagagcccacaagccgactgtacaaagtcaatgatttangacccaaaccctgggcacagtgcctgggagtgtcagggtcacccactcccctgaggtgagccactntncatgtgcatcttctgncgggcggggccggggcgggggccgggggcgggggtgggggcctggggnccctgggccgcagcnaccccctcccctgcctccccactgtcccctggggcttggggggggcagactgcgcagaggggatgacctcaacagatgagtggaacaataaatagccccggtgggaagagggaaaataaagggggtaanaaaatatatnaaagngttggnggngggtaaggatagagtgggagggagggagaggnggaaaggtattganttgtgtgttangggagtgaaacgnagaaanangangganttcngggnggggggngggnttgggaanntgnganggnggttngngnnangggtgggacggncgttggggnggncgnctncggnncncgncgncncntggggngtntngggttactgtttactncccgggncggngggaactcgancggtgagtatttngaacgactgcacttgtgnttnaactgtaacgaggggaccgagttacttgggcactccacgngngggtacancggggtacggggtcatnactaacacgggggtggaggacacagacgggtctcgtacgggtatgggggantaaccggaatgga

SEQ ID NO: 685265 - DNA, 233 bp, Homo sapiens
tcgtagcggtcgtggtggcgcacccactccatcgtgtagctcaggcccgcctcgtcgcgtcccctgggcgtcaggtcgatgaggttgtaggtccccatcatcacttcgacgccgcgaccgaaggtcgagtaggtgtggaagacctggccggcctcgtccctgcagaagatgctgatgccgggcgcctcctcgctcgggaagggcgtcatgtggaagttgtagaacacctcgcc

SEQ ID NO: 685266 - DNA, 125 bp, Homo sapiens
  misc_feature (115)..(115): n is a, c, g, or t
gacggacgtccagctgagatctcctaggcggactccctctctctcaatttaaggtttctgaggtctgtctcctgtcatgtaaaaagaggaccactagaagtcttttttttttttnaacaaatttc

SEQ ID NO: 685267 - DNA, 459 bp, Homo sapiens
tttcaatttatacatagctaaatcaggggacctcctgggaaaggaacgggttaagagttggggtaaagaacatgattattctaggtgcaggggggggcgagtgggcaggaggggggcaaatagacaaccaaagggataaaaagcaaaatctgggggtgggactgggtgatagtacagataaacaggttaaaggaagacagtcatttctggggtcaacaatattaatggagtcacttggcatgggttagatacggaagtaaactctggagaatcaaaagcataaataaagcagagcccctatcttcagggagcttagagtgtcaagggagaagaaggcctacaaaccagattttaatcttaaaggcaactaacactttccatttataaccaggcgggcaattagtagataatcaagaaaggttttggaataattgattcagtttcccagcacaagaacca

SEQ ID NO: 685268 - DNA, 330 bp, Homo sapiens
caagttgttctaaagaagtaagtgatgtgcttcatcatcaaagcccctctgacaaattgctacgtatttctaagggcttataatcttgacagaggtcaatccagcttatgctgtgtttggtttgggtggccaaatgccatgtagaatccaatcttggcatcttccacttttttttgggcatctgtgggttgactgaaatccttgtccacattcacgccctactcagtaagtgcctcagcgtccgcccactttgccttctactttgataagctcaaagtcaacgtctctgcgctccatatctgctacagtgagcgcggcattcacagcact

SEQ ID NO: 685269 - DNA, 146 bp, Homo sapiens
cgccttctcgtatagagtgaaacgtgaacgactagagtatactttggtatctggatatgaggaaggaggcagagtcaaagattattcttagatcggttatgtggatagactgatgaattatggtgccctttataatgttagagata

SEQ ID NO: 685270 - DNA, 435 bp, Homo sapiens
cagcatgtaggttgtgtggtgttgcttttcgaggtggtttgtgatgcttggaggaccctgcaggttacctgggccccaccaggtcatcaggagcatctcccatctcaagattcatcaccgagttccctatgcagagtccctggtgcggtgtaagcaagcaatccacaggttccagcgggtggggtgtggacatcaggcatgcgtgttcttccaagcttgcaaaagttacacaaatgtatgccatgagggttagaggtgaggacataactccaaagcagactccaggtcttcccaggccacacattctcttcccatcattaattggaattggaattcgtttttgtgccatagcgtatgtttcaaagtcacgttcaggtgaatcattaaatgctaccaaccatagacaataaaataataaaatctaaaagatcaaaa

SEQ ID NO: 685271 - DNA, 239 bp, Homo sapiens
tatattatactgtgctttctagtagggtaccagcttgattgaagcggcttgagaatgacgattcaaagtactaagtagctggcgcgagacagcttgctgatgctgcgtctgagtggcttgagttcctgcagcctccggctgctgtgccttgaccccagactacagtcgcccatccaggctgcaacagacgctggattgttatgaatctgatgtgagccaaggcgttgtgtgagtcttgg

SEQ ID NO: 685272 - DNA, 684 bp, Homo sapiens
  misc_feature (52)..(52): n is a, c, g, or t
  misc_feature (100)..(101): n is a, c, g, or t
  misc_feature (183)..(183): n is a, c, g, or t
  misc_feature (219)..(219): n is a, c, g, or t
  misc_feature (239)..(239): n is a, c, g, or t
  misc_feature (378)..(378): n is a, c, g, or t
  misc_feature (395)..(395): n is a, c, g, or t
  misc_feature (418)..(419): n is a, c, g, or t
  misc_feature (432)..(432): n is a, c, g, or t
  misc_feature (440)..(440): n is a, c, g, or t
  misc_feature (447)..(448): n is a, c, g, or t
  misc_feature (457)..(457): n is a, c, g, or t
  misc_feature (459)..(459): n is a, c, g, or t
  misc_feature (481)..(481): n is a, c, g, or t
  misc_feature (504)..(504): n is a, c, g, or t
  misc_feature (514)..(514): n is a, c, g, or t
  misc_feature (532)..(532): n is a, c, g, or t
  misc_feature (558)..(558): n is a, c, g, or t
  misc_feature (575)..(575): n is a, c, g, or t
  misc_feature (577)..(577): n is a, c, g, or t
  misc_feature (586)..(586): n is a, c, g, or t
  misc_feature (596)..(596): n is a, c, g, or t
  misc_feature (666)..(666): n is a, c, g, or t
ggcgggattcctgggtcccattttcagcgcccagggtcacagatccacagtnggaagttctgtgggacacattggcactgagccacaaagaaggtgtggnnagaacaacttgggctcctgctgaccaatgtcctctagggcctaggggacagaggaacacagagtcacagcttcaggggccgnatgaccctggcggccttcctgagagaatatgccccnccacgaaactcagcccagtngacaccatcctggtagcggcttcggtagtggccgccgtggtgccacacaccgttgaggttggcgtgggctcaggcctggtcccccccgcctccccgctggtcccgggcccagttacccgaataggggtctcggtccctntccacggtgctgaaggncttgtcattgtgccaggtaaganngtctcccgcctcnccctggtnctggccnngccgcaggntnagtggtcgctctcgggttccanggagaagccatcataatgggcangtgctccacngcccccccagtcctccangagaaccagccgctcatggtccccanggctggtcagctgatanangggttcaangcccagccanttttctccgtctggccgcccaaagcccgccttatagtgctgccaggtagtgaagaagttgactgaaccancttgcctccgctggatca

SEQ ID NO: 685273 - DNA, 773 bp, Homo sapiens
  misc_feature (129)..(129): n is a, c, g, or t
  misc_feature (204)..(204): n is a, c, g, or t
  misc_feature (220)..(220): n is a, c, g, or t
  misc_feature (233)..(233): n is a, c, g, or t
  misc_feature (271)..(271): n is a, c, g, or t
  misc_feature (285)..(285): n is a, c, g, or t
  misc_feature (383)..(383): n is a, c, g, or t
  misc_feature (521)..(521): n is a, c, g, or t
  misc_feature (552)..(552): n is a, c, g, or t
acctggtcacatgcacagtcacaatcttaccatctaaatacaatcaatattcagagtaggggtcatcagcccctatctaaaagagaagtcagagagactttaaaactagccttaagggcgggatggggntcacacctgtaatcccagcactgtgggaggccaaggcaggtggatcccttgaggtcaggagtttgagaccagacnggccaacatggtgaanccccgtctctacnaacaatacaaaaattagctgggtgtggttgcgcctgcntgtaaatcccagcnactggggacgcagaggtgagagaatcacttgaactcgggagatgaaggttgcagtcagcagcgatcgcgtcactgcactccagccttggggaaagagngagaccccgtctctgaatgaatgaatgaatgaatgaatgaatgaatgaatgaatgaaagaaacttgcctttagtcaaataagggacaaaacaaattttaactaatccatgttctttttctctacaccatccccccaancactctagccactgcttcttaatttcttggntggattcctatcctgttacaccttaaatgttaatattccttatagtttttattttttaatttttttatcttttatttagagactgctaattgtttgccccagggcgggcatgcacagggcgcatcccataggcgaactgcgccacaatgcaccctccaaatccctgggcccacggaaccttcctgcctccagtgtcccaacactgggaataaggacacaac

SEQ ID NO: 685274 - DNA, 360 bp, Homo sapiens
agtctacgtatttttaatacatttaaaatatggaaccctagaagacagaaagatcccgacgataaaaatagcatcatttatacaatttctagtgaagcttaaagggaagaaggaagtgatagaaagccattggtattactttaccaattcaatagacgcagctcagaatcaagcagggttttcacgatcacacatttagtacaggcacctcgcccactctctccccacaatccccatccccttccctttctaggtctcgtttaccatactgattttatgtgatagtttcccctctagtcttggctcattttaaaagcacaaacgtgctacttttaaatactatatattattcattctaac

SEQ ID NO: 685275 - DNA, 574 bp, Homo sapiens
gcacgagatttgtttgcatattcagagagtagataattaacacccttgtattttttaagcataatttttaaatatctaatgtgttgatctacaaagaattgcttaatatatggtactgagcagaagatataaattggtattccccccaaaaagatgactgttggtgctagaatcacattcccactaagctgaaaatgctttctttgccatgtgtactgactcatacgtatcatgggttgtttgaggcacatccattttgtaccatcaaagttctgtctgctcttgtgctggtatttcacttattcactacctatttatgacttagaaaaaccacagacttttttattttgaggcagagtctcactctgttgcccaggctggagtgtagtagcatgatctctgctcactacaacctccgcctcccaggttcaggcgattctgctgcctcagcctcccaagaagctgggattaaaagcacccgccaccaccatgcctggctaatttttgtatttttagtagagatgggattttaccatgttggctaggctggtctcaaactcctgacctcaagtga

SEQ ID NO: 685276 - DNA, 279 bp, Homo sapiens
cacgtcccttgggctcccgactcgcacgacagctgccggcgtgtgtagccctggattttgctgacgtctgggtgaccagcgccggttggtcaccccagctcctcgaaacccgggaagggggacacaggtctctgttgagacatcccatacccggatagcagcatccacggagtaagctgagagcagtcgccccccactgggggcccaaggccaagctggtaacaggtgtatgcccagggtgagacagcacttgggcacagccagaagtgcgcctgggtg

SEQ ID NO: 685277 - DNA, 289 bp, Homo sapiens
tctattctcttgtggtccatgctttcctaagaatttttcatcgtctctcagttcttttgccacttactagtaagggttaatatgagggccctctgagagaaaaatataagtaccctcattataatatctttttcatggtctggactagttttcattcttcctagaatttagacatctaccttcttcaaaaaccttgtcccaactgtcccaaacaagccattaaaacactgaattaagcatcagctgacaagacatttgcagacctcacacctttgcacgctctttctca

SEQ ID NO: 685278 - DNA, 414 bp, Homo sapiens
ttaagcacttgaggtgaaatgctaaaccctgagaggatgagactatggagaagctatgacatgtgctgactgccatgcagtctgcttggcagaacgcgaccatgcatcgtattcactaggggaactgttgcatgtgtacacactagttagtctgatcgcatttgctgtgagctagagtggtacagctgctatctgcgcctgactctgtgatgagtaagttctattgaaccttgtgcagactactgacttattcagacaacatgaaggtgctttgacaggtatgcgatgactcttagacccaggctgagagatcgggacagttatccaggacagagccagtgacttcgctagattccactaccctgagaccgctatgacggacaccacacagccgagacacgactagcatcgtct

SEQ ID NO: 685279 - DNA, 268 bp, Homo sapiens
  misc_feature (80)..(81): n is a, c, g, or t
  misc_feature (86)..(86): n is a, c, g, or t
  misc_feature (89)..(89): n is a, c, g, or t
  misc_feature (184)..(185): n is a, c, g, or t
ggtagcagttctcaggtcggcgggctgtggaggtgatcagagtgggagtcaggcgttctaggccggacccttttggaggnnttttntcnccggtttttagccccccctccgactgttcaggaatttcctcctccgcccgtcagagagagaccccgcgtcctttttagtccgactcgctacgcgnntcttgcgagatatctggccgcctctgccgcagctgtaggtgcatctggagaagcgcctgatgtcctacgagattcacacccgt

SEQ ID NO: 685280 - DNA, 935 bp, Homo sapiens
  misc_feature (39)..(39): n is a, c, g, or t
gccggctcctgcaaggaaacagtagtccatgtgaaagcnatttgacgtatgacccctcagatgacccttattgttcatgtcgagagttaaggtctgtctttttgaaagaagggtgatagtaccttcatgtgatcattcatagaagatctcaagatgtggtggcaggccgtagcagggaaggggacggaagtatatcgaatgctctaggcacgggcgttgtgtccagggaaaagtgttcagcagcagaagggaaggcatgagataaagcatgtgaagaagataagtgagccagaaaaatcaggaaaagctgtggttgttgcgaatgatgaattaacaaacgaggaggagaagaaaggttctgatataatgccataaaaattgattgattatgagaagcgaggagatctttagaactatgaggaaaatgtcactattatcatcagacaggcaaataggaggagacctaattcatcttgattggtccagagaactgtggacagaatgaattgtgtcagaggtcatgaacaagggaaaaggagcgttatggtctgaagttcgtcataacaaccaggagtaggcgagaccaagaagtagcggtaggattaccactttgtatcgggggaagcattcgaggcagtgcttagccggtgggagttcattggggcatggtggattgagaaagaagtgggtggaaggaggcttgattcttggtggtggggtaattgggcaaagaggctataaggagtgagcaggagtgagagatctggatgattggaaatatgtgtaggagccagagagagaggtgggtttggaaggggagtgatatggagggagtatgggagataagggaaggggagatggagtggtaggaggagagtaaaaggagcagtggaagataggggatggcgtagggggtttggtgtttttttgatata

SEQ ID NO: 685281 - DNA, 300 bp, Homo sapiens
ccaaggtcgcctgtgtgctagtcacgaccattaggatccgaagaagagatgatgactaccctaaaagtaaggtctgtgaacagcctgtaatgggacgtgagctgcggtattaaaaaaatcaagaatggaagcgttcctcaattgtcgttgagaatcataccaacacggcagatgcaaccatgaaaaacgcagctgcgtatcgcgcgtttttcatggttcgcatctgccgtgtatgcaatgattctcaacacacattggagtcacgcggcctgcgtaagagtatgaaggtcttcctgtaaa

SEQ ID NO: 685282 - DNA, 439 bp, Homo sapiens
  misc_feature (412)..(412): n is a, c, g, or t
ctccataatgtgagcccatgcttgtgtcctgaatggtatcgcctaggttttcttctagggtttttatggtttttaggtctaatatttaagtcgggaatccatcttgaattaatttttgtataaggtgtaaggaaaggatccagttttagctttctacatatggctagccagttttcccagcgctatttattaaatagggaatcctttccccatttcttgtttttgtcaggtttgtcaaagatcagatggttgtagatgtatggtattatttctgagggctctgttctcttccattggattatctctctgttttgggaccagtaccatgctgttttggttactgtagccttgtagtatcctttgaagtcaggtagcatgatgcctccagttttgttctttttgcttaggatgngcacacattatggaggggtaccgagct

SEQ ID NO: 685283 - DNA, 290 bp, Homo sapiens
  misc_feature (60)..(60): n is a, c, g, or t
caaggagcggatcgccctggaggaggacgagcgcctggagcgcggcctggaacagcggcnccgcaagctgagccggcagttgagccggcgggagcgctgcgtgctgagctgaggccgccggcccgggtggcccataacttctcgcgtccccggcgtccgccgccgccccgggcctgcgctgcggacgacccggccgtcccggaggccgcgcgcgtgtccgctaggggccgccggcgcccttccccgtatagggcagggcggatccccgaccccacgggcggggcggccgc

SEQ ID NO: 685284 - DNA, 207 bp, Homo sapiens
aaaggaccttacgctatcaggaggcagaactggaatttttgctgggtgcggtggctcacgcttgtatcccaacactttgggaggctaaagtgggaggactgcttgaggacaggaattcaagaccagcctgggcaacacagacctcgtcctttttttcgagacagagtctcactgtcgcccagactggagtgcagtggtgcaatcata

SEQ ID NO: 685285 - DNA, 186 bp, Homo sapiens
aaggctgtggtggccaagtccttcttgcccattcctttaattcttcctacgaagaatctcgaaatggttgcagatgttattgaagatgttcccatatatgttagcatttaagaagggggatctcgatgtgtggtgtggtttcatgggttgtaaagatgaacgtggaggccggtgcgctggtggcag

SEQ ID NO: 685286 - DNA, 1206 bp, Homo sapiens
tggtgttccaacaaaatctttatttacaaaaacagggaagcaggcactgttgggccctcagactggtaatcttccccatcatctactctaaatggatactcagatgaccgggctggcctgagggggctggtgggccctgtctggattctctggtgagatgggaaaccactctagggtaccccggggtgcgcgtgaggcgtgtacacaccggcagaaacgagggcacgggcgtggggaagttccggaccaagggggtgacagcagcagggcaaaagcgtgaaggcgtgtgcgtggaataaggcgtgaaccttccttcataagcaacaccaacgtgcttaatctccaggctcagggccaactcttccgccagtgatacatacagtggctcccgggcgggcacgtgtccttactgggcccctaggagttcccgtgcgtgtgtggccagtgaccaccagacccatctcgtgggtgagtggcccagtggttaagatttcttcgcgggagtccaaagtgctgcttccaagcgggtgacctcagaggttctcatgcgggatgatagaagttttacaaaccctcattcacaggccaagattgaagacaaattccaggactcctttagcagcctggctgccaaagagacaggaaaccatattatcgggccttgcagagccaatggtacgaaaggcctagaccgaatgctacctaagtcccaggttcactcctgggcgaagcccctcgatattaccgaggagaatccgtgcaagcccgccggagacacctcacgccgggggccccaggggcccgaccagctcaacgaggatgacatggagggagcacatctacacgaggacctataggacgcccgacaagaaacccaggaacaagaccaccagggcaacatacgtgtccacctcggacagaatccaaccaaaagggacacaaggcatggccaacacgtgggaaacgcccacaaagccggaaacagcaaagcccaacggcgggaagtaatacccaccaaacgtaattgcccccgacaccaggcagtgcacgcaagacaccacgggggacccaacacaagaataggtacggacaagagacagataaaaagcgccagcaaccaagacaacagaacgctatacgacgaaagcaacaaacagcaagtagatggaacacataaaaacaaaacaaacaacaagcgaacagcat

SEQ ID NO: 685287 - DNA, 227 bp, Homo sapiens
cctgacagtctatcacgtatcgctaacgactccagacagcaggtatgaagacgtggttacagtcaaaggaattcaaccctgtgactgtcaatagtcttggagtattaaataggtgcacaactatttctctctacactaaggacgcactgaggacagtctgccctgcaaggggccgcgagtctcatagccaaatcactgtacaacaaagctgcatataagaggatagc

SEQ ID NO: 685288 - DNA, 101 bp, Homo sapiens
  misc_feature (3)..(3): n is a, c, g, or t
ccntggctctgattagggactgacagaggaggatcaggaaggcagaaagagaaccagaacaatgttgtgtcataaaagctaacgagaagaatgtccagaag

SEQ ID NO: 685289 - DNA, 957 bp, Homo sapiens
tggccaaaaacaaatctaaagcaagtgccttattgttaagaaacaagggattcttcaagaactccgtgctacacgagttatttcacaatgtcaaagagggcccaagaattcaggaccaccttaaagacaacgtgacaagaagagtgtgctcagaagcccagaggccaacctctgtgcgataagattgaagcgcaggcaggcacatgtgactctccattttctatattctgtagatataagcggaagacaagaagaaagaggcattctctcagaaccagagatgtgaaaaaccaaagggcgtgggtgtccataaaaaaacacagaattgtgggcttctcaaagaaaaacaccatagaggaaagaacccacgagagagcgcgtgatatttagattttatagtataaaaattaactcattatgtgcccaagcgaggggaaatgtggagaccccacttctcataaactccaatgggctatgtgaactctcaattcttcttttcagaaatacttgggataagggtggctcaaagcttgtggtgtttaaataagtatactttttcaccgtggtctctgggggccaaaaagagctctttctcttatactctttgggggcccatatagggtgggggcgatactccaggtttcctctcccatttttttataatgtggtggtttcccaaaaaccaaactcctttttttttaccttgtggacctttcaacaaaacccaagggggggccagttattaaaaccaccaaaaggttgtgcctgcaaatagtggggggactcttataatcaccgcattataaattacccaaagatttttttccccaatagcttttctaaataggggcataaaaacggaaaggggtttctcacaaggaaattttattaaacgcgggtttatcccccaaattttttcttatacccttataaggggggcgaagtgtaaaccacacc

SEQ ID NO: 685290 - DNA, 411 bp, Homo sapiens
acacagttgtatctttctgggagaaggtactttctttacatggctcatgtattattctttgtcctatttttttttcgaaataatgtaactgtaaccaacctggagtgtcttcttagcttaaacttttcaccgtgctgagcccggtgctgacgactttaactaagcaattgaggccacagaagtaaaacacttggggccaggcgcggcggcacatgcctgtaatcccagcactttggtaggccgaggcaagcagatcacctaaggtcgggagttcaagaccagcctgacccacacgtgaagacaactccatctctactaaaaatacaaaattagctgggcgtggaggcacatgcctttaatcccagctccttgggaggctaaggcaggagaatcgcttgaacccaggaggtg

SEQ ID NO: 685291 - DNA, 240 bp, Homo sapiens
agttcagaggatccccttatcactactttattgcttctgtaatgtgtgtatggtaatcatatgtaacgaggttagattgattagtcatatgtgggtggtgattagtcggtatgttgatgagatatttggaggtggggatcaatagagggggaaatagaatgatcagtactgcggcgggtcagagcctcaggcattgtggcgggccaatgcaatgcaagcgaacagattttcgtccatttt

SEQ ID NO: 685292 - DNA, 272 bp, Homo sapiens
  misc_feature (44)..(44): n is a, c, g, or t
ggccccattagactggtttgcagggggcatcactggctttcccncctgacaccctcacaactaaagcaaaaattgggtctttggtcttttggaaattaatagaggggattttggggtatcccagatttgtgcaggatgcaaaacttaaggctggtctttgatgcaaacttaagaacccacagaaaatgctttttaaaatgcctgttttaagatggaattgttgtttttataatttgattttagtgctaaataaatgattggctttgtacatg

SEQ ID NO: 685293 - DNA, 342 bp, Homo sapiens
gctcgacgagggagtgaatagaattgatcccagaacagaacaaggataatcggacgggcatggtggttcatgcctgtaatcccggcactttgggaggccgaggcaggtgaatcacctgaggtcaggagttcaagactacctggccaacatggtgaaatcccgtttctactaaaaataaaaaattagccgggcgtggtggtacatgcctgtaatcccagctactctggaggctgagacaggagaatcacttgaacctgggaggcggaagtggcaatgagccaaaattgtgctattgtactccagactgggcaacaagagtgaaactttgtctcaaggtcgacg

SEQ ID NO: 685294 - DNA, 140 bp, Homo sapiens
tgtgcgccagaacgcttagcctagccacacccccacgggaagacatgcagtgattacctttgccaataaacgaaagtttatacttagctatactaaccccagggttgttccatttcgtgccatccaccggtctcacgact

SEQ ID NO: 685295 - DNA, 773 bp, Homo sapiens
  misc_feature (1)..(1): n is a, c, g, or t
  misc_feature (275)..(275): n is a, c, g, or t
  misc_feature (339)..(339): n is a, c, g, or t
  misc_feature (636)..(636): n is a, c, g, or t
ngtcccaggggtgtttctctatcctacggggatattttgtatgaggcctctttcatcttgtttttgtggtgggggtcttggttgtggggtggtgatgtagggtggggggggagaatattttgtggcggcccacacacgcggccgaacaattatgccgccaacaaagttttttgttttttgtcgttgtgtgatcttttcctcactcttcttgttggtcctcacataacgaccttcttttgagggggtgttgtttttttttgagcccccaacgcgtnttctagggttatttggtgggcgctctgtgtcacataaccccaccactctccaacaccccctcgnggggagccctctcaccctgcgtggttctctttctctctttccacggcccttgagcctcgcgtggatacccacgcggtgtgttgttgtttgaatttgagggtgtgtgttgtgaggggtttcacagattgtgtgtggaagaaatatttggtggcgcccccgcacaatgtgtacacctgagactgccttctacaaaggtttggcccattctctgtgggcgctttataaaaaacctggggcccagaacccaagatagaggcccttgggttcctggattttgggtgtggtggccgcgaccanccacccaccagagattttagatttcggatattcattttcaaaaaaaagtgagggttgttacaagagggttccccaatttaaaaaaaaatgactttttggccagtgtgaaaaaaatatatataacaattataaaaaaa

SEQ ID NO: 685296 - DNA, 826 bp, Homo sapiens
caagcatcatatggtgaaggagaaggagacacagatgtgatgcagcaggagacagttacagttcctgtaccttgttagaataccaaacagtctaaagattgttttgtgatacgactcaagaggaaagaaacgaggttgccacctagacgctggaaaagaggaattatcatagagactgatgtttcttgtaaatcgttatgccgaagttatggttactctgatcatcgttgtttgttttttatggtgtgttagagtttttaacgttcgatgatttggtttttgtgagtgatcgctgtcgtgtttgtgttatatcatgggctatcattttgtgttgtttcttgtgtgttttaattttttgattctatggttgttgggttttgttttttttttatcgcttgtggaattgtttgttttcagtggctgggttgtttttttttgcgtttgtgggggctatttgttatattttgttgtctttggtatttgagaatggtgtttttgttggtgtaaagtttttgctatattattattattattttagtatacgtgatttttgtttttttatttagtatgtggagcgcgttgatgcgaatgtcgggctatattttgtgcttatgctagtcgttatagattgttgtggaatgttgtagctatctatgtcgaattagctgttttaggagtagttttaggaatatgtgatatattatgacttgtgtaattctgtgatatgctattattttggttattgccgctgcatcttcgtttcttgtaacgtttatcgtttattttgctgttgatttttttatgtgacgtgtttatggtggtcctt

SEQ ID NO: 685297 - DNA, 348 bp, Homo sapiens
  misc_feature (3)..(3): n is a, c, g, or t
  misc_feature (12)..(13): n is a, c, g, or t
  misc_feature (19)..(19): n is a, c, g, or t
  misc_feature (25)..(25): n is a, c, g, or t
  misc_feature (45)..(45): n is a, c, g, or t
  misc_feature (62)..(62): n is a, c, g, or t
agnaaaacgcannaagagnaaagangatatagttttttctccccnaaaggagcaccaagacncgccagcccgttgcttataaacaaaaggagagccccacccaccttaagcttttttttgaatggttttttctgcactcattatgtaccagacactatgtaagttactgggatctaaagatgagttacactgatcctttaaggaattcaaagactagtgaggatgctgttaatgaatgcttatagtacagtgccacgggtgccataacagtagtgcaaatgctgagaagtgtcagcaaatcagttccgccgtctaaaaatataaaaaaacaaaaaaatgaattcttgt

SEQ ID NO: 685298 - DNA, 111 bp, Homo sapiens
acaggcatgagccatcatgcctagctaatttttatatttttcgtagacgatgaggtttcactaatgctggccagtgctgactattgaacattcttgaccgcaggtagatcc

SEQ ID NO: 685299 - DNA, 780 bp, Homo sapiens
  misc_feature (358)..(358): n is a, c, g, or t
tggcattatagttttataactggggggagggggacaaaaaggagggagaagtctaaaaaacaaagggaggggggccacaggaattggtcagaaagtggaggcttaggctgtccatacaggattcagcaagtactgggggactgcgactagaagaagccaggggtggggaataagtagctgaggaggagagggagctgatgtggaggagagcaagggcaacttcaaggaacaaaggggaagctgcaaggcaccagctccattaatttaagcaaacatttcctgtgtctgtattgccattgccagggtcctgtggtcctagtggttctctccaggggggtacgctagaaactgtgcccanacagacagggaacgagacagaagccaaagcaaagaattccgtaaaggtagccggccgtgcgtgccaaaccggggcacaaacgtgtagtggaggcgcagcgtgtggtgtagccagaacccgagttaaaacctaggtcccacccgggccggtctgactccacggctctcataggggtgggtggggcaaagcgtgtgagggctgaaggcgctaaccatcaaagatggaggtcgggtggcaaaagatggggtggaaggcagagcagtgagtacagcgaagggggcctcaagggactaagaaaactccagaacttgcgggaaaggcctgagcccgcatgggacgctcgggggtgaccacatcggacacgggtaccgggagaccccgcctccccgcgcccgcatacaacaggcgcagaacccgaaaca

SEQ ID NO: 685300 - DNA, 881 bp, Homo sapiens
  misc_feature (60)..(60): n is a, c, g, or t
  misc_feature (103)..(103): n is a, c, g, or t
  misc_feature (108)..(108): n is a, c, g, or t
  misc_feature (114)..(114): n is a, c, g, or t
  misc_feature (119)..(119): n is a, c, g, or t
  misc_feature (125)..(125): n is a, c, g, or t
  misc_feature (129)..(131): n is a, c, g, or t
  misc_feature (135)..(135): n is a, c, g, or t
  misc_feature (143)..(143): n is a, c, g, or t
  misc_feature (151)..(151): n is a, c, g, or t
  misc_feature (159)..(159): n is a, c, g, or t
  misc_feature (162)..(162): n is a, c, g, or t
  misc_feature (166)..(167): n is a, c, g, or t
  misc_feature (169)..(171): n is a, c, g, or t
  misc_feature (184)..(184): n is a, c, g, or t
  misc_feature (258)..(258): n is a, c, g, or t
  misc_feature (713)..(715): n is a, c, g, or t
  misc_feature (717)..(717): n is a, c, g, or t
  misc_feature (719)..(720): n is a, c, g, or t
  misc_feature (728)..(728): n is a, c, g, or t
  misc_feature (733)..(733): n is a, c, g, or t
  misc_feature (740)..(740): n is a, c, g, or t
  misc_feature (745)..(746): n is a, c, g, or t
  misc_feature (751)..(751): n is a, c, g, or t
ttctgggtacatttgatctgactggaattcctcctgctcctcgtgggtcccacagattgnagtcacctttgagatagatgtgaatggtattcttcgagtgacngctgnagacangggtncagggnacannnattngttcacantccccggnggccagantcncttnnannntgaagaaatcganaggatggttaatgatgctgagaagtttgctgaggaagacaaaaagctcaaggggcgcattgatactagaaatgngttggatggctatgctttttctctaaagattcagattggagataaagaaaagctgggaggtaacttttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcactcgctcacatgtctttnnntngnngggagaanaaganttggccntcttnnaaagngggtaaaaaacctgggttcgtccgcgtgttcaccttctaaatgttggaatccacaattgggtcaagcgcatggggcctagtaaggttttttaaccacaagtgacaccaataaatgtatgtcattttaaga

SEQ ID NO: 685301 - DNA, 880 bp, Homo sapiens
  misc_feature (60)..(60): n is a, c, g, or t
  misc_feature (103)..(103): n is a, c, g, or t
  misc_feature (108)..(108): n is a, c, g, or t
  misc_feature (114)..(114): n is a, c, g, or t
  misc_feature (119)..(119): n is a, c, g, or t
  misc_feature (125)..(125): n is a, c, g, or t
  misc_feature (129)..(131): n is a, c, g, or t
  misc_feature (135)..(135): n is a, c, g, or t
  misc_feature (143)..(143): n is a, c, g, or t
  misc_feature (151)..(151): n is a, c, g, or t
  misc_feature (159)..(159): n is a, c, g, or t
  misc_feature (162)..(162): n is a, c, g, or t
  misc_feature (166)..(167): n is a, c, g, or t
  misc_feature (169)..(171): n is a, c, g, or t
  misc_feature (184)..(184): n is a, c, g, or t
  misc_feature (258)..(258): n is a, c, g, or t
  misc_feature (713)..(715): n is a, c, g, or t
  misc_feature (717)..(717): n is a, c, g, or t
  misc_feature (719)..(720): n is a, c, g, or t
  misc_feature (728)..(728): n is a, c, g, or t
  misc_feature (733)..(733): n is a, c, g, or t
  misc_feature (740)..(740): n is a, c, g, or t
  misc_feature (745)..(746): n is a, c, g, or t
  misc_feature (751)..(751): n is a, c, g, or t
ttctgggtacatttgatctgactggaattcctcctgctcctcgtgggtcccacagattgnagtcacctttgagatagatgtgaatggtattcttcgagtgacngctgnagacangggtncagggnacannnattngttcacantccccggnggccagantcncttnnannntgaagaaatcganaggatggttaatgatgctgagaagtttgctgaggaagacaaaaagctcaaggggcgcattgatactagaaatgngttggatggctatgctttttctctaaagattcagattggagataaagaaaagctgggaggtaacttttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcactcgctcacatgtctttnnntngnngggagaanaaganttggccntcttnnaaagngggttgccattttgggttacggcccctcccccccttcccgggccccctccctggattgccttaaaagagggttgtgttggaagttttttaaaccataaataacaccaataaatgtttgttatttaaaaa

SEQ ID NO: 685302 - DNA, 522 bp, Homo sapiens
aagaaaaacaaattttcctttgttttatggtatgactttatagattcttgttctctgtaactagtaacttcaagtattctgttttgtctaaaaggtactgcgaaggtcatgagacgcctgagaaggcctgaactacagctgtctgggcacctagtgaaggttataaggcaaaccagtgcaaggctcttttgagcaaaacctagataacagacatctaggttgcaaagcaacagtcatgtgtaatcccgagttatgaactgtcacaatttgattaattgttctccctctgtatctctgctttcatgccactgtaagcctacatcaagttagcccaccccttttggaacgtgtgtatgaaagtcaagtgctgtctttgttggggcccaatctctggatgttaagtcagctgagtctgagtgcactcaataaagatatcctcctgtatacaccccaaggtctctctctggtactcctgattcctgcaaaaagatgtcaatttataaacaatatacaggacagatg

SEQ ID NO: 685303 - DNA, 1438 bp, Homo sapiens
  misc_feature (210)..(210): n is a, c, g, or t
ggagagaactagtctcgagttttttttattgttttgtttttacggggcaccaatgtgggtttaaagtggcattcaagacccaggaggttcacacgtttatgtatctgggtgtggcaacgtcttataggggtgaggggtgtgtgggctccattgcggcccacaaagcactttgaagaattgggagtgccgcgggtcctcaccacgtttttntcacggctccctctcccccaggtgagaacaataaagacttaaaacgggatgtgtcgccgtgtactgaaccgaagattcctcagataggcggcgccgggggcgtctgcatgacactcgcatgggggggcctgttacaaatgatttccggacccaggggctgttggggcgtgttcccccgctacgaggcgagtggggcccccctgggggcgttggagctccccgtgagagatagcggggtgacacctcaggatgtgtgttgggcacgcggagggctctccattgtctcccatgaaacctggtgggggcgccctcctgtggggaggggggggccattcctggttctgtggggggaggcacatcctttaaacagtaaggacacatggtggagaaagcgctctggaccacaaagggggacattgtgactaccctacagcggggaagtattttagccaccgggagaaaacggacattgtgcggcgtcccccgtcggggattgttaaccaaccaggccgtggagagactataacgacgagttttggcgcagttgtgcggcgaacaacaaattctagggccgtgaacaagggggaaaagttgttcgctaaagaggggggccaaaattatatgcggcggccgcagaagcagggtttcatgaaaaacaaccaacgagataaaccagcacttatcgccgttttgttatatacccacaaagagactgggcattcggtgaaaagcaacctcttcctcggaggacaccacagcatgaatgtggtggtgttcgacaccacctacgcacttttttttgtgccaaccgagctgtgagaacacttgacacacgggatactccctttctttaggggccaccctaaattagtgccgcagagcgcgttgggattttcccccattgggacggagggagcgttcttccactcatcaacaaacacggcggggaggtgcacccttattatattcacacaattttggtcgccaagatagattatgcggcctccccgctgtgggggaggccaccaggtcggttatacaaaagaaaaacggtgcttctagtaggagcagaaagagggactcttcacatgagttatgggagacgacggagcaacgcgcggcccccccccaccgagtgtggcaaccatctgtttaggtgagaaaaccaacgtttgcttctcatcatccatgctgtaatatcatcagtaaacgaaagtgtcttctgtca

SEQ ID NO: 685304 - DNA, 770 bp, Homo sapiens
  misc_feature (60)..(60): n is a, c, g, or t
  misc_feature (103)..(103): n is a, c, g, or t
  misc_feature (108)..(108): n is a, c, g, or t
  misc_feature (114)..(114): n is a, c, g, or t
  misc_feature (119)..(119): n is a, c, g, or t
  misc_feature (125)..(125): n is a, c, g, or t
  misc_feature (129)..(131): n is a, c, g, or t
  misc_feature (135)..(135): n is a, c, g, or t
  misc_feature (143)..(143): n is a, c, g, or t
  misc_feature (151)..(151): n is a, c, g, or t
  misc_feature (159)..(159): n is a, c, g, or t
  misc_feature (162)..(162): n is a, c, g, or t
  misc_feature (166)..(167): n is a, c, g, or t
  misc_feature (169)..(171): n is a, c, g, or t
  misc_feature (184)..(184): n is a, c, g, or t
  misc_feature (258)..(258): n is a, c, g, or t
ttctgggtacatttgatctgactggaattcctcctgctcctcgtgggtcccacagattgnagtcacctttgagatagatgtgaatggtattcttcgagtgacngctgnagacangggtncagggnacannnattngttcacantccccggnggccagantcncttnnannntgaagaaatcganaggatggttaatgatgctgagaagtttgctgaggaagacaaaaagctcaaggggcgcattgatactagaaatgngttggatggctatgctttttctctaaagattcagattggagataaagaaaagctgggaggtaacttttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattatgccgtttgctcacgatctctctgtgtcgaggtaggagaagcttacaggggtatccgagtctcgatattcgctaactc

SEQ ID NO: 685305 - DNA, 699 bp, Homo sapiens
  misc_feature (60)..(60): n is a, c, g, or t
  misc_feature (103)..(103): n is a, c, g, or t
  misc_feature (108)..(108): n is a, c, g, or t
  misc_feature (114)..(114): n is a, c, g, or t
  misc_feature (119)..(119): n is a, c, g, or t
  misc_feature (125)..(125): n is a, c, g, or t
  misc_feature (129)..(131): n is a, c, g, or t
  misc_feature (135)..(135): n is a, c, g, or t
  misc_feature (143)..(143): n is a, c, g, or t
  misc_feature (151)..(151): n is a, c, g, or t
  misc_feature (159)..(159): n is a, c, g, or t
  misc_feature (162)..(162): n is a, c, g, or t
  misc_feature (166)..(167): n is a, c, g, or t
  misc_feature (169)..(171): n is a, c, g, or t
  misc_feature (184)..(184): n is a, c, g, or t
  misc_feature (258)..(258): n is a, c, g, or t
ttctgggtacatttgatctgactggaattcctcctgctcctcgtgggtcccacagattgnagtcacctttgagatagatgtgaatggtattcttcgagtgacngctgnagacangggtncagggnacannnattngttcacantccccggnggccagantcncttnnannntgaagaaatcganaggatggttaatgatgctgagaagtttgctgaggaagacaaaaagctcaaggggcgcattgatactagaaatgngttggatggctatgctttttctctaaagattcagattggagataaagaaaagctgggaggtaacttttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagttttgaaagtcacccgaataaaacacctcatggtgcagcaggaaatgctatagtttaaacggttgaatgctgctgttgttatcccgcc

SEQ ID NO: 685306 - DNA, 184 bp, Homo sapiens
cccctttgggttttttccctttattaaaatccccagcttttattaccgcccctttaaaattagattaaaatgggttgggaatttttttggtttcttaaagggtaatttcttttttgttcctttaatggcccccctttttagcctgtccttttaggtttttaatccttcctgtccttctgcctta

SEQ ID NO: 685307 - DNA, 674 bp, Homo sapiens
tacaagtttgacaagatggtgtgagctgtgcccagtcgcttgacctccggttgccctcagacagcctgtcttgtagtagtagactacttccacctcgtgcgcccaaggcaagtgtgcgataaccgtcatgggtagttatttcgctggagagccacattgtgtcgggcctgccacatcttggctcaacgtggtggcaagctctcagctagtgaaaatatcctctttgtacttaggatttccgcccgcgcagaggaactaccttgcgtatttaatatactacttttttggacaaaccaaggttctaccttgaactgtgtcgcactcaccccatctgaagaggtctcctggtccacgtaaggcccatggagggcatggacagtaggaactatattttggacgccccttatactagagtcaccaattacccctgaagtgcgcttaggttggtgtcaacactccataattgggccgaagatggcacaatgctaggtacctagtttattatcctttcattattatggggcaaagaagatatctacttcgtcgttggcgccaaggagaaaagatacatagaggaattggactacgtagttaaattatacggacgaggatgcctccctaagcgtaacacggtttgagaagacaaataaaggcctaatatggaagacctcaat

SEQ ID NO: 685308 - DNA, 208 bp, Homo sapiens
tgcccccccccccccccggggaaaaaatgcccttttcaatggggcccccccccccggtagttggaacagccccggcccggggggcacccttttccttcagcgccgggacaaaaccaagggttgtttgccccccctgttttttgtaggggatgggatggggggcttccccgtttttttcccccataaaaaaaaaaaaaaggtttgttta

SEQ ID NO: 685309 - DNA, 559 bp, Homo sapiens
aaagaatgttagctaagtcccgaaagcaactgtaacaaaacaaaaatgacaggtaggactaattaaactaaaaagtgggagatagcaagtgcaacaaaaaaaaaaaaaaatttggacaggtaggacctaattaaaaggggatttcttcagttaaaaataaattggtagaattatgggggactggttaacttttcaccacataactaaaaactatgtgtatatgcacacacatacagaaaacacacggggtggaaatttccaaaggctggattataaacccagcttttagctaaaatccaatttaggagcaattttaaaaatccgggtagtggtcagacacagatgaagtatgatgaagtctggaaactatcatctctatcctctaggtccattatccctacagggcatggtgctcgggcccacatgtaatacatgaggtctcataaaagaagcatccagggcttgatttacccaaagggagagctatctcggataatgaaagggctcggatttaatggtctggatactcacctcactggtggtctccagaggtaggggc

SEQ ID NO: 685310 - DNA, 216 bp, Homo sapiens
gcgaggatcccctcttctccgaagcacatgtatcatgggttctgaaattatttttaacgaggcatcatagggtccagtttataccatactttctagccattatttgcactattattctaagacttctgttatttcacagtagctcttatagtttgtcaaacatgtttctaattttccatcctcaattattgcttgcccccagatcatttatttagt

SEQ ID NO: 685311 - DNA, 1067 bp, Homo sapiens
gagtcgggaggtcccggcgccagaagcgcgcccgcgcccaggcgcacgtccgcaatctcgaggcctatgtccgcgaacccgctagtcgttgcgtgttcgcgcgaggcggcgacgggtcgcgaacgatccaggcagcggcagcctggacgtgcggcgggtcgatggacgccgctcactgcctagctctgtctgccaggttcggtcagcaagaactcgctgcaaggactgcgtggccaggggctgggcgccgtcggggttcacggcacttttctggatcctgagcgaaagcagagaccaagtgtctactttatagctgagtgcgtcctttccaggaggcacccatgcttggatcttccaggtcaggaagtactcgtctggtgacgtgagatgtatggatcttccagtccacatgcgtgccgtgaaaccgtcgatgctacggagacgagacgagggtgttgcgacgacgctctgacctcctccctgggatacctgctaaacagggttatgtgccccaccaatggggtcatgccatgatggaaaggcgtcagtggggtacgaccaatggattgccaggagacccctggtttgccccacttgcgcagtctagagcgtagacaacaaacggggtgaacacccgtggggacaaccattcccagttcagtacgtctgcatgggccctctacgttcgattccgaaggtaccgaaagcccgcagaacctccaccagagaatggctggagatctttcctcggggacaaacttactacgtccagttctaaaaaagtttccgtgttccctttgtaggggggctgcctgaaggttcgacagcgagaattgggaaagggaacaggacttggtcgtcccccaggggacacagaaccaggtttatcccgcacatagagcaaatttgaaggcccccgggcacctggctagggggaccagttcaagggcaggaaggcctttgcctggtgctccaacaggggggactggcccgggggcgccttggtcccgagaagggaagccgaaggagggcacaggaggctcctggaccacggcggggaacaccaa

SEQ ID NO: 685312 - DNA, 169 bp, Homo sapiens
gatcccgcaggagagctgccctcataatgatatttggcctcacgggaggacatttcctatgaatggctgttgtctattcgttgcaacgccgcgaggactattgccgcatttttcaggttttctgagcttgcagaatctgattccgttaactactatggccctcgtcccg

SEQ ID NO: 685313 - DNA, 130 bp, Homo sapiens
gggggggggggccccccccccccccctgtttgggggggggggggggcccatattttgtccccgccggggggccccctttggggttccttttgggggggcctggaaaaaaaaaaaatccctttttggggga

SEQ ID NO: 685314 - DNA, 799 bp, Homo sapiens
taacccctccttagcctttatgcgctcaaaaaccaaattaaaccccccccccatgtaacaggggggaagtgacaaacagcaaaaacgcacaaacccgagctggttgaacaacacaaagttactgcccccctgccatattactccgccctgatgggattttgtgttttaacactcatgctccctgtatcgctgtggcgctaagagataagatggtgtgagaccccctcctatgtggaggagaactgtggcacaactgtgatcgcccccctatgtgaaaagaacgactcataatggagagaagctggaaataacaggtccatgtgtatcgcgagcccgtggctatatctgtgggtgcaccacgtgtggctgtgtgtctccccccgagaaaagtctccttgaatgagtgacgatcaggtggagtgtggtttggtgacaggggtttctctccctatcgagagtgtgtttcaagtgaagtggggtttgatctctcgggtagtgtccacatacagggtaagggcgcgggactcactgtgggggattggcgcccctatggacgccgcttttagcggtcccgttgcagacaggttgagtgaatttggggcgcactaaaaccatcggtttttgttcgataacaccaacatgagtgggtgttcaccaccaatccaagatagcctttggcgcggccaaacatggtgatagtagccctgcccattctcaccggaccaacacttttattggatatgtggaataccacctatcacccccatcattatccactcactactgtgtgaaccatttt

SEQ ID NO: 685315 - DNA, 693 bp, Homo sapiens
gtagcaaaatagtgggaagatttatatggtagaggcgacaaacctaccgagcctggtgatagctggttgtccaagatagaatcttagttcaactttaaattggcccacagaaccctctattaagtccccgttgtaaatttaactgttatgtccaaatgaatggaatcagcgtctttggacatctaggaaaaaatccttgtggagagagtaaaaaatttaacacccatagtaggcctaaaagcagccaccaattaagaaagcgttcaagctcaactactccactacctaaaaaatcccaatacatatagatctgaagctcctcacactccaagttggcaccaagtctatcagccctatagaagaactaatgttagtataagtaacatgaagaacattctcctccgcataagcctgtcgtcagattaaaacggctgaactgacaattaacagcccaatatctacaatcaaccaacaaggtcaattaattacgccaaaaaaaaaacaacaacataagaaaggtagaaaaaagcaagacaaccgaaaaaagaaagcgatacagagcatcaacaacacaatacctaaaaaagatcgcgcgggggtataactgaactcctcacagcggaggggacccagtctatcagcctatagaagaatgaaaggggcctcagtaacctgaagattcatcctcggatg

SEQ ID NO: 685316 - DNA, 155 bp, Homo sapiens
gagttggcgataatgaacagcgctagtattatcttctaggcatagtagggaggatatgaggtgtgagcgatatactagtattcctagaatgctgagatggtaaatgctagtgataatatttatgtacctgaggggccagtcgaaagccccaagcg

SEQ ID NO: 685317 - DNA, 364 bp, Homo sapiens
actcttagaggatccccctgcaatccacgcatggtcagtcagtgaagagggcccgagagaacctagaagaatgagagggatatggaggagcatcaagaaatagggcatggtgcgccctagtttcaagtacagacccggtgttgtgtcgatcctcccagcttcttcttgggccttgcgggcttcacttcctactatctgtaagcattgatagcgaggtgatgtgctgagagaccatgcacagggcagaggtctgcatcaccaccaccatcaccatcaccatcaccaccatcaccatctatcgtcaccaccatcgttatcaccaccttcaccactgcctctcccgccgccttgcgtggatcgcctg

SEQ ID NO: 685318 - DNA, 294 bp, Homo sapiens
aagaccaatgcaacagaaccagaaccaagtgtaaatccacacatttacggccaacccatttttaacaaaggccccaagaacatccaatgggcaaaggacagtctcttcaataaatggtgctgggaaaaccggataaccatacgcagaagaatgaaactggacctctatctctcactatatacaaaaaaatcaaatcaagatggattacagacttaagtctaagacctgaaattatgaaactactagaataaacattgaaaaccaggtgtggtggctcatacctgtaattccagc

SEQ ID NO: 685319 - DNA, 658 bp, Homo sapiens
gaagaagagattgttgctagaaatatggatgttaaaagcaattctagtgagggctcagatggaagtgatgagaatggttgagaaagcttctataatcttagagaatatatataatcatatatatagaaagaatgttgctagcaaataggaacattaaaggtacttctggtgagaccgtagaaagaaatgaggaacatattactggaaactgagcaaaggtgattcttataaggcgtcagagaacttggctgctgtgggcaaaaagcagaattcaagttggatgtttagctgaggagatttctaagcaaaatatggagggtgcagcctagtttctccttattgcttacagtgaagtgcaagaggaaagagataaattgaggaaggaattgttaagcacaaaggaaccagtactttatgatttgggaggttcttggtttctctgttgagaaagcacactgtggagagagctccaaagctgtggctggacaacattttgcaaagagattaggtgtgtgactcatgattccaatcagccatcacagtagaagccaggaatagaggtggggttaatcaggaagtatctatggagaatgctcggctaatgagtgtatcaccctggcatacacaggagacccaaattttgggatttttccaatgg

SEQ ID NO: 685320 - DNA, 226 bp, Homo sapiens
atgttgtccaattgctttgctggtaagggagggatcgttgacctcgtctggatgtaaaggatgcgtagggatgggagggcgatgcggactaggatagatgagcgggcaggatagttcagacggtttctactttcctgacgcgtctgacactgttagtattacgttacgttcagtctgtgacgtgtacggacacaccgggacctacaaggaactaggacagcagact

SEQ ID NO: 685321 - DNA, 565 bp, Homo sapiens
gtgtctaaatgtataatgtggtactgagtgctgtggactaggaatagggaactttactatagggccggtgatggattcttgggaaaataaaatgaagggcaaatggaagcaaaagacaatataatttgcttctgttttaagggaacttttaaaaagttaattcttaacattttatcaatttacaggacttcgtcaagaacaccatcgacttaaatcatcattgagtttaaccctaacaagcatcagatctttcagtctgctgtcatgaggaaatacaagtttctttctgctttctattcatgattgtagatttgcatgagcgtgttttaggttaggctgtgttatgctgtggtaatacataccaccaacatcctcatgatttaacacaataaaaaacttctgctcacaccaagtctgcttgagggctcattggccccgtggaaactgatctccatgtccaggccagtttggtcttgtggccgtccgttttagggcagtgcttagggtcaggagagcaaaacaacaggctggagagttaagcacaggcaactaaatgcttcagcat

SEQ ID NO: 685322 - DNA, 483 bp, Homo sapiens
ggcgaagatgcaaacgattacaggcagtagacatgcaccagccgttaaggttaaaagcgcaaaacaagtgaaagcagtgtcaaatcggggaaaagtgagaataggatgcattcgtggaaggagcgcaaccaagcatgaagagcaggcaagacatttataaacaggtgcagacagcatggggacttgttcgaaagactcaagaggtagactatgaatacagactacaaacgtagatctagaaaatctgaaccagaccagatatgaaacaattgaaaaaccgttaaaggagtagtgacaagaacgaggcgaatagaaaaaacacgtaagccattaccaaaaagagacgtctagaggtaaaaataataaaaaccgctctctctctctctctctctctctctctctctctctctctctctctctctctctctctctctctctctctctctctctctctctctctctctctctctctctctctctctc

SEQ ID NO: 685323 - DNA, 406 bp, Homo sapiens
  misc_feature (187)..(187): n is a, c, g, or t
  misc_feature (348)..(348): n is a, c, g, or t
  misc_feature (354)..(354): n is a, c, g, or t
  misc_feature (365)..(365): n is a, c, g, or t
  misc_feature (387)..(387): n is a, c, g, or t
tcgagacagggtctcactctgttgcccaggctggaattcagtggcgcgatctcgactcactgcaacctcaacttcctgggtttaagcaattctcctgcctcagcctcccaagtagctgggattacaggcactcgccaccacacccggctaatttgtatatttttagtagagacggggtttcactgtnttggtcaggctggtcttaaactcctaactttgtgatctgcccacctcggcctcccaaagtgctgggattaaaggtgtgagccaccgtgcccagccgataactgaatatttttaactactgtctacaggattcatttccaactgatcaataggctagatttncttttntgattcggagntttaaactttcctggactcctntttacttatgcattccttg

SEQ ID NO: 685324 - DNA, 192 bp, Homo sapiens
taaattttttcccaacctttcaaaatatttttggtggggtttaacggctcctgggagctaaaaaccccttttttcgtttttcccccggggtgggaaaccctcccggtttagggagggatatacctcccgtaagttccccccttagggaagctcctaaataaaaaaagggggtttgccccccttggtttccca

SEQ ID NO: 685325 - DNA, 1094 bp, Homo sapiens
ggggacccggggacaagtttaccggggactatgtcgaaccagcgtcgattaccattacacttctaggaatactagtatatcggtcggacctcatgttcctccctactatgcctagaaggaataatactatcgcgttcattctagctacttctcataaccctcaacagccatccctcttagccaatatagtgcctatgcgcatactagtcttgccgcctgcgaagcagcggtgggctagccctactagtctcaatctaccaacacatatggcctagactacgtacataactaaagctactccaatgctaaaacttaatcgtcccaacaattatattactaccactgacatgactttccaaaaaacacgtaatttgaatcaagcagcaacccacccacagcctaattattagcatcatccctctactatattttaaccaaatcaaacaacaaacctatttagctgttgccccaaacttttctccgaaccccgcataaacaaaaccgccctgcgtaaataataaaactacctgacttcccggaccctcacgcaatacctgggccagccgaagcgccgacgtatatccagtggaagccccgtatcgaggaagagaaaactctacacgcgtcgtaaagctaataatccctaaaaagtcgtccgttaataatcaccatcacaagacgacaggaaaacacactatatagacaatccgtgtacgtcgaacaccacgcgaataatacgcacagctggagggataattcacaccgaggaggacaacaggcacggaaaagcgatgaaggaggagcaatacagacaagctaaaaccgtaagaaggacaccataaccatactacacgaggatacttaaacgacagaaaactaagtcaggaaaattataagaccaagctgcaaaacatacagaccaggccaaaataatgacgagaaagagaaaaagaagaagtaacggagcaaggaccaagcaagcaagcaacgagacacgacgagaacaaacagaagaaccgaacaaacacgagaggcgagacgagaacagaaactaccaaaatataaagggaacaaaagcacagagaagagaaaaa

SEQ ID NO: 685326 - DNA, 244 bp, Homo sapiens
  misc_feature (28)..(28): n is a, c, g, or t
ttccatcagcaatatatgagggtccaantgtttttttttaatgcatcctctctaacacttgtataacctgtgttcttaataacagccatcctgttgggccccattcaactcttagatcacatgtacctgtgtttaatcattgtgacttctgtgtcctggcctttaataaaagtgatcctggtctgactggctgccttctgtaattggctcattgccatgctcatgttcactcatcttggtattc

SEQ ID NO: 685327 - DNA, 211 bp, Homo sapiens
accgttcgtacgggaataaagcccaaatagaaaagcgggcatgaagatggatagtgatatttgaacaactatgtgaatgtacttaatgccatagaactatatactttaaaatagttaaaatggccaattttattatatgtatattttaacacacacacacaaaatgtttaggcctggcatgtttggcgcatgtcacgtactcccacgcact

SEQ ID NO: 685328 - DNA, 429 bp, Homo sapiens
agcgggaactcctctcgcatccctttcttttttttcgcaagacacgtagacatacaggctagctggggtttcccttttacttacttctggttcttcccacttgcatttaacatcctaagccattcttaaatctttctgtacaactccattgcatattcatattttacgaataacaaattacactatttttgttttacttagttaacaaacacacttcaaacttacataactcatctcattcttgcctcattccacttttgcccacctcccaccgaaacacggccatactgctctttccttctcgtacccttcaaataactgcttttcccttcccttccccttccaatattttctcccaagagctgcgttttttacaaatcctcgaccggccctcctttttccgtccaccaccccatcatccgttgcccc

SEQ ID NO: 685329 - DNA, 101 bp, Homo sapiens
tgtcatacgtacgatcagtttcatgaaggagctcatgcagtggtacaaggaccagaagaaactgcaccggaaatgtgctaccagattctggtacaggtcaa

SEQ ID NO: 685330 - DNA, 173 bp, Homo sapiens
  misc_feature (115)..(115): n is a, c, g, or t
  misc_feature (131)..(131): n is a, c, g, or t
aagacgacaacggtgacggaaacactggtgggatttctgatgtacaggaagcaggagagcactgttccagagctcaaggaggtgtcattgttgatctgtgtctggacgaatttcntttttaaaactccacncttattgacgatgtaattaatactgccttgtaacgtcatcca

SEQ ID NO: 685331 - DNA, 169 bp, Homo sapiens
acttgtaccggtcagccagctggtcaggcgagctgtacctgctggggtcctcgggagcatttgaagtccaggtcatacttcccagacctgaagaactcggaggccgcatacgtccattgccgcataccacctttatcagctgtagccagcatttcccaagtagtcagtc

SEQ ID NO: 685332 - DNA, 560 bp, Homo sapiens
aatgcaggcactcaggttcgagtgactgtgtttccctcaaagactgtagctcagttattcgggagtaccttggcggatcatcctagtggctattctcgctgggatctggatgcttgctttattacgcgtttagtactatggaagtgtggattctttaaacgctctaggtacgatgacagtgttccccgataccagtgctgtaagggatcccggaaagaagagcgagagatcaaagatgaaacagtgatattgataagccttgaaaaaaaaacagtgggatcacaaagtgggaacgaaaattgaaagctacgtcatagcgggggcctaaaaagaaaaaagcttcagcaggtacccaaacggctttttgccaactcagaaattcgaattggatttaaaagccggcttcaatcccctgaggactggatttcagagtggactacacgacaggtacggaacctacaggttttaactggtgggatactggttacggtagcctaagggctccgtgtttgtgcacagggcaaagtttaaaacctggtgggaactggattttccgttta

SEQ ID NO: 685333 - DNA, 425 bp, Homo sapiens
gttgtttactggattagaccatatcatagatgtcgatatgttgccggggctaatctctgtgcaactctacatgcagctagctgaactgatgtcagacctttgtctgcttattgatgaacatgaccatagtccctcagcgttgacgccgcatactatgacgcagaccgagccccttgtgaggcgatgattgattagagcatcatgaggatgaggatcgaatatcgcagataatgttgtgctacatcgtagagcagatcctaagattactatctgcttgatagtcgaatccgtattgacctcatcgattaaggagaggtgatgagcttaacgatgccgaccgccattagcctgcggctagctcatcctagacatttgacatgctatctaggagacctacttgggagatgatcactgagacgcttctt

SEQ ID NO: 685334 - DNA, 870 bp, Homo sapiens
  misc_feature (444)..(444): n is a, c, g, or t
gtaaactcaactgtattggtcacggtcagcccattcaatgacaagggtgtctgtctggcttcaccttcaggctattttagtgtgcagctataggaggcagaggaaacgtgggtggtgtagtttctaaaacacgctgacttgctgattgataattcagggttattagtgtaacaaagcgtagtggaaactcctactcctgctgcaccatacagttacagaccctaccatactcttggtctcatttaaggaaccattaacaccttcactgctgaaaagaggatttataagcataagtcatccacctctaaatattttaacatttaaaatgcctgattcaaaagatacagttttgttgtttttaactagttaaaaataaatcctaagaaaatatatttaaatattgcaaatgccacttctaaaccaaaatacctgagaatatttttngtctttttaataacgattttaccattcattttatttaaaaacatttctcagcatagcagggcactgtatggtctctgatgcactactcaaccctctagttgtagtagagggagccacagacagtacataaatgcattgggcagagctatattccagtgaaactttatttaccaccataggcatgggatttggcccatgggttgtagtttgccaatccctgacacagaccaacatagactgggggctggatgaaaaacaaataacgatgtgtcatttctttctttaacataaaataaattcaatatggctcacctgatttttggaagtggcgaatgtttaatgccaacgttctcccaagtttttattttacttcgatttaaattcggcctaaaggcgtgacctgaggaaaattatataggttctccc

SEQ ID NO: 685335 - DNA, 280 bp, Homo sapiens
  misc_feature (28)..(28): n is a, c, g, or t
  misc_feature (125)..(125): n is a, c, g, or t
gttgcagtgagccaagatcgtgccagtnaactccagcctggcggcagagcaagactctgtctaaaaataaagtaaaataaaataaattaacagtgcatttaaaaataactaagaggataattggntttttgtaacacaaaggataaatgcttgaggtgatgggtacctcatttaccctgatgtgattattatgcattgtattcctgtatcaaaatatcttatgcaccccataagcatatacactatgtacccaagaaagttaaaaatttaaaattaaagg

SEQ ID NO: 685336 - DNA, 901 bp, Homo sapiens
ggcgcttctctctggcccgagccagtatgatccgctgggcccccagcgcatctcctggaagagcccactcaccctggacgagctcttcggtacgcctcagaccgtccttgaagagcgatgactgagacattactgggccacgcgctgtgtgtcgtgctctctggggcaactgtcatcattgacaataatgcgctacctcttcatccaggaaactgggggagggtgggttcaggttatgtggacctaatggaagggttacatgatggacacttctacgccctgaagctgaatcctgtgtcgctagcagcaggaccgaggaggaggcccgatcgatgaagcctgatcatgtcatcgcgctcttctaatcacacccaacatctcttcagcgcatcgctggcttactgtctgagggaacggggtgctaatgcatgaggcctggactgctgctaccattacttcatacgtagcacttgacatggcccaccaagtgatagttgctctcggaggatgagggcgcagcgcacgcttatttaattaggcatcattgggggattcccagttgacatttcagacgtcgactcgcgattaccattgtagcgcagagagctccacgtctcaatggcacttctgaagaccctgccaaggcatcgtgggcgcacgctctcaagccgtgtagctagccagtactctcgtaaccgtagaccacctagaggcgactttctgctgttgcagaagtcaactgtgttcatcgaatgaagcggacgtgattgtctaggtccctaaggcttgcgttgctatatgccatgactgttgggggaaggcccttatgacatggttgttccaaaagggtgacagtgtgggccttgctgtgcagaaaacaactcagcatccacaaaagcca

SEQ ID NO: 685337 - DNA, 196 bp, Homo sapiens
  misc_feature (150)..(150): n is a, c, g, or t
cccccaagcagttaatacagactcaacgacgataaataatgtacactgacacagatattatgcttttcagtctgctgagggtccaggcagcttacagactcccaggagagtgccataaacagttgcaacctggggctgtactcgctggcncttccggggcttttattcacgcacacgttaacatgacaaacagttt

SEQ ID NO: 685338 - DNA, 397 bp, Homo sapiens
tgctacaagtattcttgtacaagctatgctgcctactgattttagaccttgggcaagttactctttgttctggtcttgtttccctcatttataaaatgaagtgattggaatagagcatttattatgtgtcttttgattctaatactatgattcttgacagtatggaagctctgctggagttgatgtaactggttaattgggtcatccaagaagaagatgttcacacagtatcagatatgcaagagatttattagaggaagatttctgatggtaaatgagggagggaagctggggaggctgagaaaactattattttgtggactcatgctacatgccaactgctttatatacattatggcatataattctcacactctatatgatgatgtggtagcat

SEQ ID NO: 685339 - DNA, 180 bp, Homo sapiens
cagtggccactcagcacacacacgagagtacagcacacaaacgcacagcacacgcacatcatcacacacagcacactgcacacagtcacacacacaaagacacagcacacacattcacacacggcacacacacgcgaacacatgcacacactgaacacagtcacacacatgcacactaca

SEQ ID NO: 685340 - DNA, 172 bp, Homo sapiens
aagtatcttggaccatgaggcaatgtgctactatggcaaaacagccatataggagaagctgcttgacaacttgtggagctgctataccagtcctgaaatgtctacctctgaacttgaaacaaacaaatttctgggctgggtgcagtggttcatgcctgtaatcccagctact

SEQ ID NO: 685341 - DNA, 103 bp, Homo sapiens
catggatttgctggtgcagtacaactaggcttaatagggacatgagatttgggctgggacacagatccaacccatattggaaatgtaaatgcctttcaaaaaa

SEQ ID NO: 685342 - DNA, 317 bp, Homo sapiens
  misc_feature (19)..(19): n is a, c, g, or t
  misc_feature (110)..(110): n is a, c, g, or t
  misc_feature (129)..(131): n is a, c, g, or t
  misc_feature (134)..(136): n is a, c, g, or t
  misc_feature (138)..(138): n is a, c, g, or t
  misc_feature (151)..(151): n is a, c, g, or t
  misc_feature (153)..(153): n is a, c, g, or t
  misc_feature (164)..(164): n is a, c, g, or t
  misc_feature (169)..(169): n is a, c, g, or t
  misc_feature (185)..(186): n is a, c, g, or t
  misc_feature (198)..(198): n is a, c, g, or t
  misc_feature (202)..(202): n is a, c, g, or t
  misc_feature (225)..(225): n is a, c, g, or t
  misc_feature (229)..(229): n is a, c, g, or t
  misc_feature (317)..(317): n is a, c, g, or t
gtcagaaatcccccagtgnaacttaagacaaacagagagaagtcaccttcctcttaggaccctccctgggttagcagaaggaaagaacccagaagccttcagtaccacancccgcttcggcatctcccnnnccnnncnccgcacccccagncnttctccctgcnggganggagtctctctaaaanntggatatttccngganaaaagtatgaatttggggtttantttntggtatgaggtgggtgaatacagggagtaagaatttattttgattagagatggagaagggtggaaggaggggggagggggtttggggn

SEQ ID NO: 685343 - DNA, 464 bp, Homo sapiens
tgttgttgttgttgttttagatggagtctcgctctgtcgcccaacaaagatcaaaagagacaaagaaggggaatatattatggtaaagggttcaatgcaacaagaagagctaaaataaatatatatgccaccaatacaggagcatcccgattcataaagcgtgttcttagagacctacaaagacacttagactcccacacaataatagtgggaggttttaacactccattgtcaatattagacagatcaatgagacagaaaattaacaagaacattcaggacttgagctcagctttggaccaagtgcacctaatagacatctacagaactctccaccacaaatcaacagaatatacattcttctcagcaccatatagcacttattctaaaattgaccatgtaattggaagtaaaatattcctcagcaaatgcaaaagaatggaatcatgtttacgcggccgcga

SEQ ID NO: 685344 - DNA, 173 bp, Homo sapiens
gcagccacgggagtaatgattttgtacaaatcactatacgtaggacattcttacgaggaccccttcttcggctttgacggaaaatttttaaatttggaaaacccccccttacccggggggccaaaaatgggaggcccccccccttccccacatttggaggaaccccaaaaaaa

SEQ ID NO: 685345 - DNA, 276 bp, Homo sapiens
ttggaggatgatggcaagccaatgatcaaagaggccatggaagaggcagtggtagaatccatgatggtgcatagacacatctctaagactgatggtcctcatactcatagcccctccatgtcagggcttcatagtaccttcctagccatggacacggaggagggggtataggtgtgggttgtgaatgatgctccgtttcggtaccacgggaagtgccttcgtggtgctactagtgagaggattcagacctgtgttcgagccgctgtgtgctggttg

SEQ ID NO: 685346 - DNA, 397 bp, Homo sapiens
  misc_feature (64)..(64): n is a, c, g, or t
  misc_feature (70)..(70): n is a, c, g, or t
atcagactccattaggtatttaatgatactcagtaataaggctttagaaatgagtcagaatttncttttnaaacatgagccaaaacttcagttaaaagggtacctcctgaaaaataaaaaagaaaataaaaataatcaaaaccaagttttagaagacacagtcactaacgcggtatgtgtgtgtagaattcaagtgggaccaaaggtgaagctgttggctgagacggggctacccctgctgcagacactcctagtaacacttgctggagctgtaagccagtggcagatgctatcatccccactgtctccagagagggaaataggggggaaggcctgccacacccaaaggggcagacccaaggggtcgattttgtcctgtgtggccacaaccagctgg

SEQ ID NO: 685347 - DNA, 125 bp, Homo sapiens
catggatttgctggtgcagtacaactaggcttaatagggacatgagaaggatcgagacaaagagaaggaaaaggaacaggacaagaaaaggaacgagaaaaagacagatccaaagagatagatga

SEQ ID NO: 685348 - DNA, 1323 bp, Homo sapiens
agcggacctatcatggttgaccccgacctgcgctacccctcggtcctcgatcgaggactactacaattatccgtgaatgtcgatgccctccgacacctgctagcacagtccagaatgagtcttactcatgtaacatacctgtagactgtcaatcagctgttctgtgtgtataccattgtgaggtcgttgtagccgagagcactcatgctagcaatgatgagatccctgcgccttaactattgtctgctaagcgcctcgtgagttactcttgtgcgtgatgaattcttctcgaccgtgagacttatgtcaacaaccagaccattttacagtgatcgcctcctttaggacctgaacgcttatctatatatggttgactcttaccgcatggttcggaaggcctcttgactagtcggcatgtgcgtatgggacgaattgatactcgcaatgtcctagtactgagtgcgttgcacatggctctttcactgaagttgtactttcacgtaacgaagtgatttaaactataggcgtttgtagcacattgttgcctatacatcgaataacatattcctgagaaggagcacggatttacccagccataaatctcgggagctcagagcgtagtgcccgcttcatgctaagtgcgcgatagattcgtttgcccaggcttcgagggggataaccgtgtggaataggaatatctttatccttactgggtaagttgacttgctggctaagtatttaggactggccagggtatagccgcatttgtgaggccccgagcatggcccatttgaagggccctggtcttctatactagttggcgcccaaacctacatactgctggtcaatacctgggagggaccaatgaagcgtcccagcggtggtaatatgtcggcctaagaaatctgtggggacaaccccatgtgaaagaaagcctcacccttttactaataccgatcctatgcaccgaaattctgatgcccaatccataatcggtcgttggggacctcatgtgcatgtgcgagaccaaactatgaaatattccgccatgaagccgcacagtgtttgtagccagcggtccaaataccgtcggttgagaaacgggagagtatacaagcctttgacccacacgggctcaaaatttccaggacatcgatgtaattccattgcctgaacataccaaggctcttcgcaacagggaaacccacctcgtgaagccaaggaaaccactattgatgtccgaatgcatggacacataagtggacaatatattagcgatagaaagttatgtcgcatagtgttcacccgcgtgtttatatggca

SEQ ID NO: 685349 - DNA, 118 bp, Homo sapiens
catggatttgctggtgcagtacaactaggcttaatagggacatgagaattctaataaaattcaatagatagctaaatcaagaggtaagtaggaagagattaagaaggccaaattagaa

SEQ ID NO: 685350 - DNA, 116 bp, Homo sapiens
catggatttgctggtgcagtacaactaggcttaatagggacatgagaacgaaagagttgtgtttaaatcacaaaaagagctgaaattcagggaaagatggaagatcttccagaaca

SEQ ID NO: 685351 - DNA, 731 bp, Homo sapiens
ctagttggcagacgggcccctggaacgcaccatcccaccagccccggcttgcttgtctggcctcacgtgtctcagattttctaagaaccaaaaaaaaaaaaaaaaaaaaaaaaaaaaaaaaaaaaaaaaaggggggcccctaaaatttccccggggggccccatgtacccatttttttaaaagggggccccttggactttatgccctgaggaacggggcgccgctgtttcaaacaacgtctccgtctcgggaacaaccttgctcaactgtggggaaatcttggggaaaagaaaccctatattggtgggggtgggaacactaattggggaccaaccttacccctgaacgagtttttaaagcctcttcttgaagataaatatttttacacacttccaagcgtgttataatcgttgttaaaccccaccggcgcattattgccttggcggcctgggaaaaatttctggcctacgcgagatttttgctttttactgaacaacattttttaaccccgagaggacttgcttgtaaataagagctcggtaagttcctcacaactgcattcaatcagctctgcagcatcctgcctcacactgacccataattagctactactcactactatcgatacaagcataacgctgatctgaatacgcttgtctgactctctcattcatcctccaacagcttcatatcctagtgtgattgatagcgcttcaccggatacctctcaa

SEQ ID NO: 685352 - DNA, 1073 bp, Homo sapiens
ctaattcgtgggcacatgttatccttattgtatttatcctcgtgccatggttgtcccattttccaagcgcccctgtacttgtccttggtggggtctcgattttttctagaatcctcgggacggttcactttttttcttgaacaaggcacaatcgatatgcacgggatggaaaaggataaagcacactttgcatttgagaaaattgagctgtgcaaataacttgcaatggttcaggaataaaccgtgtaaagatttttgtgaaaaatgggctttctaggtgtatgctgcatttaaatcctagtgctactataaaatgtagctattgaacttgtacatgtgagctctcttttcttgtatacgactttgttgcccggtcagctttaaactaccttagaacacattgagtcttactcttgtctgtaagtccactgtgtaaaataccttaattcaacttgttcacgtgtaaaatagtacaattacgtcactgcgttagcgatacataacattagtaacgcaaccttgattactacttttcacttctctctactatagtacttcagttttccgtaccctactagttacacaacagaaaggtaatagcacaaagactcttaagctaaattttggccagtcctaggtctttaaattgcaatagttcctggtagttacttctacaatgccagaagtttttttcgagtaattcgtagctcttgcaataaaattagtgaacgttcttcttagctgtaattggtgaccaatgtcaccataatgaatcgactatctgagacaagtgttaacagatacacgctacggatctctcgtgacgcactgctgactcgcaaggaccttaagactagttcagtataccatgtagtcgtttttttcattgctgctgactaactataacgcatcgatcttgcttaatgcatttttgatgggaagaaaaggtacatgtttacaagaggtcttaagaaaagaataaaaattgacttcttgcttgtacatataggagcaatactattatattatgtagtccgataacactacttaataactacggggtctcttggttg

SEQ ID NO: 685353 - DNA, 354 bp, Homo sapiens
  misc_feature (166)..(166): n is a, c, g, or t
  misc_feature (168)..(168): n is a, c, g, or t
  misc_feature (237)..(237): n is a, c, g, or t
  misc_feature (243)..(243): n is a, c, g, or t
cttaagggaaataaggggagttccccagtaggaagctaaagatgagcgaagtatgaaactcttaaaactcgagaactggttgaatttgccacctgacgtgatagccacactgtgtatggacaacatgatccagatggcttactcttcacagaggaggctccatctnanccaaaacaaatcatcggagcatacagagtgactcagaggcaaagggtgctgttgtcacaagcactgtgngtggcntgcaggtctctgctgcacttcgccatttttctataggtttggtctaccctagggtaaactccacactctctgacagtgagagacgagacacggagcatcccttgttattca

SEQ ID NO: 685354 - DNA, 108 bp, Homo sapiens
catggatttgctggtgcagtacaactaggcttaatagggacatgagaaagctatggtgaaaagtataaacatcagaaaatgtcatatctaggtatttacagcaaaaaa

SEQ ID NO: 685355 - DNA, 157 bp, Homo sapiens
gcccccggagccaagttactcacgggagcggagagaaaccatggagggaaaagggggctggaggcagcgctggctcactaaccgcgccctcgcgcgtgcctgcactgcgcttaaaccggcgaccggcgcggcagctgctcggctccactgcggcccc

SEQ ID NO: 685356 - DNA, 362 bp, Homo sapiens
catggatttgctggtgcagtacaactaggcttaatagggacatgagaaaacttcagttaaaagggtacctcctgaaaaataaaaaagaaaataaaaataatcaaaaccaagttttagaagacacagtcactaacgcggtatgtgtgtgtagaattcaagtgggaccaaaggtgaagctgttggctgagacggggctacccctgctgcagacactcctagtaacacttgctggagctgtaagccagtggcagatgctatcatccccactgtctccagagagggaaataggggggaaggcctgccacacccaaaggggcagacccaaggggtcgattttgtcctgtgtggccacaaccagctgg

SEQ ID NO: 685357 - DNA, 1118 bp, Homo sapiens
  misc_feature (717)..(717): n is a, c, g, or t
ctgtaatatttttgtaaaaaaaaaaaaaaaaaggaaaaaaaaagaccagctaaaattttcgacttgactttattaacttaactcatgaattaattaaagcaaatgaaaagatttaaacagctgctgacttttccctcggagcatatttgtacgcttttaggaaaggctgatgatggctataaagttggctcattaagaaaaaaagaccaagcgctagatttccgacagcagagcttgctattgcgacaataacaagtgatcaccgtgttcgtttatgtgactctcccactgaaccttgcagacattatttttataccacattgctaaggaagcccactcatctaactctgtagcccgtggaaacccttctttggcccctgatatgttgttcccaggttataggatctgggtccattagtgggattttggacagcaagtgcctctgatgagttttagccaacattccccgttgcatcctgctcattggttcacactcctctgacttgaggaaagctgccttcaccttgatcttgtaacctggtcttccttgcatataacggtagcacattccagatcacttcggtgagaaaagacctctgtttccgacgaggcaaactttcttacaattggtccacaatcaacactttaaaaaacttaaaaactctattccaacacttgacaaaccttaaaattcatggcatacctttttgtgcgccnctgaagtttggaaaagccttgacctaaaatgccttaacctctcaccacaccactacgcttattgtgggtataccccagtttttttattagaccttgtcaacgatgccatttataccgcgtattaacatgagaacaacttttctcaaaattggggtgggaacgatctgtcccgttacgagttgtttacaagcttccttaaagtgttgctcacgcctaatatgatcaatctctatgtgggcgtaaaagtaccagactatggggaaacatataatgatatagcagaacacttcacaagatgggagtagagaatatacagggatgacagtcatatcttcgcgtgttgtacactctccgtttcctatcttctcatcccctcctacatgggaaggggagggagggtc

SEQ ID NO: 685358 - DNA, 147 bp, Homo sapiens
atcgaacccgcagagctatatcatacacgaacgcctgagccctatctattacactcatcgctacctccctggacaagcgcctatagcgacacgaataagttcattctcaccctaacaggtcaacctctgcttccccaccacatacta

SEQ ID NO: 685359 - DNA, 1358 bp, Homo sapiens
  misc_feature (318)..(318): n is a, c, g, or t
  misc_feature (462)..(462): n is a, c, g, or t
gattccggatctccgtgtggtctcagactgccgtgcctacattcgatattgtaccatgtacactcgggggtgacccaggaaggaccaggtcaacacccgtcagatgacacgaatctttcgccttgcttctactagaccaagggttcccggtctcgctagagacgcgactcgacgataacttaccattgtctaggacgcatgcgacttgtcgcgaagcgctgcacttggcacggtcaccagcaaagacagcgcctcaggatatggcttgggcttcccttggtgacgagagctagcctgcaactacatctctgactgcgngcgaaacgtggaggaacagctttcgtggggcgtcgctaggcggaggtagacggcgtagagaaggtcgtagtgcaagggcagtggatgccttgtagtggtaaaacaactcggcgaggggcgacctgggctagcgtacgcgtaccnttctcggcaggacctccataggtcattgaccgaggattggcacaatcgaaatctcagaacggagcggtcaagccattgacccgacttgtgagagacaacggccgacgtttgtgatgttccctctgggacactcccattggcaatagagaatgggtccgacgactgggaccccggacctgtgagggagctttaacacaccagagggcggctctgagaacagtctgggggacgtgtatcttgcgcgcgttgggtacaacgggctggaaaaggtaccgacttgcttggaaatccaataccatatccgtcggtcctaggttgcactattccactttacttatttggaaattggaagcgaaggaaaattctccagggacgaaagccctcgaactacgctgtctccataggacctccttaccagtgaaatttacccagttccatcgactgcgctgtggtgtaaggtcccaggtcgaggatcccataaacaaagggccggaattgcgccctgtccggagcgagttggggactgagggcggcactccaaaatttgcttttgaacaggggcacctctgtcgtcggcaaacaaggttgtccacattgggaacttacatttggacctaaattcacgggggaggcggcgccaggtgcggttccttagaatataggcaatcgaaggattaggaccccacaatggctaaacagggagagacacttcgaataaagatcaataaggacaggggggacaggtgcaatgaaccagtgtgcaagttccccactggtgaccaccggtttgtcgacccaatgcccatgcaagcggaaggtgacattggtaccacccatatagaggacgggtggtacttacacatacccaagagacatggtggtacaagacacttcct

SEQ ID NO: 685360 - DNA, 770 bp, Homo sapiens
  misc_feature (2)..(2): n is a, c, g, or t
  misc_feature (71)..(71): n is a, c, g, or t
  misc_feature (74)..(74): n is a, c, g, or t
  misc_feature (100)..(100): n is a, c, g, or t
  misc_feature (160)..(160): n is a, c, g, or t
  misc_feature (162)..(162): n is a, c, g, or t
  misc_feature (172)..(172): n is a, c, g, or t
  misc_feature (178)..(178): n is a, c, g, or t
  misc_feature (185)..(185): n is a, c, g, or t
  misc_feature (211)..(211): n is a, c, g, or t
  misc_feature (229)..(229): n is a, c, g, or t
  misc_feature (236)..(236): n is a, c, g, or t
  misc_feature (254)..(254): n is a, c, g, or t
  misc_feature (260)..(260): n is a, c, g, or t
  misc_feature (268)..(268): n is a, c, g, or t
  misc_feature (292)..(292): n is a, c, g, or t
  misc_feature (362)..(362): n is a, c, g, or t
  misc_feature (371)..(371): n is a, c, g, or t
  misc_feature (375)..(375): n is a, c, g, or t
  misc_feature (381)..(381): n is a, c, g, or t
  misc_feature (395)..(395): n is a, c, g, or t
  misc_feature (422)..(422): n is a, c, g, or t
  misc_feature (427)..(427): n is a, c, g, or t
  misc_feature (446)..(446): n is a, c, g, or t
  misc_feature (561)..(561): n is a, c, g, or t
  misc_feature (620)..(620): n is a, c, g, or t
  misc_feature (638)..(638): n is a, c, g, or t
  misc_feature (695)..(695): n is a, c, g, or t
  misc_feature (698)..(698): n is a, c, g, or t
  misc_feature (701)..(701): n is a, c, g, or t
  misc_feature (747)..(747): n is a, c, g, or t
tnttcatcttccaatggcggcctcatccttgaggcgtatcctctggcgagagatgcctttctcacgcgccnccncgctccctgactgggctaagatagtncagattgatcttaggtcaatggtaagacctatgttgttcatgaagtcttggcttttcggngntgggtcgccnaaagcngagtggngagggatagagtggtggctcccagantcccggagaacataagcngtgagancgagccctggcgcatacncttgtntccatggnaaccatcagcacaaacacactgcnaaagacctggaccatcaggtacacaagatccattctcaggacacatttctgggtccccagtgttattgcnaaggttctnttgnccttgngagagttggttgtntatgtgagaggtgatagtgttccaggnattgnttcctccggggcagtgganatgttgtggcagtgtcagagtgtggggctgggtgaagccacggaaggtgttggccaagtcacctttgggggggtttgcttgcgggtctatgatggcagtggtatgtgcctggtgngagtgtggaccagggtgctccagagaacagtgctggagatccagctccaagatggtgcncttctgattcaggcagcnacgggcatgcagcattagctctcgtgtcgttttacaataaaaggccactcttgacanatnttngcacgctccctggacattgggtgcatatctcgggttagcgccaganccctttccacgcccagagcgagg

SEQ ID NO: 685361 - DNA, 748 bp, Homo sapiens
gcaatgaccctaggagacgcctatgagtatgggtggacgtgagagacttctgacctgaagagcatcatttgtcaccacctccaacaaccacatcgaggtgcgggctgagaagctggcggttgacggcagctgtggcgatgaacacgcttcgctcacaagtgccatgctgccggaggacgtggagcccgacgtcggtgaccctcggtctctgcggggaggactggcaggctcacatatactccggggcacgtggtcgacccgcatacagaacacgtcccagctagactcttccggacggagatcaaaatctagagtgcctctcgccttcccgttgtcccgtgtccccccgccaccaggccttgccagccaaagcctcgctaatcgcattacaacagctccaggacgatctcagcccaggttctagcccccacgcatccgcgagagccctaggtggaccgatcctccccaaactaggggcctcctactcatatccaggcaggccaggactccctggcctgacacatgatgcccagatatcacgattatgggctccggcagcttaatgccagagtacaggggctggggtcagggaaggaagcatctagagaaccactgtggggcagggaaatgggagcagcgaggacgtatgcggcaagctactgaggacagacagacgagacagacccctctgatctatgaaagtctctcgagcgccattgggaccagggactggaaccgccttggccaa

SEQ ID NO: 685362 - DNA, 269 bp, Homo sapiens
aacaggcttttattaaaaaacagaaacgaaactttagacagatatgacaaatcgcagcggaggacacgaggtcatttcagtatgagatcggatatttcgtaaaactagtgcacgtgtgctaatatcatcactctagttgtgcgcatagtcgcgtgagcaccgggggtactatgctctaaactgagcttcaaatctcagcttatgatcctgtcgggacagtgtcaattcatgcacattgcgagcgagtcattctccttcaatctaatata

SEQ ID NO: 685363 - DNA, 206 bp, Homo sapiens
  misc_feature (123)..(123): n is a, c, g, or t
gggtagggctgtgtggcgcaaaaaatccctgggtttcccccgggggatttatccgaatggcgttcgaaaaagcatttgggggggttcaggcaagtgctcaatggcctatagccaacacaaggntagagattagcggctgagaaggggaagggaggagagaggagaagagaacggaagagacgcgagaaggaggatcaaaggagggc

SEQ ID NO: 685364 - DNA, 254 bp, Homo sapiens
cagatgtggctccacagttgcccataagcgatctgagtataatcatttgctggaatttcgccagatatatatactccttgctagtctaatgagttaaatctaagatggtggctgtgaccctacgagcagcttgacgtgcgtgtgtgatgctcttgtccagcctttatggccagacagcccatttgcagcttgcagtgaaacactgaaaaaacaaagcaggccaggcgcggaggctcacgcctgtgatcccagca

SEQ ID NO: 685365 - DNA, 1310 bp, Homo sapiens
  misc_feature (238)..(238): n is a, c, g, or t
  misc_feature (276)..(276): n is a, c, g, or t
  misc_feature (507)..(507): n is a, c, g, or t
  misc_feature (642)..(642): n is a, c, g, or t
  misc_feature (818)..(818): n is a, c, g, or t
  misc_feature (982)..(982): n is a, c, g, or t
tatcattcgagatataaagttctggacggagttgcggctggtccactgccatgatggtccgctagactattgggtaacgttgattgggtctgagatcgatggctggcgtgaagaatggttgtacacagctgctcggttcctatagctatagacacagtgcacaaatacatttacacgcggcgactagtggctcgtgttcgctgcagctcatggaagctcgcctacgtatagcatacgngggaaggcctgcaagctatgtgagtaatcgctctgaanccccacgagatgagcatgaaggatggtgagatgaggtccattgattctgacagccagcttgacatcatccacaccatgtagggacaatgagttgagaacatcgcgatctctttacccatatcacataccggagttgattttcttgcaggaaaaagtcccccttgtttgcgcgtatcagttcttatgtcctttatgaatgtgatgtctgataactgtaacgcacaaagcctntaaggagtcgggtctctatacatgacactgtagacgagccaacatataaggggcctcaaccagtgagagttttacacccctctgtctgagcttcctcatatgaaatacataatacaaatagaggctatatatacngagccctaagcgtatgtcacatatgactaccggtgtaaaattactgcagataggtaagaaaaacgacaaaagtgctaagacgtgcaccccaaattacaccactatatttgagatgcgtctggttgcgaagggcggaattttaaaatctatacaccctatatgattagatatgccanggggaggcgaagcgcttacagaccgcggtaggggagaagagaaaatccctcaatcagggaacgggcggagcagcgcaaaaagcattgtatcgcatgtaggtataacgcaccaagcctttttgtgggctcctcgtgggcagaatagaaggggggagacctcaacncaaattacggaggggagaggcccccagagaatgaaaccttaggggagttcactggtttggggggcccgcctcgcgggagcccttgggcccgattgtggtctttaggccccacccgtgtggtctgcttgtcccctgttgggggggagttcatcccgtggggacaccaccctggtggggggggacagccgtggtcgggaaagcgggaggggtgggtccgctgtgcccatttccttcggccagggcgtgtggctgacacggcgtaaaacgtgtttcgcgccccgtaggggcgtattcccccgtttggtggtctcacgcacttttttgtaca

SEQ ID NO: 685366 - DNA, 177 bp, Homo sapiens
gcatctcttatcatatcttctgctcatccaataagcatgctgttgccctactgtgatagattttccaaacaaaaataccgtgagacagcatatttagtaaaatatgccttcagtggcattcaacaaagtggagtttcccctagcacagttctgtaagactgtgcgtgtgagacgtgt

SEQ ID NO: 685367 - DNA, 368 bp, Homo sapiens
  misc_feature (271)..(271): n is a, c, g, or t
  misc_feature (325)..(325): n is a, c, g, or t
  misc_feature (328)..(328): n is a, c, g, or t
  misc_feature (331)..(332): n is a, c, g, or t
  misc_feature (343)..(343): n is a, c, g, or t
  misc_feature (348)..(348): n is a, c, g, or t
acacatattacaagagcaggctactaggaactaactgaattcacaaagaaacagtgtttcagttcgttaaaacgttgctctatcttgaataacaagcttattacatgcgaatcctattgggaacctattcaattcaccatgatacgtggattctgttccttaaaatgttgctcgatattgaaaagcaaactcatacaagcatgtcccattgggaactcattgaattcgcctagaaattttgattccattcgtgaaaatttttctatatccngaacagtccacttattactactgcggcctattgggaactaaccgaattcaccanttnctnnattcggctcancaaanttttataaatctttaaaggt

SEQ ID NO: 685368 - DNA, 397 bp, Homo sapiens
ctctggatgcaaagtgtcagatcaagatttggtaacttctgtggcctctctccttggctgcagatggctgccttcttcctgggtcttcacatggcctttctctgtgtacatataaccttggtgtttcttttatgtgtgtcctaataacactttataataaggacaccaaccacgcagattagattagggaccaccctaatgacctcgttttaacttaatcacctctttaaagaggctgtctatctccaaatacagtacagttctgtggtcctggggggttagggcttcaacatataaattgtgtaagaggtggcacaactcagcccacaacatcttgtcaccttgctcccttcatgccttgctgcctccctttttggtttctttggtgtcttgtttt

SEQ ID NO: 685369 - DNA, 416 bp, Homo sapiens
cacgaaagtaccccaagtgtgaactccaactcttgtggagggctcaagaaacctatgaaaagtgggcagcaaatgtgtgtgaacattctgaagcaaaaagaatgcgcctgtgcagaagacatatctatatcgcggtcctgaaccacgtatgtgtggtgcatgagcgccagtaagtgaaagagtcaccaaatgctgcgacagaatccttggtgaacaggcgacacatgcttttcaactctggaagtcgatgaaacatacggtcccaaagagattaatgcgtgaaacattcacctttcatgcagatatatgcacactctttgagaaggagagacacaatcaagaaacaaactggacttggtgagcttgtgaaacacaagcccaaggcgacctgcggctgaccatgagaccccgtttgg

SEQ ID NO: 685370 - DNA, 371 bp, Homo sapiens
  misc_feature (21)..(21): n is a, c, g, or t
  misc_feature (35)..(35): n is a, c, g, or t
  misc_feature (48)..(49): n is a, c, g, or t
ccagccaagtcccatcattgnctatacaaatgaantatagttaggggnngaaaagcagatgcatgggttagctgaggtttcatggggccacagggcacaatggttcattcaataattaaactaattttccccacattcaattaacaaaacaatacatggttataacatattacataccaaagttgaacagtagtcaagtaaaacatgataggattttcatagatcaaaggatccaccagtgaattacagcaaaatattctaatttccctagctgatacaaactctggcttggtcaatgagtccattatctttattttttgcagagttgtaacagagtagtgtagtaaagaaggaattaagcccagcctgag

SEQ ID NO: 685371 - DNA, 250 bp, Homo sapiens
ccccgctcagccccgcaagacgccacggttcccgtcccaccccgttgatcatcgacacggaatcgtgctgccgatggtttggatcgcaatgcgcccccttatctagagccttccccggtcatctacaggcaggatgcgcgctgggaaaaagacaactggaatttctcgaaagttgatggtccgcacggttgaggattctacgtggattctcttgggttccccctggtgtgtgttgtgtctggacgcgagg

SEQ ID NO: 685372 - DNA, 140 bp, Homo sapiens
acgtagtgcacaaaatctcaaataagtcttttatctccagtaattattactctgcttaaggcacaggacttgcaactccaggccaagcccgagtgttgtaagtacctaacactggacagggtacgactatggaagttcta

SEQ ID NO: 685373 - DNA, 239 bp, Homo sapiens
ctgtgcacctccagcaggtcgtagagggtgcggggctgggagctgaacagatgcatcagcggcgaatgcgccgccggggccgacagttgcgccacctgggagccgcggccctgtcgagtgtcgaagatgccccgcgcccgcagcagtttcaggccctcgcgcagggccgtgcgcgaaaccccgagcttggccgtcaggcgccgttccgagggcagcaactggtcggtcttgaatacccc

SEQ ID NO: 685374 - DNA, 394 bp, Homo sapiens
ctgcatcatggaaatggtctagcacctattcatgtcacttgagcatgattcttccaccacgcctctgccagagaagcatctgtattcccacaggtaaacgatcacctttagcgtcttaagtgtcaaatacgcaattctacgtgactggcaccagcaagtttcagcacgtgctcttaacgcgcagtgatgtataaaccctgcccagcgagctgtcagcacataccttcgcagagacttgcgcttctcaactccataacagaaactgtattgatactgcctaatgaaacaatagaactgtctctatacgtttttaacaatctcctagtgctgtgagcaaagccagatgcacatgatgtgtgcgagttggtagctcacaaatggtagtccattacac

SEQ ID NO: 685375 - DNA, 1011 bp, Homo sapiens
  misc_feature (455)..(455): n is a, c, g, or t
  misc_feature (1011)..(1011): n is a, c, g, or t
agcggaggcagcgcggcagcccaagggccccggcgccaggggcggcggggaaccccaaacgcaaccgggtctggagggatccccgcgccgagccagcctgccgtcacctgcctccgctgcctgcccctgcgaggcttgtgcatggcgccctggcgcgcccgcacgtgcgccctggctcgccggcttccctgcggtcccacccgtgagctcgccggcccgtcgcccgcttctgccattgcaaccagcctgtccggccttcgcggcgctgtaggcagcctcgccggtcagggcctatgccttgccccttgcttcggcccggctgcttcctttggcccgcctgctctttgcctctgctttgcctggcctcgttccagcgtgcttgtgtgcccgccgggacgtgctgccccggtggctcattccctacgcggggttggccccttcgcaagttggccgtntcagggttcgaagctgcccggttccagttccggtcggggaaacagtgaggcgcctagtttcggtctcccccggtctgtggccttttgccttcgggcccttcggtgtccgtgttactccccctgggtggcctcctcgcctcggtaagttcggtccccgggtggccccccggcagctgtacggggccctgtcgcctggggcctgctgcctcgtgcctgggctcctgccccttgtttgcgccaatgctcctgtttcagggcgctgctgtgccctatggctctgtgtcctcgggtatttggctcttgggagtgcgctctttttccggctccgtttggcgcactatcccggggttttggctcgtctactttttgtgtggcgtgctgcccctggggtgtccccctgcggtccgtgctgtggacgcgcctatttttttcccctcgatatggcgtttttgcgcccggagtaatcgccccgtttttaaccctgttgggcctctttcccagttgatgccaggttgccgcagaatgtgctccagcacacctgacggacgtgggtcan

SEQ ID NO: 685376 - DNA, 165 bp, Homo sapiens
ctctcgaggattacaggccgtagtcagtgcagtagcagggtagtgccatccccagcttcttcataagtgtaataggcaacatctatgaacaagtttagctccaatgtacttgtatatatctaatcaagtcaatagacttatgcaacagtcacaccatctaaatgt

SEQ ID NO: 685377 - DNA, 301 bp, Homo sapiens
  misc_feature (11)..(11): n is a, c, g, or t
  misc_feature (83)..(83): n is a, c, g, or t
  misc_feature (94)..(94): n is a, c, g, or t
  misc_feature (217)..(217): n is a, c, g, or t
tggaggaagtngtatcccctccatgtgttagtccagaagtgaatgaattattgatggaagcccagttgttccaggtatccttncttgaaattcnggaactttaccagactttacttgcaaagccaagccttgttcagcagattgaccgaagttcaccagtgagacccagcagtgagaagaatgactgttgccgagggaagcgagatggaattaacantcttgagagaaaactgaagagacgcctggaaagagaggcttctccagtgagcggtgggaacgagttaagaaaatgcggaccccc

SEQ ID NO: 685378 - DNA, 368 bp, Homo sapiens
aagtcaggacgagaccatcctggctaacacggtgaaacctgtctctactaaaaatacaaaaaaaaattagctaggcgtagtggttggcacctatagtcccagctactcggaaggctgaagcaggagaatggtatgaatccaggaggtggagcttgcagtgagccgagaccgtgccactgcactccagcctgggcaacacagcgagactccgtctcgaggaaaaaaaaagaaaagacgcgtgcctgcggtgaggaagctgggcgctgttttcgagttcaggtgaattagcctcaatcccccgtgttcacttggctcccatagccctcttgatggatcacgtaaactgaaaggcagcgggagcagcaaag

SEQ ID NO: 685379 - DNA, 102 bp, Homo sapiens
cgctatcatcggcacctcgctattcatcggcaccattagctctagaggtccatgcatacttatattatactataattcaatacgggtgccgataaatagcga

SEQ ID NO: 685380 - DNA, 609 bp, Homo sapiens
  misc_feature (142)..(142): n is a, c, g, or t
  misc_feature (210)..(210): n is a, c, g, or t
  misc_feature (346)..(346): n is a, c, g, or t
  misc_feature (543)..(543): n is a, c, g, or t
agaggatcccaggtctttccctcaagctgattctgtctctatttcttctctcctgatttatgtatcctggtttctgatcattccctaaatggtaaaactggtatctgaaaaattagaacataaataaaataaagttaagtcncaaatttatcttactctgtttatgtgtgaaaagatttgaagaaagctaaaacttagaaaataaactanattcaacttcccaagtattccttctcccaattctgtttgaataataatagctaacatgaattgaacgtgtgttataatcccaacgattattctaaatgattttacatatactaacttgtctaattcttacaagtcnatgagcaagacagcatttattattcccattttgtatatgaggaaactgagtcacataggagtaaactggtctaagttaaaaactgccaaactggcaaagttaggattcacatctaagtaatctggatctgagtctccattcttgcgtacacccatagacctacatatacgacaaaactctctagccatagtcttcantgagaaaccaaaattactgaacacaggtttatatacctttaccatacgtagctacatgacatatat

SEQ ID NO: 685381 - DNA, 183 bp, Homo sapiens
ccccccccccccaaaccctcccttaaggggggaaattggaaaaagcccccctttgtttttttcaaaaaagggggggggggggttttttcccttttttttttttaaaaaaaatccccaccgtttttttttttaatttaaaaaaaaattttggtaaccccccggttttttttccccgggggggga

SEQ ID NO: 685382 - DNA, 436 bp, Homo sapiens
ccgctacggacgcctaataagtggttactttaacctctccacccttatcacaacacaataacacctatgattactcctgccatcatgaccgtgggccattatatgatttatgtgcacactagcagagaccaaccgaaccggtttcgagcttgaataaggggagtccgaactagactcaggcttcaacatagaatacgccgcatgccccttctccctattcttcatagccgagtacacaaacattattctggtgtgcaccctgagcgatacaatcttcctaggaacaacatatgacgcactttgccctgaacattacacaacatattttgccaccaagacccatacttctaacctccctgctcttatgaatacgaacagaataccccctattccgttacgaccaactcatccaccttcctatgaaaaaactttctac

SEQ ID NO: 685383 - DNA, 506 bp, Homo sapiens
tctattaataaatggatcctactctctacaaacacttattacaaccccaggaacacatatgattacttctgccagcctgacccatagccataatatgatttatctcaaccctagcagaaacaaaccgggcccccttcgacctgacagaaggagaatcagaattagtatcagggtttaacgtagaatacgcagccggcccattcgcgttattctttatagcagagtacactaacattattctaataaacgccctaacaactattatcttcctaggacccctatactatatcaatttaccagaactctactcaactaacttcataatagaagctctactactatcatcaacattcctatggatccgagcatcttatccacgcttccgttacgatcaacttatacatcttctatgaaaaaactttctacccctaacactagcattatgtatgtgacatatttctttaccaatttttacagcgggagtaccaccatacatataaaaaaaa

SEQ ID NO: 685384 - DNA, 172 bp, Homo sapiens
cgactctgaggatcccgaattcggctctcttgggggtctggctgacagactggcggtctcactccatgagttttcttccattcgtgtccggccggcgcggggagcccgcttcatcgcagtgggctacgtggacgacacgcagttcgtgcggttcgacagcgacgccgcgagc

SEQ ID NO: 685385 - DNA, 353 bp, Homo sapiens
  misc_feature (243)..(243): n is a, c, g, or t
tagccagtgtgctggagcagaaaaagagtctttaacattcctagcaaacctccttggagcaagtgttcaagaatactttgttcgcaaatccaatgcaaagaaaggcatgtttgccagtactcatcttatactgaaagaacgtggtggctcctaaatatgaagcctgcaaagaagtggaatttacctgccgttactatagcttggctgttggagactgcctagaacggggaaagagagcagacngaaaggccattttctgattgaaaattcaactaaagaagaaccgaagtttgggaaaccagaaataaccaaatggaatcaatctaaattcagatactgcagagcatccctgg

SEQ ID NO: 685386 - DNA, 379 bp, Homo sapiens
ggaggcccaaggtggggtactcggagccgaaagactgatgccgactcccctcccccaggggagttggccctgcttggtcttgtatctcctcggttgctctgactcttcccgtttgtttgtgaagataaaagctggaatccttttttaagtgtcctgagaaatggagcacctccacaaagttcagttcatgtccgattggagatttatttctatatgtacagtttgtcagagaaaaaaaaaatcttatccacgcttccgttacgatcaacttatacatcttctatgaaaaaactttctacccctaacactagcattatgtatgtgacatatttctttaccaatttttacagcgggagtaccaccatacatataaaaaaaa

SEQ ID NO: 685387 - DNA, 120 bp, Homo sapiens
aggcaattgctttgccgagggcatcccggagctgccagctgtggtccctcgggagcccaggaggctgtcggccccgctgacaggcggctgtgtggctggagacgccgccgtactgtggct

SEQ ID NO: 685388 - DNA, 379 bp, Homo sapiens
cccttttttttttgggggggggggcaaggtgtccccctcccacaacaccgcatgggcccctttttttgtggggggacgcagactacaggcggagacagacctgcagctccctggttctctgtggggccacctcacctaaataacccaggtgggtcccggctctttggtagatggggagggccattcctgactgggtataaaggataattatgaaaagcagttctggctggtgggccttccagatcctctccggggctgtgttacgagccagcaggtagcctgctggttttatctgagtgaaatactgtccaggggaaaaaaagagatcttattttttttcttatacttggcgttttttgaataaaaaccttttgtctta

SEQ ID NO: 685389 - DNA, 500 bp, Homo sapiens
acttacgtacacttacattgcgctgttgccgtttgaaactcggtttcgtcccgctgtgcccatgtgagacgcatgcgtggtccgcactgtgtgccttcccccgggggggctgcagctgccggactggacggagtgtgagctctccggctacggcaagcatgaggccttgtctcctttttattcggagcggctgaaggaggctcatgtcagactgtactcatccagccgttgcacatcacaacatttacttaacagaacagtcaccgagaacatgctgtgtgctggagacactcggagcggtgggccccagggcaaatttgcacgacgcctgccaggggggattcgggaggccccctggtgtgtctgaacgatggccgcatgactttggtgggcatcatcagctggggcctgggctgtggacagaaggattcccgggtgtgtaccccaaggttaccaattacctagactggattcgtgacaacatgcgaccgtgaccagga

SEQ ID NO: 685390 - DNA, 111 bp, Homo sapiens
gtgatgggtggtgggacaagttttgtcataggaggtgtgtgagtgggtcgtagcggaatcgggggtatgctgtgtcgacattcatgagtaacagagcaggttagacagtag

SEQ ID NO: 685391 - DNA, 141 bp, Homo sapiens
catcctattctttctttctttctttctttctttctttcttcctttctttcttctttcttctttcttcctttctttctctctcttctttcccctccctccttccctcctttctccctttgtatctctccttcctctcctctc

SEQ ID NO: 685392 - DNA, 185 bp, Homo sapiens
gatctgcggtgcccgggagtagtctcttccctcggcagcggaaatactgattccgactgctcctgcctctagggtgcagtgccgtacctgctggagcctgggcctccttccccagccagcattgagaaacttgggaagaagagagaacctcaagctcccaaacagcacgttgcggttgaagaatg

SEQ ID NO: 685393 - DNA, 377 bp, Homo sapiens
  misc_feature (38)..(38): n is a, c, g, or t
  misc_feature (97)..(97): n is a, c, g, or t
  misc_feature (251)..(251): n is a, c, g, or t
  misc_feature (294)..(294): n is a, c, g, or t
ctgtcggccaggctggagtgcaatggtgccatcttggntcaccgcaacctccgcctcccgggttcaagcgattctcctgcctcagcttcctgagggnctggtattacaggcatgtgccaccacacctggctaattttgtattttgagtagggacggggtttctacatgttggtcaggcaggtcttgaacccccgacctcaggtgatctgcctgcctaggcctcccaatgtttcttcattttttaacctttnctatgagactttcaccctctccactccattggcacagctcttntcaaggtcaccaatgactttgactttcctaaatgcaatagtggattccccagtcctcatcttacttgctccatcagcagcact

SEQ ID NO: 685394 - DNA, 1165 bp, Homo sapiens
agcgggagttaggccacgataccgacaaatatactgcatgccaaaatgtcgaggtggcatgagtgatcagacgagaagggaaacgtggcaaatggtccaaggggaagcatcactcttgcacgcttcgctatggtacaagaaccgatctctccgatgatgtgtccacgtctacgattccgacaaagttgagttgccggtataggcgacctgcggagcttgtgtggtgaacattgcggtagtgcaagacccgaaagacgacgtcctatgtaagtaacgaattccggctgggaattccacttgaccctcttgttggaactaatgacgatacagaatcaatcccacgagaatataaggtggaacatagcgaactatcatgcatccagctcaaatgatgagatgcatctgcggtagaataacgtgcaagagaccatatactctgtggattctattacaacaataccttaggcaggactcgagttgtatatatacaccttgaagggacaatctccgtccaattatgtacacaccgtgttgacaatacaacatgacctgtctccatattggagtcaccccattaagagtcccgtgtacaaaggtatgagcactttccaataataaggtttgtccccgcaggtgacctgtgtctactgggtacatttaaagccatgtgccaagtttgtgcctctacggccttgggtcgtcacgtgattgcctttttctgcccgagaaggcacgaacggccattgatctggaacctcctctacaaggatctagtatgaccccagggtcgacgtagggggacactctgccgacttggttcacttcgtcagaagtcgtattacacgggggataaacggctccaggctccacaaaggcccaacaatatgcggggctactgggacccccccgagaggaatatggcctattagcaccagtagtttgtttacctacgaaatatttgccacctgtgcatatgtcccggaatgggacaacccgacggttctgtaacctttgagtaagcaacaccaagggaaatttagggtcctaagaggtcgtctatatacaaaaatcgataacctcaccgtaatcaaaggtacacatgggcactctcccaaggggcgataaactgcctgtgtggcaatgagagactaaatccgagtgttag

SEQ ID NO: 685395 - DNA, 477 bp, Homo sapiens
actactgattgacatatgatcatcagttcagaccctcactgcatacagtgatggtctagaactgatatcctatcacccggattgagggggattttattttggagaaatatagggcccccccatttttgtccccccaaatttcggaatttcaggtggcaacagacacatcggctaccggtggagactatcagtgttcccccaggggtataagggggaactcatatccaacatcacaggcttaaaccagagtttgttgcccacaatcaaggttcccggcacaaaaatgagggataatatataaaagccgtttatataataaaataatatataaaaaatacataagaggagcaaaacgaaaacgcgagtcacataccaccattattttgtaaccataacccacacaaatataatcagtcaataaaaaaaaaacacaaatatatctcgccaatataatataaatacaacacaagcaaatca

SEQ ID NO: 685396 - DNA, 365 bp, Homo sapiens
  misc_feature (105)..(105): n is a, c, g, or t
  misc_feature (356)..(356): n is a, c, g, or t
ggatttagaagtttgagtgcaaggaaggtgtttcctgcccatgcctaaacctactgccccaagattaaaagaaaaaaagtggcgggccacgtgaggtggccttanaccctgtaatccccagcagtttgggaggcccaagacaggtggatcacgaggtcaggagatcgagaccatccctggctaacgtggtgaaaccccatctatactaaaaatacaaaaaattagctgggcgtggtgcgggcgcctgtagtcccagctactcgggaggctgaggcaggagaatggcgtgaacccgggaggtggagcttgcagtgagccgatatcacgccactgcactccaccctgggcgacagagncgagactct

SEQ ID NO: 685397 - DNA, 475 bp, Homo sapiens
gtggcccttccaataaataaagattattaccatggcggcatgagagttgctttatttatttatttatttattgaggactgagttcactcttgttgcccaggctggagtgcaatggcacgatatcggctcactgcaaacttcgcctcccgggttcaagcgattctcccgcctcagcctcccgggtagctgggattacaggcacatgacaccacgccctgttaattttgtatttttagtacagacggggtttctccatgttggtcaggctggtctcgaactcctgacctcaggtgatctacccagctcagcctcccaaagtgctgggattacaggcatgagctaccgtgcctggccaaatctgcttgatttaaagagaaaattagggcctttagtttaattagatcccatttgtcaattttgtcttttgttgccattgcttttggtgtcttggacatgaagtccttgcccatgccta

SEQ ID NO: 685398 - DNA, 575 bp, Homo sapiens
cgcggtggctcacgcctgtaatcccagcactttgggaggccgaggtgggcggatcatgaggtcaggagatcgagaccatcctggctaacacggtgaaaccccatctctactaaaaatacaaaaaattagctgggcgtggtggcaggtgcctgtagtcccagctactcgggaggctgaggcaggaggatggcgtgaacctgggaggcagagtttgcagtgagccgagatagcgccgctgcagtccggcctgggtgaaagagcgagactgtctcaaaaaaaaaaaaaggaaaagaaaaaaacaaggaattaggctttttccaaaaaggttttatttttataaaaaaacacagaataggtcacggtgtggtgcgctcaagcctgtaatcccagcaacttgggaagcgctagaggagggtgtatggtcagacgctcaggagctcaaaaccagcctaggcaacatggttgaaacccgcatctctccaaaaaatacaaatttggccaggccttggtggcgcacgcttgttagtcccagccatacagggcgcttaaggtggaggatccttgagcctgggagt

SEQ ID NO: 685399 - DNA, 1437 bp, Homo sapiens
ggtaagtgagtctggggtcttccccagttttctcagccaggcggcggtggcgactggcaatgtttgtgcctcaaaagaaactgcggtaatcgtgactcaacactcatactgtgcgggtgggcctggcttggtggtgccaggaatgccggctggctgccaaccactgccctgtgtgaatgtggcgaccttctttgtgcgtaccgtgacggacacgtgacggccatctgcgacctgtgcagagcagactagggagcgacggagcgatgtgccagggacagcaggagagaacttggcagagaaggcacgccggcgcgcaaaagcacaacacaggtaccaagcaccgtcacagcgcccaaggaactcccccctgggacgcggctcagcagctgggcacacgcgccgagcacaacttgggccagaaccagaagcgctcacaccggagagccatcttcaaaccgcggacggaacacacccacaggcggaatgcgattgggcattatcatacctataccgccgggcccccaacgcacgtccctgtcagtccgtacgcgacccgtagcattatgaccatcagtcaacttgcgaaaggcccaccaggtgcaccaggcgatggaacgaacccaaatcaaacttgcggctcgcaccgcctgcacacacgatggtggaatactcttcgggctcccggcgcgctatagccagaacacccccctcgcatagtctccttacattccaggcgcacactgcccagcacgcctcggtgacttgcgcctcccttcggccacggatcagtcgtcttgggcaccctaaacggagtacagcggagacgcaaaattcactctggacaccaatcacacaccccatccaaatagacataaccagcggcaacagtaggcgcatacaaccattaagccccgcgttcagcaaacgggacagctgcagccgtccccactccaacaccacagcgccacgacaagctgcaacgttgaacaggaaaggcactaggacacccgcggagaatagtctaccgccaattgcagacaaccactatcaatactgcacacatacagaggataacaacccattcatcagctacgcaatgcactactggaccaaagctccggggaactaccacaaggtacgaacaccaacgcagaatgactcccacactgtggtgtaccacagtgacctccatgagagtgacccaacaccccagagtgcacgtcggcacacgatgcctccctcatcggtcagcacacaccatctacgaagatgcgcggagctctgagcgaaatgtgtagctgtgtaacacatgccaacacacaccgacagacatgagactatctccacacaagagaacaagtgacaatatacggcaagacacacggtggacgcacactcgacacagaaccgacacagaacaccaatgctcgacaacac

SEQ ID NO: 685400 - DNA, 465 bp, Homo sapiens
  misc_feature (5)..(5): n is a, c, g, or t
  misc_feature (179)..(179): n is a, c, g, or t
  misc_feature (182)..(182): n is a, c, g, or t
  misc_feature (184)..(184): n is a, c, g, or t
  misc_feature (187)..(189): n is a, c, g, or t
  misc_feature (191)..(191): n is a, c, g, or t
  misc_feature (207)..(207): n is a, c, g, or t
  misc_feature (236)..(236): n is a, c, g, or t
  misc_feature (239)..(239): n is a, c, g, or t
  misc_feature (246)..(246): n is a, c, g, or t
  misc_feature (251)..(251): n is a, c, g, or t
  misc_feature (261)..(261): n is a, c, g, or t
  misc_feature (266)..(266): n is a, c, g, or t
  misc_feature (271)..(271): n is a, c, g, or t
  misc_feature (274)..(274): n is a, c, g, or t
  misc_feature (278)..(278): n is a, c, g, or t
  misc_feature (286)..(286): n is a, c, g, or t
  misc_feature (291)..(291): n is a, c, g, or t
  misc_feature (302)..(302): n is a, c, g, or t
  misc_feature (313)..(313): n is a, c, g, or t
  misc_feature (323)..(324): n is a, c, g, or t
  misc_feature (349)..(349): n is a, c, g, or t
  misc_feature (359)..(360): n is a, c, g, or t
  misc_feature (414)..(414): n is a, c, g, or t
ccccnacgatggtcctcagctcgagaccagcccggttaatttttttgtatttttagtagaggcagggtttcatcgtgttagccaggatggtctcgatctcctaacctcatgatctgcccgcctcggcctaccaaaggaggcattactgtaatcaaggattacaggcatgagccactgtnccngnccnnncncagctaattttgtatntttgtagagatggtgtttcaccatgttgntcnaggctgntctcnaactcctganctcangtganccncccnccttggcntcccnaaatacaaggnttacaggcatnagccaccacnncctgcctattttccttagttttcanagaacctttnngtcccctgggtgttctagcccagtatatctcaaacttgctgcactgaggacctngttgaaatgcaggttctcatctgggaggctcagtgggccagcaaatctgca

SEQ ID NO: 685401 - DNA, 139 bp, Homo sapiens
gcgcacactggactgcagcggtgcaattacagctcacgcagtcttgacctcctgggctcagaccatcctcccacctcagtgtcctgagtagctgggaccataggcgcctccatgcccagctaattattaaactttgtct

SEQ ID NO: 685402 - DNA, 336 bp, Homo sapiens
ggcggctgtggaggcggctgagaaggtggggacagtttctgagacagtaggagcatcttacagggaggtcagctgtgttgattcccaggaaggaagatcagctgagccagggccaggacgagctgtcaggttacgtcggatgccgtgttggttggagcgcaggatacgcaagagagtgaggaagaagaaaggtgagcagaaagggccggccaggtgaaccctagagccacgtatgtcagtgttttcagtggcaggattcttcccatttctcccgccgagaaacgtccatgagcacagcgaagctcgtcatgtggtttgcactggggagggctagga

SEQ ID NO: 685403 - DNA, 580 bp, Homo sapiens
actgcacctccactcctggggttcaaatgattctcctgcctcagcctcctgttatttctcttctaatcgagtctaatcaacaattagcagaaagtccttgaagtttccactatctggcatgtggttgcccttcctagtaactagtgctgatgcatggtggcacttctgtttaactgcattgtcggaggaagtggggtgacagacacctgctgatatggtttggatctgtgtctccacctaaatctcatgtccagttgtaatccccagggttggaggtggggcctggtgggagcgtgattggatcatgggagtggatcctttattaatggtttagcaccatcctctctgtgccattctcatgatagtgagtgagttatcatgagacctagttgcttaaaagtgtgtaacacctccccgctctcttccttcttctctggccatgtgaagtgccggctccctgtttgccttctgccctgattgtaagtttcctgacgcctccccagaagcagaagctcctatgcttcccgtatagcctccagaaccatgacccaattacacctcttctattcataaattacac

SEQ ID NO: 685404 - DNA, 259 bp, Homo sapiens
cctgctcggtaacaaccctggggtgtttttggccaggacgagaatatgtgtttctccttgggcaacgacgctagggacctcaggctgctactcttcctctgaccctggaatactacgtatactgagggtccactacccagaactcctggcagaatggcagaagctctcctggcagggctggcctggtttgaccctgtggggggctttagatctgttaagctggacacactttcactgggcaaggccatgttatcttcaa

SEQ ID NO: 685405 - DNA, 282 bp, Homo sapiens
gtcatgtatcaacgctgttttgataacgccagtgaaacgctgtttgtcgccggtaaaacgccacggctttcacgttttgcatttagcgatgatccaaaatgggagtccggacatcacgttcatgacaatgaaaccgagttgatttacgtcaagaaaggggttgcaaggtttaccatcgattcttcgttatatgtcgcacatgcggatgacattgtggtgatagaacgcggcaggctgcatgcggtggcctctgacgttaacgatccggcaacgacgtgtacc

SEQ ID NO: 685406 - DNA, 391 bp, Homo sapiens
ctgagctgcaatcatgctggatatgttgtaaaacagcacgtcagtccttatagaacagcatctggtgctgaggcttgacgttaaaagtggtgcttaacttcggcaaatcctggcaggctcatgttcttcccattttgcaccgtccagtccgtcaggctcttcatctcaacactgttcattgttaaacgacgttttcgttgaccctctaggcttgaacagagcagaccggtctgctcgactccaagccatcatcgtggccccttggctccacctcggctgcgtcctgagatgtaagactgcccgcactgttcgttctgccttcgggccatgactcgctcagcataatgcactgctctcaagccaccgtttagagtcccgccctgcatcccaa

SEQ ID NO: 685407 - DNA, 181 bp, Homo sapiens
atcgtgtgctgtaatagtatcacatcgtgcacatacacacaaatctactattgtctatctcaagtatgcagttagcgtttatattcctgaaatggatttgactcagcatagaaaagttcccacaacaactcatttcgagaccatttcaaggtctgcctatttaatgtagttcaaatcctag

SEQ ID NO: 685408 - DNA, 455 bp, Homo sapiens
tagagacctgctttacaaggttggcccttgattggcatctgggaacttggagttcagggggcttccaccattcccagaactgatcaaagtagcttactatatctaaactgtaaaacaatatagtttctcctgaacacctgctttccttctgggagtctggaattttggtatgtgccaggcagagactacctttgtgaccagctcccagtaaaaaccccaggcactcagtctctaacaagcttttctggttgacagtgtttcacaagtgctgttacaactggttgctgggagaattaagctcatcctctgtgattccactggcggaggattcttggaagcttgcacttagtttcccctgacttcaccccatgtgtcttttttcctttgctgattttgttttgtatcctttcactgtaatcacccatggccgtgagcagaactgtaaaaaaaaaaaa

SEQ ID NO: 685409 - DNA, 378 bp, Homo sapiens
ccccatatggccatcctcatgacagctgcctgcggcctgcctgcagcactgcctggcgtactggccctgtcacagctttggtacatacttgaagcggaccttctccgtccatgtccatggcgcggatcctgtagtgatagaggctcaccatgctcgctccatgcactgtctgcctgcacagtgaagtccagcagcttctggttcgtgagccttacactcctgcaagatgtcatcttcatccattaactcctgcagcgtcacatgctccttgtccagcagcttgtcaacatgggacgtggtgtacaagtcaaacttccagaacatcgtgacggccgcagagctgcaaacgagggcaaaggggtcacgtctctcaccctt

SEQ ID NO: 685410 - DNA, 981 bp, Homo sapiens
ctttccgctcggtgtttcctgcgcaggagccgagggccgtaggagccatgggccagccggaatggatggtcttgaagccccattccacaaggatgcaggcgcgtgccactgtgttcaccagcctgcccgaaagatctgcagacgtagtgccggaagccagggcgcgcgttcgttcggcgccccggtgtggtgtccccttcggggccccttcgtgcgcttgccccagggtttcggggcccacacgagggttggccgcgggccggggttttcaagctgggagggccgcctacagggggggcgggttccaacggagggttggccgggacccttcggcattttcgttgtggactcccggggcgagggcgggaacaatgtcccaggggattgtccttgcagggccaacggtgcacagcggtttgacagagcattacgcgcccaaaattcattctttttcccaaaggaagccctttgggccccaagaagggcaccaggttctggttgaagaacttgaacttggccaccaagttggcggggactgttaatgcacggccggaaccgtctattaagacagggagaagtccgagttcatcactttgggcgaccgacacgcatttcaaaaggcttcggaaagtcatccagaatggcgggtgcaaacgccggggttcctcgggattcgggcaaaagagcaaggacggggagacatggttgtggaagaaaaataagggctctggcgttgatcggcggacagcatggtgggccccagggttgtctggaacactgggccgggcagggctaccgggtgagaccactgcaggattggtggttttaaaaaacgcaccccgtaagtacctttgttgaaccccgggtgagcgacacacacgacttgcgcaacagaggacgagcgtttcaagcgaagggcagcacactggcgcgggctaacacaaaaccactgctgtgctgtacgtgatctatagcatggtg

SEQ ID NO: 685411 - DNA, 425 bp, Homo sapiens
cattcatacacaccagccacatagtaatgagtaataagtccccaattcatacctgctgactgttgtttctatgatctaatatttttccacggacccgcgaaggaacatctgtataagtctctctcctaattgcctccccatggaatcctaaatactacagctgtacacagatataccacactgtacatctgttcaggaactgggatcttcgagagaggccacaaatcactgtaatgcctaagtatttacacccttctaccaataactaattttcactcccttgtcgcgagatatcgccctcactgagaatgcatgttctgatgtatggaaagaaacccagaaaaatgaattccaaatttggtagctgtggggagctgatgaatggggagaaagggcaacggaactcttaacgaccgtatccgcag

SEQ ID NO: 685412 - DNA, 167 bp, Homo sapiens
  misc_feature (162)..(162): n is a, c, g, or t
gctggcaggtaacaacactatttctacgatatctacttataaatataattttatgttaatatgccattctccgtcaccataatcaccataatgttcaaatatcaacttttgtatttcatttccgaatgtttgcatggtagaaaacccaactaatctattacntttca

SEQ ID NO: 685413 - DNA, 935 bp, Homo sapiens
aggagaaaaaaagaaaaaaaaaaaaaaaaaaacaaaacggcaagagacacgagagagaaccaaaaccagaaagcaaaatacacaaataaggagagaaaaacagtgatatagaagagacacacagaagacaacgagtacgatacgtataaagaagcaagcgagaaaagatagacacaaacaagaaacaaaatacacaaggaagagacataacaagggagaacaaagagacaagaacacgggactacaagacacgagaatacggaaaacacaacagcaactaccaaaacgaacagaataaagcagaaacagacaagaagaacagaaacgaagcaaaaccatagagaagaaggaggacaaaaaagaggaaaaggatgaacaggacgaaagaaaagaaagacagagaagggagaagaaggcacgcgacagagacagaagcagacgcagcgagaagggagaaagagagaagaatagggaagcggcggccggacgggacgggagaagacgaaggaaagagaaaaaaacgacacaccgggaccaggcaagaatgactagacaagaaatagaaagagccaaatagaagagaagtaataacagtgaggaataaaataagaaaagtacagtaagacggagcgagagcgaggagagtaatatatagagcatagacagtagaagcaagaagagaagaagacaggtcagaagtaagcagaaaggcagaagactccataatcaaagtcacgaggagacgaatctgatcaatacgaagcaagaaagtacagctacagaatgatacgacgtatagtagagatgaaggataggatgtcactgaaaaaaataagaagtagaacaatggcagaagagacacgaagaggaagaagcgtacagactgctgacggaaatgtatagtagcagagtgactaatatctgcactgaacata

SEQ ID NO: 685414 - DNA, 406 bp, Homo sapiens
agtgcaccagtcagatgcggtggctcatgcctgtaatcccagcactttggaaggccgaggtgggtggatcacctgaggtcaggagttcaagactagcctggccaacaaggtgaaaccacgtctctactaaaaatacaaaaaaagtagcctggcagcccggcgtggtggctcatgcccttaatcacatgacagtactttgggaggctgaggcgggtggatcacctgaggtcaggagttcgagaccagccaggccaacatggtgaaagcccttctctacaaaaatacaaaaaaattaactgggcgtggtgcacatgcctataatcccagctacttgggaggctgaggaaggagaatcgcttgaacccgggaggcagaggttgcagtgagctgagatcacgctgctgct

SEQ ID NO: 685415 - DNA, 120 bp, Homo sapiens
tcccggcacgacgacacgctggagcagtggggcgagcgcatgggcgccagcgcgcgcacgctggcgcggtgcatgaaggacgagaccggcatgagctttcacaactggcgcttgcaggtg

SEQ ID NO: 685416 - DNA, 846 bp, Homo sapiens
  misc_feature (31)..(31): n is a, c, g, or t
  misc_feature (189)..(189): n is a, c, g, or t
  misc_feature (377)..(377): n is a, c, g, or t
  misc_feature (389)..(389): n is a, c, g, or t
  misc_feature (411)..(411): n is a, c, g, or t
  misc_feature (416)..(417): n is a, c, g, or t
  misc_feature (430)..(430): n is a, c, g, or t
  misc_feature (440)..(440): n is a, c, g, or t
  misc_feature (457)..(457): n is a, c, g, or t
  misc_feature (473)..(473): n is a, c, g, or t
  misc_feature (475)..(475): n is a, c, g, or t
  misc_feature (479)..(479): n is a, c, g, or t
  misc_feature (481)..(483): n is a, c, g, or t
  misc_feature (486)..(486): n is a, c, g, or t
  misc_feature (489)..(489): n is a, c, g, or t
  misc_feature (493)..(493): n is a, c, g, or t
  misc_feature (497)..(497): n is a, c, g, or t
  misc_feature (510)..(510): n is a, c, g, or t
  misc_feature (515)..(516): n is a, c, g, or t
  misc_feature (521)..(521): n is a, c, g, or t
  misc_feature (524)..(524): n is a, c, g, or t
  misc_feature (541)..(541): n is a, c, g, or t
  misc_feature (547)..(547): n is a, c, g, or t
  misc_feature (552)..(552): n is a, c, g, or t
  misc_feature (556)..(556): n is a, c, g, or t
  misc_feature (559)..(559): n is a, c, g, or t
  misc_feature (582)..(582): n is a, c, g, or t
  misc_feature (617)..(617): n is a, c, g, or t
  misc_feature (626)..(626): n is a, c, g, or t
  misc_feature (637)..(637): n is a, c, g, or t
  misc_feature (660)..(660): n is a, c, g, or t
  misc_feature (667)..(667): n is a, c, g, or t
  misc_feature (679)..(679): n is a, c, g, or t
  misc_feature (684)..(684): n is a, c, g, or t
  misc_feature (688)..(688): n is a, c, g, or t
  misc_feature (702)..(702): n is a, c, g, or t
  misc_feature (738)..(738): n is a, c, g, or t
  misc_feature (743)..(744): n is a, c, g, or t
  misc_feature (746)..(746): n is a, c, g, or t
  misc_feature (750)..(750): n is a, c, g, or t
  misc_feature (770)..(770): n is a, c, g, or t
  misc_feature (839)..(839): n is a, c, g, or t
aaggggcgcctcccatcccctcccacaacanacaggacagaagcccctctgggccggcaggggaaggcccagcctcaatccttcttgctcccgtgccgctgactgtgaaacttgtggtgcacaaccctcagggtggtgaagaaattgccgaggaaaaggagaaggaagggaaagccgcacataagcacntgttactctcttgcactgagtggtcctgggccaggttgaacaacgtcagcgcgtaaaaaagctgccagaagtgtccaaagaaaagaaaaggcagcaggaaggtgaggccccgccacatccaggactggaagccctccacagtgaggtccatggtgtgccgctcgcccagcgcctctgcaggcggttantaggcagccgcnctggtatgtagtacttggaganactgnncgaagctctggtncatggaaaangagaggaattggttccngaatttctggtacatnanaacntnnnccnatntcancatnactcccgacaggnaggtnnacacntanactgcaacacccatcancctttnatccnccanccnttgttgatgaggatgctctcccngatggtcagggtgcagtagtaccagaccagcaggnagttgaagncagcatctgtnaccctggagttgagcaggaagcngcaagtnaaggagaagagnatgangatnatggtgaggtagancttgaacttctcatactcgtccttgtaggcaaactnagccnncntgcncaggaccgtgacgttgacgnccccagaaacaggctcaggtacaatccattcttcttacgcaaataggcctccatgtcaaagaagaggcnttgcccc

SEQ ID NO: 685417 - DNA, 171 bp, Homo sapiens
ccgtccgatgtgttgcgcgtctccggcaagacgggtgagggcgtgcgtgagctgctcgacgaggtggtgcggctgatcccggcgcccgtaggcgatgcggatgcgcccgcgcgggccaagatcttggactccgtctaagacatctaccgcggcgtggtgacctgcgtgcgc

SEQ ID NO: 685418 - DNA, 247 bp, Homo sapiens
ctcggcccgtgttgacatataatcccagcactcaggacgctgaggcaggagaattgcttgaaccccaggaggcagagcgttgcagctgagccaacgaacacgccactcgcactccagccctgggcaacagcacacaagaccccatctcaacaacaacaaaaagagactgtctagacagaaagctgcgactgttctccaggcttttatagacctttattaaaacagaactccttacttgcccgtgact

SEQ ID NO: 685419 - DNA, 893 bp, Homo sapiens
  misc_feature (71)..(71): n is a, c, g, or t
  misc_feature (142)..(142): n is a, c, g, or t
  misc_feature (198)..(198): n is a, c, g, or t
  misc_feature (224)..(225): n is a, c, g, or t
  misc_feature (228)..(229): n is a, c, g, or t
  misc_feature (235)..(235): n is a, c, g, or t
  misc_feature (240)..(240): n is a, c, g, or t
  misc_feature (259)..(259): n is a, c, g, or t
  misc_feature (263)..(263): n is a, c, g, or t
  misc_feature (274)..(275): n is a, c, g, or t
  misc_feature (280)..(281): n is a, c, g, or t
  misc_feature (308)..(308): n is a, c, g, or t
aggctggtactggcctgagatttatggataaaaaaaaaaacaagatgacgacgacaaccacaaaaaaaatngacatcagatgaaatgaaaaaaaaaaaaaaaaaaaaaaaactaagggaaggaaaaagctgtaaaaatcacnggcattcgtggggccatccccacccaagctccacgttgttgtccgtctgtgctccntggcctctgggggaccagctggggannatnnaacttngtctngccaggcccccgtcgcgtngctngaacgggtgtnnagttnngtaggtaacgcacacaccccacacctnaaggtgtctgcatcctcctgccaacgcatgggctccacgtggtgtgctcgcttgagatgtcgtgacttgtcagctgtctctggggagggtgctgttgtggggcccgatgggatagcctacattacccgctaagttgtgcctgagagtacgctgttagtacctgttttcccttcccttcctttacatcccttgaagggtctaggctgatagggattaaccacgttagccgcggaatattcccaaaaacaaacccagatagggaaacaaaccattatcgtgacgaaagacactagtgaagggtacacaaatcaccccaccagggacataatgggaaaatgatgatagttcacgagaatcccctgagggcctattaataagaaagagcgccgctataaaaaagcccacagagggactccaagaaacatgagtacacatcaacggggagggccaccaaacggttcgcaaaaaaaagaggagcaaaaaggcactaaataattagggagccatagacggccacgaaagaacagacaaagagcaacacggatatgaaaaacgggaacaagaaaaagaacaaggacgtgagca

SEQ ID NO: 685420 - DNA, 1001 bp, Homo sapiens
attttcaaaaccttttttttcaggctgaagaaaaaggtttgaaaatgttttctgtagtttgttggttctaaacaacaaataggttttaatcactcgaaatggaattatattgtgtattcattgaataaattcttctgtcagcttaacaaaaccaaacaaaaacaacaacaacaacacaacacacaacacacacaacacaccaccacaaaccaacgagacgaagcacccaccgacaacacaaaaacaccaaacgcgaacccccaccccacacccaaccccacccccaccgcacgggcgcggccgcccccccccccccccccccccgcgccccccggccccccccccccccccggcgccccccccccccctgatactaaccattagacgacaccacgccccacctccgccaagcacgacacaccgcctcgaacaaacacgcccccgccgcgaaaatctaccagccaagacgacaacacacacagcacgagtcggcaaggatatgaaagggacaaccccaccgaacacaatatggctacgcccaaagaaagtacaccacgcaagcactgagtgctgaaacaaccaaacccgcacgacctccaccgcaaacaccccacgccctcacacccacacacaacaacacaacaaaacaccgagccgcggacactaacaacatcagcgactaccacacgacgaccaccaaacgaacaccacacgaacacaaacacacgcaacagcaccaaacgcacagcgagcaccccacacccacagaccagacaagcgcagaagcacccacccacgcaaccaaacgagacacctacaccgtacgacccaacaccggccacacccagcaccacagcacacacaacacacacacacaacaacaccgaccgcacaaaggaccacaaggaccaacccaacacacagagaacaacccacagcaggacaaagaacgaacacacaacagcaaactactaaagcagcaaccaaaacggcgagtcaga

SEQ ID NO: 685421 - DNA, 250 bp, Homo sapiens
ctctatgaggatcccccattaacccgtctcacgaaaaatacaatagaatcacaaataatatatcacatatactgggatgtgtccctttctttgtaggcagattactttaccatttactaaatttgagcttcagaaacattaagcatgctacacaaactttgctggaaatgaatactgaaatggaagtttgaattcctagatgatttcttttgaatcccatgctaatgctcttgaaacttctaaaactagg

SEQ ID NO: 685422 - DNA, 588 bp, Homo sapiens
gccaacaccaaggtgaactggcccatgttccctgagagctttggcaactggggacaggacaatgagctgctggaacctctgtcaggtgtgcttcctgccaaccggaatgtcccattcaaattgaagctgcatggtattgccaaagtcctggtgaaggggcaggacacatggcccctgaccctgaaccacgagggctactgggagggaagctgcagcacagctggctgccaggaagtctatgtcatggtgctggagaatgccaaccacaatttctactcctacatcctgaaatacaaagtgaatgcccagtgagggctgtgccccggtcttaccctcccaaagggccaaggccagacctccccagggagggctcgaaggaagtgcagggagccctggacaccactgagtctgcatgaaatcccttctaggcctctgcctcagtgtcccacctctgccacaggagctgtgatctttgtgttctgaaggcttcactcaggtgtggctgtgactgagggggcagaggcagtggctctttagaaggaaaaggtgctatgtaaatctaaggtattttaaactgtaaaaaaaaaa

SEQ ID NO: 685423 - DNA, 358 bp, Homo sapiens
  misc_feature (21)..(21): n is a, c, g, or t
ggatgccatacttatatgtanttttggccttttgattgagtattcacaaatcataagtgttcccgcttaggagtacttttaaaaagtgaaaaaagggctggaccctggtggctcagacctgtaatctcagtactctgggaggccaaggtgggcaaattacttcagcccaggagtttgagagcagcctaggcaacatggcgaaatgccatatctacagaaaaaatacaaaaattagctgagtgtggtggcatgctcctacagtcccagctactcaggaggctgaggtgtgaggatcacttgaccctgggagaagctgaggctgcagtgagtcatgattgctactgcactccagcctgag

SEQ ID NO: 685424 - DNA, 352 bp, Homo sapiens
ctcatctgtttcagggtatcctcattcccactgtgtgtttccgggcggagcttgcacggtgaactcactgacttgattgtctatagcccccgtgaatgatgatggcttaagcttccactttggcttcctactttacctagagttcgcctatattcatgagtccaggctaaactctatacgaacaacctatcgacctgaatcatattggtgaggagcattacatgcctagcttcgtaatgctataggaccagggctacctgctattgatagttaacatgactagatcctgtccacacgactacttccatacagtaccagctgtctgtgtcacaacagcaccgcagaactgcct

SEQ ID NO: 685425 - DNA, 166 bp, Homo sapiens
cgctcgagcggatcccataggcgaagactgtggactcagggctgctgtggcagcgccatgagccgaagaatggagactgaaattgaagctgctgataaccttgcatgatttagaaaagcacctgcgtgaaacggccctgagatcaatgaggaaggcccaagtgtcc

SEQ ID NO: 685426 - DNA, 451 bp, Homo sapiens
  misc_feature (430)..(430): n is a, c, g, or t
  misc_feature (445)..(445): n is a, c, g, or t
tggactaatacactaaattggtacaggtagagtcaagtgctcctgtaaagatacccaaaaatgtggaagcaactttggaactgggtaacaggcagaggttggaacagtttggagggcttggaagaagacaggaaaatgtgggaaagtttggaacttcctagagactagttgaatgggcctgaagcaaaatgcctgatgataatatgaacaatgaaatccagactgaggtggtctcggacagagatgaggaacttgttgagaactggagtaaaggtgactcttgttatgtattagcaaagagactggtgagtttggggccctgtcctagagatttgtgaaactttgaacttgagggagatgattaagggtattttggggaaaaagttttttacgcccaagcattcaaacctgccccttggggtgctgtttnaaagccatatgtatncgaaaa

SEQ ID NO: 685427 - DNA, 466 bp, Homo sapiens
gaacggattctgcttctcagtgatgcctggaaagtggatttctgctctgctgctgctgtaaataagttgctgcttcagcatctgtgaaatgtgggacagtgtatggtagtgggcgatggaattcagtcattggatgaacataaaaataatactggatgaactggtacagagaggccatgaagtcactgttctgagagcttcagcttactatgttcttgatcccaaacaagatcacctggccttaagtttgaaacttttcctacatctgtcagtaaagacaatctggaaaattttttcattaagtttgtggatgtgtggacttatgaaatgccaagggatacatgtttgtcatattctcctttactgcaaaatatgattgatgaattttctgattatttctaagtctttgtaaagatgttgtttcaaacaaagagctcatgaaaagctacaggaatccaagtttgat

SEQ ID NO: 685428 - DNA, 1125 bp, Homo sapiens
ggtgagcactagcattggacgcttgagccatgaacaagagcgaccgttatcaatggtgcggcgaataccgggtcccccatggaacgcaagagctcgcggttgactctccactctacctagagtaggagagttggatagtgagtgcttacagctccgcgtggacatatgtacgaggtagtcatgacaatatcggatcccacagcgtcgatccctcaccggcaccgaaggaatctcgagatcttgaatctgattggctcgtcatgggcctccgcctgatgatgtaggatgatcggaggtcatcgcctgagtactgccagcaattcgatgcacaggttgctgatagtagcagagaagtctcccaaagtcctgtatgtgacagtgagagaacatggctttcatgggacctcatatcaacgtgtcccttcggatctattcgttcccgactgactcagtcgggagtacttagaagcggcggtcgaaatcacaccagggtagtcgccttcacatggatttccacacaaacacaattgtgggcagaaccaaaaaattggactctggcaaacgccatcgatcgttttggtaatgcgtcgacagggcacttaccctccggaattggagatttccaccatttcggacgtaagccgaattctttagatgcccgtcgattggttggggcggtgacgatgcttggaacaagagatcggacccaaccgagaatgcgaggtactacccgtggagaatggattggcttccgtgtaattggcgttcaaagataagcgcatacccaaaggtacgccgggactaattgtacgccagtgtagatggagagggaatggcactttgggagacttgtaccattgtaaaccccctgaaggaagggcgatgggcgaatgaagcgtgaggacttgtagcccttttggaaggaacacgccaaagtgttggcgattccagggttgaacaagttttggatatatgcgccaggtgaacccaggtcgagctttgggacctacaatatggcaaccattaaggacatagagaaggggccattttgttcccacaggtggcttagttcttgatcccgttctttccccagttggaatggttcctgtcgggtttcaggaacaa

SEQ ID NO: 685429 - DNA, 245 bp, Homo sapiens
gtctaacctgcagctctctctgatgctcttggagggtctgatggggccttctgaggctggctggtagtggtgagtgagaagtgacatctcctctgtatcctcccaacatctgtctgtccagaatagtgtcccctcctctctgtggaggatcccgccgtgacccaagaaggtaaggccaggttacgttgccgtttggctgtcttcgttccttcctgctgtgttcgctgcgagatacagtctgtggc

SEQ ID NO: 685430 - DNA, 458 bp, Homo sapiens
  misc_feature (9)..(9): n is a, c, g, or t
  misc_feature (21)..(21): n is a, c, g, or t
  misc_feature (39)..(39): n is a, c, g, or t
  misc_feature (192)..(193): n is a, c, g, or t
  misc_feature (327)..(327): n is a, c, g, or t
  misc_feature (450)..(450): n is a, c, g, or t
ggggccatncccctcttcccnaaactgctctgaggaaantggggacccagcaacaggtgtaagattcatgatgaaaaccctgagggttccctctagactgagtgactcagccagttacaaaaagacaaatagtgtgtgattcccatttatatgaggtacctagggtagtcaaaatcggccgggcattggttnncacgcctgtaatcccagcactttgggaggtggatgcgggtggatcacctgaggtcaggagttccagaccagcctgaccaacatggagaaaccctgtctctactaaaaatacaaaattagccaggcgtggtgcanatgcctgttatcccagctactcgggaggctgagggaagagaatcactcgaacccgggaggcagaggttgtggtgagccaagatcacaccattgctctccagcctgggcaacaagagaaaaccntctgtctc

SEQ ID NO: 685431 - DNA, 294 bp, Homo sapiens
  misc_feature (39)..(39): n is a, c, g, or t
  misc_feature (175)..(175): n is a, c, g, or t
ccgtacaaggaccttctggaccctgcacggtggcggatntgatccagcagttccggtacgacaactaccgactacaccagctgggaaacaattctgtgttcaccctcaccctgcaggctggcctctcagcaatcaagacaccacagtgctacaaggaggacggcagctccaagancctgactgccctgtgtgcagccgctccctgaacaagctggcgcaccctggcccatggccactgtgccaactccccgcctggtctgcaagatttctggcgacgtgaatgaacgagaacaa

SEQ ID NO: 685432 - DNA, 116 bp, Homo sapiens
agcaacccatgttcgacgggtttttttttggccctgctgcggcaataaattgtgacccaatttgggaggtgttgtttggaaaaaactataacgaggaaaagaaacgaggccccccg

SEQ ID NO: 685433 - DNA, 270 bp, Homo sapiens
gtggacgaaaggcaccaaatacaattctgaagttgttgataaaaagatagaagagtttcttatctagctctcgatgatgcaagcatgagaacctcattgatgaggcattcaacacccagatcacagctctcatcatgctgtatgaatgtgaggatacccaccttggggaggaggtggataggaactggaatgcatgtggcttacacagcagtacctctttgaccgccttgcccacgagattgaagcactgaagtcattctcaaaatcaga

SEQ ID NO: 685434 - DNA, 161 bp, Homo sapiens
tgtggctcagattcagtccctggtccaggaacttccatgagccgtgggtgctgccattaaaaaaagaagaagaagaagaagaagaagaagaagagaagtatcctcgcactctctggtggcagggcgagtggtggacggggaacaacgaagcaataggatga

SEQ ID NO: 685435 - DNA, 159 bp, Homo sapiens
cggacgcgtgggtgcaactctcccaaaatccaaataaaacatatgtctgatagtagtcgactgaaacaataaaataaaaaatgttattttcctaatttagtaaatcttttctatttgcattcagatagctctggagtcttcactcccctttttgccttg

SEQ ID NO: 685436 - DNA, 267 bp, Homo sapiens
cggcctcggcctcccaagtagcggggactacgggtgcatgccaccactcacagctaattttggtagagacaaggtttaatggcccaggcgggtctggaactccggggctcaagcaatccacccacctcagcctccgaaagggctaggtgtgagccacaacacccagccagggccaggtctggacccagcggtttctccagggcctagcactattctaggggacggggggtttgggtagaccagagactggtaaatgcagatgtaacg

SEQ ID NO: 685437 - DNA, 1143 bp, Homo sapiens
  misc_feature (408)..(408): n is a, c, g, or t
attagagtcaaagggtgatggaggagagagggtgaacaaccagccccagaaacaggtgcagatgctacccctgggcgctgggtgtggctatcactggctctgctgcattctcagtggattgcagtgcgcgacgtactgaactgggtgaaacatgaaactgaaaacaagctcggtcccattacactctgaggaatcggtgactacctcataaatgggatgtatctatagtactgtaatttcaataccttgtgggcagggacatgtagcgtttataatttatacatcgtattaagttctggatatttagagcattacttttgtttgtaattgggccgagaagatctgcagaatcccaaatctgtactttattattctatcgtaaagaagaaaggttccgtgtagtaagcntcatagaaatgagttttgcaagatttagagcaggaattcatgattaaagattcctaaaaatataattctgatttatgtaagctggcgcctgagaaatagaaatgtgtacttagctgatgagaaaattcgagcatctcaggaggtggtatgaggatgactgtgtgaagccattaccttttagaagccaactgtggacccttaccatgctggactgctataggcccagacttccaccttgttctgtggcccttttcttcctccttgaagctccaagtattcttttccttttcccctctaaagcgggtttctgagaagtggatctccaagcaagttcatggcttcagtccgatgttactaagggggggaatacctaaaattgttacacccatgtcccacatcagtagcttaggaaggtgcaagtgggccattcaaaagctctgactccgtacacaggggggggccccctaaaaagacccatgagggaaaacacacacccacggacatggcactgaaacggagccttagaaacagggcgaacagcgcaaaccacagacgacaaggaagcaacaacactgacatagcaccaacagaggaagccagagaggaggagacagagaaacgagacgcagacagacaaaaacagcaccagcgacgagagcaagagaagaaacaatggggcagcacaccaaacaaacgcacgagaagacaacacaagcaccgacagacgcacacgct

SEQ ID NO: 685438 - DNA, 322 bp, Homo sapiens
tgctctcgaggattccacaacttcgtccattgcgatttgctcagtttggatactcggcgtgtgcagcaacaacttcgtccaccgtgacttgatttcaagaagtgtgtggaggctcggcgtgtgcatgcacacgccgaagacccaaactgcacatgccgaatgcccagactatcctcaactaggggaccctatagttccccgttgccttgaggacctcattctatcaagatgtttcaggtactggatctccgtggtatcagggaaatccgcgcgtagcttgtagagcctcgtggcagcttttccagctgcttcggagctcacc

SEQ ID NO: 685439 - DNA, 309 bp, Homo sapiens
caagttcatattttatttccaataggtttggagctttgctgatttttgcctttttgtaaaaaaggaaaaagttttcacttaattcattgaaagccctttcttgctgagcccaagggggagcctgggccaagaccagaccctctcatccctcttgttcctaccgcaaacacccggtgctgggggtgcggctgttccccttcgcccactatgacctcccgcccctgctggatatttctttgtccagaacactctttaaaatggaagctgagacacagtatacactgggcaggcgcacacacacgcacacat

SEQ ID NO: 685440 - DNA, 82 bp, Homo sapiens
gggtttttttttttaaaaaaaaattaaaagggaaaacaaaaccaaaaaaaaccagaaaccccgaataagaatggaaatgcca

SEQ ID NO: 685441 - DNA, 1719 bp, Homo sapiens
  misc_feature (993)..(993): n is a, c, g, or t
  misc_feature (1018)..(1018): n is a, c, g, or t
ttgctcgtgacaccccccctctcgtgttagatactagcaccatcgcgtggggggaccgtatactccgtccacatggagtggtgttgactaacaagggcgtgaacagatgatacactcgtgtgctcgcgcactctcaaattgtggagggaatccttttcttcctccctgtgggcgcacacaagggttgggtcccctccgagaggaggtagcttgttttcctacactcttgtcgttgacggcagcctattttgggcccccccgtccccgccccgcccgggtgggtcccccactcgttccccaccaccggcggtcccttttggacccacaacagaatgttttgcaaccacaagaggtttttgctgcaaacacccctgtccgttgacaaagaggaatacaaaactaccctcccattttctcccccggtgtgaggggatttttgtccccccagcttcctaagtgaggccaaccgcgtgttccacgtgttcgcgatcatgttgtcttattgataagaataactaacagtgttgggacgagttctctgtgtgtgtgtcccccacaccgtgtgtaccacggcggcagatcttcctttgggcgttgtacacccatcatgaaaggtgcagagtctctttgtgtgtttgtccccccgtcgttatcgtgggaaaacccagattgggggtttcttccttccagagtgggagaggccccccccccgcgggggaccggactctgtgctctcagggccccccttgtcctgggggcgcaccccccggctttcttcgggttggcggccacattgttgccaccacccccccctctccctagggggggtctttctagcagagcttatcaccttggacgccccccccgccggttgggggagccacgtggccaaaacaacagcccccttgtttcctccaccagcacttctgtgagcctccgcgaactagtgttcacagctatggccacaacagagtgccctactgctgtgccccncccctacttgtggtggtggtgcggnacaataaaagttgtcacaccacaccgggcggtggtcaacaacaacaacagcagagcgggggcggccgccccccgctggggtgctaccctcccgcccctctgtgtctcgagaagcccacaaatggcgctctgtgtttccgcgttttgcgcgcccacatctgttctctgtgtacgcgtcttgatatatggtgttcatacgtgtttatacatagatggaggtgccaccacacggggtgatctctgtgtgtatctagcacgcttccacaagccgtctcacgagagagaccagcttcccttgagcactgcatttgggacgcaccacagagggggagacctcaccattcgcgccacacacgccgaaggcgcgacacaccccagtcaccacagtcctccacaagggcacacatgccacacaagccgccctcgccgtgagagcctgtgtgcacttccgggcaggcatgtctctctcgagaggagcggctttcgctctgtgggagacactggcggcccactacgcccgcggaactccacgagacctcccacgaaacccttccccatgccttactctccctcggagtgatcggcccggcttctctatagcacacagggctaacatagggaaccccccttccacaccaccagcctaccatttagatcccccccactcttctatcccttcacgaaaataaaacaaaataaaga

SEQ ID NO: 685442 - DNA, 749 bp, Homo sapiens
gagattctccccagacgccgagatgcgggtcatggcgccccgaaccctcatcctgctgctctcgggagccctggccctgagcgaaaccgagaccgaggtatttctatcacccgccgtgtcccggcccggaccgcggagagccccggcttcatcgaccagctgggctacgtggacgacacgcagtctcgtgcaggttacgacagacgacgcgcgcgagtaccacctgaggggagccgcatggcgccgtgggatggcagcaggatgggggccgagagtatagcggaggaccgggagacatcagacacgtacaaagcgccaggcacagacttgaccgatgtcgagacctgacgggacaatctgcgtcgcgctactacaaccgagagctgaggccggggtcttcacatcctaccagaggatgtattggcttgctgaacctggtggccctgactgggcgctctcctcccgcgggtataaccagttcgcctacgacaggcaaggattacttcggcctgaatgaggacctgaagctcctggatcgccgcgggacaaggcggctcagaatcacccaggcgcacagtgggaaggcggccctgctagaggcggcagcagcggacgaggctacctggagggcacgtgcagtggcagtggtccgtagataccctggagaacgggagaagacgctgcagcgcgcggaacacacaaagacgacacgtgagcaccaaccgtctctgaccatgaggcccccatag

SEQ ID NO: 685443 - DNA, 577 bp, Homo sapiens
  misc_feature (546)..(546): n is a, c, g, or t
agcggccgcctttttttggaaatgagtctcactctgtcgcccaggctggagtgcaatggcacaatctcggtgcactgcaacctccgcctcctgggttcaagcgattctcctgtctcagcctcccgagtagctgggattataggcgccccccaccacgcccggctaatttttgtattttttgtagggacaaggtttcaccatgttggccaggctggtcttgaactcctgacctaaggtgatccacctgcctcggcctccaaagtgctgggattacaggcgtgagccaccgcgcctggcctgtgacttgcttctatctctgtactcccgtacttggttgtgtgtagccaataccctgaatgaaaaaaaacaaaaaggtaaaggttggcgggtggtgatgtaaggttattttcatttctgttgatgatagaagaaataagtataagcaccttcatttggccctggttccttttgcaaatgtattttaagaacataaacaggagtttctcaagctgggggcgaaggggtaattgcatgacagttctctgncagttggtgccatcgaggcagctggtgcttg

SEQ ID NO: 685444 - DNA, 101 bp, Homo sapiens
gcggccgcctactactactactgctcgaattcaagcttctaacgatgtacggggacatgtaatttgggtggtttattaatagattgcctttaggaaaaaaa

SEQ ID NO: 685445 - DNA, 913 bp, Homo sapiens
cctgacttccctaattccccccatccttaccaccctcgtgaagcctaacagaaaaaactcataaccccggattatgtagaaagtccatgtcgcatccacctttattataccagtctgttccgccacgaactaatattcagtgtgcctagaccaaggaagtgattatctcgaactgacactgagccacaacccaaacaacccaggtctccctaagcttcaaactagactacttctccatagatattcatccctggtagcagttgctgtcgttacatggtccatcgatagaatgctcactgtgatagtagtaaactcagacccaatacatttaatcagtttcttcaaatatctactcattttcctaattaccatactaatcttagtataccgctaggaagcaagcctattcccaactgttcatcggctcgagagggcgtaggaagtgtgatatcctgtcttgctgcatcagtttgatgatacgcccgagcagatgccaacagcaagcagccagttcaagccaattcctatacaaccgtatcggcgatatcggtttcatcctcgccttagcatgatttgatcctacgactccaacttcatggagaccatcaacaaatagcggccttctataacggctaatcgcaagcctgcatcccagctaactaggcctcctctctagcagcagataggcagagatcagcccatttaagggtctcccaccccttggagtccccctcaggcatagcaggggccccaaagaccaggctcagccctgatccactcgaagcaactattagtgacagaaggaagtcttctgtacagcttccggtttccacaccccctaggcagaaataggccagtaatcgaagtttaaacttggtaggggcgacaccctcctgtcgagacttgcccttga

SEQ ID NO: 685446 - DNA, 255 bp, Homo sapiens
ggagacgtagaggagtccgccgcctcaactgaggggagtagttctgtgggaatagtactgctcgtcgtgtacattaccagggatcattttactgtcgccataggtttgtctctggccaaaatgtcatatagttgcaatcatatagtatgtagccttttcagactgcctgatttcgtttagaaatatgcaattaagtttcttctatgtctttttgtggcttaatagctcctttctttgtagcactgaatagtattc

SEQ ID NO: 685447 - DNA, 424 bp, Homo sapiens
  misc_feature (46)..(46): n is a, c, g, or t
  misc_feature (121)..(121): n is a, c, g, or t
  misc_feature (311)..(311): n is a, c, g, or t
  misc_feature (325)..(325): n is a, c, g, or t
  misc_feature (385)..(385): n is a, c, g, or t
  misc_feature (399)..(399): n is a, c, g, or t
  misc_feature (423)..(423): n is a, c, g, or t
ggtggttgcctgcgggaggccgccgcgggtcatgtgaccggaaggnctcctcacggacgccgtccctcctcggcgcggcctgagccccggcccgaccccggccatggggtgctgctacagnaggatgaacgaggactcggaccaggaccgagaggagcggaagtgctgctggaccctagcagcccccctaccaaagctctcaatggagccgagcccaactaccacagcctgccttccgctcgcactgatgagcaggccctgctctcttccatccttgccaagacagccagcaacatcattgatgtgtcttntgcagactcacagngcatggagcagcatgagtacatggaccgtgccagggagttacagtacccgttttgggttntgttttaaggaagnaagcttgaaccttttgggaaggang

SEQ ID NO: 685448 - DNA, 165 bp, Homo sapiens
gaatctgtgtaccagatttctgaaaactcagttactgctcctaaccagtctacttaagtgaatatatttttgccagtgcatcaacgagtatagattcagtataagtggagtcagtctttgtcgttaacaccctatccctttgcctatatgagtagtccatctctc

SEQ ID NO: 685449 - DNA, 625 bp, Homo sapiens
cgtgtgctgaggacacctgtgccgcagtcgcctgggcctggccatcgctccccggacagtgggcacgtggccaagatgccagtgtgcactggtggggtgccgcctcggggcacgggaagcactgtacccaagtcatggggcgaagctggactgcggcctggcctgcaccaccaccgacactgtccaccaccacgtccaccacagcacagccctgtgcccaaggatgcaggtggaggcctgaggccaccctgcagtgcccagagcagcttcgcctggggcctggaaccacacatgccatgtgggcaaggtcccggagggctacctcagaggagttgtttgggcgggcttgccccccaaaacgggcccaatggttgattgggcccttcggccccagcaagttgtggacagggttggtgcgttggctgttgcaaaaggaaatgccaagaaggctgaggtcggcggaaagagcgccagcaaccgaggtttgccaggtgcctcggaaggaatgcgggagaaaaaccagaaaaattcattgcggctggatcatttgaggggggacaacgggagatcacgctggcaccgcagggaccggcgcacggggtctcggggggacgaaggaaagcca

SEQ ID NO: 685450 - DNA, 102 bp, Homo sapiens
cctcaccaagactgacaactatggcagaagcaggaatgcagagagatttaccatataatcttatggactttgaacatgtctgtccttttaaggcagaagcag

SEQ ID NO: 685451 - DNA, 413 bp, Homo sapiens
aagatagtctcattgggcagagggaatagagggtgtagtgaaaagtacgagtgttatagattctccggggctgagagtgtctgtatgggcagtcccacgtatgagtgattggacaaagggttggtaccaaatgttgtggtactgctgtgatgtggctctgacaaagaagaacataaggaagagcagaagaggaccctgtgtgtcactagggggacttgggggaggcagcagagtatagatagcatttgagccaaagcttaaaggagaaattggaatttttagggcagacaggctcaggaaatacattccaggaagagcgaagagtgcgggtaatgacatggagtcaaaaggctatattccagccaggcacagtgactatcatctcagcttctcggtaggatacagtagggaga

SEQ ID NO: 685452 - DNA, 306 bp, Homo sapiens
  misc_feature (99)..(99): n is a, c, g, or t
ccccggtgcaccagccctgaccaccaccccctcctcaaggagaaatgtggaatcaacaacccttaagaagaaatcctgagaagggaagacatgcgtganaaatcccattcaggctatgaatccacggctaatatttgcagtgcccaagcatctatcacatgtgcacctctaaagcgcccatctgttctgctggtaacactactactgtggcatttgcctcctgctgagggaaaacaatatgctcctatattaggggtcatttctgctctacagggtagaaggctctgtttctggccttttaaacct

SEQ ID NO: 685453 - DNA, 247 bp, Homo sapiens
ggtcgaccagagagcgagagagtaaggaggagagagggagcaagaggttaaggagaggagtgaggcagagagagataagttaaggaggggagtaagcatgggagagagaggggttgtggagggatggatgtgagtgggagaggaagagagagagaagaggaggagatagataagtggaatggcgatgagtgagaacttggcctcatgctgccctcctgactctgcaaaccgatcgccagcgtcgacg

SEQ ID NO: 685454 - DNA, 888 bp, Homo sapiens
gtgacgcgctgggtgcgggtgtgggccttggccagcatggagcttgtgatccagttccaggtgctgaaccagagctgcctctgactggcatggagccccccgatgctgtggactgccctgagcagcagcggctagctgtgctggctacgtgtgactgtgctccctgcgcatcttacagacgtctacccgctactggtcatggagctcaaagatgcacccaccaccctggtggcggctgaccactgttgccttctccacacgatggtacagactgtacctactactggagacaaggatgggctcgttggctgtgagccacccctgcacaggggacaacacttccgtgtgcttgagtgaccaccagggactccccaatctctaccatctagtgtcacgtgcacaagagtgtgacgacttagggagtggagtggcacagacctatgggcttggcttgccaagtggggaccatgacggtgtcacttctatctgtggcctcccgaactggcatgcgtgaaccaacatgtgacactatgtggacttggatgacgttcccaatgccatgcacaccactggaggtacaaccattgctcctgtgactacatggtggcgatgtgggaccaaggtaccacgatcacagcccagaacacgcaagcagtgcatggtgccttatggaagaacatacgatggcacacgatcttgacaccatcgcctagccacttcgcctttgaccctaatcctagacccgcttgaggacattatggctgccgcctccactatgcaatgcatacagctggtgactctccgcagtgtggtactcacccaaaggctcacggtgtgtatatcaattagcgctaacccctctgctccgagaacatacagtggatcgga

SEQ ID NO: 685455 - DNA, 346 bp, Homo sapiens
tgcccaatctttgccaacagttgaaccaagactctgaggctgatatgcaatgtcacttacaacattaatcagatactgcatttaagtacagacggggtttcaccatgttggccaggatggtctcaatctgttgacctcgcgatccgcccgcctcagcctcccaaagtgctgggattacaggcgtgagccaccgcgcccagcctgaactttccatttctctcccaagtctcctattctacatgctgaggatgccagagggtccccttaccaccactcctcaccaccccaaaccaccctcctccccatcactgtactagatctgaattaaacattaaatgaaataaaa

SEQ ID NO: 685456 - DNA, 441 bp, Homo sapiens
gatctaaataatcatttcttccctagtaaacaggaggggaaagtggcaataagccagagaaacttacaggcccaaaacaacaactcaacaaaggtatctaaaaagagtggaggccaggcacggcggctcacgcctgtaatcccaacactttgggaggccgaggtgggtggatcatctgaggtcaggagttcaagaccagcctgaccaacatggtgaaaccctgcctctactaaaaatacaaaaattagctgggcatggtggcaggctcctgtaatcccagctactcatgagactgagggaggagaattgcttgaacctgggaggcagaggttgcggtgagtcgagatcgtgccattgcactccagcctgggctgtagagcaagactccatctcaaaaataaattaataaaaatttttacaaaattaagaatgcagcagaga

SEQ ID NO: 685457 - DNA, 1600 bp, Homo sapiens
  misc_feature (711)..(711): n is a, c, g, or t
  misc_feature (934)..(934): n is a, c, g, or t
tggaaaaagtcatggaggccagggggttgggcttgaaaccagcttgggggggtccgatcccttcctttttggtctaaattttatgttatatacgggtttctctcgaatgtggtggtggataggggtggggggcatctccattattagctcacctccaggtttatagtggagggttctctcatactatttaggactttctcgctctcgaagcgaaggcttcctcaaactcagtaaaaatttatttaattatttacgtggcgtttatagaagaaacagtgaatgtgagccctacgagaagtgaataggagtgtttccagtggtgggtgtagtgccactcggggatagctccgagtataacgtctcggggcattcccggaaataggcccgagaaaaaggtgttgtggtgggaaagaaagagtgttagaatttatagcgcccggatgtgaaattattgaatagtgtgaacaatgtggatttgtggggccgtataggttgtggggacccatagggggtgtgtagccccgtggaggaaaaataggggggaacactcagcgagaaatttgaaagcgccctcctatatgtgagtgggccaaatctcaccggcctcctatattgggattagcgacccaatttaggtgggaacggtgggcgcataccaaacggttacgaaaccgggttgctcggtgataagaacacgaggaagggtcccanaagtgggaatggaaggttccgggcgtcaaataaccatatggggcccaggtccaggggcgccaacctaaacggggtggcaacacacgcaacacgatgggaaatcccctaaagggggctccaaaagaagccactggggcaggcaagaatcccattcccaaaaattgcggtctcccccggggggacgctggctgggacagaatggttccaaggattcaatatattnatccttctttgaggagcgccccggggtgagagggggaatagaaggacgaaaacgaaaaccatgggcggcaacacgcggcggggcgggcggcaacataattggcccccgagggtgtgcgccacaacagtattttattacccccataactgcgcgggcactcttattttcgcgcgccgcaacctcccgctgtttttaaaaccccccggcgcgggggagacgccccccgtgatgcaggcccccgccgcgctgataatgcccgcccggggacaaacaacacggcggcggcacgccgtgtagaagcccacccaaatatcttccctttaaaaaaaaacacccggcgagagtgcgcgcgtgcacaccagaagtggcgcggagtcgacctacctgcagcaaaggttctaatcatgtcggtggaggcgcccacacacgatggtggggcccaccacacgagttgaccgcgacaagaacggatgtgacctcccctcgagcgaaaagaagcatgcgagtcggtgctcaggcaacaccacaccgacgaacccacgctctctcacggcgacggcacacaccactctgtgtgcaatcccgctcagccgacagctcaagtaggtcgacccgcaccatcacgcgatggaatcgcaccaacgacagcggcagcgacgcacacga

SEQ ID NO: 685458 - DNA, 101 bp, Homo sapiens
agccatatacaggtcccgtatttcacgaacaagtcattattctacctttgcacggttcgggtaccgcggccgttaatcatttgtcgggtaccgagtctcga

SEQ ID NO: 685459 - DNA, 716 bp, Homo sapiens
cacactgccacgctggctaattttttttcgtattttagtagagacgggatttcaccatgttgcccaggctggtcttgaattcctgagctaaggcaatccgcctgcctgggcctcccaaagtgctaggattacaggcgtgagccacccacgccactgtgcccggctgtagctatggtttcaaaagaatcacctagtatacctttttctggtggggagggagtctcactgtgttgcccaggctgaagtgcagtggcacgatcttggcttctcggctcactacaatccccgccttccgggttcaagcagttctcctgcctcagcctccggagtagctgggactacaggtacatgccaccatatctggctaattttaggtatttttagtagagatggggtttcaccatatgggtctggctggtctccaactcctgacttcaggtgatccacctgcctcggcctcccaaagtgctgggattacaggcttgagccaccgtgcccaattctagtatactcctttttatatggtagctgaaaggtatcgtaggtgcctcagaagggaacaggttgtaacagagtcaagccgcttggacagcccatgttcaaccacgctaacttctaacatgctggatagcacctttttcccactatcgcacaatctacgcacctcctatcacacacttggacataccttacagtcccccacaataaggttgtca

SEQ ID NO: 685460 - DNA, 446 bp, Homo sapiens
  misc_feature (5)..(5): n is a, c, g, or t
  misc_feature (21)..(21): n is a, c, g, or t
  misc_feature (214)..(214): n is a, c, g, or t
gccangtaaaaattttgaaangcccaaaatatatgtaatatcccagttataatattgacaagtagccttcctcagatcacagattttaaataactcaatttagtgagatcctaaaaattttatttaaagtataaaaactgtggctcacacctgtaatccccagcattttgagaggctaaggtgggaggattgcttgaggcccaggaatttgagnccaggctgggcaacatggtgagaccctgtgtctgcaaaaaaataaattaaaaaaataggtggacattgtggcatgctgctgtagtcctagctacttgggaggctgaggtgggagggtcacttgagcccgggaaatcaaggctgcagtgagctgtgtgaagccactgcatcccagcctgggtgacagagtgaggccctggctcaaaagtaaaataaataaataaaaagtttta

SEQ ID NO: 685461 - DNA, 136 bp, Homo sapiens
aagaccaaccacaacctcaaaccaaaaaccacaaacgcacaaaccaagcacaaatactcgacaactccgaatgacgtcatataggcctgcttagagcgaacgacgagcgccagcgaagtagtgagcgaggaagcgg

SEQ ID NO: 685462 - DNA, 495 bp, Homo sapiens
  misc_feature (344)..(344): n is a, c, g, or t
  misc_feature (357)..(357): n is a, c, g, or t
  misc_feature (391)..(391): n is a, c, g, or t
  misc_feature (432)..(432): n is a, c, g, or t
  misc_feature (473)..(473): n is a, c, g, or t
tactaaaaaaaaaaaaaaaaaaaaatatagccaagcttggtggcgtgcgcctctataatcccaactacttgggaggctgaggcacaagaatcgcttgaaccctgcaggcggtgaacagagattgagccaccgcactccagcctgggtgacagaccatgaccctatcttcaaaaaaaaaaatgcttttgtagatcggaaacagaggtttcagagaggttcggtgcctccaccaggtcacccggctggaagtgacaaagctcctgccacaacagatctctctcttgctgttatttcccagcctctggggattggcctccctagaggaataaccccagtgcacccanatgtcatctcgangtggatcatgttcttcttgcagcctgtaggctanagcatggtgcctaagccagtgtgctgtgcctctgggttgcnttttgcgtggtctcgccatgagtccgccctcgagcacctcntcctcaggtcactgggctgggg

SEQ ID NO: 685463 - DNA, 102 bp, Homo sapiens
accgtatgtgggctgactggcattgtattagcaaactcatcactagacctcgtactacttgacacgtactaccgttgtagctcacttccactatgtcctatc

SEQ ID NO: 685464 - DNA, 302 bp, Homo sapiens
  misc_feature (13)..(13): n is a, c, g, or t
gggtgactgcacngctctccctctgtgccctgggaagttacagggccccctgagctccacagcatgttggtgacatttgtccacaacacaccgatgtgacttgttcccaagtccgtctccctggcagaccccgacctcctatggggtgacagctggggtcttggacatgtcccattcctaggcttgctcagctgcctgggggcacctgtccaagtttgaagtgacagtaatggtggtggctcctgtgtcaggaaccatttgtgatacagcaagcctggggtgggtgagagcgtaactcctcg

SEQ ID NO: 685465 - DNA, 102 bp, Homo sapiens
ctcacgagtgagtgtggggggtgagctggaaagcacagatcagacagcactgtggtgtggctggtgtacctgggcccaaagggggctggaggctccatggtg

SEQ ID NO: 685466 - DNA, 290 bp, Homo sapiens
tccctttcgcaatagacccagtctttgtcctcgaggctcccaagggcggctggtcttcattcccagctctatgtgttctgtctggggtaggttctccactgccttcttggcaaaaaggttggccagaaagctacttctatgtacttcagcttctgggccgcctgggtgttggcaccaatctgcagacacccaatctactggttgtaccctggccagtgtgccaacccttccccattggggttcccattgcgagcccagttgggccagaatttcatcaccatcttgctaag

SEQ ID NO: 685467 - DNA, 459 bp, Homo sapiens
tgcactgaccatcacttggtccttctttccctgtatcccaaatgaagcttttaatcaagaaatcctttcagccaacatgtgcctaggattgtcagagccttgtccctagcccctggggcagatactgtaactctgcctgctacaggagaagttatgtgtgtggaggaactaattttgcatgtgatgcaatgtaagaaggcccttcttgtcccaagacccagggtatgctggctcctgtggacagttggaagtttgcttagggaaactttaagcaaggagactttagaaacccccaggatgactcatagcaaaacagatatttttcttctacttttagaattttaaagagcattttacaaaagcaaaactcaaagtgtagacatgtcattggcagtgtgataagagtattttcactattctctaccctaaacactactgccagatttttaaaatcttctt

SEQ ID NO: 685468 - DNA, 431 bp, Homo sapiens
  misc_feature (17)..(17): n is a, c, g, or t
  misc_feature (27)..(27): n is a, c, g, or t
  misc_feature (55)..(55): n is a, c, g, or t
  misc_feature (86)..(86): n is a, c, g, or t
  misc_feature (139)..(139): n is a, c, g, or t
  misc_feature (148)..(148): n is a, c, g, or t
  misc_feature (176)..(176): n is a, c, g, or t
  misc_feature (194)..(194): n is a, c, g, or t
  misc_feature (301)..(301): n is a, c, g, or t
  misc_feature (342)..(342): n is a, c, g, or t
  misc_feature (389)..(389): n is a, c, g, or t
cttccaaaaggattttncccaagggantgagggaaagttgcaaaaattcaagaanggctgtggttgagattggcaaacaactttanccctgggtgtggatgtggatgacattgagtaattccctagagggggttccctnaggaattgnctaatgggttgctgttggaactggaatnggagtgcatagctgaagnagaggtaaagaaaaagaaagtgcaggagaagggaaaaaaagaactcccaagaatactcacagtgatgggtttagcagaagcttcttcagactccaacaagctccttnagaagtctgaaaacatggaccccaaaactgaaaggttttcnctaatagagaggaaagttcatggtgcattatctgcctacaagcaaanccaggattcaaaaaaccctttgagctggagcttcaaagcaca

SEQ ID NO: 685469 - DNA, 188 bp, Homo sapiens
agcagtttgtgcctcccagtctttcacacaccatggttcttcccaggtccatgtcatttagtgctttgcttcagcagccatcttgcacagcacttcaaacaagtgtcaataggccatggtttcaaacattttcacaccattccaagtcaggagcacaatcatttccatgctagtacagcagcattcca

SEQ ID NO: 685470 - DNA, 390 bp, Homo sapiens
catagaaaatacacgaattggtccttggccccagaatgagattaaaaactggctgggaattgatcttaaccccaaaaaactcagacgggtgtcgggaacactagagagggcgggtcagtacccactcgggagcatttctcatcagtagtccacattacaattcatccatccttggccattagtgtcattccttcacagtgaacactcaggggcccagggcattttattgggcattacctcccaggggtggcaccaagctaggtgctattggtcatcggctctgtgtcacaccagagaaccaggctacaagagaaaaagcagaggccaggagttggagggagaattagtcgggtgaagaacccggtatccataaagacccggattccatta

SEQ ID NO: 685471 - DNA, 1449 bp, Homo sapiens
  misc_feature (1331)..(1331): n is a, c, g, or t
tggaacttaacagatactttattggtcacctttcacacaaagcacacctccagtcctttaatgtgcccagtgaaactaattccacagtcagaaacatggctagacactttattggaagaaattacttgtaatagagatagtttgcaatgttgtatcaagtatgcatgttggtgaacatgaggattcaccttagaaacatatgtcgaagaaagtttacttacttagaggagacacctttccgtacactattgagagtaaaccaagtataatgtatgtggtgtgtttgtggtataaaatgatattctccaatggggcactatcggtaccaaagcagcagttacgtgccgcccgcggatttgacattttagtgaccagcggtggtgaccttaaggaagtggaaaccttttaagagggtaaagagtctcgcaattataagggtgtagaccttcgttcgtggcagaaaatagtgcagcgaaatcttcaaggatagcgcgcttaatattgggggttgaagtgggacaatacatgggaatccataagtgctgcaaactcctggaaaaagcctttggaacgacggggccgaataatcacgatatagcatggatctcatgaacatagtcgaagattaaaagtgtgtagaagctaataaggtacgatgttcagcgctattaagagttaaaggtatatgggaaatttgcgtgaacgtgacgcgtgggtaatccgagtctgaagagaacaaagatttccttcccttgtataactcgtatagttttttaagcttggaagattggggctcaggaaagagaaatgggggaaaggcgaaaaggtgtggcgatgaatggccatggaggtttaaattaacgccacgtggggctgtcagacaaatgtaacccaacgggttaaggcagcggcgttattagacgacagggccacccacaggctaatgtgcgggaacagcgggacacaacaaggccgctctacacaaagggctatagaccaccaacatgttggaggaaaccgtcgcagagaggagacccgcccaaccaacatggcgcggcgccgacaaacaacaagagaacccggcgcacaacgtagagatctaaaccatgtcgctccgcacagggaaaccctactcgaagacgagaagaaccctgaaggggggcagagacccctgacaaccggacccaccggtcgcacacacagcgcgccgcgggcgccgcgcgtcagagaggggaacacaaaacacactcgtgtcaccaaaacaacaagccacacaacacacaaaagaagacgacaacgcggccgcgacacaccacgagaccgacagaaancgatgacatgacgacgagagataaccacgagccaccggaagacagcccaggccgcaatcgctcgaacaactccatgcacgcagcgagagcagaagcgagacgacaccaaacacaacct

SEQ ID NO: 685472 - DNA, 1409 bp, Homo sapiens
ctttctggtttgtttactgtgtgtgcttctcctcctttgtcctctttgttgctcccttctgtgttggcgctttctgtttctgcctcgtgtttttctggtccgtgcgtattgtcttggtttcttcgtggcttacttgtgtcgtttgttttttgttgtttcttgttggtgtctcttttcttttcttccttgtccctctcccttctatttctatgtctaggtctgctttctggtccttctgctcgtctattcccctgtcttcgtgggtgtctttgtcttcactgtcttgtctctctttctttgaattgtggtctttcctctgctccatcctttttctcttgttcgatatacctctgtccccttcggtgtgcttgttgcacctctgtctgtttgtcctgtatgtcctccctattcttcttggccccctgactgttctgggtgtctcttccctgttcctatgtcttttccgtgcctcctctcattggctctctttaatctctcttcttctgtctgtgttgtcctctcgctgtccctttttctcgctttcttagttcatctatgtcgcctctcctcttgtgtttcttcctctgtgtttcgccttctttagggtccccgtacttgtgttggaccatgtctcgtctggcagcttctttgctcccatgcccccgtggtattggtcggcttctcagctgttgtgcaaccattccctctctttgtctgggattagatgatgacctgtactatctggtacgtgcagttttgatgcctccgtgtactctttacgataagtacatctagggatcttctctgtgagctcaaagtcgatggtctctcctatggactctccccacctctctgttgtactagtgcctgtccccctattgttcttcttgtctcctattgaagtgtcatgcggccctcccatcactggaatgtctgtctagtggggtgtctctggggttggattagaacactaagacggtgaacatgtatgagctgtgtgcacgcgtgtgagtgtgcatgtgtgtgtcgtgtgcaaagctccatgccaccccgtcctacagcccgcaaggtggtgtctggcgcatttgcctgacacaccagccccctctcctcctgagccattgtgggggtcgatcatgaatgtccgaagagtggccttttgccactgtagtcccatgcgccccctttctagtggctggatggggagacaggtcagggccctccaccctctgcagcgcttgcagacaaatgactactgcacactggacagcatcctcttttctagaagtctatttatattgtcattttataacactctagccactgcccttattgggggacagatggtactgtcttgcggggtggcctaggcagaaccactgccagaagaaccagttcctgcatacccg

SEQ ID NO: 685473 - DNA, 215 bp, Homo sapiens
ccgactctgggcttggaggtaagctgggcaggtcagtggatgcgaggtggttgatcccattctgtggcatgtggcacctcctccacgttcccgactgaccctaaaagcttcttgcaagggcagtggcgccatcattctccagattggttgctgccagccacaaagaccttcagggccagaggcttgccttgtgccctgcatttccggtgactttc

SEQ ID NO: 685474 - DNA, 677 bp, Homo sapiens
tgtggaagaaagggtctcactctgtcacccagggctaaagtggcgggggaacacttatggctcactgcagcctcaatatctcaggctcaagcaatcctctcacctcagcctcccgagtagctgggaactacaggtgtgtgtggcaccaccatggccaattaaatttttgtgattttatggaatgagacaaggtctcgccatggttggcccagggctgggtctatgagctcatgggctcaagcaatcctcaccacctcggcctcccaaagtgctggggaccacaggttgtgtgagcatagagcacctataccgtggttaccttagtgggtggactataagcgatgaacctcccgaggggtgtataacccttcgaagatcaaatcacatggatacagggactctatcagagtgccctgggatccttctttccagcctcatagtgaaacagcatcaaagatccgggtagacgggaacagagtaacacaaaccgccataccccaaacggggaggcaatttgcacgaatgcttgagaatggtacacaacgcggcagcaatgggggaagaatcaagcgaagttctcccgggtagggcaatcgggggacacgatctcacatgaaggaaaccggactctcacatgggcctagactgggacacaaatgcacaggtatccttggatc

SEQ ID NO: 685475 - DNA, 213 bp, Homo sapiens
acgtaatccattgtccctgacatctaccagacatcccctgttgtcagagaagaaatggagaaagtataagctggagaaacgctatcagtcaatgaccccccggacgttctggacaggcagaaatgccttgttgccttggtgtacctccgacacgccaagtggttccaggccagagccaatgggctgaagtcttgtgtcattgtgatccgggtc

SEQ ID NO: 685476 - DNA, 301 bp, Homo sapiens
ttttataatatatttcaagcatgttcataactgcttattgaagcactgtcatgatgactcctttaaaattagtgtcaggacaaggtgccatgactcatgagtataatccaaacactttgggaggctaaggcaagaggatcgattagcaccaacagtttgagaccagcctggacaccatagcgagacctcaggaggatgaggcgggacaatcattcaagcccaggagtttgagaacatgctgtgagcaatgaacacatgccactgcactccagacctaggtgacagagtgagactctgtctc

SEQ ID NO: 685477 - DNA, 853 bp, Homo sapiens
  misc_feature (272)..(272): n is a, c, g, or t
ctaatcgctttgtggtagctgtttgtcgccgtggtggactctgtgttgcagaccccgggggtaggttctcgcatgtcccatggggagcgtgcgttcacgtgcgtctcggaatatttcccggtgcagtaggtccccccgccgtgctcggtgtttttcgtgggccccgccctgccctccgggtggttcttcagccccggtggggccccatcccacggtgtgggtaccccactcctcgtgtgtgtgtgtcctccaacaccggttgtgcgtgtcgncccgtgagtccacgcacctatttggtggcccgcggtttgtcatccgctgccgcctatttgagtgcccttggggtgcacccccccccccggtatagtctgccagattctccgtgcttctccgtgtggcctctgcgcatctatcttcatcaccagcatcactatcatgcagccccccggtttgtttcccgcccctttttgaacgccgggcaattttggcccggcaccacatggcgtcacattccgcgtagagtcccccccacccctttgaagagggttgatgccgcgggccgtatctaccgatggtccacaggatggtttgatgacctccgtcctgactcaacactggtggaaccccacttttcctatcccagaataccccacaattattgttgggccatgtttgcgcaatttcctgtaaatcccacggctatccccatgagcgctgatgcgcacagaatgaacctaccattggaccacccggaggcgcccgatctttccacctgatcccgacgattatgtgcccctggatactccacccctgggtgaccacggcccgcagacatcccctctccaaaaaaaca

SEQ ID NO: 685478 - DNA, 733 bp, Homo sapiens
tgtctcgactaaaaatacaaaaaattagctaggcgtgatggcgcatgcctgtaatcccagctactcaggaggctgaggcaggagaatggttgaacccgggaggcggaggttgcagtgagccgagatgcaccactgcactccagcctggccaacaagagcaaaactctgtctcaaaaaaaaaaaaaaaaattagccagggggcgggctcatggccggtaatccgggcccttggggagaccaagggggggggatcacctggaggtcaggagttcgaaaccagcctggaccaattgggtggaaaccccggtcctctatttaaatacaaaaattagctggggcgtgggtgggcacacaactggtagtcctagctactcaggaggctggagacagggagaatcactggaacctggggaggcggaggtggcagtggagccgagattatgccactggtactccagcctgggcgacagaggagactcccattcacaaaagaagaaacgccaacacaacaccacaaaaaaacttgtggggggcacggcaggggcccgaaaaaggttttcaaaacccactcggggggggcgcgggggccccaaggtatgaacggggccaccggggtcaaagaacactcggtccacgacacggcgggtgtccccaaaagaaaccgcgggacaggcgcgtcggaccacccgaggggtcggggggcgcgggtctcacaaggggcccagcggcatta

SEQ ID NO: 685479 - DNA, 827 bp, Homo sapiens
cgcacggcttgaaggactttctttgcgaaccattgcgcccccttggcagtcaaatgtagcggtttatttatgaaggggggaataaaccttattgagagttaccaataaaatagagaaccactgtggggaagaaccatttggacctcggaattttgagggacctttggaccttgttctggggtgaccgtgcaccactagggatgtgatccccctgtggccaggtacagcataaattaggagttaggctttagcataaatttctagcgcatctgagtctcctgggatgggtgctctttggctggttttggctccggatggtgagatcagagccagctctttcctgctgctggcccccgccaatccagttgttgggatgccccagtgccagatccactaagtagtaagattttaatccaaaccacgacccaggtcccgaaaagccaggtcatgagtgtgaaattttccaatttacataaaagtagaagtatagaccagtttaaccaatttggtattaaaggagaggaaattgtagcagcttttcacagtttccccgtcccccaatagagggccgttgagacccttgtacctggaccaaccccttttgcactccagtgctttctgatgcccttaggagaattgttttgtttcaccaaagctgggaaggaagaaggcccttctgcagctgttagatctgcctctcagggaaaagtactaacttgttctttttgttcctggctttcatccgtttgtgagatttctctattttttttaaatataattttatttctttccaccaatataaataaaaaaccactttgggaccatga

SEQ ID NO: 685480 - DNA, 235 bp, Homo sapiens
tttcgcgatgcacgacatgatgccgatgcagtctcaaggtggatcgggcggatccatgggcggcggcatgatggatgacaacatgcgcatgcagcagccgaaccagcccggccagacgggcgggacgggcggaatgcaaccgcaaggatcgatgggccagggcggcgcatccggtcagatgggcggcatgcccccgcaaggtcagagcggctcgatggggagcggcactgcgttg

SEQ ID NO: 685481 - DNA, 180 bp, Homo sapiens
aactgcgctccagcctgggcgacagagcaaggctctgtctcaaaaaaaaaaaaaaaaaggttatgggttttggggcaaaatcctaaaaaataaggcggggaacactggctcctgcctttaacccaaaatactcaggaggctggtccaggaggtttgtttgagcccaggagtttgaaacca

SEQ ID NO: 685482 - DNA, 205 bp, Homo sapiens
  misc_feature (42)..(42): n is a, c, g, or t
  misc_feature (70)..(70): n is a, c, g, or t
  misc_feature (78)..(78): n is a, c, g, or t
  misc_feature (104)..(104): n is a, c, g, or t
  misc_feature (140)..(140): n is a, c, g, or t
  misc_feature (147)..(147): n is a, c, g, or t
cgactgataaaggcatgaggatgtggcctgcatgctgcctgntcttcctagaaccggctgcacctgctgntctcttgnttatgcaaactggctgcacctgctantcctttgcttatgcccctacccctggctatcctaantccctgntctcctgcctcactattactgtattctctacttctaaataaaaataaaacaaaataca

SEQ ID NO: 685483 - DNA, 475 bp, Homo sapiens
gcattttacagagtgctgattggcgcatttacaatcctttagctagacacagagtgctgattggtgcatttttacagagtgctgattggtgcatttacaatcctttagccacagagtgctgattggtgcatttacaatcctttagctagacacagagcactgattggtgcattgttatagagtgctgcttggtgcatttacaatcctttagctagacacagagcgctgattggtgcgtttttacagagtgctgattggtatatttacaatcctttagctagacacagagcactgattggtgtgtttataatcctctagctagacagaaaagttccccaagtccccactcgacccaggaagtccagctggtttcacctctcactagtaggaggagattaaaaacgaatgccaatcaacataaattatagaaatctatcatggatatatagaagacgacttattatataagtagtct

SEQ ID NO: 685484 - DNA, 449 bp, Homo sapiens
  misc_feature (161)..(161): n is a, c, g, or t
  misc_feature (243)..(243): n is a, c, g, or t
ctcagagcagtatgtgcatgagatgtcatctctaggcacaatgcctcttctgatacctcgaaaggcctgcttgaggctgtttacagtactagtttttgttttgttttgtttgtttataagtagaaggggctggtgctgtggcttatgactgtaatccagcnactttggagctgaggcagaagatcactcgaaccaggagttcaatccagcctgggcaacttagtaagaccctgtctcaaacanaaattttaaaaattaacctggcctggtggtggcacctgtggtctcagctacttgggaggctgaggaaagatcatttgagcccaggaggtcaaggctgcaataagtcttgttcacaccactgcactccagcctggacacagagtagactatgcctctaaaaaataataaataggaaacactctagatacggttatattatgtatatt

SEQ ID NO: 685485 - DNA, 295 bp, Homo sapiens
tacaaagcagataacataatcatatacataaaaacacattaaaactaataaacacgtacagcaagactacaggatacaaaatacctacacaaaaatacagatgacagtactatatgctaacaatgaacaatccaaaaatgaaattaacaaaacaattccatttaaaatagtacccaaggaatacaatgcttaggaatacatctcaccaaggcagtgagacttctatcaacttaaactataaaacatagtataaaaaaattaaaaacctagggaggctgaggcaggcgaatggcgt

SEQ ID NO: 685486 - DNA, 295 bp, Homo sapiens
ataacgtcgaccaggtaggagtgcagtggcgtagatctcggcttactagcaactatccagctcctgggttcgaacgaatctcctgcctcagcctcccgagcagctgggactacaggcgtagcgcacaccatgcctagctaattatagtatatagtagagataaggtaacaccatataggccaggctggtctaccaactcctgacctcaggtgatccacctgccacgacctcacaaagtgctgggattacaggcataaaccactatgcccagctaacaaaatagagtacttaaact

SEQ ID NO: 685487 - DNA, 794 bp, Homo sapiens
gagagagagagagagaggagaatgctcccttcagcgctatccgtcgcctgccacactgaggggctactgcggggtcactgaatgttgcctgccatccaaaggggatgggcgggattggaagaatctgtggcatctcttttccctgttcacctccctgtcgtgccaggggaagcggcagggaccgcgctctgccaaggggccctcgtgtgtattccctttctctctgagggatatgtgaatattttgtgtctctggtgcagtgtatgggcgagatagtgttccctgacaccgatgtgtgtgtatttttaactctcacgcgtgatcgtcgtagaagaggtgaccacgaggagtttctgtcagtagccaagtgctattcttcatacgctagttgttgccgatcgtccctcgttgttgccgtgtgaacgttgacgtagagcaccaacgtcgtgtctgtcctctcccccggtgtgcactattattacccccttctccactcttcttcccaatctcggttgcccgttactacccacctctttgatatcgatagtgagatttgtgataaatcttcatagcctcgtttgtactcttgttgatagaagtagttgtaaacatttgtgtttcgtttcgtcgttgtagaaaccatctatacatttgtactattgcggacgggtaagagggatgtcgtccccatgttgcatcccgtgtgtcacctccccttttaatacgccaatcacgtgtctatgtttctgtgtacactcagtgttaaggtttggcgcctctcttgctccagtggc

SEQ ID NO: 685488 - DNA, 116 bp, Homo sapiens
  misc_feature (46)..(46): n is a, c, g, or t
  misc_feature (84)..(84): n is a, c, g, or t
gaaaagagtgataggacaagaccacgacttttcagaatccagtgangaggaggcgcccgcagaagcctcaagcggggcactgcnaagcaagcatggtgagaaggctcctatgaaac

SEQ ID NO: 685489 - DNA, 247 bp, Homo sapiens
tggcaccaggttgacataacaagaaactgctcgccgagaagactagaggccacagctgtaaaaatcaaaggacctggacggtgcttcatacccgctctagaggagccggttgctgtaatcgagtaaacccctgatcaagcctacaccgactctcttgctcagcctatataccgccatcttcagcaaaccctgatgaaggctacaaagtaagcgcaagtacccacgtaaagacgttaggtctacctgg

SEQ ID NO: 685490 - DNA, 1262 bp, Homo sapiens
ggttgtgtggaaaatccagtatgctcctcagaaaagatgatgcccgtggtgatcgatgacactacatacggcccgacagcaggatgagatgctggggcttcaagagtaagctacctagcagtcagaagccagcaagaggaagatctcgagcataatgaatgtgctctgatttcagtacgaaactgtccagaactgcaattgtccctcgcgacttctatgacctaatctatgtagaggcctagatacaaaattccctcagcgtttgatggtacggttatctatcgatgtggctacacaaaactagcggagtacacctgtgtgtgcgctcggagaccgagaatgacgggctgaacactcgtcgtgagggacgccatggtacgacaaccacgtatgaggacactggacgcgattctgctcgctcctacaaatcactatgactgtgcttcgagtatcatgatcccagatgaccatcgcatcgaaggttcttggaggaccatttgccgatgttgtcggtacaatctcctaggtaggccttagaaattttgggacagctaggggacatgggctagtcgctccgagggagtgaccaagctttcaagacgagcagctggcaagcgagcctgcctggaatcagtacattccgggagaactaggtggaaccaaaaaattcctgttcagcactgggccgaccaggattcccaatcctgggacagaacggaggaaactaccagggagtttagccaagaaagatggaccagatcatcgaaggtaacatgaaggccacgtttagttactggagtgatccagacaggaaacagttacttttcagcaatgtgtatgcgcctggaagatgatcctgagatgaaggtggagcgctacaagcgtcacctttgaccaaaaatgaggacgctagggttcactgaccttgaaaacagagggctttgaggcatggcttgggtccgcaatgggtagcagtgggttgctccaagggccagctccagcggtgatacttcctggagggctatgctattcagacagtttggaatgaaaggcaaagggccggagaagtttttttcctcacaacacctgtcccaagggtgtgcgaggccacaatgcactggcccgaaaacctggacacaacttctaaacctctggacgcgaccgggttagccaggtgtctatgcacatattgggaacttacatacaatgaaaacacaaaaacagggatgctacaataaacgagtccacacccataaggtatg

SEQ ID NO: 685491 - DNA, 919 bp, Homo sapiens
gctctctgtgtgggtcctgtagacccagagaggctcatggtgcactcgacccggctgggagagctggtgtgtggggaacatggcctgggcctccgagtgctcctgtctgctgcccctgcttctggctgctggctctgctggcctgcctgtgggccctgtgctgcccaagggaggacattctctgtccttctggccagactgatgtgtgacatgcccaggtcctccccagaggtgcagcagtctcgcccaatgcacgactgtccccgtgggagcctccgtcaacgtctacctgctccaccagcgggggcctgacgtgggatctacctgaggcagactctgggacacaggacccaagacatcatttagctacgaggacggaggtggttgcccactacaggacagacggaatccgtgggccacaatcgacttctacagggatcccagtgacaagcctgacttatcacgcatgcaacctgcctagcagctgtcggacaacttggcaccgtacaccatgccaagtgccatcacaggaggtcaatagtcataacgtgctaccgagcaacccatgggtcacgtgtgtgacaggaatagagacaagttcacgcaaagggaattgtgcgacaagaatagcttctggaacgacatcacaatacaaagtgtgacacatagttggcatgccaattcgcaactttgtcgcctaaaaaactggaaccaagaggtgatttacagggagcaccaatctcaccattgaaaaacatctggcagatgacatcaaagtggcgatactatgtaccccacggttatacgttagaaaaagcaccgtgcgaaatgaaaagagcctaatcaagcgccacgattagagccatgagtagtggacacaatgcggaacgaggcgacaacaacatgaagatataccctt

SEQ ID NO: 685492 - DNA, 707 bp, Homo sapiens
  misc_feature (548)..(548): n is a, c, g, or t
  misc_feature (597)..(597): n is a, c, g, or t
aaataaagtatttagtatttcttgtcagacaggtctggtgttgatgaaatccctcagcttttgtctgggaaagtatttctccttcgtgtttgaaggatatttttgctggatgtactattctagggtgttttcttccttcagcacttgaaacatgtcatgacactctctcctgacctgtaaggattctagtgacaagtctactgccagatatattggaaccccattatatgttatttgtttcttttctcttgctgcttttagggtcctttctttatccttgatgtttggcagtttgattattaaatgccttgagatagtcttatttggattaaactatcctggttttctgtaaccttcttgtacttgaatgttgttaagcttactacctctgtctctctctaccccctctttaaggccaataacttagatttgtcctgttgaggttattttgcagatcctgtaggtgtgctttattgtgttttactttttttttcttttgtctcctcaagttgtgtgttttcaaagagcctgtcttcaagctaattctntagcttgatcaattctattgagagattgatgcattctttagtatgtcangtgcgttttttcactctagaatttctgcttgattcttttaaattatctcaatctgttaatttatctatgattatagaattctgttcccggcaggtgctatgcttcaccct

SEQ ID NO: 685493 - DNA, 116 bp, Homo sapiens
  misc_feature (49)..(49): n is a, c, g, or t
gaccagcacgtgcctggcatgccccttctctgtgaaggtgacacgcganggccgggtgaaagagagcatcacccgcaggcgtcgggctcctttagtgggcaacgttggtagtcatt

SEQ ID NO: 685494 - DNA, 524 bp, Homo sapiens
agcgggcggtcctggacttcctcttgctgcaggacccggcttccacacaatctatacgagcacggcgtaactcaggcgctccgtacggcctgggtgcctacgccgccagtagcagctagggtcgtccagtagttatcccgtggacgggccttctggtgtcaagcttacggctgcccgtgcggagtgcctagggcctgagtcgctctcccagtgagccgtgcatgtacgccccgctgtttgtgcgtactggcgctctgattccgccttacaacatgcgcctccgacacccgttgcctggttgccccatgcgacactgccagacatcgcactagcgaccatctctatgttaatccactatcacccttgaccgaatccacaatcgctacgaccagtctttgttagcatcattaacccataggacaactcatcaaacagcaagatctcaaatatagagcgcgacacatgaatctttatgtaacataacgatcccatatcgatacgactctgatctgtctattataacg

SEQ ID NO: 685495 - DNA, 756 bp, Homo sapiens
acagggccctctggggctcagccctgagctggcgtcacctgtgcaggcctctggggctcagccctgagctggcctcacctgggttccccaccccgggctctcctgctcctgccctcctgcccgcctccctcctgcctgcgcagtccttccctaggcacctctgtgctgcgtcccaccaggctgagcagagtcctctcggggcctgtgcgcactagcctccctctcctctgtccccatagctggttgtttcccaccaatcactcgactaacagttacttcacaatataaactcaaagcaagctcttctcctcagcatatggggcagccatggcctctgtctcgtattagggaaaccaacgtcaggcggccgtcgcagacataccatctcggcgacctcggccccgtctcctgagcggtccttgactgtgtgacccggactggacccttgagcctacagccctgagaggccgctgcttgacacaaaacctgaatcccagaagccttcttgaagagtaacctcgccaaggcaggcgcatgagatggtcaactcacagaagccctcgcatcgactcacccggtgtgcttaaacccccgtcctggatccacatccacatccagcatctatgacgtcaggacttgcaccatgaaccactgaccaagtcccacaatcgcatgaccaccacgcgggaacgcagacttatacttgcaaacacaacagcaccacctctacccaaactacacacttatggaagtgct

SEQ ID NO: 685496 - DNA, 382 bp, Homo sapiens
acctcgtgcctccgggggtaataagcaattctcctgcctcagtctcccccgtccccgcccccgagtagctgggattacaggcacctgccaccacgcccagttaattttttgtatttttagtagagatggggtttcaccatgtcggccaggctggtcttggactcctgacctcgggtgatctgcccacattggcctcccaaagtgctgggattataggggtaagccaccgcacctggccgcaggtaagagtttttaaaggcaggagtcttgtaaagacagcaggggaaacacacacacagacacacacggaaaaggcaggggtaaatttcaggacagcagaggctacaggcaagaatcataaatcagtacaacctgccggtgg

SEQ ID NO: 685497 - DNA, 180 bp, Homo sapiens
  misc_feature (171)..(171): n is a, c, g, or t
caggactgtagtcactactacagaatctggtacagcaacatggtgctaccacaactttacacttgaaaagtgttaggtggtaggggggatgttgatggtgataatgaaagtgggccagccttatttgactgtttgcttagtaccaaggattttaccatgtgtgaactaccncacgtacat

SEQ ID NO: 685498 - DNA, 330 bp, Homo sapiens
  misc_feature (5)..(5): n is a, c, g, or t
ggaantggggaggtctcactcttgttaccattaggctgggagtgcagtggtgcggatttcggctcactgcaatctccacctctcgggttcaagtgattctcctgcctcagccctccaagtagctggaatgacgagcatacgccactaagcctggctaatttttgtatttttagtagagacagggtttcgtcaagttggccaggctggtcttgaactcctgacctcaagggatccacccgctttgacctcacaaagccctgggattacaggtgtgagcccaccatgcccaaccttaactttattttcatctaaaaagctttcaggcgaaaa

SEQ ID NO: 685499 - DNA, 392 bp, Homo sapiens
  misc_feature (325)..(325): n is a, c, g, or t
acaccacctggcatacctacctctacactgtgggtggattgcttacacacacagcagcacccacaacccacctcagcccctgtgcaatgctgtatggtagctggaggctagtgcactgtaggtctgttatttctactctagcaaagggaactagaaggctaaaggaagacagtggattcctactgcacagtgcagaatggttaggcaagacggtggaccttacaatgagttgccacctgaggtgtataactacttggggatccgtgcacgttaacgattactaggactatgcagaaaccagagagtttaagaataccgtattganaaaccccacatgaactactcccgtcttacccgacgctctcccctctattttctctttaagctgcgct

SEQ ID NO: 685500 - DNA, 796 bp, Homo sapiens
aaaaataaagaatcccgagagtttaattttgtatatctaaacagtccctcccgataagtatgccctgctggaaagcagttcttattgtcgctagaagcgtttttcccaacctgataacattaatacaggcaatgagctttcctctgccgtgggcctggtctcctagtaagcagcctaattgtttggtaattgttacccatagcaggagtgtgcgaaaaatgtgcatcgaggttatggtacagcgtatacacaatgggattgtatggttcattttcttccagtgtttaatcgcatgatctcgtgttaaccaaaggatatttgcagtatttgtgtacagtttcgtattacgtgcgatgtatcaagcagcgctatatagtgtgtcaaaacactcgaatacatagtcttggtcacgagcaattttatcttgtcaaggttgttcgcaacaactagctgcgcactattcgtaggagtcttagacgtcctacaacatatggagccggctcttgggattctgtcttggtgatctgatctacaggcgtcattctgtcatttggagtctcctagggtctcgcatcagatcacatgtctattttatgagactatagggcttctcagcaagaggttttgattattagagctattatatacaagagttgtgatcacagtattatgcatcagtcatcagaagcaggtgtattactcccctggtagtcgaggatgacatcctatattcttctgagtcgagtccacaagaatacaagcatatcgactccgatctgacaaaggacaatctctc

SEQ ID NO: 685501 - DNA, 508 bp, Homo sapiens
  misc_feature (441)..(441): n is a, c, g, or t
cacgaggggatgttgtcccacatcatgtcgacctggccggccagcagatcctggtgcgccggcgcgctgcccttgtacggcacgtgcagcaggttgaccttggcgagctgcttgaagagctcgccactgatctgcgggctggtgccggggccggacgatgcgaaggagtacttaccgggattctcgcgggcgatggtgatcagctcgggcacggtctttgccggcaggtcgaggcgcgtcatgaggaggttgggcaccgaccacagcatggcgatgccggtgaagtccttgccggcgtcgaacggcagcttggcgtagagcgtcggcgcgatggcgtggctggccacggtgtagaggccgatcgtgtagccgtcgggcggcgacttggcgatcgcatcggcgccgacattgccgcctgagcccgccttgttgtcgacgatnaactgctggcccgtcagctcggagagctgatggcagacgatgcgcgacagcgtgtcggtcggtccgc

SEQ ID NO: 685502 - DNA, 177 bp, Homo sapiens
gatgagccggtaccgaattcgacagttgtgcagggcaccgacagcttgatctacaagaatggtttcctcaacttggaccggcctttcttgggtttctctgaaccccttgccgcacctagtatgatggacttgctccaaactagactgtagtgatggcgcacagcttgttcgagattc

SEQ ID NO: 685503 - DNA, 395 bp, Homo sapiens
cccttttattcttttttcaactggcatggaattcagaaggtagcttttgttttaaagacaaaaattatttttgaagaaataatattatatacaatgttagtaatttttatttttgttagatgatgttatcaaattatgttttcatttaaaaaggaaagtataggtgggcgggtcacaaggtcaggagatcaagaccatcctggctaacacagtgaacccgcgaatttactaaaaatacaaaaaaaaattagctgggcgtggtggcgggcgcctgtagtcccagctactcggtaggcgtgacaggagagtggcgtgaacccgggaggcggagcttacagtgagccgagttcgtgccactgcactccagcctgggtgacttgtgagactccgtccca

SEQ ID NO: 685504 - DNA, 362 bp, Homo sapiens
  misc_feature (323)..(323): n is a, c, g, or t
ttatcaggaagatgatagtctgcccttcctcgggaagctctgtaccagtgaggtacgaacctgtgggcaatctgaacacacctataagatgtggtggaggcaagttgagaagtcttacctagtcaggacgaacaagaacagggatttgcttcaaaaaaaaaaaggtcgggccaggttttaatagagcagcggtgcggggcggggggtccactccagcccggggtccacctcagacactctgaagccctagggttgaaggggtggggtcacccaaacagcaaagatgacattctggtcctccccgggggagctctgactcgggnaggcctgagacctctgtcggccagagaccagcagtcagg

SEQ ID NO: 685505 - DNA, 502 bp, Homo sapiens
agcgctcagcaatagtacctctctcctctctatagcactcatcccttctgaggtgtcatttcaccagccacctgagtaagtgctccagctatccccagaaccagctagaaaacatcccaagccttggtcatgtatagcattcaatgtccagtgcatactcgagggctcagaaatcggtgggttagtaccactttttcccacttaccccctttatattccacaaggggactcacagccaagcaggttaactctcccctccctacccccaccaaacccgggaaaatcacagacagcctttttacagctcctctttctcggcccccttcttcgggaaggcagtcaggatgttaaagctcttcgggagctcctccttcttcccgtcactcatctggtccttctcaatcagccgggcgatccgtgtcatctctgatgctgggaagtcctcccctgggtctaagatcttccccatgatcttcaggtatggctcagcgctgggtaccga

SEQ ID NO: 685506 - DNA, 558 bp, Homo sapiens
  misc_feature (14)..(14): n is a, c, g, or t
  misc_feature (43)..(43): n is a, c, g, or t
  misc_feature (111)..(111): n is a, c, g, or t
  misc_feature (149)..(149): n is a, c, g, or t
  misc_feature (151)..(151): n is a, c, g, or t
gcgaattgccgagnagaagcgagggccggagcgtctcctcgantttcagaacgattcgcggggccgtgcactcttccaggatgtgcagaagccatctcaagatgaatgggntaaaaccccaggaggccatggaagctgccttggccatngntgaagaaccttgaatcaggccctcttggatctgcatgccctgggttctgcccgcgcggaccctcatctctgtgacttcctggaaagccactatctggataaggaggtgaaactcatcaagaagatgggcaaccatctgaccaacctccgcagggtgcggggccacaaccagcgcagactggcgcgccccaggggtctctgggcgagtatctctttgagcgcctcactctcaagcacgactaggaggcctctgtaccttccaaggggctcccccctctgctctgcaccagcccgccctgggacctccacctgaatgaacctctcaagccactaggcagctttgtaaccgccctggagcctctgtcaagtcttggaccaagtaaaaataaagctttttgagacagcaaa

SEQ ID NO: 685507 - DNA, 326 bp, Homo sapiens
gacgatccccttcgcggtatcataatggtaaacggggtttttttgtgtctctgtctcattcagttctgctctgatcttaggggagggcttgccttctgctaccttttgaatttgtttgctcttgcttctctagttcttttaattgtgatgttagggtgtcaattttagatctttcctgctttctcttctggacatttagtgctataaatttccctctacacactgctttaaatgtgtcccacagattctggtatgttgtgtctttgttctcattggtttcaaagaacatctttatttctgctttcattttgttatgataccgccaa

SEQ ID NO: 685508 - DNA, 354 bp, Homo sapiens
gagaaaccccatctctactaaaaatacaaaaattagccaggtacggtggcatgtgcctgtagtcccagctcctcgggaggccaaggcagaataatggcttgaaccggggagggaggttgcagtgagccgagatcgtgccactgcactccagcctggacaacacagtgacactctgtctcaaaaacaaagagaagaaaaaacttttattaggaatagaaatgttaacttggccaggcgtgtgtgctgaagcctgtaatcccagcactttgggaggccgaggcgggtggatcacgaggtcaggagatagagaccatcctggctaacacggtgaaaccccgtctctactaaaaatac

SEQ ID NO: 685509 - DNA, 184 bp, Homo sapiens
ccgggtaactgcactgaccttagggaatggcaggtcaagttcacttctggtggggatgagaagggagagagagctagagggacacagagaatgagaagagatggatgatctgggagagtctcactttggaatcaggaattggagatcacattctagtttatcacagccatacatgtacaggaca

SEQ ID NO: 685510 - DNA, 456 bp, Homo sapiens
ttttttttttaattttttgagattgacttttgctcttgtcacccaggctggaatgcagtggcacaatcgatcttggctcactgcaacctccacctcccaggtttaagcaattctcctccctcagccttctgaggagctgagattacagccatgcaccatcacatctggctaatttttctatttttagtagagacagggttttaccacgttggttaggctggtctcgaactactgacctcaggtgatccgctcgctttggtctcccaaagtgctgggattacaggcatgaaccaccgcgcctggcccccgttctccttactgggtatgttaaaattatttctttcaaaggaaaaggctggtcaaagtgcaacggtctttacaactaattgatcacaaccagttacagatttttttgttccttctccactccaactgcttcacttgactagcataagg

SEQ ID NO: 685511 - DNA, 155 bp, Homo sapiens
agtcgagtgttcgcagtgccggctccagcgcggggagcagctgggggcgttggggtgcctggcggctggggcctggttacttggtgacgtgcagcgctctctctggggggctgccgctcctcttggggggagctggcctcagatgcccccgtagg

SEQ ID NO: 685512 - DNA, 167 bp, Homo sapiens
  misc_feature (7)..(7): n is a, c, g, or t
  misc_feature (30)..(30): n is a, c, g, or t
  misc_feature (41)..(41): n is a, c, g, or t
  misc_feature (117)..(117): n is a, c, g, or t
  misc_feature (136)..(136): n is a, c, g, or t
  misc_feature (157)..(157): n is a, c, g, or t
ccttgancctggtccacggaccgtggggancgggggaaagnactcaaaatattggtcttggctcctcctgcccgtgcaggtccggacaggagcggcaggtagagcagctgcagcatngcccaccaggcatgaggcncggcagcagcaggctggtagnaggcggcacc

SEQ ID NO: 685513 - DNA, 403 bp, Homo sapiens
agatgtaaaatcagtgctggatcaagtcacagatgacattttaatcggcattcagaccgagataaacgaaaaactgcaaatacaggaagaggcctttaatgcacgaatagaaaattcgacaacggcttatggacttggtacaaggagagtgatgctaaccttcacagaaacacacaaaaccagccagaataacagactctctggcgcgtcgtgtctccatcacttagttgtgcaaggaaaaccaagctcaactttttatcttcctacgcacttcgacaagtcttggtccccacttcgccatctcccatcccacaccaccccctgactttattgcaccaactctaatgcgaacatttctgcatccacgagcttgaaaaatcacatctcaaaatccaattacacc

SEQ ID NO: 685514 - DNA, 504 bp, Homo sapiens
aattgatttctcagccttcctagtagctagaaaaataatttgacacaattctggtcaatgataaatgagttgaaatttgctgaatctaccctgtccccttccctttttttctaccttgaatgaagttctgatgtataggcctgaaaccaccatcttgtcaccatgaggtgacagccataaggataagaccaagaaaatctcagaaagtctagttcctaatatcatatcagatttaacatttttgtttcttttgatgtataggcctgaaaccaccatcttgtcaccatgaggtgacagccataaggataagaccaagaaaatctcagaaagtctagttctaatatcatatcagatttaacatttttgtttcttttttatttacctagcagttcatttatgcaccaagattcttgtccccaaggttgtaacttagcagatggagacagacattaagcaacagacatgataaacaacataattatacagaaaaaaaatagatgcagt

SEQ ID NO: 685515 - DNA, 197 bp, Homo sapiens
tagccatcccttatgtactcgatcgttagcaatccatgactatatattcccgacaggcagatcagtaataatatctgtgctaacccccaatttgtgatttttagtgagtaattttaccttaagaaatatgaaactctacctgacaaacatacaatgttttcttgttgccaacaaatatatagaagcataaatttgaa

SEQ ID NO: 685516 - DNA, 115 bp, Homo sapiens
ataaaatgcttaaagaggcgggtggagtggctcacgcctgtaatcccaggttcaaacaacctaaaaaaaagaactgaatttttttttaggagacagagcaagaccctgtctcttt

SEQ ID NO: 685517 - DNA, 179 bp, Homo sapiens
ggaacaaagaaaatgtacagagttatatgcgcttttttttggtatgggggacaagaaacacttaccaacaaaaatatttcaacaaccccaaaataacttactcacaaatatgcaaaattatctatggcatagtatttcgcactcgatgacatttagagataaaaaatcaaatggagctt

SEQ ID NO: 685518 - DNA, 118 bp, Homo sapiens
gcgacggcggcggcggctgaagggctggaggggtaggcttcctctcaccgctcgtcctccttcctcgctccgctcggtgtcagacgcgccgccgccgcgccggggcggacttctggcc

SEQ ID NO: 685519 - DNA, 117 bp, Homo sapiens
  misc_feature (28)..(28): n is a, c, g, or t
ccaaagtgctgggattacaggcgtgacnaccgcgcccggcatctgaactttgttttatttattttttttgagacagaatctcactcctgcctgggtgatagagtgacactccttctc

SEQ ID NO: 685520 - DNA, 543 bp, Homo sapiens
gcacgaaccctatgtaaatggtatgggccagagatctaggtgtgcactcctcctgagaatctaatgcctgatgatctgaggtggagctgaggcagtgatgctagtgctggggagcaagctgcaaggtacagatgaatgttagcagagaggtttgactccacagagaccataataatacatcagttgcttgcagactcatcagaactctatcagtgagtggcaagtgacaattagcctgcctctggtggcaggctttatagtggcaagtgagctgatgtacttcaattgtacagctgtatctggtggcaggctttaagtcagaatccaacacttatttcagtccgtgcatggcctgcccgttattttatttaccactgccatccacatctctttcccacactgtgtacttgtctcagccatggtttgggtaagcccacccaccaaccctagccaaaatgagtaaaaaccaaacgtcactggagagcttctttgaaaagggggagggacccattgatgagacagcagaacacgccaagactgaca

SEQ ID NO: 685521 - DNA, 488 bp, Homo sapiens
  misc_feature (129)..(130): n is a, c, g, or t
  misc_feature (133)..(133): n is a, c, g, or t
  misc_feature (137)..(137): n is a, c, g, or t
  misc_feature (145)..(145): n is a, c, g, or t
  misc_feature (148)..(148): n is a, c, g, or t
  misc_feature (162)..(162): n is a, c, g, or t
  misc_feature (168)..(168): n is a, c, g, or t
  misc_feature (174)..(174): n is a, c, g, or t
  misc_feature (178)..(178): n is a, c, g, or t
  misc_feature (184)..(184): n is a, c, g, or t
  misc_feature (193)..(193): n is a, c, g, or t
  misc_feature (208)..(208): n is a, c, g, or t
  misc_feature (219)..(219): n is a, c, g, or t
  misc_feature (324)..(324): n is a, c, g, or t
  misc_feature (331)..(331): n is a, c, g, or t
  misc_feature (349)..(349): n is a, c, g, or t
  misc_feature (388)..(388): n is a, c, g, or t
  misc_feature (439)..(439): n is a, c, g, or t
  misc_feature (479)..(479): n is a, c, g, or t
tcacggtgacagcagaggcagtcagtcaagcatcatcacatccggagaactcggaggaagaggagtgcaggccattcaccatccctcaggtgctgagaaccaaagtgcctagagaagggcaggaggagnntgnccangatcaggnagncgatgctgacgagnaggctnccaagnccgnccattntgttcaggnccctgcagtgctganagagaaggcanaagccaggcgcatggcctttctcgcaagaaagggtaccggcatgacagctcacagcagtggccggcagcccccgaggccatgggcagagccgtagacaacccatnaactcangaagaatgaaccaacaangtacaagaccaaccacaccggagaaccatggccgaccgnaagaggagcggcatatcccatcctgagacctgtcagggccagtggggcagnggaccagactcccaggccggctccatcgctggggcctctnactggggcc

SEQ ID NO: 685522 - DNA, 166 bp, Homo sapiens
cagatctaatcggccgcctttttttgctagactaaggtagactttgctgtatcttactgactacgttgatagattactccgaagtacttctccaagctctataagaaagtgtgacaaacctatgtaatatactaggattcagttataaccagaggaggacaaacac

SEQ ID NO: 685523 - DNA, 1226 bp, Homo sapiens
cggtgctgcaggaatcggcacgagaagagtctgaacgaccaacctgaaattgcagatgttggttctctgatgagtgcagaagaaacgaacaggatggttgacacagacagcagacacgaagaacgacttacgtgagaaacgcaccctactgcttcaacgcacagaagcgtaccacaacaagaccacaagcgccgcatcatgggacacgcagcaacagtccccggactgcagtcattcacgttaagttgcagtggagcttacaggtagatacatatcgtcattacaggcagccgatggaaccccagttgcagcttggcgtcaacgcatcgacctatgtgacgcatgctgcaacgcgactttcgtaccaagggtatgacatgcgcactccgagtagtggacataatccagacatgcgcgccgatacataataatatgagtcgccccactggcacggatatcatacgcctatagactgcatacttatgagctgttggacacacacaactgcaacacgcaacacaaggcaacgccattatgtcccaccattagtagtagttactgcgagcagctattatcgatacgcatatgggattacactaggtgcagagcagcctcaaatcaccctggcaatcatcattgaaactctccatatcagcaagtgggtaggtatgacctcgtgcgggatctttcgcctacctaaaccagtataccacgctaaaggatagttcggccaggcaccggcacgaagttattgccaacgacgaagtaccaggacagaaatccagggacacacgacatgcgctagacactctgattagttggaactgggcgggacgactaagagagaacctaccgacgcacaacatcctaattggagccggatctactaccgttagacggttggacatcactgagcaagacttccaactccggagcgaaggctgactcagcgtgttactggtccacaaatcatgcccctgtggactcaatggtgaccaccaggactatgtcacagaactgaagagaaccacaacaatcaattaatcactggtggactggccgggagaagtcgccttatgacactggacctgtataagtgcactaatacgccatgagatacgacaacgcgcagcacgtgacaacgtaaccaagcgtaccctgcaacacaggaacacgtgcctagtcaacaagggagtctccagtcatctattttatgcagcgtcccg

SEQ ID NO: 685524 - DNA, 552 bp, Homo sapiens
  misc_feature (193)..(194): n is a, c, g, or t
  misc_feature (197)..(197): n is a, c, g, or t
  misc_feature (201)..(201): n is a, c, g, or t
  misc_feature (209)..(209): n is a, c, g, or t
  misc_feature (212)..(212): n is a, c, g, or t
  misc_feature (226)..(226): n is a, c, g, or t
  misc_feature (232)..(232): n is a, c, g, or t
  misc_feature (238)..(238): n is a, c, g, or t
  misc_feature (242)..(242): n is a, c, g, or t
  misc_feature (248)..(248): n is a, c, g, or t
  misc_feature (257)..(257): n is a, c, g, or t
  misc_feature (272)..(272): n is a, c, g, or t
  misc_feature (283)..(283): n is a, c, g, or t
  misc_feature (388)..(388): n is a, c, g, or t
  misc_feature (395)..(395): n is a, c, g, or t
  misc_feature (413)..(413): n is a, c, g, or t
  misc_feature (452)..(452): n is a, c, g, or t
  misc_feature (503)..(503): n is a, c, g, or t
  misc_feature (543)..(543): n is a, c, g, or t
aaggtgcctctgcacccaggcgagagcctgccctaccacagtgtctactcgaaggatgagtacgatgacacatacgatggcaccaaggtgggcgccaatgatgcagactctgatgacgagctcatcagccgcaggccattcaccatccctcaggtgctgagaaccaaagtgcctagagaagggcaggaggagnntgnccangatcaggnagncgatgctgacgagnaggctnccaagnccgnccattntgttcaggnccctgcagtgctganagagaaggcanaagccaggcgcatggcctttctcgcaagaaagggtaccggcatgacagctcacagcagtggccggcagcccccgaggccatgggcagagccgtagacaacccatnaactcangaagaatgaaccaacaangtacaagaccaaccacaccggagaaccatggccgaccgnaagaggagcggcatatcccatcctgagacctgtcagggccagtggggcagnggaccagactcccaggccggctccatcgctggggcctctnactggggcc

SEQ ID NO: 685525 - DNA, 130 bp, Homo sapiens
taagactgccagaagtcagaggaggagatgacttcttcgttcctatccctaaatctggtatgttcatagtgtcctatagtcctctattcctggtagataacctacacaaccgacagttggaggtttacac

SEQ ID NO: 685526 - DNA, 749 bp, Homo sapiens
ggtggttctaacccggtcccccccccccccgggtgaggggtggtttttcctcgtcctccctccccgcgggcattgtgggggaggtataacgggcccctcccctcccccctccccggccgtattgtttttgtttcttctctgtaggaggaccgcgggtgtttgttattagttgtgcccgccgcgggtgtctttcaatctctctggtcgctctcccgtggtggccgcccctccctcctggggcctctccctccgcgtggggtggggggtaacaccggcggggtggtccccccccgcccccgcggcgcgaggaattttgtttgtcttggtccgcacaacgattatcttctcccttctgtttgtttttgggttaaatgggcggttgtttgttttgccccgccttgacgtgatgtgccgctgttcttatagaatccttcttgagctgatagatcgtctttttacatggagagatcgtctaagatgactatagtgatacagtggagaagaagaccccacgtgttcatataggtcttttgtctcttttttttttgggaggggagtagggaggaggagtggtagtagaaccacctcatgaatatattttttcctaccaggacacgttgagtctccctatatataatgatgccggtaagcttctgttggggcgaaccctctttgaaatttttttttttttttccccccccccttttttttgtccttcccaaaaatagggcccccccaaatttttgtga

SEQ ID NO: 685527 - DNA, 133 bp, Homo sapiens
ggatttgctggtgcagtacaactaggcttaataggctcgaattcgagctcgaattcgagctcgaattcgagcgaattcgaggctcgaattcgagtcgaattcagcttctaacgttagaagcttgaattcgagc

SEQ ID NO: 685528 - DNA, 283 bp, Homo sapiens
caactaacccccatcaagtgccagaccctcccagtgttccgagagtcatctccatgctaaacagcctgcggtttatatgatttctctacccagccaaaaaaaaaaattggtccatcatgtccgcggttatctagtcttaagttatattctggcttttttctcccactttattatggggcagaagtaagcctatcatgttcttagaagggtttttaagaggggtcctggagcccttgaatcactttagcatctggggtaggatgggccaccaggaggatttggt

SEQ ID NO: 685529 - DNA, 167 bp, Homo sapiens
tgcagatgctcaagttacagctgaaaaaaatctgaaacagctatagacccatgacagacagatacaaagagtactgcattgttaaaaaaatgataaaaaaactccacacacttactcggtacacacgggataccgacgctcgagtttcggtaatcattgggtcatat

SEQ ID NO: 685530 - DNA, 283 bp, Homo sapiens
  misc_feature (88)..(88): n is a, c, g, or t
  misc_feature (98)..(98): n is a, c, g, or t
  misc_feature (102)..(102): n is a, c, g, or t
  misc_feature (120)..(120): n is a, c, g, or t
  misc_feature (135)..(135): n is a, c, g, or t
  misc_feature (202)..(202): n is a, c, g, or t
  misc_feature (222)..(222): n is a, c, g, or t
  misc_feature (226)..(226): n is a, c, g, or t
  misc_feature (229)..(229): n is a, c, g, or t
  misc_feature (236)..(236): n is a, c, g, or t
cacagtggtaattgtataccattgctattcatgctttacattccatatgatgtgcctgtaagccaaggagttttccccgtttgtaaanagccattgtngatnattgcatgtttgattttngaaaggtcattagtntcctgttacacatttggttcgtctggttcttgtcgcttaccgggtgtaatattgttcttccaaatanttgatcctatggtatgtatngctnttntaataanagttgtgttctcacctgttaataaaaaaaaacaaaaaagggcggccg

SEQ ID NO: 685531 - DNA, 680 bp, Homo sapiens
ctcagactcttatgaagcaagaaggagagaaggagaaacagtattaacaggaacttgatagtgggattatattgggatggaagagcacccagaactccagcagtttcgtgggccagatgggagaagattgatttcgcagacacaggcaccaagtatgacaggaggttcagggtgtgtaaagcgagacctgctccttaccccaaagtgctggtactattatcggacgagaaacagtcaaacagggcccagacgagggcctggtgaaagacgtctgaatcggaaaatcgagatagaacggatcttgtttgtgttagttagtgctaggcaggatgaccttgtgattctccatgagcaagagtatgacagtgtgcttgaatctgtctgcaaaactgaattcctaagcctcttagcaaagcgtaacgaggagaagacccagaagcaactacctctgaaatacagcaatacgcttgaactgaagttgaaaaaggacaactggggcccctggagtgcagggggctcccggcaaagtgcagttccaccaagggtttggggacctggctgtcctcaagcccagtaacaaagtgctgcaggtcagcatcggacctggacgtgccaagaactcgcgtcctaccagaaaggacaatagccaaaataaaggtaatccagtgggactcaaatgc

SEQ ID NO: 685532 - DNA, 252 bp, Homo sapiens
gacaggatcttgctctgtcacacaggctggtatacatgggtgagatcatagctcactgtagccttgaactcctaggctcaaaagatcctcccatcttagtttctctcaagtagctaggactacaggcacacagcatctcaagatcctggcctcaggtgaatcgcttgaccccaggaggtggaggttgcagtgagccgagatcgcatcactgctctccagcttgggcgacaggaactgactccatctcagaaa

SEQ ID NO: 685533 - DNA, 895 bp, Homo sapiens
  misc_feature (883)..(883): n is a, c, g, or t
gcccggtactgatcattctatttccccctctatgatccccactccaaatatctcatcaacaagcgataatcaccacccaaagaatgactaatcaaactaaacctcaaaacaaatgataacatacacaaacataaaggactgagcctgatctcttatacgagtatccttaagtcatttgtatatgtgccataactaagctcctcggactggcctgcctcactcatttacaccaaccaggccaatatctataaactagccatgggcatccccttatgagcgggcgcagtgattatcaggctttcgtctaagattaaaaatgccctagccaaattcttaccaaaggacaacttaacacccccattatccgccatagtgagtataatcgaaaccatcagcctactcattcaaccaataggcctggcggtacgcctagccgctaacataagtggcaggcaccatactcaatgcgctaatggaagcgccacctagcgagtatcagccattacccttcctctaaacttataatctccacaatctaattctactgcctatctagaaatcgtgtcgctgaatccaagcttacggttccaacttctagtaaggctctacctggacgaaacacataatgacccacaatcacatgcctatcatatagaaaccacagccatgaccccaacagggaccattagctctatgcctcgcagcatgtgattcactcatccatagtcataaacagcataacaactaccttacatgggggagtgccgagaagctacagacaaccattaaagtgagggatatataccaatcgagagagatagaacagcaacaaggggaagccaacaaatcatacgacccccaacctataccactcgtggatatnccaacgacgcaa

SEQ ID NO: 685534 - DNA, 119 bp, Homo sapiens
cacacaaaaaaatgataagtaggtgaggtgatggatatattaactagcttaatttaatttttctcaaaatatcacattatacttcataaatgcattcaattattattagtcaattgcaa

SEQ ID NO: 685535 - DNA, 251 bp, Homo sapiens
cgtagggtatggtcctaaatagcccactgagagtcatgagcttggcctgtagaggctgactggagaaggttctgggcctgtagaggctgccgggaggtaggagcataatgtagaatcagtgtgcgtgttaagcttgttttcctgcaactggatggtcccacctgagcgtgatgggagaaagtaacagatcaataggtattagattctcataaggacagcgcaacctcgatcccttgcagcctgcacccgta

SEQ ID NO: 685536 - DNA, 122 bp, Homo sapiens
cttcttttagctgtttaaaaaaaatggaacatgatgggtcgccaaaaggtgtcaagaatgcttgcgctaacagaagtcattttcttgtgctctgtgacccatcatgttccattttttttagc

SEQ ID NO: 685537 - DNA, 934 bp, Homo sapiens
  misc_feature (54)..(54): n is a, c, g, or t
atacgggaaaaggtgtggaaaggatgcacattttgggcgcaacgcccatggtcnaccaccgggtcgtggtgcgttcggtagctcaggcggagcacgcctatatcggggaaacaacacgcttggtgggtgcgacgggcttgctaatgtgtttctttgcgcggagcacaaaagctggcggccgttcttttatatgagagtactttttctttgcatgcactaattgtttcgccttgggggaacgccgtcgactgtgcgtttgtatgaagcgggccgtacctgagcgttgttcgtcttccgtctggcaccagtcgtatggttatagtgcgccgcccaccgccctgttcgagcgttgctttttcgagaccaaccggcttgcctgctacggaacaatctgtcctacctctgtgtgaagaattgtcccttgttggttattagaaacacgaaaaaatgttcttttcgttattagctgtcaccccccagggtaactgctccatgtctatgccgccactaggatgtaccgctcgcgagcatactccccgcttcgcaccgagacggtcttttatgtgcgtcgttgggtaatacgcgcaatgagcaggtgtcttgcgtgctgatgcatgttatagaataacagtggccactgagtgtagcattctggttggtcgacatcgcatggtcggccttccacgtccccgcatgaacgaggtattaggaggggcgctcttgctcgttttttatcatcactgcagcatgggctgtgtggatagtgacaagatgtctataataatagtgcagcatatgggagtgtcagggtcatcaaataacggagagctatatctctgacagaatccgaggcgagtcgccgtctttagcaagcaatatcaacaattatttcatgtgcaccgtagggactttcttgggaaaaaaaccaaatgac

SEQ ID NO: 685538 - DNA, 119 bp, Homo sapiens
gctcgatctaggatacagagatctctgcagtgcgccctgcctccagggagcgactgaagaagcagactgccgggggaacacctggattcatgaaccaaagcagcctcaagttacatagt

SEQ ID NO: 685539 - DNA, 363 bp, Homo sapiens
atgacagtactatacaattctgatttaaaagatagaaaaaacaaacacacacaagttaactgtacagatgaactggtggcacaatcagcgggaagcagcgagaagtcaaacctcagcagctaggttggtccagtcagtgagtgtataaccttgagcaaagtaacttgagcttctctgtgcctcagtttagttacccgtaaagtagggctgataattaataactagcctcgtaaaagtttctgtgaagaactaaaagagataatgtaacatgtttgaaataagtgcctcgattgttcgtaatgtccgctgtgtataatagactaacgctggccttcatcttctacagatatgttgaagaaatgg

SEQ ID NO: 685540 - DNA, 273 bp, Homo sapiens
aatctaagcaattcttctgcctcagcctcctgggcaacaggaattacaggcgaagtgccaccatacccagctagtttactgtattttcttgtagagatgaggttttgccatgttggccaggctagtctcaaactcctggcctcaaatgactcgcccgcctcggccttccaaagtgttcaagtaccggagtgagccaccgtccctggcctaatcttagtatttgccttagagatgggttttcaccactttggccagtctgtgcttgaacacttt

SEQ ID NO: 685541 - DNA, 271 bp, Homo sapiens
gagaccaccacagggggcaagcagacccgaaccgagcaatgcatgctggactttgactatgtctgctcccgagacaacctgtgagtggctgtcatgatctaccctttcactgtgaaccacaagcacaagttttactgggggcacaccgtaaccctgatgcctgtcttcaagaacatggctgatgccatgaggaaccacccggaggtagatgtgctcatcaactttgcctctcttcgctctgcctatgacagcactatggagaccatgaact

SEQ ID NO: 685542 - DNA, 514 bp, Homo sapiens
gaattgagtacacgactattgcgtgaacacgaaatattgactactatcaagtgcttgatgctttgacacaacaattattggtgaaacgatgtcagaataataatactagtatacaaacggagaacctggaatctgtaaggtgattccaaaaaccaattacgtcgaagatccactggtgaaacctgacacattctacctctgcttcggagaatggctagtcatacaacgagttcagtcatcctgcaagatgtattggtagaggtgtgctctatacataagacttcatctcatttgtgcttgtgcagaatcatcccaatcttcccaagactgaatgggcagtcctgtggctttcttccttttccatattcccaacaaggctacgtgaagttcaactcttgatgagccgcttacaacagcagttccttaggagccaacatgacaggtgggtcagatttccctatgagaaacaaaactggccacctacagcaaaatatcaaaatgggtaagtccttcc

SEQ ID NO: 685543 - DNA, 557 bp, Homo sapiens
tactatgtcgaggctgcactttacgagtcagctgggagctttaagcagcgctaatttctgggtctcactcagattctcatgtagtcagtgtggcagattgtccagccatcgggattttaataaatgtatttctttggtgatttaaatgtgtagacctgcttaagaatgactctaaattttctgggaatggggttgttctgggggcaagttctgcccacaaaggttcaggtattgactttattttttttttggagacagagtttggctttggtggcccaggctgtactgcagtggcgcagtcttggctcactgcaacctctgcctcccagttcaagcgattctcccacttcagcctcctgaatagctgggattacaggcatgcaccaccatgcccagttaatttcatattttaagtagagatggggttactccgtgtgggtcaggctggtctcgaactcccaacctcaggtgatccgcctccctcggactcccaaagtgctgcgattacatgcgtgagccaccgtgcccgtcctaactgcagatcttactttggaatc

SEQ ID NO: 685544 - DNA, 455 bp, Homo sapiens
gattcaatcatgtcccaggttgttccgtaggtcacatgagctggtgctgatccaaggtcccgtgatccgggttgtactcaaggtcctgtgtggccaggatgtaccgtggtcgcttgactcgagagttgtagcaaggtcgctgacgccaggctataacaaggtccctgagacatcgaactgtcaagcgtcctgaccagaggctgatcgaactttccatgagccaggtgccagcaaagttccctgaggaaggatacaccaaagttcctgtgccagtgctacacaaaggtaccagagccatgtccttcaacggtcactccaggcccagctcagcagaagaccaagcagaagtaatttggtgcacagacaagcccttgagaagccaaccaccagatgctggacaccctcttcccatctgtttctgtgtcttaattgtctgtagaccttgtaatcagtac

SEQ ID NO: 685545 - DNA, 106 bp, Homo sapiens
ggcttccgtccgcgagcggctaacatccaacctcttcccgagtgcccctaccacttccgggcccccaggccgcgactcttctggtcggaccgttgactgagtgtat

SEQ ID NO: 685546 - DNA, 133 bp, Homo sapiens
cgttcctgagtaaaaaggataacataacttggttccaagatacattcctcagaaacagactgaggacatgcatgcctttgtcactgaagttggctacaaagtggagcttctgcaaattgaaaacatggttttg

SEQ ID NO: 685547 - DNA, 118 bp, Homo sapiens
ataaactaaagaatttatcattcaactctagtactcacataggtacattgtgatttatttaaagttttgtccattttccatgaaagacatactgcaataaaaatgctactctgtggag

SEQ ID NO: 685548 - DNA, 307 bp, Homo sapiens
gcctactactactactaaatttgcggccggtcgacgctcacacctgtagtcctagcactttgggaggatgaggcttgagccaggagtttgagaacagcctggacaaaatagtgagactttatctctacttaaaaaaaaaaaaaaaaaaaaattagccggggtggtggtgtgtgcctatagtcctagctactctggaggctgaggtagggggattgctggagcctaggagtttgagcttgcagtgagctacgatcttgcttgtacttcagcctgggtgacagagcaagactttaaaaaaaagtcgacg

SEQ ID NO: 685549 - DNA, 129 bp, Homo sapiens
ctgttgctgctatgatctagaggatcccttcttgcccgctatcgaggacggtcattagttccatgcagttgagcagtttggagtggagtcttttaatcttgcagtctagcttgatctgcactgtggtca

SEQ ID NO: 685550 - DNA, 308 bp, Homo sapiens
cgaggactctcagcatggcgtctgtgttgtaaacgagccagctggtctggtgtctgctgtgccgacattatgactctctcaatggatcatgtattgattccatatttatatgcgtctacttcctgtggctgggatcaggagttcctgaaggttccgtgggggtgcggggggttggacaggacactccttcttggaaggcaccaagttttcccagccccactcccattacacacacacacacacacacacacacacacacacacgacacacacacacacacccagtgacacagagggtagcgcgcgcga

SEQ ID NO: 685551 - DNA, 2497 bp, Homo sapiens
  misc_feature (34)..(34): n is a, c, g, or t
  misc_feature (94)..(94): n is a, c, g, or t
  misc_feature (119)..(119): n is a, c, g, or t
  misc_feature (154)..(154): n is a, c, g, or t
  misc_feature (185)..(185): n is a, c, g, or t
  misc_feature (187)..(187): n is a, c, g, or t
  misc_feature (224)..(224): n is a, c, g, or t
ttttagaaagtcctataatgtggaagaaacaaanagttgctaccaaagattcttcaaataaacatacaaataaatgtgtatatttaatgttttnttgttagcttctccaaaaaattgangcaaattctggtaataaaacttgcattttttcccnataacctggttaaaataaatacgccattggnantacttcataatgtaatggaattgtttggggaacactnactgtaccctcccatcctttttccaccttactgtgttaacttagtgacatttaatgcccaatatgtatgaatagatctaagccatttaattttttttccttaaagattggagtattttataattcaaggagcatacaaaacaatggttgggaacatatgccaattatggaataggctatgtatttaatattaatctctgccattaggatatctactcactgtataaacctcagtaaaaatagtgaagacatgcatcatggaatgagaaaatgagaaaggaatgagttgtctaacatcacagtgggatctgttttttgtgaggttcatttctgaacacattaggcatatgagcagatttccagtgaatctatttatgtttattttctgagtttcaacgctgaccttttcttgcattattgtttcattttaatgatagtgttacttgtcccactgttgttttcattgagtttggatttatattttaaatgttcgaatgaaagtatgattgtaaaagggagtgaattggtttaaaaatatatgtatattttaaactttgttgtgtgtaggaaacatgaaggcatgttaattcaatataaatgacctttgatttcatggaatattaaagttggtttaaagtccaatagttaaaccttagcaaaaatagctttttacttcatcagttgctaagatttaatactttggattcatcaaagtgtgacatgggcttgtttgacttctgtaagtggcatttaagttccacattcttattacttgaggtactttatactaacataagacagtgagagttagaggtattacaagttgctagtttataatgtcttactaatgcagaaacaaggaaaaaagcaaaattggcctgaatattctcttggggaaagagggcaccaaagaaaagggtaagtgcatctgagggccaaaagagatgtataagccttttagcccattccccatgctgggcctgctcacagagccacaggaagatcattcagaaactaggaaaggaggcccccacagctgatcctgccacagcacacctgactcactcggctctgttagtgtaaccttttaaatgtagcaacacaaaccctttccctcttgtcagttcactcatcctttggtttctttttaatcacctgtgtctgggcacagacaatcacaataaatgcagccctttattactgttaaggatcatactgttggtttggagttggaagggtactactctgtgattcaggtgtgttgtacccatatttataattaggctttattatcttcctaaatcaaggaaaggaaatcatccccagaccatttatgctgagctttggaatactattttaaactggattgtacttaaataatgaagctctgcatagaggaactagtcagaagtggggaaaacactgtctaatttttatcagtctggtataaagtattgatctaagagaactctccctgtgccccttggtctttattctcaattaagaaaaacagtcacatgtcacgacaaaccaatcaatctttatgagatattcctgtatccataccccagcttgtttgcaatttataaacctccccttcaaaactaaggagttgcagaaaaaaatggatttcacagagccttgtgtccctaaagttctgtcccagtcagcagtctttatagtccaaacagattataaaaaatgttttccatttgaactttacagtttgcaaaagtgcttttatacattttctaatttcagaaacaggataatataatttgttaagtgggtttcagtttgctaatagggattttttgtgttttgttttttaattttcagcatctcttgaagaatcttgctacagccaaatggcatctcactttttaaagacgtttgcaattattagttgattcacagtacagaacaaggtataaaggaaaaaaccctgctaggtagtgttataattgctagattaaaaatagactagaacaggttcattttaagatttacttggaagagcaaagaaggaaaaattatatttttaaagaaagagaatattcaggctttatttctggtatgaagtttatattttttaaaaaaatcctatattatcacaccagagattttagattcttttctggttagaaacattgctggtagttggattatatttttattgtattcatttatcttagggggaacattgtaaagaaacaaaaaggtccagatgaatgtatgctagaaataaaagttgaaagattcttaaaaaaaaaa

SEQ ID NO: 685552 - DNA, 177 bp, Homo sapiens
catttgtatcttgaaccttttcacttgtttttctcaaatatttcatttctgggccccatccattacagggtaccaggaggaaataatctacataaatatcacatgaaaatagtaactaaaaaagaaaaaaaggagtctaaaaatatctaaattacaaactaaatcaagagtataaga

SEQ ID NO: 685553 - DNA, 109 bp, Homo sapiens
gtatacaccgaaactgcgagaaaggtgaggtgtgtgacaaacccacagtgcctgagaaaggtgaggctgcgtgacaaaccctaatagtgctgagaaaagtgaggcatgt

SEQ ID NO: 685554 - DNA, 2497 bp, Homo sapiens
  misc_feature (34)..(34): n is a, c, g, or t
  misc_feature (94)..(94): n is a, c, g, or t
  misc_feature (119)..(119): n is a, c, g, or t
  misc_feature (154)..(154): n is a, c, g, or t
  misc_feature (185)..(185): n is a, c, g, or t
  misc_feature (187)..(187): n is a, c, g, or t
  misc_feature (224)..(224): n is a, c, g, or t
  misc_feature (263)..(263): n is a, c, g, or t
  misc_feature (284)..(284): n is a, c, g, or t
  misc_feature (305)..(305): n is a, c, g, or t
  misc_feature (312)..(315): n is a, c, g, or t
  misc_feature (337)..(338): n is a, c, g, or t
  misc_feature (340)..(340): n is a, c, g, or t
  misc_feature (354)..(354): n is a, c, g, or t
  misc_feature (359)..(359): n is a, c, g, or t
  misc_feature (363)..(363): n is a, c, g, or t
  misc_feature (372)..(372): n is a, c, g, or t
  misc_feature (376)..(376): n is a, c, g, or t
  misc_feature (379)..(379): n is a, c, g, or t
  misc_feature (385)..(386): n is a, c, g, or t
  misc_feature (388)..(388): n is a, c, g, or t
  misc_feature (394)..(394): n is a, c, g, or t
  misc_feature (401)..(402): n is a, c, g, or t
  misc_feature (405)..(406): n is a, c, g, or t
  misc_feature (410)..(411): n is a, c, g, or t
  misc_feature (413)..(413): n is a, c, g, or t
  misc_feature (417)..(417): n is a, c, g, or t
ttttagaaagtcctataatgtggaagaaacaaanagttgctaccaaagattcttcaaataaacatacaaataaatgtgtatatttaatgttttnttgttagcttctccaaaaaattgangcaaattctggtaataaaacttgcattttttcccnataacctggttaaaataaatacgccattggnantacttcataatgtaatggaattgtttggggaacactnactgtaccctcccaccccccccccccccccctgtgttcncccagtcacacccaatgcccnaaatgtatgaacagacccaanccacccnnnncctttcccctaaagattggacnntnttataagccaaggngcagncaanacaagggcngggnacnaaggcnnanaagggnaaaggcnnggnngggnngnggangggcggccattaggatatctactcactgtataaacctcagtaaaaatagtgaagacatgcatcatggaatgagaaaatgagaaaggaatgagttgtctaacatcacagtgggatctgttttttgtgaggttcatttctgaacacattaggcatatgagcagatttccagtgaatctatttatgtttattttctgagtttcaacgctgaccttttcttgcattattgtttcattttaatgatagtgttacttgtcccactgttgttttcattgagtttggatttatattttaaatgttcgaatgaaagtatgattgtaaaagggagtgaattggtttaaaaatatatgtatattttaaactttgttgtgtgtaggaaacatgaaggcatgttaattcaatataaatgacctttgatttcatggaatattaaagttggtttaaagtccaatagttaaaccttagcaaaaatagctttttacttcatcagttgctaagatttaatactttggattcatcaaagtgtgacatgggcttgtttgacttctgtaagtggcatttaagttccacattcttattacttgaggtactttatactaacataagacagtgagagttagaggtattacaagttgctagtttataatgtcttactaatgcagaaacaaggaaaaaagcaaaattggcctgaatattctcttggggaaagagggcaccaaagaaaagggtaagtgcatctgagggccaaaagagatgtataagccttttagcccattccccatgctgggcctgctcacagagccacaggaagatcattcagaaactaggaaaggaggcccccacagctgatcctgccacagcacacctgactcactcggctctgttagtgtaaccttttaaatgtagcaacacaaaccctttccctcttgtcagttcactcatcctttggtttctttttaatcacctgtgtctgggcacagacaatcacaataaatgcagccctttattactgttaaggatcatactgttggtttggagttggaagggtactactctgtgattcaggtgtgttgtacccatatttataattaggctttattatcttcctaaatcaaggaaaggaaatcatccccagaccatttatgctgagctttggaatactattttaaactggattgtacttaaataatgaagctctgcatagaggaactagtcagaagtggggaaaacactgtctaatttttatcagtctggtataaagtattgatctaagagaactctccctgtgccccttggtctttattctcaattaagaaaaacagtcacatgtcacgacaaaccaatcaatctttatgagatattcctgtatccataccccagcttgtttgcaatttataaacctccccttcaaaactaaggagttgcagaaaaaaatggatttcacagagccttgtgtccctaaagttctgtcccagtcagcagtctttatagtccaaacagattataaaaaatgttttccatttgaactttacagtttgcaaaagtgcttttatacattttctaatttcagaaacaggataatataatttgttaagtgggtttcagtttgctaatagggattttttgtgttttgttttttaattttcagcatctcttgaagaatcttgctacagccaaatggcatctcactttttaaagacgtttgcaattattagttgattcacagtacagaacaaggtataaaggaaaaaaccctgctaggtagtgttataattgctagattaaaaatagactagaacaggttcattttaagatttacttggaagagcaaagaaggaaaaattatatttttaaagaaagagaatattcaggctttatttctggtatgaagtttatattttttaaaaaaatcctatattatcacaccagagattttagattcttttctggttagaaacattgctggtagttggattatatttttattgtattcatttatcttagggggaacattgtaaagaaacaaaaaggtccagatgaatgtatgctagaaataaaagttgaaagattcttaaaaaaaaaa

SEQ ID NO: 685555 - DNA, 192 bp, Homo sapiens
tagggtataatagtctgggtcgactagacgtcggagatcctcttagcagtttgacctgtagtgcactgtaaagcttggtactgagccgagctcctaagcgacccagaacgattataccctagccgaaccccttaaatacccctccccggtacatgcaagacatgcaagacatgcaggcccggtacatgcaag

SEQ ID NO: 685556 - DNA, 873 bp, Homo sapiens
  misc_feature (86)..(86): n is a, c, g, or t
  misc_feature (143)..(143): n is a, c, g, or t
  misc_feature (228)..(228): n is a, c, g, or t
  misc_feature (239)..(239): n is a, c, g, or t
  misc_feature (253)..(253): n is a, c, g, or t
  misc_feature (284)..(284): n is a, c, g, or t
  misc_feature (291)..(291): n is a, c, g, or t
  misc_feature (296)..(296): n is a, c, g, or t
  misc_feature (318)..(318): n is a, c, g, or t
  misc_feature (332)..(332): n is a, c, g, or t
  misc_feature (357)..(357): n is a, c, g, or t
  misc_feature (377)..(377): n is a, c, g, or t
  misc_feature (397)..(397): n is a, c, g, or t
  misc_feature (433)..(433): n is a, c, g, or t
  misc_feature (454)..(454): n is a, c, g, or t
  misc_feature (545)..(545): n is a, c, g, or t
  misc_feature (562)..(562): n is a, c, g, or t
  misc_feature (586)..(586): n is a, c, g, or t
  misc_feature (606)..(606): n is a, c, g, or t
  misc_feature (657)..(657): n is a, c, g, or t
  misc_feature (680)..(680): n is a, c, g, or t
  misc_feature (682)..(682): n is a, c, g, or t
  misc_feature (686)..(686): n is a, c, g, or t
  misc_feature (697)..(697): n is a, c, g, or t
  misc_feature (706)..(706): n is a, c, g, or t
  misc_feature (761)..(761): n is a, c, g, or t
  misc_feature (766)..(766): n is a, c, g, or t
  misc_feature (769)..(769): n is a, c, g, or t
  misc_feature (793)..(793): n is a, c, g, or t
  misc_feature (799)..(799): n is a, c, g, or t
  misc_feature (804)..(804): n is a, c, g, or t
  misc_feature (827)..(827): n is a, c, g, or t
cggcccgacgcggaccgcttccctgcagtgccccgagtcccgggcccgcgccgccgccgcccggctccgctcgcggcccctctgtntgcaggcgtgccccggcggcggcggagagccgtcctcggccgaggaggctgggaaangcgaaacccaggcggcagaaaggcctcaacgccgttcctttcgccaccgccttttccttgccttgcgccgctgtgcatttctctncttttcctttntttttttggccccncgcgggtgtgggcattgttggttagcaaaantgcagcntcaanaaggctgaaggcaacgaggatnttcgggctgacganttgcctgggccagccttcgagagcnatgagttcatggagcctgcntgcaccgctgagcgcagacncacgtagccgttagcgacgggcgccaaaagttcgtntggggcggctacaagagtaancaagttagaggattatatgacttttatctgcctagagaagaactatggatctacaacatggagactggaagatggaaaaaaatcaacactnaaggtgatgttcctccntctatgttaggaagctgttctgtntgttttgacagggtgctgtncttgtttggaggacaccatttaagaggcaataccaataagttctacatgcnggatttaaggtctacagaaagantnttanagtggggaaanaattgattnccaaggaattcctccatcatcaaaggacaaacttggtgtttgggtatataaaaanaagtnaanattttttgggagggtatggatatntgcctnaaganaaagtattgggaacttttgaatncgatgaaacatctttttggaattcaagtaatccaagaggatggaat

SEQ ID NO: 685557 - DNA, 327 bp, Homo sapiens
caccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagcactaatgataatcccaccaccctttgctgactcttataggactcagcccaactgcacacagatgattaaaaagctttactgatc

SEQ ID NO: 685558 - DNA, 344 bp, Homo sapiens
  misc_feature (65)..(65): n is a, c, g, or t
aaaaagggctacctgggggccaggtatgttcaacatggaggctccatcttcccttttatttgttnccccatgtccaatacaaaaataggcaacctggtgccagtcaggtagagagcctctgcataataaaagattaaggtggagagtccagaaattccccccctatgcaaatggcccccctggtttgcccaatcttttgttcctatgtaaatcagaccccccctcaagctcttttgaaaaaaaacccctgcatttccccccggacccgaaaccccctggggacccatctctctgcagcaaaaaaagctattttcttgcttttgcctattaaacgtctgctctta

SEQ ID NO: 685559 - DNA, 283 bp, Homo sapiens
  misc_feature (4)..(4): n is a, c, g, or t
  misc_feature (31)..(32): n is a, c, g, or t
  misc_feature (55)..(55): n is a, c, g, or t
  misc_feature (75)..(75): n is a, c, g, or t
  misc_feature (137)..(137): n is a, c, g, or t
  misc_feature (150)..(150): n is a, c, g, or t
  misc_feature (163)..(163): n is a, c, g, or t
  misc_feature (172)..(172): n is a, c, g, or t
  misc_feature (178)..(178): n is a, c, g, or t
  misc_feature (207)..(207): n is a, c, g, or t
  misc_feature (214)..(214): n is a, c, g, or t
  misc_feature (227)..(227): n is a, c, g, or t
  misc_feature (237)..(237): n is a, c, g, or t
  misc_feature (240)..(240): n is a, c, g, or t
  misc_feature (256)..(256): n is a, c, g, or t
  misc_feature (264)..(264): n is a, c, g, or t
  misc_feature (267)..(268): n is a, c, g, or t
  misc_feature (271)..(271): n is a, c, g, or t
ggcncatttactgttttaggtctagcctatnnggattttttcctaacatacctangcaaacccaggtgtcaggantggtaatttcttattcctttcgttcaagttaaagtttttcccttcattcttgggcaactganagggataatgtgnaaactaaatgttnaacaatttnatggtnagtccttcacaaccgcagggattgtttcntagtttnaacttcattcatnaggcaaagcnttngagttaagaataaatnattgtcanttnngtnatgtccaaaaaa

SEQ ID NO: 685560 - DNA, 130 bp, Homo sapiens
cgtatcatgtattcacttccactccataactacaaaaacatatatatgaatttctaaacaaagtgaataccaaacgcccctcttcgtctgatccgtcctactgggcaccattgagcactgagtgaacgag

SEQ ID NO: 685561 - DNA, 85 bp, Homo sapiens
gcggccgcctactactactactgctcgaattcaagcttctaacgatgtacggggacatgtataaataaagctcctcgtggctccc

SEQ ID NO: 685562 - DNA, 301 bp, Homo sapiens
gtcgactttacattccaaccagcagtgtatgagagttccagtttatccacatcctcatcaacagttgttattgtctgtcttttttattatattcatctgtaatgtgaagtgtttatctcattgtggttttgatttacatttccctgatggttgatgattttcaacatcttttcatatacttattagtcattatgtatcttctttggagaatgtctgttcagatcctttacctactttataattggtttatctttttaatattgaactgtaatagttttaaaaaaatatatcctaaatacaa

SEQ ID NO: 685563 - DNA, 157 bp, Homo sapiens
actcacgaaggctgatcttccctcagtttgagaagtccttgtgttgggtgggtgtatggtagggggtgtgtgtgtgtgtgtgtgtgtgtgtgtgtgtgtgtagtacccaggtgcggggtcagagccaaacgatagtgatatatagagggagcggcgg

SEQ ID NO: 685564 - DNA, 323 bp, Homo sapiens
ccaaatatgtgatcaagcgatatatctacaatcataatgtatagccaggcacggtggctcacgcctgtaatcccagcactttgggaggccgaggcagacagatgacttgcggtcaggaaattccagaccagccagggcaacatagtgaaaccccatctctaccagaagtataaaaattggccgggtgtggtggtgcacgcctgtagtcctaaggcaggaggctaaggcaggagaacagcttgaacctgggaggcagaggttgcagtgagccaagatcacgtaactgcactccggcctgggtgacagagtgaagaccctgtcac

SEQ ID NO: 685565 - DNA, 137 bp, Homo sapiens
  misc_feature (35)..(35): n is a, c, g, or t
  misc_feature (53)..(53): n is a, c, g, or t
  misc_feature (124)..(124): n is a, c, g, or t
tctcttcaagcaacacatcagtttcaaaccaattngttcaaaacacattttcncgtcttcatttccatttctggtcaaccagttgcaatcatctgggctgtcctttttcatcacaggccagggngtcacggtcagct

SEQ ID NO: 685566 - DNA, 149 bp, Homo sapiens
atagggtacgtaacacatgcaccattactgttactaagttctgtacttgtgtcctgtgaaccttaagtataataataaaaaaatacattacagtaaagttaagtggagggctgggggctgtgtgtcatgcctgtaatcccagcagttca

SEQ ID NO: 685567 - DNA, 929 bp, Homo sapiens
gagtgtgggccataattggcccgttgtttagaccaaggccggggtggccaatatcggggaaagacacagtattgtttgagacctttcctggtgtaaaaataacgtttcgaaaataacttgattcttacacaaggtccactgggggaagaatttcacgaagagtttatggcaaggtgaattaacccccatgaggctcttagagaaccctggtgggtgccgccatctcttaacgagttttactcttaaactagtgtttgggtcaagcattatttatggcccttccacttgtcagccaatttccaaggccccttaggaatttaaaagtgaccgagcgccattttttgctgctgaaaacgtcccggtgagtttacgccacctacttttacattatcacggcccactagctcttaccaaggtaatcttttggctgaaatggggaccctcttctgacgctggagactcttagtgttcaattaatcgtgtgtaatctgtatgctatctaattgtcctgggtgcttctttcctattgcacccattttactaatgcttctaacagtatcttcgtttgcaatctttggggtaaaaccttttgtttatgacgtacttgtttctcttgaagattttaagcggtcacactttgccttcgttacatgccacactcgctggagagcttattatctggtggctaattgccacacggatgctcaacctatcgcgagtacttacctttgaggttgacgtcgccactacacacgagccactgtatgtttacttctcaccatttgagttgcccatcttgttttcacactacctcacattcttgttttaacgatgcctcttagtttgaaccgttcactttttacagtgctatttactgaagttatttgattaaaaaatgcccttaaatacgttgaaaaaaaaaaaataaa

SEQ ID NO: 685568 - DNA, 116 bp, Homo sapiens
gcgtgttagaggatcccgtctgagaagcttctccgtgctcctcctaccttggccttctccagctcctcttcaccactgagcttcttcagcttctccccattcccagcttgttcaga

SEQ ID NO: 685569 - DNA, 427 bp, Homo sapiens
ggagtggtgctcgggtccgggaggcttgggctgcgtgggagcccatggcgggtttggggggaggctcaggcatggcgggctgcaggtcccgagccctgccccacggggaggcagctaaggcctggcgagtcaagcacaacagctgctggcccagatgctaagcccctcactgcccggggcttgcaggcgggccagccgctctgaatgcggggccgcagagcccacacccaccaggaactggcgctggcccacaagcgccacacgcatccccggttcctgcccgtgcctctccctccacacctcctcgcaagccgaggcagctggctccggcctcagccagcccagagaagggctcccatggtgcagcggcagggtgaagggctcctcaagcacagccagtgggcgcccagggcgaggaggcacggag

SEQ ID NO: 685570 - DNA, 361 bp, Homo sapiens
  misc_feature (355)..(355): n is a, c, g, or t
ggcacgaggaaaaatacacaggaaataaaaatttctttgtgaattaaagtttaaggttagtatattttgacttcctgctgccttgaccttgatgaatgttataaaccatcaccacttgccataatgatgggtagttgaaatagaaagtctatttcatttgtttaaggtttcagtttctgactttaaaacctcacttctcctagagtatgtgtgtgtgtctgactttatgtctcagtactctgaagtttcacgtcttgtccaatgaggaactggatgtcagtggaactaattggggctcttcttgtggcgtggggtaccccggacatggccccactggctggctgatgttgtgganggcttt

SEQ ID NO: 685571 - DNA, 105 bp, Homo sapiens
ggtactttgggacaagtcttatagcttacataatgtgaattcatcaaaaggcagttaagaaacttacaggaatatatacacgtgaacccaagacccaaactgaca

SEQ ID NO: 685572 - DNA, 314 bp, Homo sapiens
tctgaccattcatgcaggctcacacttgacctgatgtgggttctgtctcctttgcttgagaattgaaaggcctgggagatgcaaaagctttaggctccagccatctccccatgtcaggtaggccttttgcctagtgtatccagttggtaatgctgcagagatgcatgaagctggagtcagaggccacctgtagtgctgccctgacttcagacctgagcccagcccagcagcagagagggggctgggagccagaggaggcctcacagtaacagcacagacaggtgggggcccacaacaggccacatgtgttcaaa

SEQ ID NO: 685573 - DNA, 455 bp, Homo sapiens
gaagcaagcctgggcaatggcgggctgcccctctgctaaccttgcttgccgcgcttgcagttttgatctcagacttgctgtgctagcaatcagcgagattcctgtgggcgtaggaccctccgagaccaggtgttgggatatagtctcgtggttgcaccagttttttaacgcttgtgtcttgtcaacagcgcaatattacgcggtctgcggagttgaccccgaatatttcccaggatctaatctgtaattgacaagcaatgaaggatctactttgacgcacaacaggctaaatcttgcgcaaataccctttgcgttggaaacacgcgtggcgacacgtcctccaatttgtcctttgcccttcttataatttctgcgacagttcacattcatgtcttcccaaagaatttctgagtgtcagccattttccattcgaatcccacgaacaaacactcggg

SEQ ID NO: 685574 - DNA, 170 bp, Homo sapiens
  misc_feature (39)..(39): n is a, c, g, or t
tggcgaggcagtctctacaaaaaaattaaaaataaacanttttcaggcacagcgacatgtgcctgtaatcccggttacttgggaggctgggatgggaccccgcttgagcttttggaggtagagattgcagtgagccgacatcatgccactgcactccatcctgagtgaca

SEQ ID NO: 685575 - DNA, 611 bp, Homo sapiens
  misc_feature (529)..(529): n is a, c, g, or t
  misc_feature (540)..(540): n is a, c, g, or t
cagggctgctccgtatgggggcatccaggcctggctgctgatgccctgtggctgaggacacctccatctgcatgagccagtttggaagtccagcttgccccccaggcagtggaggccagtaagggcttctccccagattgaccactcagatcaaattgatccaggtgttgagacagaattggccccattttctgctaatttccattctctgattgtgctgcctgctacaggagtcattttggatttgggctgacctggtagacttctgaaagacagtgctctgggttcaagttgtcctcagggctggatgatccatagcaaatatcccctgatggataagcattgtgctgagagacttgcctccatcagctgtgtaaacctcaggatgacctgcacacaggtatactaaggcacacagagaccagctcgtagtcagtgacaagtaacttgcccaaaagccgggtttaaaagcatgtctgcaaattcttggacactcttgtcatccagaaaatagagtctaactttcctnccttgaatacnggcttggcttcagtggtgggaatagacaatgtgtgaagtttgaggttgaataaaaaaggagaaacaaacct

SEQ ID NO: 685576 - DNA, 253 bp, Homo sapiens
ctgaactagatcatttgttaaggcaaatgatctagttcagaaggaagcaaaatcccttaatctatgtgcaccgttgggaccaatgccttaattaaagaatttaaaaaagttgtaatagagaatatttttggcattcctctaatgttgtgtgttttttttttttgtgtgctggagggaggggatttaattttaattttaaaatgtttaggaaatttatacaaagaaactttttaataaagtatattgaaagttt

SEQ ID NO: 685577 - DNA, 135 bp, Homo sapiens
  misc_feature (25)..(25): n is a, c, g, or t
tgcctatgaggactcctccccgacnagcccgacaggggttagttcctacctctgaccccagcttctctctggttcccacaggccccatgcatctccctgcctcactcccctcagcccctgtcgggctagtcgggg

SEQ ID NO: 685578 - DNA, 2318 bp, Homo sapiens
  misc_feature (1062)..(1062): n is a, c, g, or t
cggacgcgtggcgccagagtggcagttgtgcagcacgcgccctctgagtccgtggacaatgccagcatgccacctgtgaaggtggaattctccctgactgatatggctccaaggagaagctggtggacttcctcagcaggggaatgacacagttgcagggaaccagggccttaggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggaggtatacaccttcgccagtgagccaaacgacgtcttcttcaaattagtggacaagtccaccgagctcaacgaggagcctttgatgcgcttcgggaggctgttgccatccttcgtcagcagtgaaaatgctttttacttgtccccagatatcaggaaacagtgtgattggttccaaggggaccaacccacaaagaaccttgtgaagtttggtcacaaacaagtaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagatggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatggttaagatgtcccgtgaagtccaggtgtttgagataacagagaacagcgccaaactccactgggagaggnctgagccccccggtccttatttttatgacctcaccgtcacctcagcccatgatcagtccctggttctgaagcagaacctcacggtcacggaccgcgtcattggaggcctgctcgctgggcagacataccatgtggctgtggtctgctacctgaggtctcaggtcagagccacctaccacggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcgctcctgtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctaatgttgtgtgttttttttttttgtgtgctggagggaggggatttaattttaattttaaaatgtttaggaaatttatacaaagaaactttttaataaagtatattgaaagttt

SEQ ID NO: 685579 - DNA, 1969 bp, Homo sapiens
  misc_feature (713)..(713): n is a, c, g, or t
tcctgatgtgatatatccccaagaggtatacaccttcgccagtgagccaaacgacgtcttcttcaaattagtggacaagtccaccgagctcaacgaggagcctttgatgcgcttcgggaggctgttgccatccttcgtcagcagtgaaaatgctttttacttgtccccagatatcaggaaacagtgtgattggttccaaggggaccaacccacaaagaaccttgtgaagtttggtcacaaacaagtaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagatggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatggttaagatgtcccgtgaagtccaggtgtttgagataacagagaacagcgccaaactccactgggagaggnctgagccccccggtccttatttttatgacctcaccgtcacctcagcccatgatcagtccctggttctgaagcagaacctcacggtcacggaccgcgtcattggaggcctgctcgctgggcagacataccatgtggctgtggtctgctacctgaggtctcaggtcagagccacctaccacggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcgctcctgtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctaatgttgtgtgttttttttttttgtgtgctggagggaggggatttaattttaattttaaaatgtttaggaaatttatacaaagaaactttttaataaagtatattgaaagttt

SEQ ID NO: 685580 - DNA, 251 bp, Homo sapiens
cacacagtcctagatgacgtcggaggtacagcacacccttggtgatggtgcgtcggcagagggcgcccgtgacaagggaatttgctggaagtggcctgtcactgtagcagccgtgaggtccagaacttccatggtggtgcttaccgtcaacaaggccctcatctatctgtgacaaacaagaaaaaaggaacaagagacgtaatagcagcactcacggaggaagggacctgggcccggtcagccgccatgat

SEQ ID NO: 685581 - DNA, 129 bp, Homo sapiens
ctgcgctgtcggacatacttctggtggcactgtgcggaaactgaggataaatcagtgagctgcatgcacttacaggcatggcctgtctcctcacttcagtgcatgtccatcgaccaaagccctgttctg

SEQ ID NO: 685582 - DNA, 1447 bp, Homo sapiens
aacctccttatctgctacactctgtcattcttcaaacacaagatgggctagtgtcatttctccttccttccttccatatggccagattgtatatgtattcacaaaacattaaatgtccatcctgtgccaggtactatgcagatgtcgacaggataccggcggctctggttagctcgtgactactctatcctgaatctaacagtgacttcatacactcagcgagacctgcattagcacccttacaggtctagctgtgtgtccgcaaattccactctgccaactggacaacttccactacttcagggctacgagctccgtgctccttaacacctacggtgctccctacatccacatgctcacaacgcactattcaccacatcaacaccgccaacctttatcacgctcactcctcctcacaaccctctgtccattcaatctcccggtcgactcccttctcgagcacacaggggccttcaaacggaacctactctcatgcgtccctcaccacacccacattggcgtacttgcataaagcaaacgttcacacttcactcgcataccacaccggcacacactcaaccctttggttcgactctccacctaactcggtcaccccaaggcgggcgccttcatacccttcctatgccacgagggaagaccacacacatgctttgtcccacaacgcgtatgagacacgatgcatatcctttagtccatcaacgctttcccacaatgagggggccatacacacattcactttccaccatcgtcagcggtgcaaccttgttcgcccctcactaggcatcgagccactatccatccctatcctaccagcagcacatactggacactccttcgcacactagccacggcataccccctctggcctcgcgcactagacacagcacacatagggcacaagcattctacagctcgaccgccccttgttaacacgacaaaaccagtatcgctccatctactgcgttcgatacacaactataccgacaaaacacaccagatgcacagctaccgcactaatcacacgtggtcgtcaatacaaccaggacataaatgcccaacggccaacacacatgcaccgcttcgtcgacccccctcacccaacgcaaccacaataaccccagcacaatctaccacgcagcaccagcacagcacaacccaccaaggcaaaaccaacaacgtgcgacaaaaacaccaccaccaccgcacacacacgacaccacgcacaagacacactaaccaaccacagcacaccaccccgacaccacaccgccaacaggaccacccaacaacaacactcgcaccagctcgcggaacacagaacacacactacacagccacctacacacgcacaaacacaccaacacacgacccgagcagccacccgcaacaacacaacaaccaccgcccgacacaacacaaacaacaa

SEQ ID NO: 685583 - DNA, 1768 bp, Homo sapiens
  misc_feature (512)..(512): n is a, c, g, or t
atatgattttaaaaaaaaaaaagtttgcaaaacttgtgcacctcggcaagccccggataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagatggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatggttaagatgtcccgtgaagtccaggtgtttgagataacagagaacagcgccaaactccactgggagaggnctgagccccccggtccttatttttatgacctcaccgtcacctcagcccatgatcagtccctggttctgaagcagaacctcacggtcacggaccgcgtcattggaggcctgctcgctgggcagacataccatgtggctgtggtctgctacctgaggtctcaggtcagagccacctaccacggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcgctcctgtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctaatgttgtgtgttttttttttttgtgtgctggagggaggggatttaattttaattttaaaatgtttaggaaatttatacaaagaaactttttaataaagtatattgaaagttt

SEQ ID NO: 685584 - DNA, 1764 bp, Homo sapiens
  misc_feature (508)..(508): n is a, c, g, or t
catcgcaacaaataccaacctaacacaaaacaaaaagacttacagtgacccgataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagatggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatggttaagatgtcccgtgaagtccaggtgtttgagataacagagaacagcgccaaactccactgggagaggnctgagccccccggtccttatttttatgacctcaccgtcacctcagcccatgatcagtccctggttctgaagcagaacctcacggtcacggaccgcgtcattggaggcctgctcgctgggcagacataccatgtggctgtggtctgctacctgaggtctcaggtcagagccacctaccacggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcgctcctgtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctaatgttgtgtgttttttttttttgtgtgctggagggaggggatttaattttaattttaaaatgtttaggaaatttatacaaagaaactttttaataaagtatattgaaagttt

SEQ ID NO: 685585 - DNA, 1787 bp, Homo sapiens
  misc_feature (531)..(531): n is a, c, g, or t
tttggtgtatttttttcttattgttttttttaatcgaagtcttctttttccttgtttcatagttatcaggtaccgataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagatggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatggttaagatgtcccgtgaagtccaggtgtttgagataacagagaacagcgccaaactccactgggagaggnctgagccccccggtccttatttttatgacctcaccgtcacctcagcccatgatcagtccctggttctgaagcagaacctcacggtcacggaccgcgtcattggaggcctgctcgctgggcagacataccatgtggctgtggtctgctacctgaggtctcaggtcagagccacctaccacggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcgctcctgtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctaatgttgtgtgttttttttttttgtgtgctggagggaggggatttaattttaattttaaaatgtttaggaaatttatacaaagaaactttttaataaagtatattgaaagttt

SEQ ID NO: 685586 - DNA, 256 bp, Homo sapiens
tccactgttaaaggaatttttataaaagcaagaatttaaaaacccaaattacgttccctggcccagttaccaattctgttactaaaaacagaactgaaattcggggctatcccccggtaaagaattacaaaattaaagaagggaaggcttaaaatttttgtactttgcggaaaatccttttccccggggccaaaaaaacataaatttgttttaaaatttcacaattttttggggtttttttgttttaaaaccaaaa

SEQ ID NO: 685587 - DNA, 2001 bp, Homo sapiens
cggacgcgtggcgccagagtggcagttgtgcagcacgcgccctctgagtccgtggacaatgccagcatgccacctgtgaaggtggaattctccctgactgatatggctccaaggagaagctggtggacttcctcagcaggggaatgacacagttgcagggaaccagggccttaggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggaggtatacaccttcgccagtgagccaaacgacgtcttcttcaaattagtggacaagtccaccgagctcaacgaggagcctttgatgcgcttcgggaggctgttgccatccttcgtcagcagtgaaaatgctttttacttgtccccagatatcaggaaacagtgtgattggttccaaggggaccaacccacaaagaaccttgtgaagtttggtcacaaacaagtaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagatggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatggttaagatgtcccgtgaagtccaggtgtttgagataacagagaacagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcgctcctgtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctaatgttgtgtgttttttttttttgtgtgctggagggaggggatttaattttaattttaaaatgtttaggaaatttatacaaagaaactttttaataaagtatattgaaagttt

SEQ ID NO: 685588 - DNA, 469 bp, Homo sapiens
agaagcggtaaccgaaacttacgcaggtccgccccggtataacggcggttgagggaaactgctattgacgcctagcgacacatacgctgactcataagacgaacttgtgtcagagctagaatatgcacaatgctgtagacgaggtctactggatgcataatgcactcgcaatatgctcaatttcaggtacaccgagatcgacatgcacctagacaccgcagggtgcatacatgctgactcggaccagtgtaatacattcttccgtagctttggcgacatgatctcgatacaatgggcctaagatatcaagctaacaatctcgagaacgctaggcttaccctaagtagtgcaagtgtatcgaatcccccttaagttcgctgacgtagtgccagtcgaattgcccatgtccactatcgacgcagcagccgcgacctagtgtcgagattttgacagacggacttacgggagc

SEQ ID NO: 685589 - DNA, 184 bp, Homo sapiens
cctgggttcaaatagttattgtggcccagcttcccaagtggctgggattagaggcgcatcaccacacccagctaatttttttattaagtagagaccatgttttgccatgttggccagactgtctcaaacttccagcaccaacctcagcctcccaaagtgctgggattatagtcataagccacca

SEQ ID NO: 685590 - DNA, 2582 bp, Homo sapiens
  misc_feature (1062)..(1062): n is a, c, g, or t
  misc_feature (2491)..(2491): n is a, c, g, or t
  misc_feature (2500)..(2500): n is a, c, g, or t
  misc_feature (2514)..(2514): n is a, c, g, or t
  misc_feature (2554)..(2554): n is a, c, g, or t
  misc_feature (2566)..(2566): n is a, c, g, or t
cggacgcgtggcgccagagtggcagttgtgcagcacgcgccctctgagtccgtggacaatgccagcatgccacctgtgaaggtggaattctccctgactgatatggctccaaggagaagctggtggacttcctcagcaggggaatgacacagttgcagggaaccagggccttaggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggaggtatacaccttcgccagtgagccaaacgacgtcttcttcaaattagtggacaagtccaccgagctcaacgaggagcctttgatgcgcttcgggaggctgttgccatccttcgtcagcagtgaaaatgctttttacttgtccccagatatcaggaaacagtgtgattggttccaaggggaccaacccacaaagaaccttgtgaagtttggtcacaaacaagtaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagatggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatggttaagatgtcccgtgaagtccaggtgtttgagataacagagaacagcgccaaactccactgggagaggnctgagccccccggtccttatttttatgacctcaccgtcacctcagcccatgatcagtccctggttctgaagcagaacctcacggtcacggaccgcgtcattggaggcctgctcgctgggcagacataccatgtggctgtggtctgctacctgaggtctcaggtcagagccacctaccacggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcgctcctgtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctaatgttgtgtgttttttttttttgtgtgctggagggaggggatttaattttaattttaaaatgtttaggaaatttatacaaagaaactttttaataaagtatattgaaagtttcctgggtgtgacgttcttggcagtcttgtttccatagcagcgattgtcagaatcacccctaggctggggaaactgggtttggttctggccccatggagctgtgcaacaccctttcgtttccagtggaggaggcaaaagagctttatcagccagtgtgcaaagagacccggctnggagacaangcatcccccgcttngtggattcagccccacatgctcccgtgcttccatgggccnagccggagggtntttcccgctgtttggg

SEQ ID NO: 685591 - DNA, 360 bp, Homo sapiens
tcacggacgcaggatgatgagtacctcgagttcgttattctggttctctctactttagaataggctggcaaatttccataattaaaatttattttgggctggggcgcaggggcttacgcctacaatcccagcacttggggagctgaggcaggcgtatcacctgaggtcaggagttcgaggccagccgggccaacagggtgaaaccccgtctctactaaaaatacaaaaattagccgggcatgggggtgcacacctgtagtcccagctactcaggaggctgaggcaggagaatcacttgaacccgggaggcggagttgcagtgagctgagatcgtgccacggcactccagccgggacgaca

SEQ ID NO: 685592 - DNA, 205 bp, Homo sapiens
gtgcgcaaagatgagaagtggtgagagagctaacatccttgccttgttcctgagttttaaagagtttctagatgcgaacacacacacacaaaagtgtgcttccagaagatgctgctgggaaggccactgcatccctagggagccaaatcaaagcattttgtcctaatgtgaccggaattggcgggttcttggtcttactgacttc

SEQ ID NO: 685593 - DNA, 147 bp, Homo sapiens
attgcgacccgcaccaatgggtggacccgaacggatcagctcgaagcactagtgaggagaccccggtcacggccatgcctgccctactagctgcggctcctcccatgccagggctggaggctgcatggacatccttctccacttcct

SEQ ID NO: 685594 - DNA, 1185 bp, Homo sapiens
  misc_feature (13)..(14): n is a, c, g, or t
  misc_feature (22)..(22): n is a, c, g, or t
aggacccattagnntgatggtnggactagaagcgacctgctcgctgggcagacataccatgtggctgtggtctgctacctgaggtctcaggtcagagccacctaccacggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcgctcctgtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctaatgttgtgtgttttttttttttgtgtgctggagggaggggatttaattttaattttaaaatgtttaggaaatttatacaaagaaactttttaataaagtatattgaaagttt

SEQ ID NO: 685595 - DNA, 967 bp, Homo sapiens
ggggctattgcaatagctcagcatggtgccagagggtgtctctatgatctgagacggaattgttgatgtctcgtgaccgcggtcactcggagatgatgattgattttgctgcgtgagatactacctcctgttgaattaggcccacgtatctctggtatgcctatgacgaccgcgccatgtgagagactttcatcccatctccgcaggtccggataactctgtgcatggtaaatatgtgacctcgagcgtacagcaccatcgtgggggtggtatctgtgtagccactctttcgtacaaaacacgatctctaagcccggaaagcactccgtaccacaatgtagtcctgggtggctcaggtgggctcatggctcctgactcctgaacgtgtcctcctttggaggtgcctcatggctttgagcacatgcgcccttggcagatcccactccgggcggctacgacggcatctctcctctcaacgtgcgcgtctcgcggccaagccttggcggagccgtgagaacaaggcgcatctgtcgaactccttccgttccagggcctcatcggaagcttggctagtcttgtgtgggacgcattgtcaccagctttccatggccacgggaagggtctaatttgccaccttactgcttgtaagcaaaactccccaaggtcgacccgtgtgtagtcacagggtagtacactccagtcacagcttggtctggggcgatacttaccctcgttttttttccctttccgttgaaaacgactcatttgcacacggtccctcattttcgggggcgaatttgtctttcctcagggcgattaaaactcaaggccaaaggcacttgtgggtcaacatttcgtgacgaggagcttcaagccacggggctttgattggaacccacgcgtgcggcatgggttacccgattcccgagccttagaagccaagggagtggtggttttgcaagggccc

SEQ ID NO: 685596 - DNA, 927 bp, Homo sapiens
  misc_feature (28)..(28): n is a, c, g, or t
  misc_feature (78)..(78): n is a, c, g, or t
  misc_feature (83)..(83): n is a, c, g, or t
  misc_feature (88)..(88): n is a, c, g, or t
  misc_feature (92)..(92): n is a, c, g, or t
  misc_feature (106)..(106): n is a, c, g, or t
  misc_feature (113)..(113): n is a, c, g, or t
  misc_feature (117)..(117): n is a, c, g, or t
  misc_feature (123)..(123): n is a, c, g, or t
  misc_feature (132)..(133): n is a, c, g, or t
  misc_feature (136)..(138): n is a, c, g, or t
  misc_feature (141)..(141): n is a, c, g, or t
  misc_feature (144)..(144): n is a, c, g, or t
  misc_feature (149)..(149): n is a, c, g, or t
  misc_feature (165)..(165): n is a, c, g, or t
  misc_feature (180)..(180): n is a, c, g, or t
  misc_feature (189)..(189): n is a, c, g, or t
  misc_feature (193)..(193): n is a, c, g, or t
  misc_feature (203)..(203): n is a, c, g, or t
  misc_feature (227)..(227): n is a, c, g, or t
  misc_feature (233)..(234): n is a, c, g, or t
  misc_feature (253)..(255): n is a, c, g, or t
  misc_feature (280)..(280): n is a, c, g, or t
  misc_feature (291)..(291): n is a, c, g, or t
  misc_feature (294)..(294): n is a, c, g, or t
  misc_feature (301)..(303): n is a, c, g, or t
  misc_feature (309)..(309): n is a, c, g, or t
  misc_feature (313)..(313): n is a, c, g, or t
  misc_feature (317)..(317): n is a, c, g, or t
  misc_feature (326)..(326): n is a, c, g, or t
  misc_feature (343)..(343): n is a, c, g, or t
  misc_feature (373)..(373): n is a, c, g, or t
  misc_feature (380)..(380): n is a, c, g, or t
  misc_feature (382)..(382): n is a, c, g, or t
  misc_feature (386)..(386): n is a, c, g, or t
  misc_feature (390)..(390): n is a, c, g, or t
  misc_feature (402)..(402): n is a, c, g, or t
  misc_feature (412)..(412): n is a, c, g, or t
  misc_feature (433)..(433): n is a, c, g, or t
  misc_feature (504)..(504): n is a, c, g, or t
  misc_feature (513)..(513): n is a, c, g, or t
  misc_feature (537)..(537): n is a, c, g, or t
  misc_feature (542)..(542): n is a, c, g, or t
  misc_feature (550)..(550): n is a, c, g, or t
  misc_feature (575)..(575): n is a, c, g, or t
  misc_feature (853)..(853): n is a, c, g, or t
  misc_feature (917)..(917): n is a, c, g, or t
ctggggattgcccctacctaggcttgcntgctggggctttgccacggggtccagttcacacttagcactaattaaatnctttnttgantaantacaataccaaacncaatgcnttcngatgcnttctgaagnngtnnnggnggnctttntgctcgggctaatggnaaacacaatagaggnggatatgcnagtntgggatagtngggtggttttgtgcggcacttatntctttnngtccacaagtgtattattnnntgatagggagcatctaatacaaccntttctacaganctngggaatnnntttctnaganaganagattttgngggccccatcttttatncccaccccaacagtctaactctaaaggggntagggcnantggntttnctcacgggggcncacggctggngtggctttgctatcggggtcngtgtttctgatccgttatgagcgttgggacgagattcagatattcccaaagggggaggcgcaatgcacgtngtgatcgcntattcagcgacagcgagcgctgcntccgngactctcntcccggggattggatgaggtcagcnacattcatgggcatctcctccactgtggtattgtagaaagtctcaatgtcacgaagaatcctcttgtcttcttcagtaacaaagtttatagccacacctttcctcccaaatcgaccccctctgccaattctgtgaatatagttttcacgattggtaggtagatcataatttataaccaaagacacttgttgcacatcaatcccgcgagccaacaagtcagtagtgatcagaacacgacttgaccctgaccggaattccctcatgataacatctctctncttctggtccatgtcaccatgcagagcagaaactgtgaagtctctggcatgcatcttctcagtnagccagttca

SEQ ID NO: 685597 - DNA, 1057 bp, Homo sapiens
cgagctcgttaccgaattcatcagccagcagtgtctgtctagttcaaccatcaatctaatggtgagcacagaaccattggctctcactgaaacagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcgctcctgtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctaatgttgtgtgttttttttttttgtgtgctggagggaggggatttaattttaattttaaaatgtttaggaaatttatacaaagaaactttttaataaagtatattgaaagttt

SEQ ID NO: 685598 - DNA, 653 bp, Homo sapiens
  misc_feature (39)..(39): n is a, c, g, or t
cactcgccaagaggtgaatgccgctcgtccccagtgtcntgtgggctttacaccttgccctttcccagcatgcggcggaagcacatagtagacgagaagcagcctgggttctacctaaactgcggtcacgttcacggctaccacaactggggcaaccgagatgcagagcgagatggaagggagggacgtgagcgtgaatgtcccatgtgtcgtgctcgcgggccatacgtcccgctttggctaggctgcgaggcagggttttatttagatgcggctccacccacgcatgcattcagtccatgcggccacgtgtgctccgaaaaaacagcggcctactggagtcaaatcccacttcctcatgggacgcacaccttccacgccgcctgtccttttctgtgcacagcagctcaatggcgagcagggatacatcagactaatcttccaggggccagtggactaagcacacctgcctttgaccctatttcacaaacattaatcctttttccaccttcagtgcgatttttataaagatttttctgcgctcccagactgtttttttcttccctttctggtttataagtgacctttatactgctttttccaatacagagagaaaaaaagactatatattttcaaataaaatgataaaagca

SEQ ID NO: 685599 - DNA, 273 bp, Homo sapiens
acatcacactcctgcgtacaggttgatccatcatgcgccctgccaattgtactccttacttatttctcaaatccactattttttccctacctccaccccactaccaccctcttccaatccccattatctctaaggccccaccaggtctttcctcattcacgcttgtcttctctaatacactctacacattagcctttcatggaggtaatatttagaaatagacatctggcacattacggcctcgcacccctacttaaaattcttcaggcttta

SEQ ID NO: 685600 - DNA, 130 bp, Homo sapiens
aatatgtattatgtgtatatacttgtttgcaggacattatttgttcatgccttagaggattgtagcatttatttcgtctgaaggtaatgatagctatacagcctgtccagttactcatcctcttccaccc

SEQ ID NO: 685601 - DNA, 151 bp, Homo sapiens
tcgcctgcccactgagccggcgtgcagtgggctgcgtaagagtacctggcgatggcgatatgatcggtgcgcgtgtgccggatgagagggtggctcctagactagtagaaacccgggcctgctccgggagccgaggcgctaggtgcaacat

SEQ ID NO: 685602 - DNA, 394 bp, Homo sapiens
tcagcagacacatcaaagattttcaatgagaaaatgatgtcaggattacgttattcgggaaattaagaacctgtacagggcaatttcaactaataatggcgactacctgctcaccatcttttggcagcaacgaagaagaaatgaatggtctgaacagacttagcccgacagagctgcccaatatagaggatgccaatgttaaagtgaccacaagaaatgtaacatctctttttaggagcagccctagataaggaaatcttccaactggtccttcaggagagtgtctaagcagtcttggatgagctacatcaacaggtctgcagaccacagagccagcaatcaggaaccacattccatgtagtacaaaatttagaggtttcccctttatcaataa

SEQ ID NO: 685603 - DNA, 845 bp, Homo sapiens
ggtggcgtgagaagccatgagcagcatggtctctcgcgactccctgtacgatgcggtgcgggaatgtccttcatcgggatatccagtgcaggttccgtaagtgcctggagacggtggagttgcagatcagcttgaagaactatgatctctccagaaaggtacaaagactgcgttcatcgggcgctacgcggtcatgagcattaagacgatcctacatcacacctgcactctacagttcctcttgtgatgctgtctcgtgcgtgagtactcatgtaatgcacttgatgcatctgaaggctttaatgcgcacgggtagtgatatcccactcgaggatgtgacatcgtacgtgcgactgatcatataaactctactatattggtcagctgggtcccgaatgctggccaaggaatgtctgatagccgtgttgttgggctcatgtacgtctccttgatcgaggcatgatttcatgagtcctcggccccggtgtaaagataatggcatggacaagttctccttaccctgactctagtacgtcgaaccgatacaaacataggttcgagccaaggagtgtgattgaagtgttgaacgtccacagttaaagttccaaattggagaaggtcgttatgtctggctgtggctgttggtcacgtgaagatgtacagacgatgagcttgtgtctaacattcacctggcttgtcaccttcttgggtgtcattgctcaagaaaaagctggctgaatgtccgggctttatatatccgagagcaccatgggctaaggccccagtcgcctatatttaatggcacattttgaatcagattctattaccagtgatatgcaatgcgg

SEQ ID NO: 685604 - DNA, 187 bp, Homo sapiens
  misc_feature (33)..(33): n is a, c, g, or t
  misc_feature (61)..(61): n is a, c, g, or t
  misc_feature (101)..(101): n is a, c, g, or t
  misc_feature (107)..(107): n is a, c, g, or t
  misc_feature (113)..(113): n is a, c, g, or t
gtgagagtatggaacaatggcccataaggactnctaagcgccgaagccaaggagcctcctnccttcctggttcaccccgcccaagggacctgcccccattnctgtgnccctgnccaggcgttccaatagtgtcagaagcaacttgtggctttgctgtgggttgtgagatgggtacattccaaaggag

SEQ ID NO: 685605 - DNA, 1075 bp, Homo sapiens
tgcctgttgttcgtcacaggtttgcgtcggtggtggtgctgtgttgtctctatgctaggcaccgggggtaggggccacttgttgccctcccccttttccttggttgcgcctttgaagaggtgtgtgcctctcttttccgcttgtgccctaaccgggggttgctcggcccgtttccattgtggctcccccctctctgtggtggtggggggccctttgttcggtcaatattgtccggggttacgccataacacagagtgggggcactaccttggcccgtgggttcttttcgtattgtggtcttcttctaccccgtatgtgccccacgtggcccgttgagttcctcaccttctgtggggctacatttcgccccccccctcccaagtcactggattccatggactcgagccctttgtgaggaggacgtctcgccctctggctggaactgatacctggtgcactccccgggtcatcctgggagctttcctcagcaccttcaccgttccctccccgtgtagcctcctgtccgtgggggctggacccttctgattcagaggtctcatgcctgcccttgccccagatgccccgggtcgtgccacttctttgggattacccgttccagtctcccaccgtttctggttttctgtccccctatgtacccgtttttcacgtggaccactggccccccccctgccccctgcacgccctgctgcacccactttcaccccgagcacccaaggggaagaacgccgacactcacggtgctgcacctcaccttttgtccccctcggggaagttggggaaagggacgaaccctcggctggaggggatatggaggggcttttaaatttatttctttttctcgttgaggcttccccctctctgagcccgttttcactttcttcctggtggcacttagcccctccctgcctctcacctccacgacccgttccccccactcggggaggtatggctgggaggccaaaaggagagggtgggagcccccttttgcgtggttggtttttattaattatctggataaccccccaaaaaactgtaaaattaagagagagagaga

SEQ ID NO: 685606 - DNA, 421 bp, Homo sapiens
ggggcaaactcattaaagtttttggatcctatagtactgaaatattactcaaaagttcaaatgggctttgatttatttatctgttttggaagcttcagacttttcaaaccattatggccgttaatgcatctgatacaagattggatgtgattataggaactttgagaacataaaacatactgcttttttgcatttctgaaaaattcttaccaaaaggaagaatttgacttctgtccagaaggagtatctgatttgtttggactctggataaactcgagctgtgcatatttggccaagagtttgatttgtggactgatcatcgagccgtgggcaagactcaggcttcagaaagcgatgtcagtgtcaagaatcccacatgaacattaaatatgcttctggacagataaacactcgagccaaa

SEQ ID NO: 685607 - DNA, 530 bp, Homo sapiens
gcccgcgtgctgcccggaagtctattgcgtttgcgacgccggagtggccggggagccgggacaagcgcaccctcgcctgcctgatccagaacttcatgcctgaggacatctcggtgcagtggctgcacaacgaggtgcagctcccggacgcccggcacagcacgacgcagccccgcaagaccaagggctccggcttcttcgtcttcagccgcctggaggtgaccagggccgaatgggagcagaaagatgagttcatctgccgtgcagtccatgaggcagcgagcccctcacagaccgtccagcgagcggtgtctgtaaatcccgagctggacgtgtgcgtggaggaggccgagggcgaggcgccgtggacgtggaccggcctctgcatcttcgccgcactcttcctgctcagcgtgagctacagcgccgccctcacgctcctcatggtgcagcggttcctctcagccacgcggcaggggaggccccagacctccctcgactacaccaacgtcctccagccccacgcctag

SEQ ID NO: 685608 - DNA, 232 bp, Homo sapiens
aatgaatgtactataaaaataatgaagcagctacttaccatcaggttacaacttaactttacaaagaagtgaagccgcacagagctgaaacagaaatgacatagagaaagagaggcggcaaagtccttgagtcccaacatgtccacctcaaagtacaaacatactacaagaacaaaggcccctaatccacctcctcaatggtagggcctgacccagaccctcccttgggacc

SEQ ID NO: 685609 - DNA, 354 bp, Homo sapiens
gcccgcgtgctgcccggaagtctattgcgtttgcgacgccggagtggccggggagccgggacaagcgcaccctcgcctgcctgatccagaacttcatgcctgaggacatctcggtgcagtggctgcacaacgaggtgcagctcccggacgcccggcacagcacgacgcagccccgcaagaccaagggctccggcttcttcgtcttcagccgcctggagggctccatccagctgtgcagtggggaggactggccagaccttctgtccactgttgcaatgaccccaggaagctacccccaataaactgtgcctgctcagagccccaggtacacccattcttgggagcgggcagggc

SEQ ID NO: 685610 - DNA, 257 bp, Homo sapiens
  misc_feature (45)..(45): n is a, c, g, or t
  misc_feature (76)..(76): n is a, c, g, or t
cccaaaagcctttaagcccctccctgtcccctcccttgtagtccnaatttttccaactttccattccccatcaagntgggggttttggtcacaaggttcagtttttttccactgtccatccctcctatcatttgtagagcaaagcacaggcagttgtgtgccttgggcccagggaaccctccatcaaccttagacaggactcagtaaatggtttttgggtaagccccaccaggtggaataaagggcccagattttga

SEQ ID NO: 685611 - DNA, 827 bp, Homo sapiens
gcccgcgtgctgcccggaagtctattgcgtttgcgacgccggagtggccggggagccgggacaagcgcaccctcgcctgcctgatccagaacttcatgcctgaggacatctcggtgcagtggctgcacaacgaggtgcagctcccggacgcccggcacagcacgacgcagccccgcaagaccaagggctccggcttcttcgtcttcagccgcctggaggtgaccagggccgaatgggagcagaaagatgagttcatctgccgtgcagtccatgaggcagcgagcccctcacagaccgtccagcgagcggtgtctgtaaatcccggtaaatgacgtactcctgcctccctccctcccagggctccatccagctgtgcagtggggaggactggccagaccttctgtccactgttgcaatgaccccaggaagctacccccaataaactgtgcctgctcagagccccagggctggctggcggctccgcgcagtcccagagggccccggatagggtgctctgccactccggacagcagcagggactgccgagagcagcaggaggctctgtcccccacccccgctgccactgtggagccgggagggctgactggccaggtcccccagagctggacgtgtgcgtggaggaggccgagggcgaggcgccgtggacgtggaccggcctctgcatcttcgccgcactcttcctgctcagcgtgagctacagcgccgccctcacgctcctcatggtgcagcggttcctctcagccacgcggcaggggaggccccagacctccctcgactacaccaacgtcctccagccccacgcctag

SEQ ID NO: 685612 - DNA, 493 bp, Homo sapiens
  misc_feature (24)..(24): n is a, c, g, or t
  misc_feature (35)..(36): n is a, c, g, or t
  misc_feature (138)..(138): n is a, c, g, or t
  misc_feature (265)..(265): n is a, c, g, or t
  misc_feature (334)..(334): n is a, c, g, or t
tttttttttttagtagagacaggntttcaccagtnnggccaggctggtcctgaatgattgacctcagttgatctgcccgccccagcctcccaaagtgctgggattacaggtgtgagccaccacacccagccacaaganaactttttatcagattttttttgtctctattcatattaactacaccaagatcaagttacaaaaagttgtcagccgggtgccatggctcacgcctgtgatcccaacactttgagaggccaaggcgggnggatcatttggggtcgggagttcgaggccagcctggccaacatggtgaaagcccgcctctactaaaaanacaaaaattagccgggccgtggtggcgtgcgcctgtaatctcagctacttggtagactgaggcgggagtatcgcttgggcccgggaggcggaggcttgcggctgggccaggatcgcgccactgcactccagtctgggcgagagagtgagaccctgtctc

SEQ ID NO: 685613 - DNA, 359 bp, Homo sapiens
ggcactttgcgtggaagagaacgggcaggagcagacgatgtctgagtgtgaggcggtcgcacatgagctgcagagggcaaagcgctctctggcaccagcataaggtcttgtgcatgcggacaacccagtaggctcctggaggccctggtcagcttgcttggaatccagcaggcagctggggctgagtgacaacatctgcagcaactgggcactggacagctttgccttctccagtgtctaccttcctcctcaagtcccagacatctgtataaacacaatccttggtactcccaaatctgagtcgaattactctattgcctccttcttaatgtcagtaaggatatgagcctttgcacagg

SEQ ID NO: 685614 - DNA, 323 bp, Homo sapiens
attgcgggagcatcgcaccgggcctgaggtatatttatataccgcaaaatttacccttttaagtgtccagctctattaattttgacaaatttatatatagtcatcataacttctaccataatcagcatgtaacatatttctttttctttttttttttgggggatggagtctcactctgtcacccaggctggagtgcagtggtgtgatctgggttcactgcaaccttcacctcccgggctcaggaaattctcctacctcagcctcctgagtagctgggattacaggtgcatgccaccatgcccagctaattttggtttagtaga

SEQ ID NO: 685615 - DNA, 170 bp, Homo sapiens
tagagtgcaatggtgagatccagaatgccgcgtaccgtaggctaagtcccatcgcgatcccgaccggaataccgaacaacaccgctgcaaatagcgccacgataatgcgcgtcagactggctgccagatgctgccacagcgtcgtccataaagccttgcgtccggcaatg

SEQ ID NO: 685616 - DNA, 202 bp, Homo sapiens
cacacataatcaggggaagtatgacggggagaaagctccccccagatatggtccacacgctccccgagggccgtctcacgacacatctccatctggcgacctcgcgcatacccccgcgctctaggccctccgctccccaccaggggatcgggcggcgcatttcccccccatcctcatccattgatgtggctgcgctgctacg

SEQ ID NO: 685617 - DNA, 1443 bp, Homo sapiens
gtccccgccccctgctgggcctctctccgcagccgcgagacccgcgcttggcgcataggccggttctaatttacaagaacaccgcggcctgaggccggagagtcccttcaacccgggaggcggcggctgcagggagccgagacggcgccattgccctccagcctgggcaaaaagagcgaaactccgtctcaaaaaaaaaaaaacatggccgaaaccaggaagctgcgcgatggcgccacggcccctcttctcccggcctgtgtccggaaggtttccctccgaggcgccccggctcccgcaagcggaggagagggcgggacgtgccggggccggagctcagaggccctggggccgctctgctctcccgccatcgcaagggcggcgctgacctgaggcctccccgcaaaggtccccgaggcggcggcggcggcgggctgtgagaaccgcagaagaacgctgggcgcgcagcgacccgtccacccccgcgaggagagacttccacagaggcagcgtttccacagcccaaagccacgtttctagggtgatgcagccccagtaagttcctggcggggaagctcacggctgtcaaaagaactcttcgctccagccggcgcacgaaggggaggagggcaggaggctgccgcccgcacaggtcatctgatcacgtcgcccgccctagtctgcttttgtgaatctccactttgttcaacccccacccgccgtctctccctccctgcgccttccctctaaccttaaagacccagctacctctacgcaaatggtagctacctctacgcaaatggtagctacctctgcgcaggtggaagttgagttcggttcacgcgggaccctcttccctgtggcaagctgctgaaggagacctgctgttactgctttagctgctgttctgcttaatctcagacagctggaaggtagtattccgccctcgcccagccacccgagtaaatgcccctttcttcccttgatctaagaaggttgctccggatctcgccatctggcctgcgttcaatcagcagaagcttcctggaggagcaggaggaggcactgtgctcgcatcacataccagtggccagaagttggcttcagggaagctcaggaaataggatgcgagaagccatgagacctccccaaactctgcagtaacagagtcaacaagacaatggcttaaagatggagagaccagttgatcggtcacacaagctgttccacgataattcttgtgtcagaaggggaggctgactaccaggaccactggccccacttccagcccctccattttgagtacacttcagagggctctggcagggtgagggggtcttggtggtgccacagagagtaaaggtttagcacacccattgtggagatatttcatggggacaacccagtgacttcacttgaagtaaagtgggattttccaacctt

SEQ ID NO: 685618 - DNA, 747 bp, Homo sapiens
  misc_feature (355)..(355): n is a, c, g, or t
gaaaacttcccatttccggtcagttgtttgatggacatggcacgtactgtgacacctgtaggctctcctttgggagcactgttgccgtcgtgttgtgcgctgtgaggatggcacctgtggacccgtccttcccagccagtccgcgtcactcctggaagcgtatctaatcgacctaatgtcaagaaacgacccgtagcataatatactctgttggtagccagggaaagcaatcccacgggtgtgctcggagttggctgctgaggcatgtatttcattcttactgattctttgcacatattggagagaattgcgcgccgtcactggtgatagccgagaagagccagtcctgcttcangactcctttctctatttccagtgataattgcctcactctgaatttccgatcaagcctgcagtgcttattgcatccaagtgacgggtgcatctggctgggcaatgggccctgccatctgcgcattctgttgctttgagggctgtatgacagtttgtccgagttagctcctccggcccgattggccacttgtgccaagtccgggtgtccagaggggccctcttctgtccctcatgcttcgctgttctgtggatggccgcgtgtccttgtaggtcacgccttcgttcggtccgggagggccttcatctggttctcaatatgaacctatgggcggaccgtggagcatcatggcaagcacgaatgtcgaagttgggggagtggatgggcagcctccg

SEQ ID NO: 685619 - DNA, 188 bp, Homo sapiens
gtgtagccagagcacacaaaatctgtatacacacggtctgtgattgaccacttcctgtcactccagctcggacgtgctacatctcccaatttcacctactgaaaataaacaccactaccaccaagatgcttttgaccccgggaaatacttgagaaagcagaacgaagaaagccctaaacatgttctga

SEQ ID NO: 685620 - DNA, 859 bp, Homo sapiens
  misc_feature (94)..(94): n is a, c, g, or t
  misc_feature (158)..(158): n is a, c, g, or t
  misc_feature (163)..(164): n is a, c, g, or t
  misc_feature (190)..(190): n is a, c, g, or t
  misc_feature (196)..(196): n is a, c, g, or t
  misc_feature (200)..(200): n is a, c, g, or t
  misc_feature (228)..(228): n is a, c, g, or t
  misc_feature (233)..(233): n is a, c, g, or t
  misc_feature (237)..(237): n is a, c, g, or t
  misc_feature (244)..(244): n is a, c, g, or t
  misc_feature (259)..(259): n is a, c, g, or t
  misc_feature (263)..(263): n is a, c, g, or t
  misc_feature (267)..(267): n is a, c, g, or t
  misc_feature (310)..(310): n is a, c, g, or t
  misc_feature (334)..(334): n is a, c, g, or t
  misc_feature (348)..(348): n is a, c, g, or t
  misc_feature (354)..(354): n is a, c, g, or t
  misc_feature (380)..(380): n is a, c, g, or t
  misc_feature (382)..(382): n is a, c, g, or t
  misc_feature (385)..(385): n is a, c, g, or t
  misc_feature (387)..(387): n is a, c, g, or t
  misc_feature (392)..(392): n is a, c, g, or t
  misc_feature (395)..(395): n is a, c, g, or t
  misc_feature (397)..(397): n is a, c, g, or t
  misc_feature (402)..(402): n is a, c, g, or t
  misc_feature (408)..(408): n is a, c, g, or t
  misc_feature (410)..(411): n is a, c, g, or t
  misc_feature (537)..(537): n is a, c, g, or t
ggttcctgctggggggcagccgcaagcgtgtgctggtgcgtgtggagcgggccacggtgtacagcgtggagcaggacaatgatctggagctggncgacgcctactacctggggggcgtgccgcccgaccagctgcccccgagcctgcgatggctcttncccanncggaggctcagtccgtggctgcgtcnaaggcntcanaggccctgggcaagtatgtggacctcangcggntgancacgacnggcgtgagcgccggntgcnccgncgacctgctggtggggcgcgccatgactttccatggccacggnttccttcgcctggcgctctcgaancgtggcaccgctcnactggncaacgtctactccggcttcggacttncnacngngaccncangnacagntgcccntnnctctactaccgggcgtccccggatgggctatgccaggtgtccctgcagcagggccgtgtgagcctacagctcctgaggactgaagtgaaaactcaagcgggcttcgccgatggtgccccccattangtcgccttctacagcaatgccacgggagtctggctgtatgtcgatgaccagctccagcagatgaagccccaccggggaccaccccccgagctccagccgcagctgaggggcccccgaggctcctcctgggaggctggctgagtctggcaccatttacaacttcagtgggtgcatcagcaacgtcttcgtgcagcggctcctggggccccagcgcgtattgatctgcgcagaactgggcgcgtcatgtgagccggtgtgcccgccttgagccaacccggctgggctaggtggggccgccggagctccgcggggcgccgggctg

SEQ ID NO: 685621 - DNA, 758 bp, Homo sapiens
ggctgtgctgtgttgtgcggtaggggaaccgtcgtgcggaaggatggtgtgcgacaaatgtgacaagaaattggtactgttatcatccagatacatggaaagatggtgctaggaataccacagaaagtggtggaagaaagctgaatgaaaataaagcttggattcaaaaaaagcaatgatttgatccatatggacagaataagttctccactgtgtagaattgcgtaaacagttctgtgcaccaaccaggttctcattactgccagggtgtgctaaaaaaaaagtgcatctggtgcgatgttgtgggcacccaacacggtttgggggaataccagaaaaactacaagcaaacattctggtcctaagattgtatggatggacatttccggggtttcctaaaatgatttaacctttctggccgttgaaattttccaaggggcacataagattgtcaaccttacaggaataacattgtttgacgatacatcacagttttcaacccatgaggaatttgcgatgtgttacctccaattttgtggctcctacaatgttctaaaccaagcaaaccagtgtaacctaagctcctttgcgttcgtcacactgggttattctatccttaataaggaattttaaaggaccctaacgtgggcaaatttccatggaacaaattattttcctcggggttcttgtatgccctttctttaacacttatcatatattattctccccccaaaaattcatttatagactacgccaca

SEQ ID NO: 685622 - DNA, 664 bp, Homo sapiens
cacgaggagagagatagagagagagagagagagagagagagagagagagagagagagagagagagagagtgagagagacagtgagagagtgagagagtgtgagtgtgagagtgtgagagtgtgtgtgtctctccctctctccgaccttccttttctctttgtctcttgcttctctccatctcacactgtccccgaccctttcttctctttcttctatttctctgtcgctgctcgcgatactcttattcttcaccagcctgcccccgccctccattatgtctatggcttattcgttctctatcgaccgctcccttacccaccctctcactttctttttgtttctgccctatctgtttgtttgtctcttcaatcaccccttcctcctgccttgtctttcattctggtttgcagacctctctttcacttacactctcttctatccatccactctcatttttttctccccccctgttcttgcaccctctatcctcattccccctcccccgttctttctttttttatttcccccccctcttttacccgacccatccctttcttgttttctatctttctctggctttgccccgcctcctttttctgtgttttctttctccagccagagctgccgccctttcttcttgctgattgacttttcttcccttcg

SEQ ID NO: 685623 - DNA, 377 bp, Homo sapiens
gatgatgacttttaaggaccctgggggctgtgctagggacctgcagtggcagaactgcaaagcttagccttggcagtggggggtgcttggaagcccccagccagcaagcattaatgggggtggtgccccctttcccctcagcagagctatgtttaaataaagagctcccttccccccagcacttttttaatattttgttcccccaagggccaggccaaagacccaggaaggcagcgaccccttgggatccctaacctggaggaaattgccagggacccaaagggagtgccctaatccaacctggggattttttaaaagcttcctaggaaaaaatgatttccgatgtgatgaatacgaataaaaggcccttaatggca

SEQ ID NO: 685624 - DNA, 1485 bp, Homo sapiens
aaaagcagctggtacggtcgggggttaggatccgcgctgtggctgtttcaccgctccccggctgggacttggagtcccttatctttccctggtttggtacatgaccctggaagcctcggctggccgttgcgtcatccatggcgccggcgcagagcgagaaggaggtgggaacgccgtgaagcaagagcggtcggcagagcggggaggcgaactgcagcagagttcttgctttccggcaggtgatggcgccccccgcggcctagaggtccagcgcccgccgcgagcagcggacagtcctcctgttgtgtccgaccgagagtcctggtgactttgaacatgctggtgccgctagccaagctgtcctgcctggcatatcagtgctttcatgccttaaaaattaagaaaaattatctacctctatgtgctataagatggtcttcaacttctactgtgcctcgaattactacccattatactatttatccccgggataaggacaagagatgggaaggagtgaacatggaaaggtttgcagaagaagcagatgttgtaatagttggtgcaggccctgcagggctctctgcagctgttcgtctaaaacagttggctgtggcacatgaaaaggacatccgtgtgtgtctagtggagaaagctgcccagataggagctcatactctctcaggggcttgccttgatccaggtgcttttaaagaactcttcccagactggaaagagaagggggctccacttaacactcctgtaacagaagacagatttggaattttaacagagaaatacagaattcctgtgccaattcttccagggcttccaatgaataatcatggcaattacattgtacgcttgggacatttagtgagctggatgggcgaacaagcagaagcccttggtgttgaagtataccctggttatgcagctgctgaggtcctttttcatgatgatggtagtgtaaaaggaattgccactaacgatgtagggatacaaaaggatggtgcaccaaaggcaacatttgagagaggactggaactacatgctaaagtcacaatttttgcagaaggttgccatggacatctagccaagcaactatataagaagtttgatttgagagcaaattgtgaacctcaaacctacgggattggactgaaggagttatgggttattgatgaaaagaactggaaacctgggagagtagatcacactgttggttggcccttggacagacatacctatggaggatctttcctctatcatttgaatgaaggtgaacccctagtagctcttggtcttgtggttggtctagactatcagaatccataccttgagtcccttttcgagacgtcccaccggtggaacaccctctagctttcggccacttggacgtggcccggttgctcccgagccagtccctgcaggggctccctttccatcccttcgcggcgccccggggccccgttgttccccccgtcc

SEQ ID NO: 685625 - DNA, 234 bp, Homo sapiens
tactttcacagggtgtcaaagaactggcaagtcctgcttcagttcctttgtgtacatacccagaagtagcattgctggctcacatggtaattctgtttaacttattttgaggaaccaccaaaccgtttttcacagtggttgcaccattttgcatacccaccaacggtgtacaagggttctaatttctccacatccctgacaacacttgttattttctgtttttttccttgatag

SEQ ID NO: 685626 - DNA, 392 bp, Homo sapiens
  misc_feature (1)..(1): n is a, c, g, or t
ngttgtttctggcccccgcgaatatgatgacagtcacatcgttaacgcagtggatccacttgcggcgttcatcgcgttggccacccgtgtcaaacttgtggaagttgccttgtgtccacttgaaacttggtctcaaagattccaagagtcagcacgcgacagcgaaccagttctgtgtctcgctcggcacatagtcagctggcttgatcacgtcgttctgtgtccagaaagttctgggcacagtcattcatgtggcactcgttgagagcgttcgtagcaggcgcgctctctttcatcctcccacagagccttgcgcatgctcatagaattcgagaggagagtcagagtcaggcgcgttcatcactctcagtgtgtagtcctctctgatgtgg

SEQ ID NO: 685627 - DNA, 469 bp, Homo sapiens
  misc_feature (251)..(251): n is a, c, g, or t
  misc_feature (385)..(385): n is a, c, g, or t
  misc_feature (426)..(426): n is a, c, g, or t
gggatttcaggtgcacaccaccatgcccgactaatttttgtatttttagtggaaacaggttttcaccacgttggccaggctggtcttgaactcctgacattgtgatccgcccgcctcggcctctcaaagtgctgggtttacaggcgtgagccaccgtgcccggtcttcatcatattattaactaaatgcatttgacaaaacttatatctttttggaagaaactgaaagatgtgggttgagtgatagattangtggatgatttatgtattatcctccagtgttaaccttttaatactttattatcttgggcttcaataacacttttataatagcactttaaaattttacattgggaagtggactagattggtcccttggaagtggntagaaaaagggctggggattccatccttggggttttcaacntgggaccccaaagggaccaaaatggcctttgggttaagggggg

SEQ ID NO: 685628 - DNA, 1210 bp, Homo sapiens
  misc_feature (617)..(617): n is a, c, g, or t
gaggcattgaggcagccagcgcaagggcttctgctgagggggtaggcggagctggaggaagccgcagatagaggtttctttctgcttgtgaagaggataggagattgtactgagcaacctagcttaaaatagagtatagtgaataggttactaagatattgcttagcgttgagtttttaacgtaagtattccagtagcttaagattttcagagaaatatatgaagacttaggaatgagtatgccgatgtagcgaaggtaataacgcatacaagacggtttctaacaagatgacggagggttgatgatgaaagtctttcttcatgggaggtaataagacatgtagttctaaagaagaaagattgagaggaaaggactaacagagtccccgatcttaataccaattcgaacggggcaactgctattctacgaattcatacaacgtgaaggttgacgtgtagaagacctacgctatacacagtttctcaggtcttaccaaagtatgtacggtcgcattaccccataaattccgaacggcagatgctcttgtctccaaggcatgattcaacacgcggaacagggtgcactttgaatatcacgacccgttggaagaggtccnattgaaccgcagcggagcaaatggtcgtcagtttagaatgctctaagattagatcgcacttttactttaagaacgccgtaccgaatgaatctggcacataggaagttaactttgcggacgtgggtacgcggatgaaaccaagttcctgggcagcatcgcaatcggaccggcttgggaactggcgcaaacaggagttggacatgggaccaggacacgttaccggcgacaggcgcgcaatggacacaagcaaaatcagcaagaaagcattgggggcacgacttgggacatgcactcatcaacctttacctttgcgcgacacgtaggcgagaggactccccttttgtcaaccgcctgaagaacgttcggaacgccagaaaggcactccacagcacctgggcctccggaatagcaccccacggttacaggggccaccaatgttacccgacacttcgagtaaagacgccatgttggtgacgcatatcaaacccacgtgtttacaaattgtcagcacctctttggccagactgtttccgcattacaacaccctggggacccggcccacgaaccagctttcttcccaacccttcacacgg

SEQ ID NO: 685629 - DNA, 220 bp, Homo sapiens
gaacagcatttcccccgcctccagcctttcccctttggcaggggcccccaggagatggaattccctgcccgccccggtccgggcccacctgtcctaggttgggcaggggggggggccccagcttgttttctgccttggttcccaaaagggggggccctgggggggggggtgaggggttttgtggaagtttgttaataaagctccgtgctttgccgcccca

SEQ ID NO: 685630 - DNA, 88 bp, Homo sapiens
ccgccgccaccgagccgccgctgtgctcactgatccgcctccagggtcaccgccatgtcgagccgcggtgggaagaagaagtccacca

SEQ ID NO: 685631 - DNA, 741 bp, Homo sapiens
taaaaaccgggagcttatttaatccatctaaaaatacaatgtcaggaatgggggggacccataggaaaatcctccacctctaacagagcgaagttactgggcttctggctggctccaagaatcccaaggcttgatgttgggaaggaattaatctggtgtcttcaataactcccagatactcagactataatgttacccccactatctgggcgagaagggttctggccctggctgaagctcagatggggacgctcaaggctattgggagaaaggagctatcaatctcagaaaaaatatgtatccaaatgaacaagctcgagtggcaacagtggtgggggcctatcccaggcaatgtggggctcctaggagtggcttctgggtggtaagccagaaaccctataacaatgtctggaggtctgggcctaaggaaagcccacccatgccagctctggtgagtttcagtcataacagtcttctctggggagtcatctataattataccatactattcaagccacaaaggcctctttgggggacgcaaacaggcctctaacagaagcgctctacatctataaaaaagcccctctgggtgggtctggggtatacaccataccaattatatatcttcgccttctttacccaaaaattcctgtggatatggtaaaagcccttctggaacgagtgtgttgatacattctggggggacaaagggatgttcaaagtacaaccctgggaagagtc

SEQ ID NO: 685632 - DNA, 1313 bp, Homo sapiens
gagatggacaggttatcaacgaaacttctctagttccaagactgacctttatctgaagtgtgctgcacacgtcatggtgcaagtcaatatagtataccagtcgaagacctaatcaaagaagagtccactatctgtaatagaaacagctgttcaacgttgcctatgctgcagatttttcaggagacgcatcgtactagatcaggacataggcaagtaagtctctacgtgcttaccataccgagcacgtcctacatagtattcacgaaacaaagttttacaagcactatatcatagttttacaggaaaaagtcgttgctgcgtagacataccttgtttaaacacggctagtgcattgacatacataattaaaaagctggctatgagtatatttatccagacaagctatccaaaccagactgggatctcatgcattacaactagaatctatgggaacacaacaataaataacaaaaaaacaataaacaaaataaataatagacaagggcggagagagaacgaacacacaagacaagcgacaaaactaccgcgcgagagggagcgtaccagcagagaaacaatgacgcgcagactcacacacccacgaccaatccctcaagagacaaaaacacacaagagtgaggaacaccaccgaaaaaaaaagcgagagagagccagagcatacaaaaagagacgacaccacaagaagaaccaaacgcgcagccgcccgaccacaacagctaagagaacacaaaaaacagtaacaagaaacaaacagcgccgagaaaacaacaaaacaaaggcacgccgacacaaaaacgacacgagaacgaaacagacaatcatccacatgagcggaaagaaagcaacgagaagcacacgaccaccacagacacaacaaacaacgagaagcgcacggagtagcgcaacacaacacacacacaaacccgcgcgagggacagacacacacaaaaccgcagtaagcagcgacagcacaagcacgagcatcaaccataataaaaagagccgccaacgcactcaagcgaaggcgacaaccacacaaatcaaacgaaagcaaaacacattccaacacaacaaggaaggcagctatatacaaagcaggaggacgtaaacaacacacaaacacagaagacagaacaacaaaaactacgacaccaaaaagcaagcagaaacaagaaaaaaaatacacgaaaaacgaagagcacaaaacaagagacggaaggaaccagaagaaagcagacggacagagcaaacaacatatcaaacaaaacacagaagaaataaaaaaagaaaac

SEQ ID NO: 685633 - DNA, 112 bp, Homo sapiens
tacttccagtagtagaggagcaagtagccacaaataaaataagtgaacatattaagtgaataaatgctggaagagggaaaataaacattttttccctttaaacctactctgg

SEQ ID NO: 685634 - DNA, 1144 bp, Homo sapiens
gtgtcaaatttaaccctttgacggactgtaattgcatttctgtgcctttcacgtgaaaaaaaaacaaaagaaagaaaaaaaaggctttaaaggcatatcatccagcactcaaaagcgcgggctcaaaccccattttttattctcacatacttaaaaaagtgagcctctacactattgccgcaacgtggtttgtgaggcaaaccttgcattgcacgccatgtggacacagaatcagacaagcctgctctagccactcacgaggattccggcacagccacaacctcatcacatgtgtcctaaaacacaaaaacaacaaccaacagataatacccccaactcggcccactttataccaaaaaaccactacgtgaaaatgatctggaacaattgtgcacattttagaggactaataaaccaaaaaagtcatctgacaaagtataatatatcaaacaaacattggcgataacagcaagtggcataatatctcctcatattacctcgtgtatcacaaatattcgaccatataaatataagcatttatttcaaacaaaagtagatacccacctcgaagaactacaaaaatctttgtaccttttatcataacaagcctattcctgaactttagactacaaacgcgaacaaacacaaaataggcgaacaaccactttcgacaatctactaaacccctccataaatatcatcaccaccaatatctagcaatctataaaaaagccaccaaggcaatattgataacaaattacggaacccaaatcaaaaaaacttacgttaacaccgttcctactttttgtataccacctcctggagcaccagaaaagaaaacaaccttaaacactttaataaatttgggacaatctaacatattaacatcccggggattcacatacagagtaaaaacacaaattatgtaacatacaaacttaagtcccttaacagagatctcaacccataaaggaatatctatcgactactctcacaactctccaactgcgttcacaataagtaattcttacacaatatacaaattaaacaccacaaaacaactaaataattatttgacttaatctaaattatacaatatgaaacatattaatccataccaatctacaaaactatctttattaat

SEQ ID NO: 685635 - DNA, 583 bp, Homo sapiens
  misc_feature (26)..(26): n is a, c, g, or t
  misc_feature (279)..(279): n is a, c, g, or t
  misc_feature (284)..(284): n is a, c, g, or t
  misc_feature (333)..(333): n is a, c, g, or t
  misc_feature (342)..(342): n is a, c, g, or t
  misc_feature (518)..(518): n is a, c, g, or t
  misc_feature (533)..(533): n is a, c, g, or t
  misc_feature (546)..(546): n is a, c, g, or t
aattccctattccctctatacaagancctttgctgaaacactttccacaaaggcagcagtgaattttcagaacattttacatttttccccctcagcaaaaaagataaatcacagtgtaaattatgttgttctgctgtcatctttggctggggttagacctagaagttggcgactagcaaaccatcatagagaaaaggtgccagtgcttctcaggcctttaagctacaaactcagcaaggaatgtttgcatttaatctctttaaggtaccaccgggggtngggtnggggtgggggttatgacagcattaacttccataaacttttatagaccanatgggaaanaatctaccaaattagctagtaatattacacagcaatacacactttttatactctacacaaaccaaaattcctgggtcttaatggcgagtagtaatttttgtttgagatctgtttagaggaatagagtgggacctaaagtcgagaaattccagtatttgcagtaggaagatgttggnctctggtgggcctantgtgatcgaggcntaggctggaaacctcttcactggctggcatgatggct

SEQ ID NO: 685636 - DNA, 884 bp, Homo sapiens
  misc_feature (4)..(4): n is a, c, g, or t
taangtagataagcgcacttaaataaccaagtattgaaaaacgtagaagaacagcacacgtgttgttttcttttggcctcatatagctccccttttgtcctgctttccccagccgagttaaaatggggttacagcaatacgcgtaattcggcacttccctgcgcgcgcctaatgtccgtgcacaagggacatgacccgttgaactctggccgtccctcgaattccccctgggttttatgtgtccaaaccgatcaaatttgtaaggcaacttccgcgtctaatttcaaggcgacattttccccacgaattcataaacccttaagccctcatttctctttccaagaattcggccaaatcctctcgcgttaaatatgctctggagaccccctgaaccatccaacctgccaataattaaaaggatttcttgcagatccccccttcttctctaggacaggtttctccaattctgtaccacactataaagtggtagagaaccaaaaactatagcgcaccacaataggacggacatccaccattctcgatactaatatgcaggctctattacccttggccaacagagggtggccaactaatatctgggcgcccagagaggttaataccaaaaatctgccgtccgcgtctccaaattctcagcgatggacccgcgtcatcattgaaattgatggcactcaacatacgttgtcctgccccgttatataatacgggtagaagttttttccaaaccagcgggcagctttatggggacattatcggagaacgtctgaacactttatcaagtaaccatggtgggatttttcatcgagccatccccctctgtcattctagccccccaagaaaatacaattcctctttcaatcaaaaca

SEQ ID NO: 685637 - DNA, 368 bp, Homo sapiens
  misc_feature (4)..(4): n is a, c, g, or t
  misc_feature (15)..(16): n is a, c, g, or t
  misc_feature (37)..(37): n is a, c, g, or t
  misc_feature (108)..(108): n is a, c, g, or t
  misc_feature (312)..(312): n is a, c, g, or t
  misc_feature (318)..(318): n is a, c, g, or t
  misc_feature (338)..(338): n is a, c, g, or t
gggntgcatggaatnnggcacgagcttggaagtccangtgatcctaaaataactgcttagccagagtctggggtgtccttttggaatagagatggaaacatgcttctnacccaagggtgctacagtctttcccccaagggaggccaggccggcccctccccggcccgaatgcccctggatgctggctctgggacagcaccttcagggcggtgacttgatcctgttctgggtgtgtttcctctgcaggctgtgtgtctctacaggtctgcctcgggccacacctgcagcccctctgtgggctctcttagtgtncatggntccaattgacccacaggggnagggggtccagccatgcccaagagacaaga

SEQ ID NO: 685638 - DNA, 930 bp, Homo sapiens
tctctcccagtcctagctgctggcatcactatactactaacagaccgcaaactcaacaccaccattcttcgatacccgccggaggaggagaccccatgtctataccaaatatctattctgattgtggcggtacagcctgaagttaatatcttatcctaccaggcttcggaataatctcccatagtgtaactttactactccggaataaaatagaaccagttggatacataggtatggtctgagctatgatatcaatggattcctagggttaatcgtgtgatcgacaccagtatatttactagtagggaatagacgtagacacacgagcatattctcacctccgctgaccataatcatcggtatccccacggagtcaagagtatttatagctgacctcgccacacgtaccaccggatagcaactatggagatgatctgctgcaggcgcttcctgagccctaggattcatcgttcttttaccagccgtaggtgggctgactggcatgtattagacagaactcatcaatagacatcgtacatacacgaaaacgtgacaaggttgtagctcacattccacctatgtccctatcaataggagctgtatttgcacatcataggaggcttcattcactgatatccccctattctcaggctacagcgtagaccaaactaggccacaatcaattgacatatcatattcactcgggtaatctagatgtattccagagccattatggacaatcggatgccgacgtaatcgtctacccggtgataccactgaactactatgtttgaggtcatcattccaacgcgaatacaaactgcagattgaagctggaagaagcatagtaaaacacaacggggttgggccccacatgaacgaaaatcaacgggacccatggtgccggccctacaaaaaaatggccgcacg

SEQ ID NO: 685639 - DNA, 198 bp, Homo sapiens
attgtatttgtagtagagatgacatgatatattttttaaaaaccaataagaaactggagctggaaagtacatgactgaaatagtggagttcattagaagagttcaacacccactacctaataaaatcccaaacatataactgaactcctcacaccctattggaccaattctatcaccctatagaagaatgttttcatg

SEQ ID NO: 685640 - DNA, 370 bp, Homo sapiens
  misc_feature (321)..(321): n is a, c, g, or t
aagaaagttactatggtatcagctaacattattaagctcgtgatagcattaaagagagtgttttaaatgttttgtaaagactgttctgggctgagcacagtctgcacgcctgtagtcccaacactttgggaggctgaggcgggtggatcacttgaggccaggagttcaggaccagctggcggacatggtgaactccgtctttactaaggatgcaagaattagccgggcatggtggtgcatgcctgtggtcccagctactcaggaggctgaagcaggagaatcacttgaatctgggaagcggaggttgtggtgggccaggangctgccactgcactccagcctgagcgacagagccagactctgtctcaga

SEQ ID NO: 685641 - DNA, 121 bp, Homo sapiens
tcgaatcgacggtttctcctgctgatccagagaagctttttatccagaagttacgtccgtgtttgcgtcctctttgactttgtttctgatccactaatgtgactaaatgtggcagggaggt

SEQ ID NO: 685642 - DNA, 136 bp, Homo sapiens
gcgaaagaaggtggatatgtctcacccaaataactccgtatcatctccgtatcaattggtctaggcttatgatgaccaggtcgtgggcttgtggcttgtgtccaccacttctttccgtagtcgatgcgtactgctg

SEQ ID NO: 685643 - DNA, 80 bp, Homo sapiens
  misc_feature (74)..(74): n is a, c, g, or t
aagggcctgagggttctctgtcactgttactggcagaagaaacacagcaggtgtttctgtgctcttggttttangtttcc

SEQ ID NO: 685644 - DNA, 810 bp, Homo sapiens
tccatttttaaccaagccacttaaatttggtaacttaaaatgtgcaatataaagtcaaaaaatccttgaaaattctcacctggctcttgtacaaagtgaggctaatgttctacactccttacagttcttacatctatcaggagggatacctaatttcttacattctgtgtcccatctggggaagggatcaggatacggaaatgtagacccagcactcttctttctagagtcatgccaaaagcgccagaaaatccaaaaccattataagtctccgttgtaaaaaaactctcggcttcttggaaaccacctgtggaaactcgtggtctcagctgtgggggaacacgtgctctaattacgcggggtctcaatgtgtgtgcaacaccaccaaccggctattgaacgggactctccaccaatcctccgagcgagtctccgtgtgcgcacagcccgcttttcgtaaaaagagggggggcctctcacaagcgcgcaagcgcgaaagaggagcgccacagtcgcgaagtctacaagagggcggaaactaattaccctcgaactctcccgcgtttcgacgtccccgcgtagtgtttccccccaaggatcgcggctcttaccgccctcctctgagtctctaatctatctcttacaccctcccccctgagtgatctatacatgcaaaatatttccaggaaacacaggaataataaaaccccccgcgataatataccagtcttaaagcaaaaccacaaatctttcctatacaacaacctcttacctctataataaagagaaaaaaaatttttactctaaaac

SEQ ID NO: 685645 - DNA, 476 bp, Homo sapiens
  misc_feature (311)..(311): n is a, c, g, or t
  misc_feature (476)..(476): n is a, c, g, or t
gtacgaatacagaccgtgaaagcgggacctcccaaccggggcctctagctacccactctggtattctcgggctgacggagatttgaattctccctgagatggagtgccctgggggaggcgtgggccgccatatttgatgttttggcaacttagccattccagcctttgggctttgaggagtcccagctgacttggggcggatatggccccccagcacagcacagctgctgtacggcatggccagactgcttctttgggtgggtcccggattcattcctcctcgctgtttgggacttcccaactggggcctncaaccggccccactggtgttctcctgctgacggtgatttcaattttttctgggctggagctccctgatggaggggcaggccaccatctttgctgcttttgcaacttagccacttcaaccttcagtctttggagtgtccggagaccagggggtgatgtggaccctn

SEQ ID NO: 685646 - DNA, 994 bp, Homo sapiens
gccgcctgagactcgaagcggttagtcttgttctaatatgttcttgcgagcggaagcctgatgcttgattcactcagcctcggccttctcgcaccaatagtacacgggcttccgtgtggcctctgttccaaggcgccctcggtacgtgcgcccgggcgcgtcgagcgagcgctcgccgaggcgctctactgcacggcgctgggcggctctgggttcctcggtattacttcgtgtccctgcatccaaccgaggtttcaagcgtgctgcgagcgattggcggtccagaggtgagccatgggcgacctggaagagtagccggcgggcgtctcggccagggatattgaggcatgggcatcctcataacagcgcatcaatggcagtatcactcgtggtaccgccttgtggcattcagcataccgtcctggagctcctgctgataacgcattgttgagcgctgatgtgcggacggagaacctcctaggcgcagaaactaggataaacctttgcaacgcgaattgcgatcaatgcgcaagagaatgccggggagaagcatcgtttgagagacaaccattggatgggacccccctgggggtcaaagcacgaactgaggggtgcgacctgaaaatttcgtaacgaattcattcggaattggatcccttaaagagcgctctaagaagttcgtatcggacctatggttacctagttcgggggccaaggtagctgcgcaaatgtggatgctgtgtgcacgattttcgaatcaacggtgcgccccgatcctttgtttttggcttgaattggaacctttatagtgaggtcccatggtacttgaggaacacggacggctgggccaaatggagatgcaaggtcctggtgggaggaaacggacattccccttggggcctcccgtcacaggcgcactttgagtgaacggtccaaatagttcatcaacggagatagtcatggctttggcacaccacgacaaaccgaaggggtt

SEQ ID NO: 685647 - DNA, 388 bp, Homo sapiens
  misc_feature (54)..(55): n is a, c, g, or t
  misc_feature (72)..(72): n is a, c, g, or t
  misc_feature (74)..(74): n is a, c, g, or t
  misc_feature (85)..(85): n is a, c, g, or t
  misc_feature (92)..(92): n is a, c, g, or t
cccagacgctgcccatggaggcgtccagcgagccgccgctggatgctaagtccnntgtcaccaaccagcttntngattttcagtngaaactnggtattgcttttagctcagacactttcagatctcttaagatatccttacgttgcagttattctaaaagtgtgccgattattcaggccaagtaaagaccacctgctttttaaatttacgggttcacagatttcagaatttctacagacagattcaaggggatttctgcagttatttaaacggggtgaagacggggtcttttgttgataaaattctataattctaaagacatggccctcactttgggcaacaaaactaaataaggaggggggatctatttaatgaaaaatgcactcat

SEQ ID NO: 685648 - DNA, 213 bp, Homo sapiens
cgtgatctgatagttatgaatcagtaccatcagcttgcaaggatacatggattcctccctgtcaaatacacaataagcccatgctcgcgagtgcagctgaaatcgatcaagaaccagctctgtacaggtcgtacaacagtcgtcgtgagtagaacgcgcgtgacgctatgtccaaactgggtcttcggcaggttacaggagttactagagtca

SEQ ID NO: 685649 - DNA, 537 bp, Homo sapiens
atgaaagtcatagccagagcaggtagataagagaaagaaataaagggcatccaaactagaatggagaagtcagaattgttctctatgcagtatgacatgatgttatatatataaaaagcaaagagctaaagactctagccaaaaaactcatagaactgagtaaatttagaaaagttagaagatagcataaattagtatacaaaaagtcagtaggcatttctatgcatgaacagtgaactagtctgaataaagaaatcaaggtaaccccatttataatagctgtgaaaaaaatctaggaataaattaaccaagaaggtagaatatttctagtacaaggaagaactacaaatacactgatgaaagaaattgacaggagatacaaacaaattgagcgacactccgtactcatgggttagaggaattaatatacttgttaagatgaccatgctacccaaagtgatctccagattcaattacaatttctatcaaaataagtgacattcttcacagaaattgccatcaaagaaaaaaagagag

SEQ ID NO: 685650 - DNA, 277 bp, Homo sapiens
ccacttattaggcaatcttgtgaatttcactcttactgtaggatctgatatattatacaataatgaagctacaaagttaaatgcagagcattcatagtaaactataaatacatttgtattagaaagaagctagggtaatacaaaaataggagagactctgaggagcaggcaatctgtaagaggctcagaatatcttatatgctaagtagtctgctgtcattcctttcaaagagcacacagcacatcaggcatagtcatcatctgtcttgttaacctc

SEQ ID NO: 685651 - DNA, 181 bp, Homo sapiens
ggggtgttcaggagtcctctctgtgctgtccactctgtgtagcagctcttctgttcttaggattcttaatgtcttccttagtaagacttcttgttcaaccccacctaagtagatctcccctaatttttgttttcgttaccgcaattccctttatttccctcacagtacaacctgccggtgg

SEQ ID NO: 685652 - DNA, 121 bp, Homo sapiens
cccggacgtacgcctgatcactaaacacccctcctccccaaaagtctcatcttgagactcaatgactattttatacaaaatattcctcaattatattataagaaagaccacttcagtatct

SEQ ID NO: 685653 - DNA, 81 bp, Homo sapiens
gagagagatgaagggtcttactactgtgcctgtgacccttccttcctacggaggcggggagagtacaccgataaactcact

SEQ ID NO: 685654 - DNA, 233 bp, Homo sapiens
agggggggcccccccccccctggggtgcccctgggggtttgggtgggtttggggtgggccccccattttcccccaaggcccggggggtcccagggggagtttttccaaatttttcaaaggtcccccttccccggggggggtttttttttggttttttttggtttttttttgggcgagaaaattgggtttttaaaggtgtttttttattgccattaaaccagcccggatggtca

SEQ ID NO: 685655 - DNA, 338 bp, Homo sapiens
ctcgaattcgacggtttctcatttgaaaaaatgaatggggccgggtgcagtggctcatgcccataatcccagcactttgggaggctgaagcgggcagatcatttgaggccaggagttcaagaccaacctgggcaacatggcaaaactccgtctctatgaaaaacaaaaacaaaaaccccaaaattggccaggcatggtggcatgcatctgtagttccagctattcaggaggctgaggtgggggtattgattgagcctgggagatcaaggctgcagtgagccataattgttccactgcactccatccggggcaacagggcaatgactctgtctcagaat

SEQ ID NO: 685656 - DNA, 248 bp, Homo sapiens
tgcgggttcttcgcacgcaccaggggctgctggataggggcctctcgtctatgctcacgcctgtaatcctagcactttgggaggccgaggcaggcggatcatctgaggtcaggagttctagaccagcctggccaacatggtgaaaccccgtctctactaaaaatacaaaaacttagctgggtgtggtgggcgcctgtagtcccagctactcaggaggccgaggcaggagaatggcatgaacccgggag

SEQ ID NO: 685657 - DNA, 518 bp, Homo sapiens
  misc_feature (215)..(215): n is a, c, g, or t
  misc_feature (475)..(475): n is a, c, g, or t
gaccgagtctcctcagagtctcctgacggccaggcccggcggcttcgggaggagggcgagttgctggggagagtttaccttagaaggcgacaccgaacagacaggcctttcaaagccacccagggctctgccccgaggcccggggctgcgtggaggggctggagaggcgcgaggctgcgagccccccggcgccacaggttccccggcgcgcggcnccgcccgactgccacaggtgggcggcgctccgcctctgggctcccgcgggagggggcgcgcggctctctagggactcgggggagggggccagggctaaggggtacgggggcggctctgccttaaggagggcagcgtgagacggaagctccgggttttccctgcctagttctcgttccctcggccgggtggctcgggctattcctcgcggcaggaggagcggtggagaggagccgtgggcacctcccaccggccgcccctngagcctcggcctcctccccaggcgcggttaagccgcgcggccg

SEQ ID NO: 685658 - DNA, 118 bp, Homo sapiens
tgtggtaggatcgtggtgtcactgggactgtggctgtcgatgggacctacggatggtcggtgggaccctggttattgatgtggccctggctgccgtaggtcctaccgacaaccacctg

SEQ ID NO: 685659 - DNA, 1265 bp, Homo sapiens
  misc_feature (322)..(322): n is a, c, g, or t
  misc_feature (339)..(339): n is a, c, g, or t
  misc_feature (457)..(457): n is a, c, g, or t
  misc_feature (518)..(518): n is a, c, g, or t
  misc_feature (531)..(531): n is a, c, g, or t
  misc_feature (543)..(543): n is a, c, g, or t
  misc_feature (554)..(555): n is a, c, g, or t
  misc_feature (573)..(573): n is a, c, g, or t
ccacagggacgccttccctcccctcccctccagcccacccctgccagaccctcctccttgcccgtttccccttctccctcctgctccaggcccagcgtgtggtttgccttctggtagcctagtcccctggactgagtcccccagggccttccttcacccgactatccaaactctatccttgataggctatcagtttccttactcgagaaatgagaaagctggaatcctggtccccagcaggagagcctagtccgtcccccagcccctccagccaccagggtgtcctctaggatgcagctgccagatccactcactctgctgnctccagcaggacccaangccactttcaactcttatggggttctccacctgccccagagcttcccaagggagggtaagggggcaccctgagcccacagtgacccctacttcacagctcacaggggcaggaggcagntcccctgcctccaggaccctgttgctatggtgacacagcgtttctaggacagaggggcctnccagtctcccccnaccacccgtgcncgacttccttnncacccccaggttccctgncgagatcgtcgtgtgtgtcctgaagtgtcctcgtatttggttctttggacgtcgctaagtcgtcttggttgtaccatgtgacacaccctgttgctctggtcgcgtgctccttcggtggctatccacccgttgtacaagtgatgcatccatgccatctgcactcccgagcgcacctcaccgcaagcacgagctcttggctggacttggacggagatgggagcgctagaacgcaccatcagccatacatgcatgtctgtggaccctcagacgattcatggtttcatcatcccgagttcaatcgtacccttcgcttctgcgacgctgttgtcaggtatttgcgtagccttttcccttgaactcactgtacgttcacccactccgttagggcccacaggcacctggggccccaatgaggcacgagtcactttccgcaagcccatggggttaacgccattccaggaccagagcctcctgttacccccgttcaccctagggttcaaacgctttcgccacttcctcaatcccatattgcccgtggggatccatcgtaagtacacgcgcgtctaactgttcacttggcaacacggactcgcagattgggttcgcgtacgagggaagcatgtggctttggaaggtaatcaacaaagggcttcccctgagggtcaataggcgcagccctggggatgccaccc

SEQ ID NO: 685660 - DNA, 293 bp, Homo sapiens
  misc_feature (2)..(2): n is a, c, g, or t
  misc_feature (210)..(210): n is a, c, g, or t
  misc_feature (212)..(212): n is a, c, g, or t
  misc_feature (215)..(216): n is a, c, g, or t
  misc_feature (221)..(221): n is a, c, g, or t
  misc_feature (257)..(257): n is a, c, g, or t
  misc_feature (265)..(265): n is a, c, g, or t
  misc_feature (276)..(276): n is a, c, g, or t
tngcccccgttcctactgctacctacgatacacggtactgcgcctacctcaacaagaacggccaaggaagccaagggaagccccaaggaatgctccgaactggcaaacccgtgctgctgggaaccaacggcgcgcgtgggcgtcgtctgccacccccaggcctcaggaacgccaggcaggctgcccgctgtccggtataaaggtggtttncncgnnggttnttttagggcccaaggggggggggcactgggggtgtncccggggncttccacccanacacaggaggggtaagt

SEQ ID NO: 685661 - DNA, 877 bp, Homo sapiens
  misc_feature (322)..(322): n is a, c, g, or t
  misc_feature (339)..(339): n is a, c, g, or t
  misc_feature (457)..(457): n is a, c, g, or t
  misc_feature (518)..(518): n is a, c, g, or t
  misc_feature (531)..(531): n is a, c, g, or t
  misc_feature (543)..(543): n is a, c, g, or t
  misc_feature (554)..(555): n is a, c, g, or t
  misc_feature (573)..(573): n is a, c, g, or t
ccacagggacgccttccctcccctcccctccagcccacccctgccagaccctcctccttgcccgtttccccttctccctcctgctccaggcccagcgtgtggtttgccttctggtagcctagtcccctggactgagtcccccagggccttccttcacccgactatccaaactctatccttgataggctatcagtttccttactcgagaaatgagaaagctggaatcctggtccccagcaggagagcctagtccgtcccccagcccctccagccaccagggtgtcctctaggatgcagctgccagatccactcactctgctgnctccagcaggacccaangccactttcaactcttatggggttctccacctgccccagagcttcccaagggagggtaagggggcaccctgagcccacagtgacccctacttcacagctcacaggggcaggaggcagntcccctgcctccaggaccctgttgctatggtgacacagcgtttctaggacagaggggcctnccagtctcccccnaccacccgtgcncgacttccttnncacccccaggttccctgncgatgttgtgggggcccagagagaaagttggttctttgaacgccaaggctttgctggacccagggacacaacctgggcgcctggccgttgcttcgggggtttcacccttggtaagggtgcttctggcttttgcttccaagcccttaaccaggataagttttgctgggacttggaaagaagggaagggaacccccccccccaatccatgctggctgggggcccctaattgggttaatttccccattccccctcctaaggcccaaaccggggccccccaactctccaggagggtttcctccgggct

SEQ ID NO: 685662 - DNA, 425 bp, Homo sapiens
atctctttggatccatgtctcatatccaaggccttgacgcagggggtgggctcccaaggccttgtggcgctcttcccctgtgatctacagggtaaagcacccacagctgctttcatgtggctgggagtttgagtgcttgtgagcttttccatggtgcatggtgggaagctgtcatgtgtatctacgcattctgggggtctagacggacatgttggcccatcttcccacatgtttccactacggcagtgtcccagtatgggactcttgtgttgggggctccaaattcgcacattttcacttgtgtgctggcctatagtaagacggttctccaatgaggggctctgcccctttgcaagcagaccttcttgccttggactatcccagtgcatttccattacattgctcttgaaactctacgtgtgggg

SEQ ID NO: 685663 - DNA, 1760 bp, Homo sapiens
atgagccctgagcatgcccacctgtcgtcgccggcctagttaccatcacaccccgggaggagccgcgagctgccgcagccggcccagtcaccagtcaccgcaaccatgagcagcgaggtcgagacccagcaggcgaccggcgccaccttggtacgcgaaggctgtcgagtagccgtcgactgcgctgagccgcgtcggagctaagtgtacacagacgcgcatgcggagccgtgtatgagcccgggagagtgtggccttccacattgcgggacgagagtgatctggcacgtccacgtgttgaccacgacagaggggctgcattgcgggcaacgcgaaggggcataaagtggaggaccacagacgatagacaaactggcggtcatccaagtgcgtagccgcgcaaacgtgcctattcattagcgtttaaacagttccacagccacaccttacctttagaaaacacctctatgcgacgcagacccgatgcgtcagaacgagggaatcacccaacaacttttgcccaatcaacccgtctatgcaaacaagtctagacgctccctctcatggtggagacaagcttgacccccatttgccagacgcaaagttttgcttaatgcgcgaacagccagttgtggctcaacatgtacatccgtcgtcatgaatgcgaccttgcaggacagtggcagacggacaccgagaagagctgtccgcaaataccacacggggactatccggaagcacaaaggcacacgtccccccacaacgctttattctcacacacgagtagttcccctatgggaacacgcgacaagatctaccagagctatataccataaagcgccaaagagtagaagccacattcttgccactgcgagcataagcgcacagggatacccacacccaatttatacatcagcaaacaccgcatataaaattggcacaaccgtgacatctgagtaagggggggacgccccctactccacagaaaggactagtagagtttatccccacgagtgagctaacacgaacagtttggtatcccagacactaccttgttacgcttgtcgacgacaaacggtccggcgagaagagaaaccgcaacgatcaatcgcagacggcgccgcaaccaccaacagagcaacaagaagggatgcactgcgccacggacgaacctgttcacacagcagctagccctcccaacacaggcagcacccgatcgacagagagtcaaccagccatatcccgtgagatcgcgagtagccagcataagagagttatagcacaattaaaagactaataagtaagctgttataagtattatgggtcagaagaggagataaagacgaatatatatgtgagagatcaagttatatatgagcacaacaacacagacattagttaagtcgcgtatacatgacgtatcaaatatgagtacatatcgtaggagaaaatgcataagtagaaatataggtgatcgaagattactatcagcaataagtaatacacgaagtagtgatgataacacgagcctaatatatcaagtgtgtagagtcatgctagtgaggtagcagtggaggcgagagatatattatacgtataatgagtgtgaagaatataaagacaaacagatatatataaagataatgtgaggcgagcgccctatagtcacacaagacgaggaacgtagtattagctagacaggagagcgggattcgtagtaagaatataataagaaaagatatctaaataacgacggagag

SEQ ID NO: 685664 - DNA, 139 bp, Homo sapiens
tactcagctcggtcctcccagtcttccttgatttagtccttaatcttttatgttctgagcaggaagggtaaagacaggaacctgcttcactgtattaactagtccacggttggctgtgttccagtggcatcgataaaca

SEQ ID NO: 685665 - DNA, 461 bp, Homo sapiens
gattgataatactcaactagtctctgctgtggacaagagtacggaaaaagagaacaagattactatacagtaatgacaagggccgattgagcaaggacgacattgaacgtctggtccaggaagctgagaagtacaaagctgaagatgagcacagcagagggacaaggtgtcatccaagaattcacttgagtcctcatccttcaacatgaaagcaactgtagaagcatgagaaacttcacaggcaagccattcacgcatgaggcacaaacagaagatactggacaagtgtaatgaaattatcaactggcttgataagaatcagactgctgagaaggaagaattagaacatcaacagaaagagctggagaaagtatgcaaccccatcatcaccaagctgtaccagagtgcaggaggcatgccaggaggaatgcccggggataggaggtagggtaccgagctcg

SEQ ID NO: 685666 - DNA, 242 bp, Homo sapiens
  misc_feature (161)..(161): n is a, c, g, or t
  misc_feature (185)..(185): n is a, c, g, or t
  misc_feature (237)..(237): n is a, c, g, or t
ggcttatgttattttaatgtaaatttctggtaaacaatttagaaactacctcttctttcttcctttaaaactcacttctaactgctgctaatcagagtatgttatgagggcaacttgaatctgtgcttcccagtggccattcgcaagttttgggctcaaanatactctatatttaattataaaanaattactattatgagtgaaagctgctataaatactcatgtacaggtctttgngtagg

SEQ ID NO: 685667 - DNA, 94 bp, Homo sapiens
agattagtaatatgattcatagttatataaaagaaatcgaagatctcagggcaaccatgttcttgccaaacaggttagggaattgggggtttgt

SEQ ID NO: 685668 - DNA, 256 bp, Homo sapiens
  misc_feature (186)..(186): n is a, c, g, or t
ggctggccttggtcttatttgctctcaattccctactgccgttcttactttgaacctggaggcagtctgcagccccatcccatctcctgccctctcctgatctgactccctgctgcatcgtcttgctctcattcgcttagacgtcctcccgcttttgaccccagttccttcatccatccgtgcacncccagtccccgcagccctaaatcctcctcttttgctgtcattagtgcatcctgtgtcttctcgagcccca

SEQ ID NO: 685669 - DNA, 359 bp, Homo sapiens
gccacatgttacttgctagccagacgtggaattggatgattatagactatgtacacctttggactcacttactgagttcagatgaaagaatgaggtggcgagtaactcatatctgtcatttgctgctgagcatcactgagaaggcctcagttgctaagccacctctggtctggctaagccatgaactggcttcctgccatgagcagacattacggtcaggggatatgcatatggctcagtcttttccccttgagggtctcttatagatgctactggtgacaaaggatcgtcgtatagtacaggcaccaagggatgctgtacatgacggaatgcggcttgaggccaactgtgaggcccgg

SEQ ID NO: 685670 - DNA, 347 bp, Homo sapiens
  misc_feature (163)..(163): n is a, c, g, or t
  misc_feature (254)..(254): n is a, c, g, or t
  misc_feature (295)..(296): n is a, c, g, or t
gaggtcgtctagaggatcccgatatgcgtctcaactatacttttgaagcttgcctatgttctatctattaaagcccatatagtttctaaggtcaaaatttccagttttaatattccattggaagggctgtctcacttctcccaaatatacttgttaaaaaccnaaggggccaggcacagtggcttacacctgtaatcccagcacgtcaggaggccaaggcaggcagatcacctgaggtcaggagttcaagatcnggctgccaacgtagtgaaaccacatctctactaaatatacnnaaattagccggtgtggtggcacgagcctataatccaatctactcaggaggc

SEQ ID NO: 685671 - DNA, 112 bp, Homo sapiens
tcggtccatgagacaggctgagagtagcctcgctaggtgttcaccatggcgacccaccagcacattgagggggaagagaagaaaggtggctgcatagagcactcgccggttg

SEQ ID NO: 685672 - DNA, 111 bp, Homo sapiens
gggagtcatactttacctaagctaacattaaaaatgaacttaccatttttaatgggtacagtttcagttctgcaagatgaaaaaagttctagagatgatggtggtgatggg

SEQ ID NO: 685673 - DNA, 1555 bp, Homo sapiens
tagttctagatcgcgagcggcgcccttttttttttttgggggttggtattaatttccttcttggacctgtgatggctctcttttccactttcttttacacaccttttctggctctttccttcataaagccacgtggataaggttgtgttctgctctcaagtgtcgtgtacttctcttatcttgtgatacgtgctccttttcacagcgaggatctttccacttctcagtgtgcaataggctattcctcctgtttctccaagtggcactattctcgtgggttccccgagtttctcagtgcagaagaggctcccacgttaagaggcctcgtgaaccacttctcgtggggggcaccaccacgtgcgagtggacactcgaagaagccgtgaattctatggacaacatagtggtccacccaaccaatcccgtggcttctttccaagggaaatatatttctctcaaacagagaaactctcctctcaaatcctttcgcagtgggaacctctcttcaattttctccaaagtggggcgaggggtgtgggaacacgtgcgaacttgtggtggcccagtgaattcccccaagagtgtgttcccgtgtcgtccgtggtccccctcgttgaaaaactcgcggtttccccagagttttctgcaaagaacacggcgtgggtgggaagcctccccagaggttccccagcggcgaagaaatatcgccgaccaaaaaagggcctttcggcggggcccggggttggactcccccgactgtaaaaacaaatcaacaaaacacgagaggggcggggggcacgggcacacatagagagagtacatcccgcggagaggggggcccccaagagactattagcgggctgataccccagagggcttttctcctcgtggtcctcccacgtgggtcgcggccccctaataagggggaacggccgcgagcatctataaaaaagcgggcgagagcgcaccggtggcacggcgccagggtttacaccaacccaccgcggcgcggcgtacatgctggggcacacaccagccggtgcacaacccctggggggcatcctcctgctggacaaggagaaccgacatacacctgccgcggcgggcggcggcacccaccaacttgttggcaccacagagtaaccccctacgagagaagatttacaaggggcccacaagggcgacacagtcaacaaacaattcatcaagcgtggtaataccaccgggtggtcacaccaaccaagcgcggcacatatgccctgccgcgcctcgaacaaaccttcgcgctcaccccggacgaatatcatatgaaaaattaactggcagggcagcatgcgacaccacttcagacacaccccaactagcagcgcaccgcgacaacgtacgaagaccctagcagcgcgtagcacagacgtcccgaagtagaccatacagcatgcaggacaatcactaaccatcaaatccaactcgacactaagccgcagcgaacagaccacgccctcacacatcatcatgaccatcacgtcgaccgtcaaagacaccaacgacgcagaac

SEQ ID NO: 685674 - DNA, 728 bp, Homo sapiens
agcggagtacgcggggataccgcgcgtgggagcagcacttacggcggcgttgcggccaggaagcctcgccagtatatctcagtgagggagagcacctgagcacgactggttatttttccaatcagtaaaaatattcccgctgactagggactaaagaaagccctgcggatagagccggagctccccaccgcagctgccccgagggagcccagacgcttctcaggggacgcttgctcccctcatcacatctggttgggggagggtgaggatgcgttagggagtaggcattggcctgtgtgggccagctaacaaaaggagggtttaggcattgaagaaagtgacaagtgaaggctccctcaccggaaccaccgacatccccattgccccggttcctaatcctgtagagctgctgtgataggcgtttacttttctcttcaacgtggaactggcctaagttactcctcaagagatgcttttcttttggtagattcttgaagtcctcaaggaaagaggatgttacacggaacttgacactagcctggggactgttacagggccagcccacggcttgtcaaatcacacctggtaccgtcaaacccagctgcaatctaagactcagtgtgcctggcagcgagtgcatttcagactttgcatttccactttaagactcaaataggccgaccagggcagatgatctgcagcgcttctcttaagtgcttcaataaaca

SEQ ID NO: 685675 - DNA, 1161 bp, Homo sapiens
ctctgtgtaaatggagtgctgtacgagatttaccgaggcaatgggtaataaccagttaaggctgatatgaagtagcaagataactcgcaataacggcactttcgtttggttagtcagcgattctttgaagctgctcttacagtgtagtgacctttatagaagcaatgcattactgtgtcggagatcagaaacttgctataccagccacaccgaagcttaagaacacggaagacaaaaaacagactcttcggctggaatttggtttccctagactgataacgatggtactgttcgtaaggagattgagtcaatgtgtgtggagaatttgattcaatgactggtgatctaaagtgtgtacagcataaggtcattggcatcttacagggaagggaagtgtggagatatcaccttataacgagcacaggagtggaaacttgaatacagttttacatggtgcggagagaattatgggggttcaatattgaagagttaaagggtggttcctatacagggggacaaaaaaccaagtaaaccaccattttaacaacagaactgataatgccagtattagccgcttgattgtgcgatttggcatttatttttgaccgtgttcttttcggaagggaagaacacagtactatgaagatctgaatacgttcgtaagcatctcacactgattgtacagggcctaaattaacttgaggaataatgcgtaagttccggaagcttttaacgcaaaatacggagcaacttggttgaaggcggggcccgttcttctatttgcaaggtatgcataataggggggtaccgagattgtccttgggttacccagggggggctcgatcttaggaaaacatatttcaagcaaattatcccaggttcagggaaatcacagcgcacggagagaataaaggacaaggaacaaaccatggagactgtaattttcccgaaacaataattggtgtacccaaagggggatttcacacgcgtaaagaaacacaaggatttaccatcgtataaaccaccagagaaataacgcacgaacatcatcgtggaaaaagaaatgataaaaaaaaaagaaataagaaaaaagaagagggagtaaaaaaagaagaaattagggaaaaaagaaatatgaagaaaaaattataaaaaatagag

SEQ ID NO: 685676 - DNA, 330 bp, Homo sapiens
tgagacggagtttccctcttgttgcccgggttggagtgcaatggcgcaatctcggcgcactgcaacctccgcctccggggttcaagggattctcccgcctcagtctccctaagtaggggggggtggattaaagggagatgggtaggcccccggggcatttttttttttttttaataagaaaggggtttcaccatttttgctaaagggtgccctgaaactcctgacctcaggtgattgcctgcctgggtctcccaaagtgctgggattacaggcgtgacccccacgccaggcctaataactccacttttaaagttttatgttgtttagatt

SEQ ID NO: 685677 - DNA, 100 bp, Homo sapiens
gaaatgttgatgacgtcgcggccccagtgggatttcccatgcgggagaggtggttttgacatgaatgctcctggtcggggtgggcgtcccatgcctccca

SEQ ID NO: 685678 - DNA, 306 bp, Homo sapiens
cccatcttcaagcctgcctgctaaagcttctttgccttcctgattgtgattatggtaacaatttatatcagacagttgtacttttgataacttagggaaacagaatgacttgacagggattgctgcctcactgcatttcagagatacaattttgtaaggacacacatagcagttgtgatattaaggtgtgattatcttcctgtcatgtgcttattgaagagatagtcacacatgatatatgaggatttgttattatagactatgtgaatcacactggactgttagactgtctgtgctgttatatat

SEQ ID NO: 685679 - DNA, 208 bp, Homo sapiens
gttatatccatactagttatatcggaaaccatcagcctactcattcaaccaatagcccgggccggtacgcctaaccggctaacattactggcaggccacctaactcaggcacctgaatggggaaggcgccaccctaagcaatatacaaccatataaccttcccttctacactttatcattcttcacaatttctaatttctactggact

SEQ ID NO: 685680 - DNA, 121 bp, Homo sapiens
ggtcccatttcaatgagacacttaaacagaagcttggcatttatgatgccatgaatattggcttagtccgacctggtactgctctggatgttgctggaagcccaagcagctactggcttta

SEQ ID NO: 685681 - DNA, 1184 bp, Homo sapiens
gcgactgttgcgatccgagccaaagagagtgattcgtacagtagccgatacacacagcgctgtattctaggccagcggatggagcgaggtacatgttttcctcacgcttgcactgtccggttgccggtatcatctgtgccgaccatgacgtgatagacctcgtgagtaccgtgacactcgggaggctgaccgagtccaggatagagtgtctacgcaccgggagcggagtcacggatacacggcctgcggatagtcatgcgatgcatcagtcagaggagtcaagcagtagataattgccggtctttctcgttagcacagagagttgtcagcagattaacgagggttgtgtgccgtgaaaagctagtgagggattgcaatccgggcgggagcaggtccccggagaagattccggtactaagcgcatatacatctatatgaccaccagtctcttcacgtagcgcttgaaagatttcatccgcgtggcaccgggggtaccttcaccagtatgcccagcctgtttaggggctgccaagggatcggaatgaagtcatcgatgtgcccgggtcattacaagtgcgatgtgctcgaaaccaagtttccactggaggtaagtttaggacttgtcgggcggcttggttggcacctgtgaatagagtcgcaggtagggtgaccaattagagtacttcggagcctcgtatatgggcgcctggagtcgggtcacacacgcatgtttcccgattttcctggcttgtggatgttgagactagcctgtccgagtactcacgtttgtggccactaagtcacaattcgggggccgccgtggccgaggctttacgcttcttttaataaacgttcgcagacgtacggatgagcacttcttagttggtctgggggtgtgcgggaaaggaaaacggaaggggcaaatggaccaaatggggcaacaattgggttccaataaggccttggttggtgcctagaagcctagagctgtttgctttgtaactaagggggtggggatagacatcttaggccggttcctcccttaatacggtgacgctcgtacttaaactttcggagtaacgcccagtgttaaacctggcagtatagataggcgcagaagacaaagcttctacaagggggaggccccctatagggggttatggcttgagggagatggtggcccg

SEQ ID NO: 685682 - DNA, 147 bp, Homo sapiens
  misc_feature (56)..(56): n is a, c, g, or t
  misc_feature (99)..(99): n is a, c, g, or t
  misc_feature (136)..(137): n is a, c, g, or t
gacgctctctgtggggcaaagcggtgaacggtggactgaagttggtggtgagctgncagctgtgtgtctaccttggacccagaggttctttgagtcctnttggggatctgtccactcctgatgctgttatgggcannaccctaaggt

SEQ ID NO: 685683 - DNA, 279 bp, Homo sapiens
tgcccagagccttccaggatgagagagatgctgctctgggtttccagcgggccttcgagcagtggccattgctggatccaagttccgggtgcaacacagccatgcgtagtccccccagcaccatcggggccccccctgctcacagtcaccaggtagatggagcagactccaggaacccacaagtggatggttgaaggactgatagctcggtggcctccatccgaactttgtactcacacctccgggttccctgcagtgacacgcatggtcaggcatgca

SEQ ID NO: 685684 - DNA, 422 bp, Homo sapiens
ctctcagggatcggagtcgtctgatcttcatacatgattacagcgataggggtagagagtgcttgctagattatgcagttgatcctatggtgctttaatattcaggccttcaaaaaccacttgtacagtgatgtgcagatttttaaacagttgaacttccttgtactacagtttttgtattgacagccaaatttgtctttcattcttcagattgtgaataaagtgatttttacagggcttccagcaaagtttttcctttcatctaaggcttgtagaaccctagcttatatagctgcttacatgagaaatgcaaaatctgtattcaccatgactttattaacaaaggtaaagttttttagtagtgccaaggcaagaggaacaatcttggtggtagtactaagttttgtcaatattgtggtttc

SEQ ID NO: 685685 - DNA, 287 bp, Homo sapiens
  misc_feature (48)..(48): n is a, c, g, or t
tgccactgcactccagcctgggggacagagcaagaccctgcctgccangtagctaggattgcttgagcccagaacttcacagatgagcctgggctcatatgagaacccatctatacaaaaagtttttaaaaattagcatggcggcacacatctgtaatcctagctacttggcaggctgaggtgagaagatcattggagtttaggaattggaggcggcagtgagccatgagtacgccactgcactccagcctgggggacagagcaagaccctgcctcaaaaggagaca

SEQ ID NO: 685686 - DNA, 252 bp, Homo sapiens
atagagagtgcaagtaggattgcagagaactgatgcctatcgctggtaccgttgtgaaaacagaggagggaatggcaagctctgtgagccgcgccctcaggtcatccatggagcctctaaactactcttcccctggggaattcatgaggaagttgtcaagatggaacctgaagatgctacagaggaaatcagtggatttctttgagctaggagaataagagtctggagactgggagccttcacttcggcctc

SEQ ID NO: 685687 - DNA, 522 bp, Homo sapiens
tgaaaggagtctcgctctgtcgcccaggcttgagtgcaggggcgcgatctcggctcactgcaagctctgtcctccgtgggtttcatgccattctccgtgcttcagcctcccgagttagctcccaggagttagctgggactacaggtgcccaccaccacacccagctaattttttggtatttttagtagagatggggtttcaccatgtgttactccaggagtggttttgactcctcctgaccctcgtgactccgcccgccttggcctcccaaaagtgctgggattataggcgtgagccaccgcccgggcaaattttggctatttctaagctacagaactggggttccaccgtgttggccaggatggctctcaatctgaccttgtgatctgcccacctcggcctcccagggttgctaggattacgggcgtgagccaccactcctagccttaatgcatattcttaattatccaacgggtagattggtccatgaccaatggcttgggggctctaataacctacctt

SEQ ID NO: 685688 - DNA, 645 bp, Homo sapiens
attggggcgttaaaggcccgtttcaccagttttcccgggtagccccttgtgcgcgggataacgtattctcccctctgggcgtttttttcccgccctcgtattgtttaggtgccccctataggggggtaatgtttccgtcgcccatgtgaccggttcatcagcatcaatttgtgtaagaacgcggcgcccgcggattcttctcaataggcgtcgaccgtataactaaacggttttctctctatagcggctcccgagacatatactcccgctgggagatttcggccacccacccggtccccggggaaatacggcatcaaactgtagtataattttccgcgcgaacatgtgtttaccacaccctctcccaaaggcactacattttgtgcgtcttcacaaataacagcccacgcggtttgttcgccccatactactatcctccccaaaaggaggataccttggctcccctcctcaattatttttaagcaaatccacccaacactcctaaaataacaggctctctcgaacacccctctgttaataaaactccccttttcgtgaacccgccaccacactctctcgcccccctggggagtttccccccccccggtgaaaaaaatattccgttctcttctaccaacaaaaaca

SEQ ID NO: 685689 - DNA, 985 bp, Homo sapiens
  misc_feature (21)..(21): n is a, c, g, or t
  misc_feature (63)..(63): n is a, c, g, or t
  misc_feature (92)..(92): n is a, c, g, or t
  misc_feature (130)..(131): n is a, c, g, or t
  misc_feature (133)..(133): n is a, c, g, or t
  misc_feature (145)..(145): n is a, c, g, or t
  misc_feature (169)..(169): n is a, c, g, or t
  misc_feature (173)..(173): n is a, c, g, or t
  misc_feature (219)..(219): n is a, c, g, or t
  misc_feature (222)..(222): n is a, c, g, or t
  misc_feature (228)..(228): n is a, c, g, or t
  misc_feature (241)..(241): n is a, c, g, or t
  misc_feature (261)..(261): n is a, c, g, or t
  misc_feature (282)..(282): n is a, c, g, or t
  misc_feature (292)..(292): n is a, c, g, or t
  misc_feature (300)..(300): n is a, c, g, or t
  misc_feature (303)..(303): n is a, c, g, or t
  misc_feature (305)..(305): n is a, c, g, or t
  misc_feature (309)..(309): n is a, c, g, or t
  misc_feature (314)..(316): n is a, c, g, or t
  misc_feature (324)..(326): n is a, c, g, or t
  misc_feature (331)..(332): n is a, c, g, or t
  misc_feature (337)..(337): n is a, c, g, or t
  misc_feature (340)..(341): n is a, c, g, or t
  misc_feature (373)..(373): n is a, c, g, or t
  misc_feature (378)..(378): n is a, c, g, or t
  misc_feature (386)..(386): n is a, c, g, or t
  misc_feature (399)..(399): n is a, c, g, or t
  misc_feature (418)..(418): n is a, c, g, or t
  misc_feature (426)..(426): n is a, c, g, or t
  misc_feature (464)..(464): n is a, c, g, or t
  misc_feature (516)..(516): n is a, c, g, or t
  misc_feature (537)..(537): n is a, c, g, or t
  misc_feature (561)..(561): n is a, c, g, or t
  misc_feature (628)..(628): n is a, c, g, or t
  misc_feature (636)..(636): n is a, c, g, or t
  misc_feature (661)..(661): n is a, c, g, or t
  misc_feature (665)..(665): n is a, c, g, or t
  misc_feature (669)..(669): n is a, c, g, or t
  misc_feature (675)..(675): n is a, c, g, or t
  misc_feature (684)..(684): n is a, c, g, or t
  misc_feature (688)..(688): n is a, c, g, or t
  misc_feature (721)..(721): n is a, c, g, or t
  misc_feature (724)..(724): n is a, c, g, or t
  misc_feature (740)..(740): n is a, c, g, or t
  misc_feature (777)..(777): n is a, c, g, or t
  misc_feature (814)..(814): n is a, c, g, or t
  misc_feature (860)..(860): n is a, c, g, or t
  misc_feature (890)..(890): n is a, c, g, or t
  misc_feature (916)..(916): n is a, c, g, or t
  misc_feature (974)..(974): n is a, c, g, or t
cgggcagaggcgtggtcaganccttcttgatcacagccccagttaggatagcagggtgagganggcgcttcctacagcttcagcggcctcancggcggctctgtgccgccaatggccgaaccagctgcanngncagccccatccntcctatgcttgctgattcaccagnctcntcatcttcagagccatgtccccttggtcagaaggaaccgaggatgnccngcttgnagaatccaggagnaagctgaggttcttgttggncttgacgataaagctagatgntgtcctaaangatttttnggntntttnttttnnntttttttnnnctttnnagctnganntgaaattttaggcaagttcttggccaacttcnagttntcccgcancccaggccatccntgtaccccatggttatctnacagatgnagatcccagcttgtcccatttattacaaccgttcacgnttgtatcccctgtcctcccagcgaactgcggtcccacacatgtctcaatganctgtgctctcattgagagtcnctccctcccatggttcaccaaagnacgtttgggttagccctgggccctccccccagggatatgtatccctccagggaaataaattttttgnagctatcntttcttgtatggggggcccatatcnatgnagcntgggcnttaagggcnatcntcgtttgttagggtggtctctacggtgggcgcntgnacaaaaggacaaaacntagagtgggcctcctgttggtgtaaattcctagtacntcggacatcccatttgttagaacaggtggggcagatnccttttttagattaaagaatgtttattagaaagattccacccccantcatggtggttccttgtttctaaatgtatncattttcttgccttttcccccccacnagcctcctggtgggccctcctcttgttaggagcccccctttatttttacgggcaattnaaggtacattg

SEQ ID NO: 685690 - DNA, 275 bp, Homo sapiens
  misc_feature (25)..(25): n is a, c, g, or t
  misc_feature (134)..(134): n is a, c, g, or t
  misc_feature (180)..(180): n is a, c, g, or t
  misc_feature (229)..(229): n is a, c, g, or t
gagacgaggttttgctcttgttgcncaggctggagagcaatggcacaatcttggctcattgcaacctccgcctcctggattcaagcgattctcctgcctcagctccagagtagctgggattacaagtgccttcnatcatgcctggctaatctgttgtcttaacagtcttcaaatgtacantatactgttatgaactatagtcaccatgttgtacaatagatctcttgancttactcttcctaactgaaattttgtatcccttctgtcgtcttctc

SEQ ID NO: 685691 - DNA, 618 bp, Homo sapiens
  misc_feature (187)..(187): n is a, c, g, or t
agtccttctgctgattggagctgagagcacactcacgacgttctgcaaggattctctgattatgattctgaaggcaaaagcgatggaatggacagcacagattgtaattttctttatcttgaattaaagaagaaagtatctaggacagaaatccacgtcaagtactttgaaccagggggtgtctcancccacggagacgttgacgtattgtctattgaagaagattcttaccttgttactggacaaggttttgtcagttctacggaactggattgtcacatgagactctacactaacattcacccacatggaaaagcatagaagatgatcttggaaccaacatcttgcgttagtgacattgtgagacttgtattttattcaccccaaccaaatacagtaccaccatcacttagttggtataataccgacattatctataagttccatacttcaccttctctatgatattttattccctcctccactttaacacaactttttcaatttttttactaaatcgaaatttcaagttatacctatagtttcctactctcttctccctcttctgttttctctattacttttttaatcagttttatctaaccttctcatcccctt

SEQ ID NO: 685692 - DNA, 219 bp, Homo sapiens
atatgcctatacattagaatgttaattattcagcagtaaaaagcaatgaagtacagatacgtgctacaacataggtgaaccttgacgacatgctcagagaaagaagccagtcacaaagtactgcacattatatgatttcatttatgtgaaatgcccagaataggcaaatccatagggacaggaagtagactaacggttgggggatgggaaggttagggg

SEQ ID NO: 685693 - DNA, 1208 bp, Homo sapiens
tctctcgttggtctgtattcatcgctcccttcacatattggttgtccatcaccttccgtggggtctccgggagccctcgtgaacgggggtcaccccaagttgtacacgctggtatgaaaccaaactcgtaacttctggtgttcgccctgtttgctcaacacggacaaacctgtgggggtcttttcccgtagcgttaaccaggcactagcggtaaactttgccacacagacttaaaaaaggaaactaggcagggtaaggaacctctccgggtaaagcctgcgcagataagagatggggccatataatattatagataaatgccaagtcgtgttttagacagtaacttttttgattgtaagaatgaatagttgtgtgtgttaaaaataaaaatggtgatgctattgttaaacatgtgccaggtggcaattctttatgtgtgaaactattgtgtgaacatgtgctcgaattttaccaggtacgatgttcaaatacaatcaataatgatagcttataacccccaagatacaaaggccctatgaaagccgctcaaatatatgtaagggtataataatgccttatgccaaaattttgagaactgctatttagagtaactggcgaataatttgagcacctatgaagggattttggccaaggggtggcagaagctcagaggacggcaggtggcacagatgctgactggaagtccagaatcaaaggggcacacgatgtggagatggaacacaacttggtagggacaggaagcgatcttcactgtgacaaacttctcaacggccaggacaacaaaggtggtataggctttgtggtgtgcatttggcattgttacttgaatgcaactgtccactcagcctcaccaggaaccccaggtagcactatgcctgcccatcagatgtttcctgacatcatgcaggctacaggtttggaactggagaccttttagaatcccactccccagggccaagcacggtggctcatgcctgtaatcccagcacctttgggaggtcgaggcaggtggatcacctgaggtcaggagttcgagaccaatctggacaacaaggggaaaccccatctctactaaacatacaaaagttagccaggcatagtggcaggtgcctataatcccagctactcaggaggctgaggcaggagaatcgcttgaacctgggagaagcggttgcagtgagccgagg

SEQ ID NO: 685694 - DNA, 203 bp, Homo sapiens
caattcgggataaggcgccgtcgcgtttctctgccggtcgcaatgggaagaagagatcgccgcgccggtcattgacaatggcaccggcatgtgcaaagctggatttgctggggaccactctccccgagccgtgtttccttccatcgtcgggcgccccattacaccagggcgtcatggtgggcatagggcaaaaggactcctac

SEQ ID NO: 685695 - DNA, 892 bp, Homo sapiens
tctctcgttggtctgtattcatcgctcccttcacatattggttgtccatcaccttccgtggggtctccgggagccctcgtgaacgggggtcaccccaagttgtacacgctggtatgaaaccaaactcgtaacttctggtgttcgccctgtttgctcaacacggacaaacctgtgggggtcttttcccgtagcgttaaccaggcactagcggtaaactttgccacacagacttaaaaaaggaaactaggcagggtaaggaacctctccgggtaaagcctgcgcagataagagatggggccatataatattatagataaatgccaagtcgtgttttagacagtaacttttttgattgtaagaatgaatagttgtgtgtgttaaaaataaaaatggtgatgctattgttaaacatgtgccaggtggcaattctttatgtgtgaaactattgtgtgaacatgtgctcgaattttaccaggtacgatgttcaaatacaatcaataatgatagcttataacccccaagatacaaaggccctatgaaagccgctcaaatatatgtaagggtataataatgccttatgccaaaattttgagaactgctatttagagtaactggcgaataatttgagcacctatgaagggattttggccaaggggtggcagaagctcagaggacggcaggtggcacagatgctgactggaagtccagaatcaaaggggcacacgatgtggagatggaacacaacttggtagggacaggaagcgatcttcactgtgacaaacttctcaacggccaggacaacaaaggtggtataggctttgtggtgtgcatttggcccttatcgagctcgataagggccaaggtggggataagtgtggtttcgcccaggata

SEQ ID NO: 685696 - DNA, 111 bp, Homo sapiens
ctaaatcaaaacgctccttgctcaagtcactaacacgttcctttattttcttcataacatctatcaacatctgagattctctttttgtttctcaattattgtttttctgct

SEQ ID NO: 685697 - DNA, 873 bp, Homo sapiens
  misc_feature (491)..(491): n is a, c, g, or t
  misc_feature (506)..(506): n is a, c, g, or t
aaatgcaggcttggttactgcctcctggaggtttacctgtgtgatctgtgatgctggagatgtgccatgatgcctggatggacctgatgcttggtgagtctggtgcccctgtgtgctgtgtgtgtgctgtgtgctgagctgtgctgccaagcatgatctttacgtgtgtgctggtggacgtgagcctggtggctgtgtgctgtgtgacttgaaagcgtgatgccctggtgaacgtgggctgtggatggtcccagtggtccctgtggttgggtggtgtgtggatgcatgcatttcgtctgccgctgtgtggtgtgccgtggactccggcctgcagtgtcgccgccatcactggacttcctgtgtggacaatgcgcactgggcctcgccgccatgaactgatgccgcatcctcgaaggtaccacttcctcatgatgcgaggcaggccgtggggatgttaccgtgaacactatcggagccgaaagcataagcgncgaagaagtcctccntggtcaagtagtagtgaccggacacgacggcgtggcgagaggacagctaccatgtccgttctcgaagcagttatgatgatcgttcgtccgaccggaggtgtatgaccggcgatactgtggcagctacagacgcaacgattatagccgggatcggggagatgcctactatgacacagactatcggcattcctatgaatatcagcgtggagaacagcagttaccgcagccagcgcagcagtccggaggaagcacaatacgtgcgtgaggaaggcgcagtcggacaatattagccgctcatcttctgatgaaatcgtaacaccattaggagaaggtgaccatcggccgaggttgtacaatgtgttgaaca

SEQ ID NO: 685698 - DNA, 129 bp, Homo sapiens
ggagggagggggccccacaggctccccaggaggctcgtgtcggcccagagccagccagtttgtccctgccatctactgtctgaggccatcgctgctacactttgtatttgtatttcatactgaagttgc

SEQ ID NO: 685699 - DNA, 270 bp, Homo sapiens
catgtaccatagcggatagctggaaagaactccatgtaagttgaatgttgcctttcttatcaagtgggtgcctccgggtacaatcttgtccacttcctcatctgtgaggctggtcacccattgtgagtgatgcagctccctgtgtggtggtcctcattggatgaaaccttgaggcttccatcgtacgaatgcaggcaaatgtgtgtatggaaatcacattcctcgaggtgtcctgtgcctgatcatgcattcatcccacaaactatggtt

SEQ ID NO: 685700 - DNA, 168 bp, Homo sapiens
gtggtggattcgccaagtgtgttggaggaggtgacatcaatccagatgagttgcaatgtgctgtgaacattctaacctgatattacgaaatgttatttgattggacttggatgtctgtattaaatgccgtaagattttgataatttaggctcaggttctataaaactg

SEQ ID NO: 685701 - DNA, 949 bp, Homo sapiens
agtcttcttgacactccttccctaagctcaatctgtagccgtctcatcttctctcatctgatcacttcatgttttagtttatgtgactgcctggatgacctgcacttctgtcaaattaaagcaggtaccttaatgttccattcagcacggaatggacaaatccttgaagcccatgctgatgtttgatgtaactgtggcaggtagtgtacaaaatacttatctgacgctagggcacctttccttggcgctggcttagtcagagtgcattctcccattcattagcatgctctgtaagcatcatgaattagcatatgtctttcagtggaactgtacaagagtccctttgaagatgataatcttggctcagtttgtataaactgtcaaattgtcaatataataggtagggggctttcactaggaaaatcatgtgctcagaagaggaaatgactcgtagtcaggttcacggagttagtggagtatctgcgactttggtactgctgtcttccaaggtacgctctaagttttgactgtgtgggcttctgagtttatattctgaaaggcaatacagcttcttgtgaacatccccagtaggttcttttccattgtcaatacggagcatcagccagtgaatctgttgcaggtttccatttctgcaagaactcctccaaagcatgtgctagtgggccagacagtggttcttatgatgtttccttacctttcctggtatgttctgcggtgggtccaaaggaaaagcgtaggccctaacatgggaatgataagcccgaacgaaaagaacctgtcttcacccgggtttctaaaaaagcgggcacacacccgttcttttggacccctttcacgacacgtcccaattaaagggggagacccatttcgggcgagatatataacacaattttagtccgaaaaatattctcacctacattaaacaccg

SEQ ID NO: 685702 - DNA, 132 bp, Homo sapiens
ccatgcacttagggtgagaaacgaaacgcagagacaaaagaaaagaagggaaggaaggaaggaaggagggaaaggaaggagagagggagggagagatagcaaaggggctacatcattgagtcggctgtgcag

SEQ ID NO: 685703 - DNA, 785 bp, Homo sapiens
aacttactattggaggcagtgggcagcgcaggacatggcccaggccgacgacctggcaactgactgtcaccagctggagggaagagctgagaatgaagctggagagcatcagacagaggagctggggaaactgtctgtgccagggccaaggctctaggaagtgggatttcttggaaataatgcaaagagagctggaccattcatccttggtccccgtctgggcaactcaccttgtgccaatgcatagtgcagttgttaggcgagtgaaaagatggcacgggatgcaacttcgtaatcaatgcttgaaaggaatcctggaacccatgcgcagggacgcagggggcggaacccaaagtgcattaagaaggaggccatggaaaagcacgcagtgacaaggggtcaaacgcatttgccttgcctttgcaccaccgcggaaggtaacctacaactttgacattgttcgtactctcacttgcgcacacatcgccatgtgaacatggggcggatgtgtgtgccaccgcgatgctcgaactaggagaccgcatacttccacagaggtggtatgccctgctagctccactgtgtattcgccactactctcgattactgaatgtgataatcatactgtgacacttctccagacggacctcgtgccacgtggggctctctacagcacacgtaatcttatccacgaaaaagtagtcacgcaactctcctgtgccctaacctgttactcactcttcgactcctcatggtcgccatagttgagtgccaccccagttagc

SEQ ID NO: 685704 - DNA, 426 bp, Homo sapiens
cttataccagtacgtgctgtatggtgactatggccttatagtatagtttgaaatcaggtagtgtgatgcctccagatttgttctctttgcttagtcttgctttggctatgcaggttcttttttttttttttggtcccttttaatttttaaaatttttttttctaattctgcaaaaaatgatcggtgttattagagatggggaattactttgaattagtaaattgctttgggcagtatggtcatttccacaatattgattctacccatccatgagcttggaatgtgctcccatttgtctgtgccatctataattccttacagcagtgttttgaacttttccttgtacagttctttcgaccccttagtcaggtatatccctaagtattctcttctttggcacttgtcgcaaaggggttggcttcctca

SEQ ID NO: 685705 - DNA, 523 bp, Homo sapiens
ggacctcttcaacatctcatttctaaactgtactaagccacagtaatcaaaacagcacatggtacctggcataaggatagctatatcaaccatgagaatcaaacaaagagtccaggggaaaaaacccagacattcgtggtcaactgatttttcaacaaggatatcaggaccactcaatcaggaaataatggtctcttcaacacatgaggatgggacaactagagtaccacatgcaaaaaagtggaccccctctggcagggcgcagtggctcacgcctgtaatcccagcactttgggaggccgaggcaggtggatcacgtgaggtcagcagtttgagaccagcccagccaacatagtgaaacccccatctctactaaaaattaaaaaaaaaaaaaaaaatttagctggatgtggtggcacgcgccttgtagtcacagctacttgggaggctgaggcaggagaatcgcttgaccctgggaggcagaggttgcagtgagctaagatccacaccactgcactccagc

SEQ ID NO: 685706 - DNA, 153 bp, Homo sapiens
gaagcatacgatcagtccatagatgctgtgacaaaattaactacaatcagtctgtgcaatgaacttgatgtggttggcgttctatgtgtgtggcatttcatgtagaaaacagatggtagtgctccataaaaatatttcttctctctagcttat

SEQ ID NO: 685707 - DNA, 385 bp, Homo sapiens
gtccagctgttatacggagatgtttaatgcatatctaacttattacatgtatctcatctcatgtttacaaattgtcacaagagtaccgttaatgctgcatgctgctgaactctgttgggtgacctggccttgctgctacagggctgtgggctcctctgtctctggcgagtctggtcatgtggaggtggggtttattgggatggctgcagaagagctgccaggaagtgtctattctgggccagtaaaataacaactgtcatagggagggaacttctcagaagtgacagacaactctaggttacctttttcaatgaagagtagtcagtcttctaaattgttcttataccacctctcaaccattactcacacttccagcgcccaggtc

SEQ ID NO: 685708 - DNA, 263 bp, Homo sapiens
cagaccatgaaggagatgggaaggaggtcatttgagcacattcagcgcatcgaccgggacgtaagcggaacattacggaagcatatattcttcagggatcgatgcggaaccaagcagcgagaactactccacatcctcctggcatatgaggagcataacccggaggcgggctactgcagggacctgagacacatcgacgacttgctcctcctctatcttgctgaggaggatgcactatgagcactggcgcagctgctgtccag

SEQ ID NO: 685709 - DNA, 485 bp, Homo sapiens
cgtgccgagtctccgcagggtcgagcttcaccgcgcggcgcgggctcaggcactgcccgcagtgcgggacacgcccaaggctcggatgggagccgacgctgagggagcggcacctgcagggagcgcccggagccgaggccgcggcaggaggggcgggcgcgggcgcggccggaggggatgcggggtcgcgggaggggcccgcaggccaggccggagctggggggggcccgaggcccgagctggccggcgagggtgggaagggcggacccgggtggggaccgcaagccccgggaacgagcgcgcgagcggcgggtcccggcggcactcaccgagcctgggcgccggggcggcggcggccggcgcgcggccctctcgcggggtcccctccctcggccacccgggctccgctccagcctcgcagtgacggcggccccgacagctgcgtggccgccctggaggggagggtgcgcctgcaacccgctact

SEQ ID NO: 685710 - DNA, 530 bp, Homo sapiens
  misc_feature (424)..(424): n is a, c, g, or t
ggtatcacatcccactcccgtctgtgtcggcgcgcgtgtaatcggtgagatcgagggggatgtatcgagatgacagtcgacgaaatagcctggagtggaggctgcctgtgattgatgacaaacataagagtggcagactggagtttagcgattgctgggcgagccaatgactgcttcgcctgttcgaagttttccgttagttcgtccgaagaacaaattacgtgtaacatacaggttaccaaagtgacccaggtagatggaaacatgcccgtcaggtttgccacagagaccacgtttcctagtggataagtatgaaattctgtaataccaagaagagggagctgaaaaggaaaattttcgagattaataaagaagacgcgaatgattgggtgaagagtttttgcccagatgtacaagccactgngagagcccttgttttctgatacaatgcacgattctactgggcgcaaggtagcctcgatgtcaccccatgtttcagtgtcacagagacattctttgataaggaaatg

SEQ ID NO: 685711 - DNA, 163 bp, Homo sapiens
tgatttaaggttttcccttccttccctccctcccttctttctttctttgttttttatttattaattaattttggagaccgactctcgatctgtcacccaggatggaatgcagtggcacgatctcggctcactgcaacctcctcttccagggttccagtgattc

SEQ ID NO: 685712 - DNA, 884 bp, Homo sapiens
gactatgttccccgaaccggaggctgacgtaatgtgcgcttgccgatagtgtctgctgcctggtctgctcattcgactcactataccgctactcggctggacaaacgatctacttgtgggactatgtgctctgcgcctaactacatcgtaggatctcgttaactctctgaataatgctccaagaactgggccaccagggtcccctgttgatacgtgacaatgtagggtccatggaacggaagaggagtttctactaggacaaagtgtttgcacaagtcatacactaaactgccggataaaagtgtgtgcactagtgagtgcgctgaaatcttgtggagctagtgtattgtggacccgttcctgtgattggttctttgctacaatacctaaacgctagacagcattgcgtccacgtcgcatgctccactaggttgtctaggatatagatggctattcacaagcgaccgaggggcgcattgatgctacattatcgcgtatgtgctacccgcatacttggcacattggcagattgtagcaacttgccaagggtagactcccaaattcaggctatgcgtgggtctgagtattgcggagaggaggggagccacgttgtgaaggtccatttgaaccatcagggagtccagaatgcggttgacttgtgctagacttcctgagcgcggttggccctttctcacgtacacatcaaagaagaatacactgtcaatctcggtagaaaggcttcccttgagaaccagcccaggcagtgaggcgccctgtggttgcgaagagaacgcagatgtgaccatgagaattgacattgtgtcctccctggagaaggcattttacacgaaaacaggattcataagcctgattaatgtgaacca

SEQ ID NO: 685713 - DNA, 431 bp, Homo sapiens
gtaccctttttttccttgtgttggcttccagtgaacgtcaagtcctcaagatgctgtacaatggccgggccttgatctgggtattggtaaacaggagtagggacggacgtagatgatcgcggaggcctggctacattctcctttccctttcctgtgaattccccattttctttcttcttcacctagagataaactagttaaggggatatcaaactatttctttggagtctacacaccggtggatccatattgggtattcggaacagtctataaaccggggcatccaataacacagttccagttaccaggaggaagaacattccctaaatttacaaggtcctaagtgggtttatttccaatagggttaactcagtagtttaaagacttttaaaagcaagggactttccggtagtgtggaaaaaaaaacacaa

SEQ ID NO: 685714 - DNA, 236 bp, Homo sapiens
aggggggaacaatcacttagcgggggacaatcacttagcgggggaacaatcacttaggggggaacaatcacttcttgagaaagagtagcaaaggtgaaagcatcattgatcagttgttattgtttgtcatagctagtttagtttctatgttagttagtggtgaattgattgttaagtgatggttaagtgattgtaaagggattgtgcaagtgattgttcaagggaatgtccccgcg

SEQ ID NO: 685715 - DNA, 212 bp, Homo sapiens
tgtaagagtctagaggatcccatttcttgcgccgacgaaccgggagagtgttgtgggggagattcaacatggctgcctggaagatgcattaggccgtcaccttcatataatgcgagcaggagtgtggacggataggaatgagacgcatttgaagcctctcgtgtaaaggtggtccagttcatgtcaagaagtgtatctgtgctcgctacatg

SEQ ID NO: 685716 - DNA, 152 bp, Homo sapiens
tccggacggactgaagactttcctaactggacgactgactgacgactagtgagctatgcacgtcgaaaaagaaaaaccacagatggttaagaagtccacactgaaagaaaagaaaagaaaatgtccccaaaccagaataaagggtacagtga

SEQ ID NO: 685717 - DNA, 482 bp, Homo sapiens
tccactccgttccatcggtctatgtgtctgtttttataccagtatcatgctgttttggttactatagctttgtagtgtatttggaagacaagtagtgtgatgcctttacctttgttctttttgcttaagattgcattggttattcagggttttttgttgttattgttgttctatacaaattttagaattattttttgacagatagctttttcattattagccctggctaaaaagtcccaggaaaattcttagtggatcttcaaattggccaaacttgggacatctgttgcacctcagcctcagggagtggatgtcgcataggaaagaggatctgtcccttgaagaagggatgagagaagccatatgatcggaccagccccccaaaaaaccctcttggcccttaaaaatgaaattaccagatggcccttggtcctgtagaccttatgtccttatgtcccaagaggagcaacaagatgaatcca

SEQ ID NO: 685718 - DNA, 229 bp, Homo sapiens
gcagaagataaagtcggaagtaggacagagaacgctccgaaggcggggttggtcgtccgagatcattaaaaatggctgaccctgacaatatggacaagagtagtgaaatgtaaagtaagagagtacaaacaaatttcctttttaaggtgcttttaagaaaaaaagcagggcctgggaagttggggttcttttttcctcccctgttgcaaattctcatggtttgggttgg

SEQ ID NO: 685719 - DNA, 277 bp, Homo sapiens
cacgaggctgatcgataccagtggcaccatccgcaccctgcgcagcgatctcaccggcgtctccggcatggccttcgacatctacacccgcctgctcgtctccgaccccaacaccaaccgcatcctccgcatcgatttggataccggtgtcgccaccagaatcgctggcggcaatggcgccggcttcacgggtgatggcggccccgccacgagcgcccgcatcaattcccccggtgacatcgccgtcgattccggtggcaacatcttcttcatcgat

SEQ ID NO: 685720 - DNA, 340 bp, Homo sapiens
aagggggggggggccccccaggggccccttttgcaaaaaaggggaatttttggtaaaacccttgtaaaaaggttttgcccccttttaaggttttaaactaagggaaacccggggcagggtgggggggggggttaaaaatttttttggttaaggccccttttttttttttgggcccctttttggcctaaaggggggagaaaaggcctaagggggttttttcccaaaaaatcaaaaagggggggggccccggttttaattttttggcctaaaaccaggtttttggggggtttttgggcccgtttttgggggctaaaatttaaaaaaattttttccccttgga

SEQ ID NO: 685721 - DNA, 183 bp, Homo sapiens
  misc_feature (36)..(36): n is a, c, g, or t
  misc_feature (74)..(74): n is a, c, g, or t
  misc_feature (110)..(110): n is a, c, g, or t
  misc_feature (139)..(139): n is a, c, g, or t
  misc_feature (148)..(148): n is a, c, g, or t
tcccgcccctcagcctgttggaagaggaggcagggnagggtggccaggacatgcccgaggccgaactcctcctnatggtggctggggaggtcaagagcgctctgggcctngagttgtccaacagcagcctggggccgtngtggccggncaggcggggcccacgctggcgggaacagctggcca

SEQ ID NO: 685722 - DNA, 243 bp, Homo sapiens
ccttttcgtattgcaggtgatttgtctgatgcagcaaatgcgcgtcaggttctttctgacaacggttcgccgacactgatctgcagatgttctcggttcttcggctatcgctacacctccgcggtaaacagtctgttctgttcaaagtaaacgagtccggtactgatgcgcttctgcgtgaaggtatagtggggcgactggaaggtttcaacatccacgaatccgcgcatgttaagaaacgcg

SEQ ID NO: 685723 - DNA, 703 bp, Homo sapiens
  misc_feature (9)..(9): n is a, c, g, or t
  misc_feature (403)..(403): n is a, c, g, or t
  misc_feature (414)..(415): n is a, c, g, or t
  misc_feature (422)..(422): n is a, c, g, or t
agcgggagngggggggtgggggtgaggggagaggcgagaggtttagcgtgtggagctgcctgcgctccgcccgggctgtcagtcccggctccagccgccgcgagaccttcccggagacgcgcgcacacacagcgcaccccctgcacaccgcacaccctcgctcccttgctcacacacacgcacacactcagcctggccgagcaggagccactgaccattttgcaagtgtcaggaccagctacagcgcggtgggcgcaaacatcccgctttccctttccgggatttagtctgggagacgacgacgagggaagaaggtgggctcggacgcagcccaggcgccgggcactggtcgggccgttttcctggcagagccgctccccgggacgggcgcgggcctcgggtnagagtagaatnnagaggancggccgcagccgccgcgcgaggaggatgggaactcccctatttccagctggggactcaggcaagaccaagacggtgacccgtaaaaaatacgaacggatcgtccagctcctcaatggctccgagtcgagctccacggacaacgccaaatttaaattctgggtcaaatcgaagggcttccagctgggccagccggacgaggtccgcgggggaggcggcggcgccaagcaagtgctctacgtgcctgtcaagaccacggtgagtgactcgccttcctctgtta

SEQ ID NO: 685724 - DNA, 385 bp, Homo sapiens
cagcatcccgagtagctgggagactcaggtgcacaccaccaatgcctggctagtttataaactttttgtagagacaaggtctcaccatgttgcccaggctggccactaactcctggcctcaagtgatcctccctccttagcctcccaaagctctgaattatattcataagccactgggcctggttgactcagcataatttttcttgagagtcttaatatgttgctacatgtatcagcaatttgcttctttttattgctgagtagtattccattgtatgaatacaccatggtttgtttatccgttttcctatgtatggacacctgggctgtttccagttcttagctattataaataaagctactctgcacaatcttaagtaaaaaa

SEQ ID NO: 685725 - DNA, 670 bp, Homo sapiens
  misc_feature (9)..(9): n is a, c, g, or t
  misc_feature (623)..(623): n is a, c, g, or t
  misc_feature (626)..(626): n is a, c, g, or t
  misc_feature (629)..(630): n is a, c, g, or t
  misc_feature (632)..(632): n is a, c, g, or t
agcgggagngggggggtgggggtgaggggagaggcgagaggtttagcgtgtggagctgcctgcgctccgcccgggctgtcagtcccggctccagccgccgcgagaccttcccggagacgcgcgcacacacagcgcaccccctgcacaccgcacaccctcgctcccttgctcacacacacgcacacactcagcctggccgagcaggagccactgaccattttgcaagtgtcaggaccagctacagcgcggtgggcgcaaacatcccgctttccctttccgggatttagtctgggagacgacgacgagggaagaagaaaccagaggagtcctgtctgggggtcccatcattattcgggatacccgccgccagcggcctgccttcggttacccacatccccctggaacggatatctgtttggggcactacaatctatcctgtagaactatggccaaatctccatcaatgctttgctaatttctgggacttaactcgtagaatctacatacagggctggaatttattcaaaatgcatctgaagaaatgacattttaaaccgttttaaaaaatatcttgataaaaaattctgtaaaacagaatttgataggtttaaaaacatgacagnagnctnncnctgcggccgggacctcgcatcctgcaacgtggccgggg

SEQ ID NO: 685726 - DNA, 196 bp, Homo sapiens
agatcgttggaacaggtcgtagtatgaacatagtatcagatagtcgatgcgcggcaaacccacataccatcactgggcaattttttagaataagaccccattattatctatggctataaacctagccagttctctggctcttctgtattttcctatttccctgccatcatctgctatggacacttctaaaactagg

SEQ ID NO: 685727 - DNA, 1099 bp, Homo sapiens
  misc_feature (9)..(9): n is a, c, g, or t
  misc_feature (403)..(403): n is a, c, g, or t
  misc_feature (414)..(415): n is a, c, g, or t
  misc_feature (422)..(422): n is a, c, g, or t
  misc_feature (1052)..(1052): n is a, c, g, or t
  misc_feature (1055)..(1055): n is a, c, g, or t
  misc_feature (1058)..(1059): n is a, c, g, or t
  misc_feature (1061)..(1061): n is a, c, g, or t
agcgggagngggggggtgggggtgaggggagaggcgagaggtttagcgtgtggagctgcctgcgctccgcccgggctgtcagtcccggctccagccgccgcgagaccttcccggagacgcgcgcacacacagcgcaccccctgcacaccgcacaccctcgctcccttgctcacacacacgcacacactcagcctggccgagcaggagccactgaccattttgcaagtgtcaggaccagctacagcgcggtgggcgcaaacatcccgctttccctttccgggatttagtctgggagacgacgacgagggaagaaggtgggctcggacgcagcccaggcgccgggcactggtcgggccgttttcctggcagagccgctccccgggacgggcgcgggcctcgggtnagagtagaatnnagaggancggccgcagccgccgcgcgaggaggatgggaactcccctatttccagctctggaaacaaatggatggaagtcctgaatggagcaactgctgacttcatctgcttggaaaaatagtccagaggaactcatatttggctactcagagcagtggagggggtgtccatgacgtggcagggggaaaatagacaactgaaacctcccgtgtgaactgcaaactgtgaccaagcaaggggaaaatgatctttctgtatatattttaatttcgtgcaaaggttttcaagcatctgtatcctaaacttacttctatgtcttgttcagcagaaaccagaggagtcctgtctgggggtcccatcattattcgggatacccgccgccagcggcctgccttcggttacccacatccccctggaacggatatctgtttggggcactacaatctatcctgtagaactatggccaaatctccatcaatgctttgctaatttctgggacttaactcgtagaatctacatacagggctggaatttattcaaaatgcatctgaagaaatgacattttaaaccgttttaaaaaatatcttgataaaaaattctgtaaaacagaatttgataggtttaaaaacatgacagnagnctnncnctgcggccgggacctcgcatcctgcaacgtggccgggg

SEQ ID NO: 685728 - DNA, 173 bp, Homo sapiens
tggaaatgggagactgtactgtgttgtgtactgggcttcttccagttcctttgatggagaaacatgtctgtcctgtaatgccacctcagttggggtctttctgtgcagcccagtgcaggtgcccctattaaactgagaatatggctcttaagaaggcgccccacatggccacg

SEQ ID NO: 685729 - DNA, 130 bp, Homo sapiens
gtggtcccagcgaacagggagactgaagcaggagaatggcttgagccaggggtcaaggctgcagtgagccatgttcacaccactgtgctccatgtgctccagcctgagcaacagagtgagaccctgtctc

SEQ ID NO: 685730 - DNA, 251 bp, Homo sapiens
ccccaggtttaagggccccggggggttctaacaagcccccatcagagtccacacaggccaggagggaaggaccagcgccccccctcgggttttgggtttcagcagtcttggggacccaggggggccgaaaggaggatttgtccttcctgttttttgcctccccccccccctttccaggacccgggatgaatccgttttggggttccttttccctcaatgcaaaagcccttgggggcaacgaaaaagcctca

SEQ ID NO: 685731 - DNA, 650 bp, Homo sapiens
  misc_feature (60)..(60): n is a, c, g, or t
tgtgtttcatcagcgatgtacaaatatacttgggagattgtcgggaaccaattcaccatntgtggaaactgacaaatgagggagaggcacccttgccctgcctttcctgtgggcaccattatccagatggccagacggacaagatgagcctctccctccagtgaattcatgacgaagccaccacgcactggaaaatcaccattttgctccatgaatctgtcgattcagatatcaagcaccaacgactgcggacggaggagctaccaccagacagtgcgtggctccctctgcgagcccccggccttgccaggggactggacccggatcccagcagtcccctggctccaggtgtccacttccaggagacgcagaggcctgcaccgaaagatgcagctccaacccaggcctcgggtacctccacgtgtccgagggccacttcccaggtgcttcagccatggcccctggtcctagtcaagattttgtaatcacagagaagaccaccctcggagctgccacaggaccctaaactcctgggcctcagtttcctcctcgtgaaggcagtggcctggtggcctggggtgcgtcatcagggtccccgtggcgggcgaagagtggtctcagcttcctctgcacagaggcccctcgtgccg

SEQ ID NO: 685732 - DNA, 710 bp, Homo sapiens
aggctaacgtcgaggtgggccaacggaacgccccttcaacgcaacgagtttaaacagtaactttttagaaatgaccgtctaatctaggaaggctccataagagaaattaaacattactattgcctgcagaaatagaataggcctcttgtcgaaggcatactttccagccctcaggatggctacagtcagaggatagcaaactccatttgccagcccccagccaatggaaagtccttaaaatccttcaccaagcttttcacttaggaaaggataagacctatcaatgtgctcagaattgttttcaggcaggaaagttctaaatggctagacatataacctctctagctcacttccaacaagaattaacacaactatcagaagcccaacccaggaaatagaaccacgtttatttaacccagaaaatgggtgttagtgaaaaatctcatctctccttccctaagacaagctgggaaggggcctacactgttcttctttcaaccccctttgcaataaaagttacaggaatcgaacttctgaatacatcacactcaagtcaaagcctgaagcgctgagggagcaacactaccagcccagaggaacgtcctgaatatcaatgtgaagaaataggagatcttaagctgcaaatcataaccaatacataatgagtgagggatactcattttactcagtcccattctacctcaccagat

SEQ ID NO: 685733 - DNA, 681 bp, Homo sapiens
gcggccagcaggcggcttttgacggagcaagacgaaatccgcacacgcgggatgaaaaacttccggcacatccaggctgatgaagctaagccattgactaggcaagggctaagggctcctgacaaccctccatatgataagggagccttcagaagcgaaatcaactgtccagcaaagtacccatccaaaccaccgaagatcacatgcaaaacaaagatctatcacccaaacatagacgaaaaggggcagggctgtatgccagcaattagtgccgaaaactggaagccagcaaccaaaaccgaccaagtgatccagaccctcatagcactggcgaatgacccccagcctgagcacccgcttcgggctgacctagctgaagaatactctaaggaccgcaaaaaatcctcgaagaatgctgaacagtaacaaagaaatatggggaaaagcgacctgtggactaaaatctgccacgattggctccagccagtgcgagccagaacccccgtgcagtgcaatcagacacccacgcaagcaggactgctggggaaattgacaatgtgccaccgccttggcgaaccgttgaggcacgatactaactttctacagggtgtcctaaacggtggccaagcgcaccctgcaaagaaaggatccatgtacggagcccctcatggcccctttgtt

SEQ ID NO: 685734 - DNA, 203 bp, Homo sapiens
  misc_feature (74)..(74): n is a, c, g, or t
  misc_feature (117)..(118): n is a, c, g, or t
  misc_feature (132)..(132): n is a, c, g, or t
cgctcacaacaggcacagccacaagttacaaggcaacagccggctgtcatgtacaaggtcaggaaccttggacngcttccatgtgggcatctgcccctcctcaagagcaaaagcaanngtggggggaagggnggtttcctcttattcaagccatgcaccctactctggcgggtaaaatcacgggcatgtggtgagcggggtac

SEQ ID NO: 685735 - DNA, 891 bp, Homo sapiens
  misc_feature (60)..(60): n is a, c, g, or t
tgtgtttcatcagcgatgtacaaatatacttgggagattgtcgggaaccaattcaccatntgtggaaactgacaaatgagggagaggcacccttgccctgcctttcctgtgggcaccattatccagatggccagacggacaagatgagcctctccctccagtgaattcatgacgaagccaccacgcactggaaaatcaccattttgctccatgaatctgtcgattcagatatcaagcaccaacgactgcggacggaggagctaccaccagacagtgcgtggctccctctgcgagcccccggccttgccaggggactggacccggatcccagcagtcccctggctccaggtgtccacttccaggagacgcagaggcctgcaccgaaagatgcagctccaacccaggcctcgggtacctccacgtgtccgagggccacttcccaggtgcttcagccatggcccctggtcctagtcaagattttgtaatcacagagaagaccaccctcggagctgccacaggaccctaaactcctgggcctcagtttcctcctctgtaaaatgaagctgatgagtcctgagtccgggagctggccctggccacagaccctccaaaccagctcctctgaaggtccacagccagcacatggcgggcagccggccctggggtcctggggtgtgaagcagagcttggatgtgcgacgggagccctgcacatctgttgctcctgctggcatcacttgggaaggcctcgtgcccaccctgagctctgtccaaccctcgggaatagcgctgggtggcgaccagggttgaatgtacagaagcccctgctggggtgactgaggagagggtttacccagcaccctaagtgtgaaccctataattgaccccattg

SEQ ID NO: 685736 - DNA, 479 bp, Homo sapiens
agtgtgagaagctctgccaactctgattttttttttaaagaacctttacgtttagagattttttttttttaagttgggggaggagagaataagcagatatagggccctttaaatcaccatctgctttactgttcagaggttaattatccaccagaaaattctccctagaaatttagggtcagttttaccaaaccaccaagccagatcgccaggggtgttggacaacgttatcataaactggtgagggtcacaaggtggtgaatgtgtatatgttgttgtatgcctatatgtctgatcatattccactggaaatattcatagtgtttggttactaattattgtgtgtctctggcattacttgtactttccatgagcaaagtaagtgaatgttttctgtaaacacataccatagaacttaagacaggcatacaaataagtcatatttttcttcttcaaaaatctggaattctttacaaaga

SEQ ID NO: 685737 - DNA, 121 bp, Homo sapiens
aaaaattaagagtggggtgatttattaatcttgttaagaactctgatacttagcacagtaaaaggccacaaacttgctattaggcggtgtggccgcgcggcctctttacaactgctgctac

SEQ ID NO: 685738 - DNA, 128 bp, Homo sapiens
caatatatgcatccggctgtcggatcagagggtccaccagacatcaggaaggccatgtagagcaacaggacacccaccacggacaggtagataacaatagatgatcctttatggtggttggtgctgct

SEQ ID NO: 685739 - DNA, 128 bp, Homo sapiens
tcaactgcaggcgcttcctgaggaccgcatccctgagaagagtggcgactaggaccgacagcgggccctacaaggcgcatctcgatctgctcctctgacagaccgacattgcctgtgacggcacgacg

SEQ ID NO: 685740 - DNA, 113 bp, Homo sapiens
gcgccctgcggaacttcctgcgcaaggagtacgggggcctggacgtgctggtcaacaacgcgggcatcgccttcaaggttgctgatccacaccctttcatattcaaggctgag

SEQ ID NO: 685741 - DNA, 596 bp, Homo sapiens
cgcagcgtagttcggtgcacgttttgaaatgtcaggttaaaagccagtggcctgtaattctcagagatgcccttttggacggaccctgagcagaggaagctgttttttgttgttgttgtttttgagacagggtcttgctctgtcacccaggccggagtgcagtggcacaatcacggctcactgcaaccgccacctcccgggctcaagcgatccttccgcctcagcctcctgagaagctgagaccacaggtgtgcaccaccatgcttggctttttttttttttattattattttttattatttggagacagagtctcgctctgttgcccaggctggagtacaggggtgcgatctgggcttactgcaaccttgcctccggggttcaagagattctccctgcctcagcctcccgagtagctgggattacagatgcatgccactgcgcccagatgatttggtatttttagtagagatagggcttccccctatcaagaccagccaagctggtcttgaactcctgcgctcaggtgatctgcctgccttggcctcccaaagtgctgggattacaggtgtgagccaccgtgcctggccccctaa

SEQ ID NO: 685742 - DNA, 867 bp, Homo sapiens
taacaatccaataattgccaattattcaataaatatatcaatgtagtccctgttactgatagaatgaacaggcttgccctgggtctactgacaaccatcttgagatcatgagttgacactatattaccagaaaatgatccctacacaaagcatgagtgcagagaggaagaaaacaatctcgaggacattattcgagtgctgtattaatgcgcattaaattacataggaccaataaataccttttctttcttaagcctgatgatataactgaaagcatcctactataatggctacaagataaaacatttttaaactaggcctatgttacttttttaactttacaaaaaaaaacaaacaaccatggcctccttgacctcaacggaggaactatgcgaacgataccctatattgagggttaattactgatcctcgttcactgactaactgaactcaatacgatcgattgaaaaaagcgtaatcatatcactcaaaagcggacatactgaaatacctaaacactcgagaacccgtatgaaaacaaatgtaaaacacatggaataaataacgccataaaaccacatactcgacaaatttcatatactaatatcatatcgatacgataaagttacaacaactagaaaactgatccaaaaggatagatgatgaaaaataccaacagaaatttaaacaatactaagaaattgacacacagaaaggtaactaaatataactaatctgaagacaatatcgacttatacaattatctcttgcaactctcatactttagaactccagcccgataactaattaactcaaactactactaaatcacagataatcatagataaactatacaaaatagaatgt

SEQ ID NO: 685743 - DNA, 2084 bp, Homo sapiens
  misc_feature (1149)..(1149): n is a, c, g, or t
gcttctgcttctttgagggttgttcggtctctctcttggttctctcgtttgggtgggttcctccttctccggtgtggtgttgtctgcttttgttttaactctagcctatatgagtgtacgttcgcccggtgtgtgtttgtttttttgttttatctctgagttgtctcgttgtctcgtatgacttgtattgctttgttgagtcttatagatgttgttggttgatgttttgggttcttttctgggtctgtagtttgttggtggtatccacctcatttcaccaggtgggttccactcgttgttggacgtctctccatagagtggcacccctctgtggccttggtgaatggtcttctttcctcagcggggtttccttcttctgtggtttgtcctctcacctctattctcgtctcctttgttctacaagttggggtgtggtctctcctttttcgttcggtgatgcgggcttctctctctttgttttcccttcctcgtgtgggttgataatatgtgtattatctcctccccctatcgtggtgttgatcaccacagaggtcgtttgtttattttgtgtccactcaggaataagaagatcattttggtgtggatgtggtgatatcttgttttgtttttccaatcaaggctcctaccatgatttatgtggtgttcttgtgtgtgttgtgttagtgttgaataatctacacgcagtcagctggatgtagattagttgtgctgtcttttgttagccaactcgactcccactctgttgtgtgttgttattttttctcgttggtggtggttctgctttcatttggggggccctccccttttgttgttgattctccatcttttagtcagtggttttctttcctctcccgtcttttgttttgtttatgatcatcttcttcgttggtgtggagtgagactcatccgattagttgtgcttctgtctctctctcatcttttcgacctacgtcgcttctggtggcggttccttctgtgggggtgttgtttgttttgctatctgtcaccatcatccatcatgctggtggtgttgtggtgtgtgtctacatatgttcttcttggtatggtttgcctctatcaggatagttgtgtggtgcccccgcttgtgtgtgacacatctctgttgtnttcgcgctggggtgtctgttgtgtttcttttgtgtttggtttcttttctctcttggtttttcctctctcggtggggcgttggtgtttattacactcgcgctctcttcgcggtgttggttgtcactccactttgtttgttgtgtgatgactccttctgttttttatagatatttgtatatgatatcgcactctttctacacagcaagacgtgttgttattagttatcactacttcataagagtgttgtctatgatgatgtatgttgtagagtactctgcgcgagacattctctctgtgagaggtagtgtggggggggtggtgggggcgtcaatagatcattctttcgacacacaataattgtggcgggcgtgtgagtcccccctcgcagctgtctctcgtcgaccacagcagagttgtgagagagatactcaacacacactacagcgcggtggctgtctatagagagtctttgagagaggggtggtgttggtggagatatattgtggccccacagtggcactgtgagaacacactctctcgagagagacacctccactcttttctctccacatcggggagaataacacacccacagtgtgttcttcacagcgagaggaatatcttccaacagggcacaaaggagagggtggttgtttggctgtgtttgtagatagagcgggaataccctcgccactaatttcccccgtggccacagttcccctccacaccctcttgggtgggcctctgcatccctgtgatgtgattgtttttctcacacccccttgttgtttgtggcaatgaaactcccagagacgtctcccccggggtgggatcgttatatacccttcttggggccaccccataaataataaatataaaaagaaaaaataaacttcgagcatatagctcggggtccgagaaggagtattatctct

SEQ ID NO: 685744 - DNA, 320 bp, Homo sapiens
  misc_feature (300)..(300): n is a, c, g, or t
tagacacagggacttttcaaaaatcttaaatcagtagaagcctggcttttgtacacactgctttggtggctgctgcttttggtgttgtcatgactggaggggcactttgagggttgttccaggctggagctaggaggaactcaatgaaaagtaatacagaagagagagagaggtgtctgtattacttattgagactcaaggtttcagagagaaagtaaagatgtttaaagttggaacagactattttttaggatcacctaaacgtgtcgttacatggccctttttccgtgggtgagtggngaaaattctgcccatctcaa

SEQ ID NO: 685745 - DNA, 92 bp, Homo sapiens
ggatttgctggtgcagtacaactaggcttaatagggactcgaattcgaggctcgaattcgagcctcgaattcgagaacaaagaaacaaaaaa

SEQ ID NO: 685746 - DNA, 1338 bp, Homo sapiens
cgcttctcttctttcgtctgttccctctctcttgtcgttcttttttcctgctctctctttcctctctttcgctctgcttctgcccgcgtctcggttctgctttctgcctgttgtcccgcttctccctccctttttcctacccctcgcctttcctctctgttctttctctgttgcgtccgtctgttgtgttctccttccgcgctcttcctagttctgtctctttgtgctccttctctctttcttgcctgctctgtctcctttcgctcgtttcttttccctcgtctgctcttcttccgcccgctgctgcggccgtgctcgcgctcttctttctctctgtttcttcttcggcttggcgttgctcttccctccttctcgtggtcgctttcttcttcttgtcttcctcttcgtttgtttcgctctgtgcgggctcgtgctcgttctgttgtcccccgtgtcgtgcttgccgtggcgctcgttggctcgtctgctgccgcgcgcgctctgtccgtgttctccctcccgtcgcctcctggtcgtcctcccgtgctggcctgtgcacaggaagagaagtattagacaaatagagatagcaacagagagggggtgaccccttcaatatggtcacgcagtgtttgccgacatcttttcccgcaatggtatgtcacagagcccctctttgaggcccaaaattccaggttttcacccgtcacccctgtgcaggtttaaatcctaagggtttccagaggccagcctgggctggtttcctgcgcactcaggaccggatccccttaattataaaagccaatttttgggcgcatgcaagcggtctgttggcagcactgttttgacttattgccgtataatttttgggattttttctgtaaaaatgggcggtaaatatttccttatacaggtatgtgaccaccaaagaagttgcctgcatgccggtcccaattggtctgtataaagatgctctttaaagagccccagaggtatcctaggaccctttattctgtttttatttgagaagttttaagtcacagtcccttagtaaaggccctagcacgtgggaaacacgtgtaactttttataaaaattggctggaatattaaatctcttggaaaatttttctgttaatgtgtgaagacacccaaagtatgggggagagacacgccatcccaaacctaactcttttgtagagtagccactttcattttcgtttaacctgtgttccacgcccatatggtagttctaccaaagagaatggtttttaggcctcccggtgttatacctttttgtttataataataataatattaaaagtaacctttacgtagg

SEQ ID NO: 685747 - DNA, 881 bp, Homo sapiens
  misc_feature (1)..(1): n is a, c, g, or t
  misc_feature (107)..(107): n is a, c, g, or t
  misc_feature (125)..(125): n is a, c, g, or t
  misc_feature (167)..(167): n is a, c, g, or t
  misc_feature (242)..(242): n is a, c, g, or t
  misc_feature (245)..(245): n is a, c, g, or t
  misc_feature (270)..(270): n is a, c, g, or t
  misc_feature (279)..(279): n is a, c, g, or t
  misc_feature (281)..(282): n is a, c, g, or t
  misc_feature (287)..(287): n is a, c, g, or t
  misc_feature (289)..(289): n is a, c, g, or t
  misc_feature (318)..(318): n is a, c, g, or t
  misc_feature (320)..(320): n is a, c, g, or t
  misc_feature (327)..(328): n is a, c, g, or t
  misc_feature (335)..(335): n is a, c, g, or t
  misc_feature (343)..(343): n is a, c, g, or t
  misc_feature (349)..(350): n is a, c, g, or t
  misc_feature (365)..(365): n is a, c, g, or t
  misc_feature (386)..(386): n is a, c, g, or t
  misc_feature (393)..(393): n is a, c, g, or t
  misc_feature (403)..(405): n is a, c, g, or t
  misc_feature (407)..(407): n is a, c, g, or t
  misc_feature (409)..(409): n is a, c, g, or t
  misc_feature (457)..(459): n is a, c, g, or t
  misc_feature (462)..(462): n is a, c, g, or t
  misc_feature (514)..(514): n is a, c, g, or t
  misc_feature (874)..(874): n is a, c, g, or t
nctcacggtacaagacaattgtatttaacattgttataaataaaagggcatcagatcaatcattatgggctccagagtgaacagcatcttcataacttccatgtttntcatctttactttctggntgtaatttaataagatcatcaattcgaagaatggtgattgcngcttctgttgcaaatttcaaactcttaactttaactatggttggctcttacacccctgcttgtctgtcgtctcgnggnttaccattgctcaaatcaagaccantccattttncnntttcncnttctgggttaacctgggcctcattatganangctcttnnttttgcnaccagatntgtggnnttctgggctgttttntttgctagtgttttgggaatnacaagangtggtcttgnnngntntgcaatcgcaaggggttcccgggggcccatgctggttgcgtagttttnnnggnatatgggaggggctgcttctacagcacccccaccggggaccacaggttttgngtccaaaagtgtcttcactacacaaagtgcatcatgtaaagagcgctccatctcatcacacatgagatcatttgcgccacgtaagagagtcgatgcagacgtacgagccttagtatttttgattaagatcagctcatcatcacaaattctctcctgtaccacttcttctgcctgtcccaacattgcagcttcaaaagtttcttcaccttccaaattggccagggttgacagaatagttgctccagaagctttggcaatgcgtttaaggtccctttttaaaactcttctaactgccatagcaccagcctccacaaaatacttcagacacatatcatcaattccaccagtggttagaataanattggga

SEQ ID NO: 685748 - DNA, 554 bp, Homo sapiens
tagttacttactattagcctggcctttcttaggggatctgatgttatctcgcttgcgccaccattttccctcggtttttgcctataatgggtattatactatacgctgggctcaatataagaatttgtcatacccgtctgcaacggctcgcctctttatcaccaatattgggggcaagtcacaaccaagtggttttgtcagaccatggataccgaccggggtggctttatacccttggaggttagcatattacggccaacaacaaaagtggtctagagctacatgcattgccgatcgacgactacctatggttagactcatcgtctccctccgcatgttggctacacgcgccacgtacagcggattgccacaataaaccaataagttgggactaccccttccccccccactggcgtatttatatggatgaaccccgataagtaattgtcagccccagggcaaacgtacccgccgtatatgacggtgcgcaccacaccatttctatgtagtgcccccttaacccccccctttaacccaccctctcccccccccaa

SEQ ID NO: 685749 - DNA, 1221 bp, Homo sapiens
  misc_feature (407)..(407): n is a, c, g, or t
  misc_feature (661)..(661): n is a, c, g, or t
  misc_feature (679)..(679): n is a, c, g, or t
  misc_feature (681)..(681): n is a, c, g, or t
  misc_feature (691)..(691): n is a, c, g, or t
  misc_feature (703)..(703): n is a, c, g, or t
  misc_feature (722)..(722): n is a, c, g, or t
  misc_feature (724)..(724): n is a, c, g, or t
  misc_feature (784)..(784): n is a, c, g, or t
  misc_feature (806)..(808): n is a, c, g, or t
  misc_feature (845)..(845): n is a, c, g, or t
  misc_feature (847)..(848): n is a, c, g, or t
  misc_feature (851)..(851): n is a, c, g, or t
  misc_feature (863)..(863): n is a, c, g, or t
  misc_feature (870)..(870): n is a, c, g, or t
  misc_feature (872)..(872): n is a, c, g, or t
  misc_feature (885)..(885): n is a, c, g, or t
  misc_feature (895)..(895): n is a, c, g, or t
  misc_feature (898)..(899): n is a, c, g, or t
  misc_feature (902)..(902): n is a, c, g, or t
  misc_feature (921)..(923): n is a, c, g, or t
  misc_feature (926)..(926): n is a, c, g, or t
  misc_feature (953)..(953): n is a, c, g, or t
gagaggggcgctggcgcggggctgagccgcccgggatcagcgcgagcacccagcccgcctcggccgggagggcagcgcggcactgcggggcgatgagcggcgcccggggcgagggcccggaggcgggcgccggcggggctgggggccgcgcggcgcctgagaaccccgggggcgtgctgagcgtggagctgcccgggctgctggcgcagctggcgcggagcttcgcgctgctgctgcccgtgtacgcgctgggctacctggggctcagcttcagctgggttctcctcgcgctcgcgctgctcgcctggtgtcgccgcagccgcggcctcaaggccctgcgcctgtgccgcgcgctggcgctgctggaagacgaggagcgcgtcgtgcgcctgggggtgcgcgcctgngacctgcccgcctgggttcattttccagacactgaaagagcagaatggctaaataagactgtaaaacacatgtggcctttcatttgccaatttatagagaagttgtttcgagaaactatagaaccagccgtgcggggagcaaacacccaccttagcacctttagtttcacgaaggtcgacgtgggccagcagcccctcaggatcaatggtgttaaggtatacactgaaaatgtagacaaaaggcaaattatttncggaccttcagattagtntngtaggaaatngtgagattgatntggagatcaaacgatattntngtagagctggtgtgaaaagtatccagattcatggtaccatgcgggtgatcctggaaccgntgattggagatatgcccttagnnnggagctttgtctatcttcttccttaggaaaccacttntnncanattaactggacnggactgncnaatcttctggatntccctggatngannggnttaatcagatactatcatnnnggnatataatatcaaactatctggtgcttnccaatcgaatcaccgttccacttgtcagtgaagttcaaatagctcagttgcggtttcctgtaccaaagggtgttctaaggatacattttattcgaagctcaggatcttcaggggaaagacacttaccttaagggactctgtcaagggaacagtcagacccctatggcaatcattagagttggcaaccaaaatcttccaaagcagaagtcctcacggagaacctcagtccaaagtggcacatgaagtctatgaggctttagtgtatgaa

SEQ ID NO: 685750 - DNA, 863 bp, Homo sapiens
  misc_feature (303)..(303): n is a, c, g, or t
  misc_feature (321)..(321): n is a, c, g, or t
  misc_feature (323)..(323): n is a, c, g, or t
  misc_feature (333)..(333): n is a, c, g, or t
  misc_feature (345)..(345): n is a, c, g, or t
  misc_feature (364)..(364): n is a, c, g, or t
  misc_feature (366)..(366): n is a, c, g, or t
  misc_feature (426)..(426): n is a, c, g, or t
  misc_feature (448)..(450): n is a, c, g, or t
  misc_feature (487)..(487): n is a, c, g, or t
  misc_feature (489)..(490): n is a, c, g, or t
  misc_feature (493)..(493): n is a, c, g, or t
  misc_feature (505)..(505): n is a, c, g, or t
  misc_feature (512)..(512): n is a, c, g, or t
  misc_feature (514)..(514): n is a, c, g, or t
  misc_feature (527)..(527): n is a, c, g, or t
  misc_feature (537)..(537): n is a, c, g, or t
  misc_feature (540)..(541): n is a, c, g, or t
  misc_feature (544)..(544): n is a, c, g, or t
  misc_feature (563)..(565): n is a, c, g, or t
  misc_feature (568)..(568): n is a, c, g, or t
  misc_feature (595)..(595): n is a, c, g, or t
ggcaggttactgtttctagaagagcaacaccaatgcaagtgaataagcaccaccttgtgagccggttcattttccagacactgaaagagcagaatggctaaataagactgtaaaacacatgtggcctttcatttgccaatttatagagaagttgtttcgagaaactatagaaccagccgtgcggggagcaaacacccaccttagcacctttagtttcacgaaggtcgacgtgggccagcagcccctcaggatcaatggtgttaaggtatacactgaaaatgtagacaaaaggcaaattatttncggaccttcagattagtntngtaggaaatngtgagattgatntggagatcaaacgatattntngtagagctggtgtgaaaagtatccagattcatggtaccatgcgggtgatcctggaaccgntgattggagatatgcccttagnnnggagctttgtctatcttcttccttaggaaaccacttntnncanattaactggacnggactgncnaatcttctggatntccctggatngannggnttaatcagatactatcatnnnggnatataatatcaaactatctggtgcttnccaatcgaatcaccgttccacttgtcagtgaagttcaaatagctcagttgcggtttcctgtaccaaagggtgttctaaggatacattttattcgaagctcaggatcttcaggggaaagacacttaccttaagggactctgtcaagggaacagtcagacccctatggcaatcattagagttggcaaccaaaatcttccaaagcagaagtcctcacggagaacctcagtccaaagtggcacatgaagtctatgaggctttagtgtatgaa

SEQ ID NO: 685751 - DNA, 643 bp, Homo sapiens
  misc_feature (407)..(407): n is a, c, g, or t
gagaggggcgctggcgcggggctgagccgcccgggatcagcgcgagcacccagcccgcctcggccgggagggcagcgcggcactgcggggcgatgagcggcgcccggggcgagggcccggaggcgggcgccggcggggctgggggccgcgcggcgcctgagaaccccgggggcgtgctgagcgtggagctgcccgggctgctggcgcagctggcgcggagcttcgcgctgctgctgcccgtgtacgcgctgggctacctggggctcagcttcagctgggttctcctcgcgctcgcgctgctcgcctggtgtcgccgcagccgcggcctcaaggccctgcgcctgtgccgcgcgctggcgctgctggaagacgaggagcgcgtcgtgcgcctgggggtgcgcgcctgngacctgcccgcctggacggaatctcgctctgttgccaggctgaagtgcagtggcaccatctcaactcactgcaacctccgactcccgggttcaagccattctcctggcctcagcctcccgaatagctgggactacaggcgcacaaccagcacacccagttacttctcgtatttgtagtagagactgggttcaccatgttggccaggatggtctcgatctctggacctcgtgatcca

SEQ ID NO: 685752 - DNA, 128 bp, Homo sapiens
ctacgaaaaagtccgtggataaacaagtgttagtcctctgtacatgtcaatggacacttcaattatgtgtatacagcaggaatatcttgccccactggagtcagaaaaagcaaaacaaaatctagagt

SEQ ID NO: 685753 - DNA, 328 bp, Homo sapiens
  misc_feature (9)..(9): n is a, c, g, or t
  misc_feature (84)..(84): n is a, c, g, or t
  misc_feature (106)..(106): n is a, c, g, or t
agcgaaatncccggaaggacgatctatgatacgctttattacttaaataagtaggcacccgctcccgcgatcgacagggaaagncgatcttcgtgcttcgccccgnaactacgatctactctatttatatgccggattctataggctacagaatagggcgcccattatttcggccgtgggcgggaaatctgctgcaccgaccttagaaacacctatcggaactgatctccggagcctgaagacccctgaacaaaataaccccgcattggattgtgttcttgcgagaggcacaacggcatgggccctttaatttggtaattttatcctt

SEQ ID NO: 685754 - DNA, 179 bp, Homo sapiens
aggtgagatagtgtaaatgtcattaaaaagagaaggaagagaagtaagccgagtggtgtctttgattggtgtagtaagggtggaaggtgatttaatctggaatgggaggtgattcctagtggggtgtgtcttgatccctgttacgttgcaatgaatatgtgagtgtggatgtgcttgct

SEQ ID NO: 685755 - DNA, 137 bp, Homo sapiens
acttcttatttttctatatatgtacttccttacgtgggtatcattctattcggttggatctctatctgacctagcctgcctggttatctcttgtctcgctctcttgccttatgatgcccttttctgctttcactcaa

SEQ ID NO: 685756 - DNA, 769 bp, Homo sapiens
tgctgggattacaaccgtgagccactacgcccagcctgatctctcatttttcatgacccttcgtaatatttggcagaatagtcctagtttacagatatggaagttgaggctggaggataaaatctcttgccaaaggtcacaaaataacattaaaacagcatatttcccccaccagattatttgggctacctcagaggagcagacatgcaatgtatcacagtatcacaaacccaatcaaccacctacaggcaggagaacaaacctggctaacttgagttcttatcatatgctattcaagaaacggaagttagctaaaaatctgttttgacctgctgaaggctaattttgtttagcaggagaggtgggaggtagtgaggtgggtgttaaacaatgacaaaagaagataggccagagttctgttcattattaaacaatgagtaagtaggaaagaatttctagtaaggtcaccatatttatgtgacccaggctccaccaaagtatggcctccccatttgtgcctgggtcacagcttaacataattcaccaaaaaaggtctggaaaaaaggtcaagaaactactcaccagttaatcctagcttgggataacccgtaatggaaagacttagaagaatgtgttcgacaatttaaagacagatgtcaggcattccttgtctcctcatcacacatacttctttggggcaaatgcagcttaaggtggagactgacacaatgagaaccttgtccctggctacagggcagccccctgaccc

SEQ ID NO: 685757 - DNA, 152 bp, Homo sapiens
agacaccttcaaatacacaacagcccagccaactctacaacaaggcggccagccaacacaggtgtcacgtagtggtcaatagcacctttgcctccccccatgcgatagcccaaacactaatgcgagtgatgggctaagaaaggggctggtac

SEQ ID NO: 685758 - DNA, 848 bp, Homo sapiens
taaaatttagaaacaacgttatggttatggttaaaatagtgagctctcatgagaaaagagtatgtaaaaagggccttcctacacccggggctttctcacttatcccagcagacggggactgtccctcacgtgtgtaggagggaaagttctccaccgtggctcccagaaatattaggctactccagttttactcttggattattgtgcaggcataaaaaaaaaaaaattcaaaatccaccgatataacagtctatctccctcctaggcattattagtgctcacaactcccgcacgtgggcaaccacaagagaggctgggccatcaagagtctccataatccccacaatgttaacaacgcccgagggaaatataaaagtggcacccctgtggaaaatcaacaagagggcgtaaatcccagaggccataggagcaactgaaagaaagaatcatcaagcatccaggaggagaatcgggtgagcaacaatcactagcaacggacggcgctcacccaaggcatagaacaaccaggaagaatcccacccacatctaacaggcaggcgaacaacattcgagaacgcgggggcagcgcaccgcagcaacgtaaaaacggcgtaaggaccagaacattctgtgggccacacgagggtaagaaatacagggcccagaggaaaagcccaacatgtggtcacccataccaccaataaccgttgacaagaatcccccttaaaattgagtgtcaaaggaatgagaactccaaagatgtctccaaaaggagcaccacataagtgaaaaaccgggcgccagcgaagtcctacaagggcaaaaggctcaaccaagtcacggccgag

SEQ ID NO: 685759 - DNA, 607 bp, Homo sapiens
gaaaagtcggaggagtatagcagttcatggagtctgtgtgaagatgacagttttctgtaactacagtcttggaaactatgcaaatggtctataattgctcagaaatcacatgataggaatataggagactgctctctgtgaccacctcaagagcaatctgattgagatagaacgttaaatgagtgtatctgcctggtgctgaggggccgcaagagactgtggacattgactgtgatgtgctctcatagagtatcggagatttgatagcatcatgaatgtggtcaaaggtgcctgtaataattatcattaggaggaactactagtagattatcacttctcgttgatccgttcctcttcgtcctggaacttgaatagaatattgtggaagcttaggtcacaaactgttttgtaactcctgtcctcctaaaacacgcaagccctgcagtcaatcactagtaatctgattgtgacagtctgcctgctgctcctcgtttgcccatgtctgagtcctccccatggatgattcaggaatcaaccagaagatggtggacctatggtgcatacctgttatctcagaaaaccaattcataatccttgtgtaccagga

SEQ ID NO: 685760 - DNA, 156 bp, Homo sapiens
atccccggttctacctctatgtggacacaacttcagtaagacacagcaaggacttgcagactggttgaataacttgtgattactggttatacagttccccattcctcacccctttagactttctttgcaattctttccatttcgttctctctccac

SEQ ID NO: 685761 - DNA, 450 bp, Homo sapiens
gttgatggataccatatgcgggactagtcaggatatgtctgatgtcccagtgcgtagacgatgccgggtctggatacgatgacacggcctttacgtgaatctggggtttcacattgacaagtcagagtggcagtgaagtttctaaacacatttgactgtgttatgctcaatatgatcggataatactccatgcatccccttcaagttacgtccttgataataaacgaatagccacagagtcaaatagcgagcagatttctcagtcgcaggtaacccgatctcttaaccatagaacttccggcgagggatatggcttcgacttccatagacagccggtgagaccgcttgacacctacgggtccgagcacctgctggttctcgatgttgcacatatgatgaatgcttcatcatatatatgcactgaggtgttaacggatgtgactgcgtccg

SEQ ID NO: 685762 - DNA, 175 bp, Homo sapiens
  misc_feature (8)..(8): n is a, c, g, or t
  misc_feature (47)..(47): n is a, c, g, or t
cagctcgnacccaatcaccagactttgggagggtgaggcaggcggantgtttgaggccgggagtttgagacaagcctgaccatcatggagaaaccccggccccactgggacaccgtgctcccgtctctcaggcagcgaagttcgatccatcaaccaaactctatgaaatcagcaa

SEQ ID NO: 685763 - DNA, 201 bp, Homo sapiens
cagctgtcatcacgttatttaatgaacctagtgctgacgacagtaaaaagggtccattgacagttgcacagaaaaaaacccagaacatcatggagtcctttgaaaatccattaaggatgtatctgccccactgggacaccgtgctcccgtctctcaggcagcgaagttcgatccatcaaccaaactctatgaaatcagcaa

SEQ ID NO: 685764 - DNA, 156 bp, Homo sapiens
ctagaggatccccttgagctgaaaatacccaagatgaaaatgccaagttcagcatgcccagcctcaaaggcgagggcccagaatgtggatgtgaacattgcctaagtgctgactgttgttgtctcagtgacccaagggtggagtgttgaatgtcgt

SEQ ID NO: 685765 - DNA, 279 bp, Homo sapiens
agatgaccgggaaagaaactaacattgcctgggtacttactacaggcatagcgcaacaaagcagaccagcctgggcaagaaagtgagaccccgtctttacaaaaaatttaaaaattagccaggtgtggcggtgtgcacctgtagtcccaactacacaggaggctgaggtgggaggatcacttgggtccaggaggtcgaggctgcagtgagctgtgtttgttgccactgcaatccagacttgagtgacagagcaaaactctatgtcaaaaaaagacacac

SEQ ID NO: 685766 - DNA, 235 bp, Homo sapiens
atactgacgcgatacgattggctctagatctacattcttcaaaaaaaaaaaattggcttaactgtttcatctttaagtagcatttggctgccattggtatggggctgaagaaatcactatggtgtatttactcaagtctttttattttccctcttttcataaatgctcttggactttatggggcttgcagagtccccttattctggggattacaatgcttttatcgcgtcagttg

SEQ ID NO: 685767 - DNA, 119 bp, Homo sapiens
atttccaaggttttatagaacgtgtgtgtgtgtgtgtgtagagtgtgtaaacttggctcagctagcttggtctcctgcaaatgtattgtagacggacacaattttctactatgctattc

SEQ ID NO: 685768 - DNA, 360 bp, Homo sapiens
  misc_feature (360)..(360): n is a, c, g, or t
gcaacaactgtgtaggctgttctttcaacctctttcttcttacttctttacttttccttcagagaggagaaagccacccctgtgctatagccaccgctccaattctgactctagctaggtcatgaaacagactgagctattattgcatcaacacattcctgtcatttgggtattattctttagagaactagagattacctagctgcaacctaagtttcctgaattagaatcatttgagcagcaccatcttaattggctcattcatatttgtgaccaggcacagtggcgcatgcctgtggtcccagcactttgggaggccgaggcgggcggatctcttgaggtcgggagtttgagaccgcn

SEQ ID NO: 685769 - DNA, 190 bp, Homo sapiens
tgtttctgcatgagcacctgaatgtgtctgcgttcgcatgtagcatagatgtgaggaggtggagagacagcccagccttgtgttcagtgtgaccccgtgttccacatgctgacctgtgtatcctccccagtcatctttcttgttccagagaagtggggctggatgtctccatctcgtctcttctcttgta

SEQ ID NO: 685770 - DNA, 227 bp, Homo sapiens
gcttcggtacctgtatatgctgtctcacattaaagaaatatttaatgggccgggtgaggtggctcatgcctgtaatcccagcactttgggaggccaaggcaggtggatcacgaggccaggagttcgagaccagcctgaccaacatggtgaaaccgcatctctactaaaaatagaaaaattagctgggtgtggtggtatgtgcctgtaatcccagctactcaggaggc

SEQ ID NO: 685771 - DNA, 514 bp, Homo sapiens
ctggatggttaatgttctaataccagatctttgatgacatctagtggtgaaatgtagatttatttattcactgttctcaaagttttaagatgtcaatgttgtatatatcttgagagacattgagataagttggagattgaataaaatggagaaatttggtaatttttgtcttcagcaaagataccttaaaatggttaagaacaaaggggtaggcagaaaagagataaacaacctttagtaaacatttttacattttaattctgagaaatttgtgtagagaataaaatttaaaactgtagcataatcacatcagctaaacataattgttgactgttttgaaaacatgctttcaggaatatctttgtgtttgttaattctgcaatattcacattgttttattaagatagagtcctgaactgaaattgaattgatgaaagtataagagtactttatagctttcggtagcattgccaaactgctttccaaaaagacttaatgagtgttcaaaaaaaaa

SEQ ID NO: 685772 - DNA, 184 bp, Homo sapiens
tcgattcacccaaagcagtcaacgagtgctccgtatgcgtgacgcattcatagtgtgacctctcaagaaagctcggtgttcttatgctggttggcagcctgagcatgctgctcgtcgtcatcatcctcaccctggatgtagacatcgggtaacctggcacgtttacctcacaccacttcaacgg

SEQ ID NO: 685773 - DNA, 143 bp, Homo sapiens
catgtatacatgcgcaggccgcaatcttaatcttctagacaaagagaatataaaccaaactcaagacatgaccaagtggattttacatggcttggctgtgcgcatcttcagctacctctgtaatacagtcttcctccagacaa

SEQ ID NO: 685774 - DNA, 251 bp, Homo sapiens
agggtttacctcgaaagaggtatctcctattcttgtccttcagcgtgcgatgttcggaagagctatcccgccaggcctcccagaagcatctggctcgctgccatctagcacctgcacaggttgggccgcagaaccctgagcagctactggggccccgtctactctgcctcgctagctcctgtacccacccacaggtaggcggctagagggggttttcagaacaaaggcatacgttggagttcagtgcacca

SEQ ID NO: 685775 - DNA, 479 bp, Homo sapiens
atgtttgtgcccactctcatattcatatattccaatattaaactcttctgtaattgtcttaagaggtggggcctttaagacgtgattatgagttaccgcttcaaccctctggaacaggattagtgccctttcaatcgagggttaccttgctctttcctctatgtaacgacattccaataggcaccatccgtgaagaagcatgtccccaccagacaccaaatctgctggtgccttatcttggactttgctgcctccagaacagtgagaaataaatttctgttgtttataagccacccagtccaactaagacattaaggaccagtcacgtaatacagactgtgtggcaagagatgagactggagacagagaggggcaagatcacagagattttatgccaaaagaatgcagtaaaacagaattagtaataaatctccagtactacaacatcttggaaaataaggatcgattgccttaccctg

SEQ ID NO: 685776 - DNA, 446 bp, Homo sapiens
  misc_feature (117)..(117): n is a, c, g, or t
tctaccaggacacctacaggcagcatctacacggcgtatcttgcctctatatgctctcttctgtctctgggtggctgtcagtcattgcaggccatcagggcagcctggagaagagancagagtaggagttgcgagagcagatctacctcctccgtgttgtttgttgagacagagtctcactctgtcaccaggctgagtcagtgttgactcagttgattgatctcggctctgaatcagcgattctctggtcagcacctgagtagcttggattacaggacttgccaacactcctggttattttgtatttagagaatgggggtctcatgtggcaggtggctcggactcttgactcagtgtctgtcacctggtctcccaaaatttggatacaggtgtagtacgtgctggcctccatttttgatcacagcaagactggagtatggcagctt

SEQ ID NO: 685777 - DNA, 844 bp, Homo sapiens
ccgaccggcaggccaggtccccagctcgccgcgacccacacatgagtcgaaaaaacgagactcaacgtaggcgtaatacgctacttcgtgcggcaaacagacacgactgtcttctctaggctacaaaactccaacacgcacctgctcggggaccatctccttaaccgcaaccagcagcaaccaagcccgcacggcactgcagcgcgtaatcctgcccaccgaccaacacaccagctgacatcgacaccccagctgatctcccaacaccgacacgcctccactcacaacacatgcggcataaccgcctgcccaaccgcacagcagaacacaagacgacaccccagcattcagtgccgacaccgcgacgcaacggctacaacccgacacagcagacaaccataacaccacacacccacaccgcacgcccgcactaccagacgcactcacacccctgccaccgacgacccaccgaccacaacacccagcaaccacaacccacccaccaacccacaacccacgccagcgtcacggctcgtcggcctcgtctcctgtctgcgcctcgataggcgtgactccacacaccgatcgttctcttcactcactcatcacgcactccttacctactttctctctcactacccatccgccacgcacctcaactatcttccccatacacaccacctactgccaaacatcagtcttctcaccatctctaacatcaacacaccccaacaatactcgtcatctcccgacaccccatcacgccccctgtcaccctccttcatcatcagttcctctcctacctccctatccccaccgcttcacccactcttacactcactcc

SEQ ID NO: 685778 - DNA, 231 bp, Homo sapiens
aaatcaaaaccccccggggtaaaacaggccggtttttgttttcttatttttaaaaggctttgggtttcctttttaaaaataagggcataacccccctttccccttgggggggccttcaccatccggctttggcctttccaatgaaaaggggtactttaggggttttatatatataaaaacaaatacccctttgtcccctttatccggtaaataaaaaagttgttttggtca

SEQ ID NO: 685779 - DNA, 141 bp, Homo sapiens
cacttccttgatgacgcggttgccgctgcgggtccaggtgatcttgtgatactgcggattggccggatcgccctcgacacgttcacgctgggagaaaatcacaccatcgtgaaggtaccaggaaacggcctcgatggcctc

SEQ ID NO: 685780 - DNA, 496 bp, Homo sapiens
  misc_feature (409)..(409): n is a, c, g, or t
gcacgagaaaacctatatgaagaaaagagactcacattatgctaagtgaaataagccaagcgcagaaggataaatattgcatggtgtcacttgtaggtggactctaaacaagttgaactcatggaaatagtagaatggtgattgcaggagtaggggttgtggtggggaacagggagttgctggttaaagggtacaaagtttccgttaggatgagtaagttctggaggtctaatggtagaacatggtaattactgttaataatgtatacccaaagatttctaagagcgttatcttaaatgttcttaccacaaaaaataaaatacttatgtgaggtgatagataagttaattcacttgatggtggtaatcatttcacagtgtatacataaaaacaatatgtcgtacatcgnatatatatatgtgtgtgtatacgtgtgtgtgtgtgtgtgtgtgtgtgtatatacacaattttaatttgtcatttatacttcttcaat

SEQ ID NO: 685781 - DNA, 260 bp, Homo sapiens
gacaagttgggatattggcaagacttcgtcgcctgggaagagcggtctcatgtctggacactccctgccttcataccctgtctgaaacttgtatcttacgtgaacttaaagaatacaatgcatttctaccccgatctcgcccgcaggactggcacgacaggtccacggcagcattagatcttttcccagtcctgatcggtgcgtggacatccagccaccagttctgattcgattccacagtgatcctgtcctctgagtat

SEQ ID NO: 685782 - DNA, 108 bp, Homo sapiens
ccttatcttctgcgttcggtcttctgtcaccatccttcttttcttcttcctcatcagaaccaacatcttcaatttgcaggtatgtcttccgacgtctttctctatctt

SEQ ID NO: 685783 - DNA, 300 bp, Homo sapiens
gaggtaaacgaccggcagtgggtggagagcttttgctgtgggtcggtcaagacagctacttattagtcgttcgccttcggggccccagcggcggcggtgaagagcccgccctgtcccagtaccaggtaatgccaggccgatcttggaagtgaccctcaccgggatcggaaccagtcttttttgttccttgctcctcttggctgtttttcatcttgtggcaggcgttccagcggattgactccgacgctgccatacgcggtcgcggggactcaggctctctcgatgcttacggcctggagg

SEQ ID NO: 685784 - DNA, 1021 bp, Homo sapiens
  misc_feature (163)..(163): n is a, c, g, or t
  misc_feature (165)..(165): n is a, c, g, or t
cccgtgagtccggcgcgcagaggaggggagaaagctgaccgcttaggcccgggtagtggtcgtcgtggttttccttgtagttcgtggtctgagaccaggcctcaagtggaaacggcgtcaccatgatcgcacggcggaacccagaacccttacggtttctccngnatgagcccggagcctcccccgccaagttgaccgaccctgctggctcgctctacatctggcttcttgtggctacttgctcctggcctgatatgataacctagatcctggcaggagtgcctgatctgctgactgtgcttggtttagcattcgccagactatctatatattaactgggcgcttataatttaattggctgggatcattatactttgtaaaagcgtgcaagactacctggtagtgctagtgacgggacccgctgaaactgtactggggactatactcgaacacttaacattcacaggaagcgacttatctccctgacacgaacgactaaggaacagacactactgggttggacaaatgtaatgcgggacaaacatttaccaatacacgaaaattaacgcggttatggcaaaagggtccgtatacaaaagaaagtggactttggacttccccagattattccaacattggacttacactgggcctggtatcccttggacacttccggaattgcgacacacaactggcttccctctaattgacacaggtttgggccacggccttactggccctacaactcctaggctcacatggctatacacgcacccccccgtttggcctacacagttgacaaaagacgaattaaacgcgcgatttaagcgccaagtttgaaccgcttttaaccgatcccacttgggacaccatcaccgtttttagagttttgggggtagcgggctaaccaggcgtgcaactacaaaagatttcaggttctaccaaacttccaaactttcacacgcaacgaaccgcatcggggggctccaacggacataacgcccatatcccacagaccgct

SEQ ID NO: 685785 - DNA, 270 bp, Homo sapiens
  misc_feature (163)..(163): n is a, c, g, or t
  misc_feature (165)..(165): n is a, c, g, or t
cccgtgagtccggcgcgcagaggaggggagaaagctgaccgcttaggcccgggtagtggtcgtcgtggttttccttgtagttcgtggtctgagaccaggcctcaagtggaaacggcgtcaccatgatcgcacggcggaacccagaacccttacggtttctccngnatgagcccggagcctcccccgccaagttgaccgaccgggcttctttaaaacgcttttgggctattctccgtcttattataacttatcggggagctataagcgcca

SEQ ID NO: 685786 - DNA, 130 bp, Homo sapiens
gtaacatgacaacatactcctccgcataagcctgcgtcagactaaaacactgaactgacaattaacagaccaatatatacgaacaaccaacaagtcattatataccctcactgtcaaccacgacacagtg

SEQ ID NO: 685787 - DNA, 523 bp, Homo sapiens
ccggccgggatgaaaggtcttacaagataaacacagtgaaaaagcttcaaactgcagttcttcacaagtaattcagcatatatcatatatcatgtatacttatggcttaagaatgtaaagcaagtatatttattacgctgatggaaatatgggaaatctctcattcatgcaatatacagggataatattcaagcgaagggaaaattcccgctgttaatgtgagtagatgtatccatatataatcatcgacatgacagatgaggaaacccatgaaggtgcccagtagtcagatatacatgttctgttcatcagaagcacctgatatctagcagctaatttataattaggatactgtgtcaatgaaaccaaaatgagccctacaagtgcctataaacaaaagcttccaaggtacgaggacagtcagtaattcatgcatcattcagaggattatggctgtcccttaagaagtgcaaggtcgaacctgtcaacaccagaggtaatcatttcatattaatttatacgt

SEQ ID NO: 685788 - DNA, 1050 bp, Homo sapiens
cagctacgttggcgaggctgattgcagtgagcaatgggctgtaagccgggaggcggagcttgtcagatgagtccgagaatcgcgaccgattgcagctccagacctggtgcgacgcgagaatgagagtaaactaaacatggaaggaaccgttgaattctcggaatccccaagtaagattaatttcactgtctgagggtagctattttgtgcattcgcagattcgagggtagcgatgtctaaggatagggacgcgtgaaaaaatcgcgattcctaatacggatgacacttttcagagaaaggctgcatttgtggttagacacttcccttcgttgatgtcctatagactctctgggcgtagaagtgaatacggtcagcttattacacattagatgaatcacttgaaccaaactggagaaggaggattcctggtccctggtagccccccaatatctaccccattcttttggtaacaggggttcgggacaagaaaagttctgagagcccacggtgcattcttacaatcatcgggtgagcccatgggtacctcagagcacgagaaagctcgactgttcatagctctaggaatgttgaagttcccgagaaccgagactgtgttggcacagcataaagatggtactatcgtaatgcaagtggttgtgcaaatcacgggactcaggggacttcaagtcctgggggccctctgcgtatgatctgggagtgcgctcagggagtattacttctgttgacccctacggcgtcggtgatgtgggtctcgttgggtcacaagaatcggttgcctctggaagtcgatactcgggccgttaccatcaatcgttatccatcggctaacgtcgggtctcgtccccaaggggagcctcttctagcttggttgcccggcgggcgtccacgggaccggttgggccacgggggtccgctgtggtgtgggttccaggcgcccggcgcgtcccacgatttccctggtccaaggcttggttccctttctgcccgtgtggaggggggcgttgtcagcgctcgaaccgcgagcttccc

SEQ ID NO: 685789 - DNA, 117 bp, Homo sapiens
atacccggtgggcattactatgtgaaaaactataatatcacaaaacagataccataccaacataaggataaaacgtaaatggaaattatacacacttgtgataaacttcacacatct

SEQ ID NO: 685790 - DNA, 1049 bp, Homo sapiens
  misc_feature (319)..(319): n is a, c, g, or t
  misc_feature (329)..(329): n is a, c, g, or t
  misc_feature (331)..(331): n is a, c, g, or t
  misc_feature (334)..(334): n is a, c, g, or t
  misc_feature (337)..(337): n is a, c, g, or t
  misc_feature (342)..(342): n is a, c, g, or t
  misc_feature (346)..(346): n is a, c, g, or t
  misc_feature (350)..(351): n is a, c, g, or t
  misc_feature (384)..(384): n is a, c, g, or t
  misc_feature (433)..(433): n is a, c, g, or t
gcttatgttgatgtgaccacttacttgctttcctgcctccttgaacagacaccgaccagaacgaacactgtgtctttcgccactagatttatcccatgctgcaaactcatctcattacccttttcatgggtttgaagctgctgtctctacaaggtgccagtctcaattcgtgcgtattgtatcagtcagtgctggacaaatcttgaatagcttatgtacaaaactttttaaattcttatattatctctgtgaaactttgctttgggtttgtggcatccctggccaccccatctggctgtgacagcctctgcagtccgtngggctggcangnttngtngactntttnaagnnttccttccctacccagtccccattttctggtanggtttctaggaggtctgttaggtgtacatcctgcagcttattggcttanaatgtactctccttttatgtggtctctttggggccgattgggagaaagagaaatcaatagtgcaactgtcttgatactgaatacttgacaagtgtctttcccgaaataacagaatccatgtccgctctcgaaggagaatgagacaataacacatagcctcggagcgccctattaatgctggggtgccgaggacaacgtggttgtcaaggtaacgcggtccatggtccctaaagtgactcccgttctcccatgatattccttgccactagtcggcagcactagccgaggacatccatcatatcatgtcactgctgatagcagaaacaccgcactacacaccagaggatttcccccgtctgatattccccctcgcctgaaaaagacaacttaactctccactttccagttcccccgacaaaacactataaccttccccgtaaagtcatcttcaagcgcccccataaaccacatatttccacaagcaacccctactcccccttggtctaacctgtcatttacacacatgatcacacaccatagtacccccaccaatctcaactccccccaattactcccgcttctcccaatcctattccccccaactccaagttccccc

SEQ ID NO: 685791 - DNA, 295 bp, Homo sapiens
cgctgcgacttgcacacgcacgactcgctgctcgtggtgtgcgatgactacagcctctacgacatacgtcttgttttttaaacgcctcgcgggcgccttcacctctcatcctcaacttctagagggactgggcgattgcacattatggaggagatgtgcgcgctcagcttcaggcaagagctcgactactggggcatcgacgagatctacctggcgtcctgctgacagggccgattacaacagaagaaaaaacagatgaacgaggagctcaagcgtgaaggcgagaacctacagg

SEQ ID NO: 685792 - DNA, 329 bp, Homo sapiens
  misc_feature (264)..(264): n is a, c, g, or t
gtgggcgtctgagtctcccaaagagagtcctccagcaccacccctccaatggagatcagctcctctcgtcggaccaagtggacccgccgaaccaccgacaggaagagggagtccggaaaactctgaaggatgaccggaagggagacttctcagagaatagagacggtgacaagcgggaagattgggaggacaacagcacacctgaaccaaaggaaaagggggaggaaggctgtcatcaaaagggtctggccctcccggtagtgnaagagggggaggttctctcacactctctagaagcagagcacaggttatggaagggtaccgagctc

SEQ ID NO: 685793 - DNA, 175 bp, Homo sapiens
cctgatgctgctggcgatctagagtatccccttgatgccaatcttggcggctacaacgttatcgtcacagcccatgcatttgtaataatcttcttcatagctaatacccatcataatcggaggctttggctactgactagattcccctaattaatacggtgcccccgagtatggc

SEQ ID NO: 685794 - DNA, 147 bp, Homo sapiens
tataggcgctagtgtgcctaggttctgtgagctgtagtcccagctacaaggtgggatggattgcttagcgcctgggtgattgaggatgcaatgagctgtgatttgtgccaccacactccagcctggccaatacagcaagactgtctc

SEQ ID NO: 685795 - DNA, 300 bp, Homo sapiens
  misc_feature (34)..(34): n is a, c, g, or t
  misc_feature (73)..(73): n is a, c, g, or t
  misc_feature (86)..(86): n is a, c, g, or t
cctttccaagcagacgttttcccaccgcatgcgntgcaaggcttgctggtgtttgtcctgcctttcgagccantaaggtggagcangcttagcgcagtgctcgggccaaagtgtggaggaaggcctgaatttgccctgtgaaagctgggggttggcagccaggaatattcatggagcccctgaccatgtactcacactgctcttcctcagttcaggggtcttggatttgctcaaggccacccaaatatccctttacgattctcagggtcccactccttccagatccaatgccctaaactt

SEQ ID NO: 685796 - DNA, 851 bp, Homo sapiens
  misc_feature (24)..(24): n is a, c, g, or t
  misc_feature (66)..(66): n is a, c, g, or t
  misc_feature (89)..(90): n is a, c, g, or t
  misc_feature (110)..(110): n is a, c, g, or t
  misc_feature (137)..(137): n is a, c, g, or t
  misc_feature (181)..(182): n is a, c, g, or t
  misc_feature (194)..(194): n is a, c, g, or t
  misc_feature (262)..(262): n is a, c, g, or t
  misc_feature (445)..(445): n is a, c, g, or t
  misc_feature (501)..(502): n is a, c, g, or t
  misc_feature (509)..(509): n is a, c, g, or t
  misc_feature (519)..(519): n is a, c, g, or t
  misc_feature (551)..(551): n is a, c, g, or t
  misc_feature (568)..(568): n is a, c, g, or t
  misc_feature (624)..(624): n is a, c, g, or t
  misc_feature (755)..(755): n is a, c, g, or t
  misc_feature (850)..(850): n is a, c, g, or t
tagtgaaaaacacagtactataanctaactgtgtgcacacagttttaacatagtacataattattncacgtacaaacctatttggagannctgttagacttttaacaaanacaaacataactgtaatacactgatgncaagaatggatggagcatttctgagttaacagtgctggacagtnncgtactgggtgncataaactctttatgaatggtaatattatgtaaattgaaatctggccctcaaactatattgcagctcncagcagtatgtttgaagaccacttttgttaatgattctgtaatgtatgaattatgttcttgagtggttaaaaaagaatatgaaggcttgataattatttattgggtaaagtcaggaaattgtagtgaaagaactaatggttttgttttttggaataaaggcacctaagctattgctaattganttgctgctagaattagaaattatgctttagaatagaattggtatttctgtgattcnntttgctncttggtattntctcttgtatctatgtatctagtattgaggcntgctctttcatgtggcnttatcctctctttaatagctgttgtaaaattcctgagtaactggctgcttcaggancagcttgcagagtcttgcttttaggttagatacaaacaaagtaaatcatagttggtgtaaatccagcaaaaaacagctggctttggaatggagaacactacaattcaaatttgaagtatattcagaagaanactttggaattagctttacatttgtttgtaaatctaaacaaatatgcaaaattggtcaaaatgtaagtatatagcatttttaaagattaatggtnc

SEQ ID NO: 685797 - DNA, 220 bp, Homo sapiens
cgacttagaacaagtcacttagtctaggtcccaagcccctcttctgtaaagtgaggatactgttactaaacgtgttttgtgagggttgaattccttatgcaatgaaggaaccctttaaggtaattttaaaattttttaggaattggtacacagtgtccttctcttcacattctctgtgtgtctctgagaaatatgagaaaaggttgatatcatctgcaca

SEQ ID NO: 685798 - DNA, 140 bp, Homo sapiens
ggaaaccaggacgttaaatccacacatattaatactaaccttgaatatcaacagtctaaatgccccacttaaaaggcatggagtgacaagctggataaaaaagcaagactcacacggtaatgctgtcgggctagtcgggg

SEQ ID NO: 685799 - DNA, 803 bp, Homo sapiens
gatggacaaatcttatttggcttaatgtgtttgtgtgtgtgtgtgtgtgtgtgtgtgtgtgtgtgtgtgtatgtatatatatatatatacactatctctcccaatatgccccgtggaccagtgtataaatcccagcacaaagagctggctgatctgcacaactataagttatgctggatactgcgacgcactataatatacactcagaggtacagacggcgctgctgctctcctccgctgccaaagacggcgaggctgtgagccagagctcctctcactatacagagactcacctagtgtatagcagcacaacaggggttgatccaacgatgagaaagacgatgaggcagcagtgtcgtagtaatagtgtctgctgcaggcggctagcaccagtgctagacgaaggtctacacaaaacgacatagcaggggccccgtagatcctccatcgaacaagaaagtaaagaaggttagagcaacatagagagcgagccacatcccatacgagaatgctaatagtcgtaggagcaaaccaaaaagtccatccaaaataggaaaaccaaataatagcggacatagataacggcctttccatcaatcaatatacaaaacaagtcttaactgcaaacacttaggataaattaaaatacaaacaaccccatttataaacagaccaaccacacacacaaaccacaaaacacacaacacacacttcatataaaataaactaataaaaaaaaaaagcaacgaaataaacaccagtaaccacacaaaccagcaatcaacaccaacaaacacaaaaaa

SEQ ID NO: 685800 - DNA, 928 bp, Homo sapiens
  misc_feature (16)..(16): n is a, c, g, or t
  misc_feature (60)..(60): n is a, c, g, or t
  misc_feature (169)..(169): n is a, c, g, or t
  misc_feature (285)..(285): n is a, c, g, or t
  misc_feature (844)..(844): n is a, c, g, or t
cccccttctctctccnccttcttcttcttctcctatttcgtgccactctgccctacgtgntttaacgttgggcgttatctgttgagtttttttgtctggagtagagacaactctcatggcattttaacttggccgtccagaagcgtcagcaacccctgctttcctttgncttttccatattcttcgttttttatttattttaattaaagaatcagcatatacgagcacgcgaaacataactgtgcgttcctcatcttcgctcccgttgtgaataaaaagaaagangttctttgtttattgtttttttttttctgttatcttactttccttttcttccctgccactccatcatccacaccacttttctttcctttttctcgtgtctgcgagagaagtttgaaaagtaagacgatagaagagccggagcagcgaggagtgatggaggactggacggtagtcgcgggagaagagaaataagggcaaatcagcaggataggtagagataaataatgctacgcaccggctccatattagagtctcgctgtcttttaagagaacctctcatttttatatcaattcttattactttatgtcaatcattatcctattaattcctccctccgccatcccctcttgtcaaacaccactcgacttccacctcgataaaacgcaatacaaagcagataatatttttatctccctataaccgaatgaactaaggttcagccaccgtcttcccgttttcatgaacataatagtaatataatgtcgtatttcgctatatactccgacgtaccttctgattcaactctggcgacgctaatatctccgccaatttgatctngcatagaaccaacgtaggagatcactgcagcgagtcatcaacaacctacgaccgcttactctccctcttctcgttaatgaagtt

SEQ ID NO: 685801 - DNA, 160 bp, Homo sapiens
tggtttttctgtaaataaaaaattgaaataaaagccccacaagggactcgtaatgccctaatttgctttttagccaactttgttaacggttataacagattgttgcttctttaaaattttggagtccttgtaacccaataaataatttaggataatttga

SEQ ID NO: 685802 - DNA, 100 bp, Homo sapiens
aaggctaggtagcgaggccgggtgtttagcgaagcgtctgcgaccgtcgtttgagtcgtcgctgccgctgccgctgccactgccactgccacctcgcgga

SEQ ID NO: 685803 - DNA, 312 bp, Homo sapiens
  misc_feature (192)..(192): n is a, c, g, or t
gtgccgcagggttcagagcaagagagccctgtggagagggaaaaaaaagagaaaaataagcgctgccttgttgggtgttataaagacgccagaaagaagcccctctctgtggtggggaaaaaagcgcacccagcggtcccaagaaacccacccccctgtgaaaagagcccttccagagaagacaccctctanttcaccaaaaggggaaaaaaccccctgcatataaatttttaaattggattttcccaaaagggccaatcattttgggcacactttttttgaaaaaaaacccggttatacaggccgggggga

SEQ ID NO: 685804 - DNA, 1024 bp, Homo sapiens
cagccttccccgacgagcggacgcggagcgcctctgtctcgctttttcttatttttcccccctttccccgtttcttattaacacattatcttagctacccagtcccaacgcatcacacaacataaccacactgagaggaagcaacaccactgggcaaggcgagcaccacgcggacaacaccacaaccacaccagcgccaaagacgccacagccgacacaacacaccaacccaccacccacaccaacgaccacaccgcacgcacgacacacgacagccacacacacacaccaacaccacagacaaccacgaccacaaaacagacaacaaaaccaaccgcaccacccaaacacacacacgccacccgcgcccccaccaacgcacgcgccacgcacagcgacccacccgcccaacgcacgccccacataccccgccacaccacacgcaaggcccgtcgcaccccgaccacaagacaggcacaaacgcagggccgagacaccagatcgacacacgccacacccacgacaaccctcaccacgccgacaccacacagacagcacggacgacccacgcagcccacaccaccgaacgaccacaccagccgacccagagccaccgcgacaaccgacgagaggagaacacaccgacctaccgacacaccaccgatgcgcacacacgaggaacagggaacgaacgcagaaggagacaagccgcacagacgaccaacgacccacagcaaccaccacccgagccaccgcactccacacctctgagccacagagcacacagcgcggccacacgacagcacacagaccgacacaacacgcccaacagcgccgaacacccagccgacaccgccagccacagcagggcgccaccaacgaacccacagaacgcacgcgacgacaacggagaccagcgccagacaaccgactcgcacggcacaccgcacaactcgaccacgcccgcagaccaagctcaccccgcgaccagccaccggacgatgacgagacgagacagcgaaga

SEQ ID NO: 685805 - DNA, 915 bp, Homo sapiens
  misc_feature (10)..(10): n is a, c, g, or t
  misc_feature (18)..(18): n is a, c, g, or t
  misc_feature (20)..(20): n is a, c, g, or t
  misc_feature (25)..(25): n is a, c, g, or t
  misc_feature (45)..(45): n is a, c, g, or t
  misc_feature (47)..(47): n is a, c, g, or t
  misc_feature (115)..(115): n is a, c, g, or t
  misc_feature (145)..(145): n is a, c, g, or t
  misc_feature (166)..(166): n is a, c, g, or t
  misc_feature (201)..(201): n is a, c, g, or t
  misc_feature (220)..(220): n is a, c, g, or t
  misc_feature (223)..(223): n is a, c, g, or t
  misc_feature (226)..(226): n is a, c, g, or t
  misc_feature (260)..(260): n is a, c, g, or t
  misc_feature (264)..(264): n is a, c, g, or t
  misc_feature (346)..(346): n is a, c, g, or t
  misc_feature (378)..(378): n is a, c, g, or t
  misc_feature (382)..(384): n is a, c, g, or t
  misc_feature (390)..(390): n is a, c, g, or t
  misc_feature (392)..(392): n is a, c, g, or t
  misc_feature (406)..(406): n is a, c, g, or t
  misc_feature (420)..(420): n is a, c, g, or t
  misc_feature (430)..(430): n is a, c, g, or t
  misc_feature (434)..(434): n is a, c, g, or t
  misc_feature (437)..(437): n is a, c, g, or t
  misc_feature (444)..(444): n is a, c, g, or t
  misc_feature (447)..(447): n is a, c, g, or t
  misc_feature (462)..(462): n is a, c, g, or t
  misc_feature (487)..(487): n is a, c, g, or t
  misc_feature (499)..(499): n is a, c, g, or t
  misc_feature (513)..(513): n is a, c, g, or t
  misc_feature (515)..(515): n is a, c, g, or t
  misc_feature (517)..(518): n is a, c, g, or t
  misc_feature (522)..(523): n is a, c, g, or t
  misc_feature (525)..(525): n is a, c, g, or t
  misc_feature (545)..(545): n is a, c, g, or t
  misc_feature (552)..(552): n is a, c, g, or t
  misc_feature (558)..(558): n is a, c, g, or t
  misc_feature (570)..(570): n is a, c, g, or t
  misc_feature (576)..(576): n is a, c, g, or t
  misc_feature (586)..(586): n is a, c, g, or t
  misc_feature (813)..(813): n is a, c, g, or t
  misc_feature (827)..(827): n is a, c, g, or t
  misc_feature (848)..(848): n is a, c, g, or t
  misc_feature (894)..(894): n is a, c, g, or t
aaaaaaaaancatcattngncactngtgacacatacaaataactnanctctcatactgcttgattttcaggttgaaaggttacaataatctatatatttcaattacatggcagtnaatacaaaagcattttaaacatcttttganctgtgtagtatactataagcnggggtttattctaaaacattccatcattcttctgncctgtttatgggtcatgcnggnttncggcgatccacatcacataaattatccaccagtnatgnggtgtaaaatcaattatgcatgtattttgaatagaaattatttttaaatgtcagagagaatgctattattggccaacttganatttcctaattagctatctgagctatttaagnctgnnnttcagngncttcatttttttanatgagagagctggnctagattttntatnagngcctacnaangcctagtgttttgcngttacttccttccctgtcaaaattntgcctcctttgnttttcaatatatanananntggnngncttactctgttgcccaggcnagagtgnagtgangtgagcttggcncactgnaacctctgcntccggggctcaagcaatcctcccacctcagcctcctcagtagctgggaccacaggcatatgctacaaagcccagattattttttatagaaacagggtttcaccatgttgcccaggctggtcttgaattcctgggctcaagtaatctacccacctcagcctcccaaagtgctgggattacaagggtgagctaccgtgctggcccaaactaactttcaaagtgactttnaacacttccttctnaccatgattatcctttcaaancttgtctaaatcttcagagttccaacatttcactgaaccatacttntgagtttaaacaacaaacagt

SEQ ID NO: 685806 - DNA, 491 bp, Homo sapiens
  misc_feature (52)..(53): n is a, c, g, or t
  misc_feature (86)..(86): n is a, c, g, or t
  misc_feature (120)..(120): n is a, c, g, or t
  misc_feature (259)..(259): n is a, c, g, or t
  misc_feature (317)..(317): n is a, c, g, or t
  misc_feature (330)..(330): n is a, c, g, or t
  misc_feature (368)..(368): n is a, c, g, or t
  misc_feature (403)..(403): n is a, c, g, or t
  misc_feature (430)..(430): n is a, c, g, or t
tcctgtttaatatggccggggtgacattccggaaattcataccgaagtgcannaagattgtcattgactttgattcaattaacagnagaccgagtcaaaagcttcagtgagttacatctnattcaatctccagaagattgggattatcgtcttctaagaggttgctaatgcctttcatcttgaagttacacataacttcttactagccagtatggcaaaagtaggcatctaaagaatataaagcctctcttcttactgnctctcttgtcacatggaatctacatgtggttggaactattgctttaggattttagggnagcctgtggtggnctggtgcacagggctagaaccagagtgccttcccttcntgggcctggctggctgggatgctggtggctctttnaaggagcatcagctgctgcattgtgcnacccggagcttcttactggtcatgtgctggaaggacaataatattggggtgggtcttgggc

SEQ ID NO: 685807 - DNA, 216 bp, Homo sapiens
cgtcggtcgttctataggggcctgatcaactaagcactctactctcagtttactgctgcatccaccttcgcacccttaacgcttcataaggactatcgtagatttctggcccagaaaatatagcccatttcttgccatcttatgggctacaccttgacctaacgtctttacgagcgtacttgcgcatactttgtagccttcatcacggatagctga

SEQ ID NO: 685808 - DNA, 144 bp, Homo sapiens
gtaatatatagagagaaggaagagaagtacgccgagggcgtctttgataagtgtagtaacgggtaggaaggtgattttatacggaatagggacggtgattcctaagggggtatgtattgatacccagtattcgtagcaaagaat

SEQ ID NO: 685809 - DNA, 238 bp, Homo sapiens
ctggtggtataaatatactgctgagaagtgacccattcacgtgaggctgtaaatctaggtcactgacactaagaacctgaagagaccctatgaacttttccctaggaggccgtttccaactgccctatgtacaatacagctgataatcacgttgtatacatgatggttcactcacggagcttcgaacttattcatacctacatttaattgatcaccacgaatgggttggccgacgtgt

SEQ ID NO: 685810 - DNA, 247 bp, Homo sapiens
ccaacacacttatgaagtaggaatccttccccatgctgtcttgtcaggttgtcacagatcagatggttgtagatgtgtggtgttatttctgaggcctctgttctgttccagttgtctatatatctgttttggtaccagtaccatgctgctttggttatggtaaccttgtagtgtagtttgaagtgagacagcatgatgcctccagctttgttctttttggttaggattgtgttgggcgataacatca

SEQ ID NO: 685811 - DNA, 335 bp, Homo sapiens
tctccatttttgcctacactctgcccacagaaaaattatcactaggcccaggtaccagacaatgtgtctttcttgcatggccctttatcatagaaagcattgttacctattgctgggctcagcacctaggtgatgtcattgctgcctgtcgtgctttcaggagaaggttgtaacatattcctggctgagtattaaagtgatgtgacactcctgtctggtccctgccctcaggaaagattgtgatgtattcttggccaaaaaacccaggtgatgttaccctcctcctttctgcctgttcacaggtgggattgtaaaatatattttggtctagctca

SEQ ID NO: 685812 - DNA, 159 bp, Homo sapiens
acctctgcaggtgctgtttgccatgttaactccacactctagctgcagtgacgctgatgcagttgctggccatcgatttccatgatccttgtgtaaatttttttccgaagaaagagaaggctccctcagggaatggtggcagctgcgtttcacttccga

SEQ ID NO: 685813 - DNA, 360 bp, Homo sapiens
acttcgccgcttgtccagctgacccatccttgcccatcctttgtacaggtgacaggtggacagagagggtgttattctcaagaccatcgagacagggtatggggatgtcgtcatgtgaggccacagaggaggagtatgatgtgctctagagagagagaccctctgacaacagagagcgttctcacctgtgtcctcagtgctctctgaagccagtcttcttatatacagagagacaacacaccgagtctcgagttctcctctcagagtctctgacctctatctctagtggacatctctcgtggtccccaagaagcgatatagcctatctgtgtacttgtaacaggtggggtatcctctaga

SEQ ID NO: 685814 - DNA, 875 bp, Homo sapiens
  misc_feature (792)..(792): n is a, c, g, or t
agcgggccgaggacccgcgccgcgctccccgcgcacctcaccgcgtccttcacctgactcccgtcggcgctcggccgggcgcggaagggcgggcgggggtctcctccatggcgtgcgcgctcggatccgcctgctgtagctatgaggcggggcgctggggccctgcggtcgccctatctcggctcagtcctccccctgtgggacctggcgacggccggcggagggagatgggagctggcgcccgggccgtggccgggggcgtggatggcgaccgggggagtggcgtgctggcagcgcgtgctgcggtgctcgaggaatccgcagtccggatcgggcctgccgaatggtaacgacacatgcgcgttcagcctaaaggatgctggtactcacgctgggtccgacgccagggtgacacgaggtgtaacgcatgcattgagacggatgataccaaatggtgcggacagctcgtgccgaggaacacggctcaaggaagattttgagatcagaataggaattgccaggagtgtcgcaacgcatggtcccgtgtagccccttgcgtcacgtggctcctcgatggaacgaatgtcgcccttgggtcgaacttgtccactgcatcctgtaatgtgcaagctccttgtaggaaactttggctgcgcaatacacttccacctcggagtaattacaataagcataagcatattaatttcactgggtggttgagctaattgtaaagatcccgcacggactcatttacttttcaccgtgggaagagcctggtgagcttctttcctntgtagcgccatcttgtgaagggtgccggattatcccaagaaaaccgccagttaaccaactaatttgaggcaagcgaaacactc

SEQ ID NO: 685815 - DNA, 271 bp, Homo sapiens
tttctcttttaaacaagtaaattttgacgtttttagcatgtggcaataaatgcacatggaacaaaatgtagagtgtttcacagagtgtgatgtgaaagcccatccccgcctctgagtcgtccagtcagacaccaccgtagttacagttccaagaatcttgtgcttagacatgtaaacatgtgtgagcggccttccgctcttcacacgcgtggcggcttagcacacacggtctgtcccgtgcctctgcaactctgtctgcaaggaacccacg

SEQ ID NO: 685816 - DNA, 532 bp, Homo sapiens
acgctcaagaactcggctctgagcgcgcagctgcgcgaggcctgctactcaaggcgtcatgctagacccttgtggttccaccaatatgacaaaagctacctgggatccatgttatattgtgcttgtgtctccacagactcagggaataccctggcagtctcttccgttccattgataagctacgatagccatgtaatgaagatccacgactagagccccatgctaacgcgggttggttggtgccatgggcttaagcttattccaggacggccatgaccttatcccttggcagctttccatgacgattcagggagcccgtgatcgtggtccacgttcatttggacgcagcagatgcacacaaacactcgacgggcgtcgtgttcatatcatcagcacgtgcccgttggaggtagtgtgcggggagggtcaccccctattggacccccattcgacacgtgatggacctatcgaggcgggacatgtggccgatggcgtgtcacttggtgacgcccaggatgcagactggacggag

SEQ ID NO: 685817 - DNA, 617 bp, Homo sapiens
  misc_feature (1)..(1): n is a, c, g, or t
ncttttcttggtggttaaaaaatttctcttttttttaagaaatttttggaaaatttcccccaaagagaaaaaaatttttctccccaaatatttggggggggtgttttggaaaaaaaaaaccttgttaaaatatttgggccccctaataacccattccccccgttttgcttttttgtgggggtaattttgaaacactcctttttaaaaaaacggggggggggataaccaaaaaaaaaacaaactttttaaaaaaaaaaaaggcccttttttccccgaccggtggaaaattttcccgtttgttgttttggggcccccctccgtaaatttgaaaaccccctttccaaaaggtgcccgcttttaattttttttgcaaaaacttttaaaaagaaaattttgaacgctaaaaaaatttggacttctttaaaaaaaggccttttaagggaagaaaaaaaagaacttgcctttaaaaaggggccacgggccttgaaaaacattttaaataaagggccccaaaacccccgtttggataaacccccctgtggggaagggttttaagggaagagttccgggggaaaacctaaaatttaaaccccccccgctcctgttgtccctttata

SEQ ID NO: 685818 - DNA, 144 bp, Homo sapiens
gggcccgagaattattatgacccgcccttttttaatcatgggacatttttcagaggggaaaaaaatgtttggcaaagtcctcccttttaaggaaaggcaaagcttaaaataaaacttttttttgtttggggcaacccccccgta

SEQ ID NO: 685819 - DNA, 236 bp, Homo sapiens
ggtggagtggcgttcatttgggttgcgacagcacttctgatcgcgaggctgacgacgctgcaaccaagcgcctggcccgcccatctcctggcgtgcggaagtgcgaatgtggcagtaaccgcgctgttcgggcttggtgtagccgcggcaattccgctgtcgttcgtcaatctctttgaggccgtcatcgctgcctcggtgctgagacttatccagataccggagcgtccgctgga

SEQ ID NO: 685820 - DNA, 81 bp, Homo sapiens
acatctgtgtacttctgtgcagcagttcggaccgtgaacactgaagctttctttggacaagggaccagactcacagttgta

SEQ ID NO: 685821 - DNA, 231 bp, Homo sapiens
agcgaactattatacgcatgatccaataacttgaccaacgggaacaagttacccgtgagggataactacgcgcaagtcctattctagaagtccatagtcaacaagtagggtttacgaacctcggatgtctggatcagggacatcccgagtggtgcacgtccgcgtattaaagggttcgttgtgttcaactgattgaaattcctatcatgtatcatgtagttcaggcaccgg

SEQ ID NO: 685822 - DNA, 1619 bp, Homo sapiens
ggattgctgcagcgagggtctggcggctagaccgtggctttgagccaggctgcccgtccgtgctgctgcggcagcctggggctccggcggaccttggctacgatctcacccccccatggcagcaagcagctcgctttatcatctctggatgacaacgccccgagttccgcaggggcctccgggggagttcactagatgacgtaggaattcatccagacccaactgtcatctctggcaatccccatcttaccgactgctcatggaaccggtgaagtgccaaatcactcaactcccagcgaggacctccacacctgaccgaacggaccacaggtgcctagaacgccctctactcagcacgcactgcaccactgacttgcaaccacgcactgtgcacccggccagtccctcctatgcagcctgcctcagccgcgcccaggggcccggcatcttcacttctacactgcaaccaaaccttatgagacagcacggcagcgagccacccgccaaccgctgccgcgacagctgcccgccccgccccccttgggacacaaaccaccgcgcacccctgcgatgctccacgagccccaccctacacccggcgcaagggcccacagcctgctgccctgcaactgcctcactcccgggggcaaccttaaccgcccccctggcgcacgaccctcactctccgactagggacaccggcacagcatggcggctcacgtggagcccacaaaccaaattgccaaggcctcggaacgcctcttgcgggcaccacacgatgcgcgccacacccacagacaatcgccaccctaggttgaccgaaccctaaaacagcgcctcgacacaaaggagaaaaacccgcacccaacgttatacagcagtcccaccctaaactcccttcacccatccccttcccaacacttgagccccccaaccggcgcacagagaaactccccgcataccacagcgaccgacggccagcgcagcccggcccagcgcgacgcgcgctaaccgacccaaccagccccaaaagagctgatgcgcccctcaaacgatcgccccacaacccaagcacggactccgccccacaccccctgccccacacccctctacgcgacaccaacgctgaccgccaaaccccacccacgtcaagcgcagcgaggcacgagccccctcaatgtcccgaggaccctaccaacccccacccccccccgccccaccaacacctagcacaagagcgccccccacccaagtagcaccaccaccccgcccccgcaccaaccaccaaccggacccaaaacgccacaaacccttcacacaccgacccccaacccactcgtgctacccacggcccaaccgaccagcagcaaactatggcactatctgccacagacacgaaggcccccacgcgacacgcgcaacccacggactcaaccacggcctgtgcacccggcacacatcctcaccctacggcagcgccataaccacgaccaccacaccgagtagcagccacgacgacccacaagagaacagaaaccaccacacccctactagacggccgtcacccaccggacgtcgcgccccacgccacccgacacacaaaccccaacccgtgcaat

SEQ ID NO: 685823 - DNA, 815 bp, Homo sapiens
  misc_feature (1)..(1): n is a, c, g, or t
  misc_feature (81)..(81): n is a, c, g, or t
  misc_feature (116)..(116): n is a, c, g, or t
  misc_feature (118)..(118): n is a, c, g, or t
nctaggtgtgtaacgttctaccaaatggtgagttaaacacagatgaccccaccgcaggacgttcaaatgcacccatcacancccctacggaagggggggtgatagataaaaccaantncttctgttttttcaaacgaaggagaaggtaaaccatacagcgccacaagtgactctggacacagacagatcctggggaggacttacatggtatctgctgtgttgggataaaatcatctcttggggggcggtatattttcaagggctcactcttagaaacaaaaatggcatactttcatacttcattttggggttggcttacattctttttctttttttttttttctctaatttaacctttatggaagctttaaaggcttggcaaaacatgagtgctttgcccatcagggaatggaatggaccaatgaggggggatcaatgaatatagttccatagaacattttccagaagttcttctgttggagaaagcagtacagtatcttaagggggaaccagttatatacctaatctgggtttttataacttctggaagagcataatcaaacaggagttttcttttctcaggggataatacaacagagaaaacagaggggcgccaatatttaaaagaagttatttcttggagaagtcatattttggggggcggtggattgatttcagtattacggggggggactgggattcataaagtgctattaacattctctcccggagaatatgggacagtcactgggcagaggggctggaggagaaaacattctggggtccggcaaaaggggggggggagaagaaattag

SEQ ID NO: 685824 - DNA, 397 bp, Homo sapiens
  misc_feature (369)..(369): n is a, c, g, or t
ctgcaatgtaggaaccaccacccccatttcatagatgtgagatcaaaggttcagagaagctgcattgcaaaggcacacagctaggaagcggttcaaaagcaggttcctttgttttgttttgttttgttttttggctcaaacccatgttgtgtccccatttgtgactcggcctcttctgctgctacactgcctgggtatggtttgagatggggtttgggttcaagccaaggagctggggttgggaatgttagagcgaggggagggaaaatgggacccccaagaccactaccccagcctttgaagtttaaggccgtatagcctgctaggagtccttgagccccttctgggcttggggacatcctctccctnggggggcagctggatcacatgtttttct

SEQ ID NO: 685825 - DNA, 277 bp, Homo sapiens
gagtatcctcagcctttccggcgggcgagcagtacatgccacgacttcaccagtcaaagcgagctactatactcaattgacccaataagttgaccaacggatcaagttaccctagtgataacagcgcaaacctattctagaggccataacaacagtagggttaacgacctcgatgttggatcagaacatagcgatggagcagccgctactaaagactcttatgttcaacgattaaagacctacgatagctgagctcagaccggagctatccatatgg

SEQ ID NO: 685826 - DNA, 412 bp, Homo sapiens
ccatatcacttccttacatggactgaaccaaggtacatcattataactacatgattgatgtctcatatcccccgtaagatgtataaaagcgaattgtatccctaacacctcggagacaccagttttaagactttcgtgacgctgtgtcatgtcgtgtgtactttactttggggaaaccagagttaccaaattgactgagacctgtctcagatattttgtgttcacaagatcgacagctaatttttttagtgtaagtcctaaatgatgcatggggtatacttatactagattattagttgttgatctgaaatttagagctaactgggcatcctgtattttccgtcatgaccctatccgggactctcctaaggtcatctttcattcttttgccaaatgtcctaatcaggatggt

SEQ ID NO: 685827 - DNA, 124 bp, Homo sapiens
tggaagtttaagagctgggaagcatgactaataaatagcattgctggaagagagggttgtgtttttttagggtatgagttggtctgtagaaacagaccagttaaggagccaaccgtggactagt

SEQ ID NO: 685828 - DNA, 212 bp, Homo sapiens
tcctggggaattttttggaagggaaccttcttcttggggggggacttaattgaccaaccctcccttccgattttaagcctctggggaaatataaattttaaagtttgaaggggggtaaccccccgcctttccctgcttcaaaaaatttttcttccgggttttggtttttaaaaattttttcccgggcccttggtatttttattggggggggg

SEQ ID NO: 685829 - DNA, 309 bp, Homo sapiens
agctttgaggagttttctatggtgtgggcgaggttacctgtggcctcccccgagaagatgccgagggtgtgggggggccctggccccccccataagccaggccttggggaggggccccccttaggccccattggcccattttccagtggccgcggccccggccccatttttggtggccccggccccacccccttattaggggggcgggcccccctgccttttcccaaccaggggcccggggcctgttttttccaccttttttggctgtggggtttgggggtggggcccaattaagttttttccccccca

SEQ ID NO: 685830 - DNA, 297 bp, Homo sapiens
aggtagagcttaaggacgcagccaatcttaagtactgtgtgaccacatctgttagtacatcacatagtcatactggatgtaatatgtgatggtaaacctgtagcttataaatttactatattattctttatactcatttactcagtcatttctttacaagaaaatgattgaatctgttttaggtgacagcacaatggacattaagaatttccatacaataatttatgcaataagtttcccagaacaaatttcctcaataaccacaatccagcattggttttcattctatttcatttt

SEQ ID NO: 685831 - DNA, 387 bp, Homo sapiens
tcgtcactatgcacagactctcggcactctgccggtctcagcctaccttcagctatactcctccaacagtttgatctcctcttcatatttatactatactttaggtaggaatacttgtccgcctgggcctccagggatatcacgttgttggtaacaatattacagctcctcctactaggtccccacatttactctacgggcacctcaggccctctcctccgagcgctccagttctccttccaggaatcaccagcttcctggccacctcttcatatttgcggtctgaatcctcagcgatagtgcttggactccttcagctgcatctcctgcagttccatcttctacctcatccttcatggaagtatcaagcgttgagggggatcctct

SEQ ID NO: 685832 - DNA, 209 bp, Homo sapiens
  misc_feature (111)..(111): n is a, c, g, or t
aagagtgtgctgtctcactatgtggtgcaggtctctggtgctacacaaggttgctgagcccaattctgttctcaggtgggacccccaaggtatcccaaaggtatacccagntccatcaggcagactcctgaaaagcagaatgttggacattaccgggttttcactcttcactttctctcctggaggaagaatgcacataagtttgtgct

SEQ ID NO: 685833 - DNA, 699 bp, Homo sapiens
taaattttaatgttttaatttagtctcccgcaagcagacagggtatttttttaaaaactatgttttactacgagaaaatattatttatagtcccattaaattggttctgtttgtgtcacctgaatggaagttctgggaagagaatggtcgcaaggtattcagcaggcaactttatagcttgatattcaatgggaaggaaagctatcctgggtggcactaggaacaagaaggtaaacttaaaagagcagctggtgaacacacatctttgagaagaagggacacaagaaggggggcactaagacaacaattcagtgtttggtggcaaaatcttagattaccaaagataaccttgggcaattttacctagcgcttcccttttctcaccccattccagataccaagatagggcctattttaatggctaacatgaactcatggaaggataattaacagacacaattcaagaaaactgtcctaatgttactcaagcaggaataagctttggcccttccctgcagctgtttcacacaaaacgtgtggacttggtacgcatacgtgtgttatctgggctccccatttttgcaattcaagaggacacttgctaataacatatcttgtcttctgagaatacagctgcttaagactacaggaactgaagtagtctaaaggtccatccagctgttttgtccggggacagat

SEQ ID NO: 685834 - DNA, 574 bp, Homo sapiens
aagcagttaatacagactcagtctcctgagtatctgggattacagtgcctgtgctaccatgcccagctaattttgtattgtaagtagagatggggtttcaccatcttggccacgctggtcttgaactcctgacctcaggtgatccacccgcctcggccttgccatagtgctgggattacaggcgtgacctgccgtacctggcctgaagctacttttaaccccagttctcagaatgccccttatcccagaggtaatcacaatgtctctattaattgggggtggggggatattatatgcagtctacggttccatagtatataatccctccccactttggtcacaggtcgtagcatatgatatatatccttgggtatgtaggcgtaatcctcttaataatatctctgagccattttctaccacgtatggcaatactggtttattctcattggaagctgcatagagttccatggttgggatgtacataaggtattaaatcagcttcctgttggagagcatattattcctctctacgctgttggaggcagtgtgccgggaataagccccttgtaggccc

SEQ ID NO: 685835 - DNA, 397 bp, Homo sapiens
gccttgtggcttttgctttgcgtgctgtttcccttgaaccagagggcggcaccgtggaaatactgttttccctgtagcatatatgtagtaggatatgcatatactaggcagagcaacaggacaatggtagccacttcaagctcctagcggtagggctatccagactgcctataatagacagtactcaacgctctctcgcggtacgctgacgcctgcaaagccctacaggcaaaagcaggagtaccctagttttcactctctgatcaaccttcgcactccactgcgaaccctttacaaacttatctctccacacccacctcattggctgccccactgcccgcctgctaccctatgctctcaccagcctttccctggcactgcgactggtgaccctctc

SEQ ID NO: 685836 - DNA, 403 bp, Homo sapiens
  misc_feature (296)..(297): n is a, c, g, or t
  misc_feature (328)..(328): n is a, c, g, or t
attgcttagaatgactacgagcggggtggctgttggggatgaaaagggaaaaaggaaagcaatatttgtggtggtttcttctcaggggggaactgaggagggttttgtgcacgcctggcaggccaaagtgtagtcaactggtctgaagtcaaggaaagtgaacactcaggctgacagccttgggtcctctccagttgagagatgcagagaaagtcagattaaaaatggtgtaggttgacccttcgggccttttacacgtgatcatacttgcctgccaccttagctttgacctttannatgagaaagggcttatagttttggcccttgnaattattctatctggtaaagtgcttagagaaccctacaaagaagtcagtatgatcattgcagtaaggctgtttag

SEQ ID NO: 685837 - DNA, 167 bp, Homo sapiens
taattctttttttaaaaaaacccccccccctaaagaagcccccctgtcaagagttttggacccccaacttcagctttgcctcccgagttttggattcccaaaaaatcaaagggggcccatttggttggttcccccatgaacccttctaaaaaaacccttttttttta

SEQ ID NO: 685838 - DNA, 304 bp, Homo sapiens
ataacctaattacggatcattaacccactgagcaagggcaggatggagcccaaaacctcatggttcctagtcggattcgttaaccactgcactgtccacgatgggaactcctccttcctcttctattgcctcccagagtcttgtctcagagcctgctttggggctgggaccctaaggcagatccattttctatttcagcaccacctccctcaccgtgcatctgagacctggggtggcttgtccatcttgggctcttcttgctcctttggttacctcgaactcatatgttttcgtaattggggtt

SEQ ID NO: 685839 - DNA, 180 bp, Homo sapiens
ctctacaggatcccggactgacagcttaattaaattcgaatgccaaagtgtatgatgtatgtcctccctggtacttatcacgcggtcataccacctgttcctcttatttgtggtttgtttcgtgtgtgtttccttctactaaacatctttgaattattactttttttgacttgatacatt

SEQ ID NO: 685840 - DNA, 99 bp, Homo sapiens
cccatctgcagttggaggaagtaatgctgagcctgcgagggctgacatcacttacgagagcgtcaggaagccagccagcacagcagcagcagcttggct

SEQ ID NO: 685841 - DNA, 214 bp, Homo sapiens
  misc_feature (186)..(186): n is a, c, g, or t
ttcccatccagctagacttccctagccagacatccaatctcaactcatccaacgccaggcgcactcattgagcaggcatccaatctcaagcttcatccaacacacagacatactcatccaccaggtcatccagatctcagacttcactccaagtaccacggacacacttcgatccaaccagagcantccaacttctcagactccattccataca

SEQ ID NO: 685842 - DNA, 119 bp, Homo sapiens
gtgatcatgagtgagtctggacacacacatatatatcaagagagtggctagagggcataaaacccttaatgagacttcaatgagcttcctggtatcatgcaaattaagcacacaggcaa

SEQ ID NO: 685843 - DNA, 142 bp, Homo sapiens
aggtttccccattttggccaggctgatcttgaactcctgacctcaggtgatccacccgcctcagcctcccaaagtgctgggattacaggtgggagccccaacccccggccatgaattaactccgttaaaaaataaacgtata

SEQ ID NO: 685844 - DNA, 328 bp, Homo sapiens
  misc_feature (205)..(205): n is a, c, g, or t
  misc_feature (208)..(208): n is a, c, g, or t
  misc_feature (214)..(214): n is a, c, g, or t
  misc_feature (216)..(216): n is a, c, g, or t
  misc_feature (234)..(234): n is a, c, g, or t
  misc_feature (241)..(241): n is a, c, g, or t
  misc_feature (245)..(245): n is a, c, g, or t
  misc_feature (305)..(305): n is a, c, g, or t
  misc_feature (314)..(314): n is a, c, g, or t
cttttcccccttgttaaaagggagttataactgtcaaccctttggaatattatgatcccaagtagtctttttataatttggattgtaaaaagactacttgggatcataatattccaaatagtctttttacaatccaaattataaaaagactacttggattgtatcgtatgttagatttttgataaaatttggccaatttttacanaanaaattntntgatcatttagttctatntatttanaaanatgtaaaactggattttttttaagtaatatgtgaccaaagttaattttgtcccaaaggtntaaataaanagcagtttcccata

SEQ ID NO: 685845 - DNA, 523 bp, Homo sapiens
ggggcgaggaaagacgggaggatactgcgcgggatgatactcgtcggcggaaaagtgtgtcaagacttacacggcagaacccaaacatcagtcccccgagaacaaacagacagaccaggcactgggcccgaaaaggctcagagcgagcccagtggcaggccggctacgcacggacactaggatctaccgcccctggggctgcacagagggtctgtgccgaggcggcagcagaagtgtgtatgccgtacactcagggccaaaccagaggctgggagaacgcggacttcaccagactcttgggcgttcccaacccccagaagaagagtggctcggaaggagacgtgtgcacatttggctgccggccaggttcacctcagacaggaaaacctgagggtaggcacccttggccggaaccttgtcccgcaggctgccaatccactgaggccctttcctgggcgacaaaacagcaatgccagagtcagaccgattctcttcctcctctttctctactccccagaatcat

SEQ ID NO: 685846 - DNA, 119 bp, Homo sapiens
agcggaggggtgcggcgcgctcctggcgaggacggagcgagcagatctcgcgtgcgctcgccgcccggcgcagcccagcacatccccctttcgcaccgtgatcccggtgtatccgtgcc

SEQ ID NO: 685847 - DNA, 246 bp, Homo sapiens
  misc_feature (123)..(123): n is a, c, g, or t
  misc_feature (126)..(126): n is a, c, g, or t
  misc_feature (132)..(132): n is a, c, g, or t
  misc_feature (134)..(134): n is a, c, g, or t
  misc_feature (152)..(152): n is a, c, g, or t
  misc_feature (159)..(159): n is a, c, g, or t
  misc_feature (163)..(163): n is a, c, g, or t
  misc_feature (223)..(223): n is a, c, g, or t
  misc_feature (232)..(232): n is a, c, g, or t
cttttcccccttgttaaaagggagttataactgtcaaccctttggaatattatgatcccaagtagtctttttataatttggattgatgttagatttttgataaaatttggccaatttttacanaanaaattntntgatcatttagttctatntatttanaaanatgtaaaactggattttttttaagtaatatgtgaccaaagttaattttgtcccaaaggtntaaataaanagcagtttcccata

SEQ ID NO: 685848 - DNA, 107 bp, Homo sapiens
gccttattttcggcactcgttatcatcggcaccaagtataatattaagtatgcattgacctctagagcgaatggtgcgatgaatagggaggtgccgactaatagcga

SEQ ID NO: 685849 - DNA, 214 bp, Homo sapiens
tgttgcctgtgacacattgagccactgcactccagccgggcaacaagagtgaaacactgtctcaaaaaaaaaaaaaaaaaaaaaaaaaaaaaattttacccccaaagggggtctggggagggccttaagttcatgagggaagacccctcttaattgcatttggtgcctttttaaaaggggcccaaaagaagtccctttagtgccctttttgcct

SEQ ID NO: 685850 - DNA, 978 bp, Homo sapiens
  misc_feature (796)..(796): n is a, c, g, or t
gagcggttccaagaggccagggtcccgccgcatcggtccgaggctcccgcgggccccctgttgtcgctcccttccgggggcccccacgttgggggacccccctttcgccggaacgtgtgataccccccgcatttgccccccctcttttttggaaccaagagcctttctggggtttgcccccccggtgtcccgcgcccaatgggtccccccaaaggttaagagccggccaacacatcttggccccagaggtacagtggcgggcccccccgtgggccccccgcgcgcgccattcggaggagcccccgcccagatgggcccgcggcctccgcgcttacaagacgcggcgggtcacagacccggcgaaatctcaacaaaccgggggttctccggaggatttccggccaccacttcgcggcaccctggcgcgcgcgtggtgcccctggagagtctcaacaccacatttcccccccggacagaaactttcaccggtcaagagacccaaggaatggcctggtggagaaaatcaccccggcacaagcacacgaaggaggccggcaccggaacgaggcacatggcgaacaatcttccccggggcgttcaaccccgggaaaacacccgctgcgccccccggtgtggagcccccaccccagtttctctcctccctgtccccctgaggggcacccctggccctggagggcccccacatgccccaagctatgccacacgcacgtcccaacgaggagtctcccacttccacgtcaccctttgagagtttcgggcccacgacttgggggcnccagaaaactgtccaaattcgcatgtagactgtccgcccacaggttaagaccttatgcccgcgatgtcccaccccctgtctgtccgcccacactgggctgtgcctcccccgcccacacctgtgtgtttttttgaaacaattattttttgtttttttccaaaaaagttccaagccacccccca

SEQ ID NO: 685851 - DNA, 219 bp, Homo sapiens
tagctgagattacaggtgcctgccaccacacccagctaatttttgtatttttaatagaggtggggtttcactatgttggccaggctcatctcgaactcctgacctcaggtgatctgcctgcctctgccttccaaagtgctgggattacaggtgtgagccactgcgcctggctgagactcatatttctaacaagctctcaagtgtgctaacacaggtggt

SEQ ID NO: 685852 - DNA, 963 bp, Homo sapiens
  misc_feature (963)..(963): n is a, c, g, or t
gatgcccgtaggttggccgcgacgatcgtacgtggggggatacggattgtgtgtatggccaggaggctgatggttggggtacttgttgagaacttgtgagctgttcaggattgataatgtcgcaagaaggtagatcgagaatgctgagcgctggactatttctgccaggtcggaagtgtgctaggttggcaaacgaactgcggtgccttgaccgtaaacccggaaagttcaggatggggaacgctgctggcccaaggcctaacggtctgttccgaattgatacaggtctttctgggaggacctcgttgaaagaatatgacactcctgaaccattacctattgacgacccagggtattcgggaatcctggtttcggaggtgtaaaagcctccgggcatgtggcgaaaggaatccagtatgggaccagtaccggttagtgagtggtagtttcacaaaagaaccggaagcgtcattcggaaattagcctcacgtatggggggaattataccacccccggagactaaattagtttgtcttccagctttgtggcattttctctgggctcgtgaaacgttgagcatgaagattccaattgtagtctacatcccttcaaggttgggttggaaaaacgcctgcgggaaagaagtccttttgtgggccagggagtatgttgcaccttgggaacggcattacttgggacatcttgggaacttacttttgatattcagagacgttgaatttcgcccttatttggtgcacggttctttagaggaacactttgcgaggagaacctgatttcgaaatatatagaacccgggaaccccaaaaataggggaaacccacacaagtgtcgacgcaaccggagttatgaagcttagacaaaaggctctggggacgctacctcttataacagcctgccaaatcggccggtggaacatatcggccagcggaatatgtcacgtcn

SEQ ID NO: 685853 - DNA, 451 bp, Homo sapiens
tactaagtgaaataagtcaggcacagaaagacagataactgcataatttcacttgtatgtggaatctaaaaatgctgaaatcatagaagcagaggctgcagtggaaggaaatagggagatgttggtcaaagggtacaaagttctagctagacagaaggaataattgcatgggatgctgatcatagttaataatgtattatatggccaggcatggtgactcatgcctgtaatcccagcactgtgggaggccaaagcaggcagatcacttgaggtcaggagttcaagaccagcctggccaacatggtgaaaccctgtctctaccaaaaatacaaaaattagccaggcgtgctggcaggtgcctgtaatcccagctacttgggcggctgaggtgggagaatagcttgaacctgggaagtgtttgttgcagtgagcagagatctcaccactgcac

SEQ ID NO: 685854 - DNA, 457 bp, Homo sapiens
tgaacggtgtgtgctttacctggtccttatatagcacggtactgaaccccgtatactttctgcattatgaattaactagaaattactttgcaatggagagccaaagctaagaacgccctcgaaaccagacgagctacctatgaacagctaaagagcacacccgtctatgtcgcacaatagtgggaacatttctcggtagaggcgagcaaacctaccgagcctgcttattcctggttgctctctgtatgatcttagttcaactttaaatttgcccacagaaccctctaaatccccttgtaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacgta

SEQ ID NO: 685855 - DNA, 321 bp, Homo sapiens
cgggggatagtttgttgaaggctgattttgagtttagggaccaaaacagtaatcatgacatgtgcaaggggaagatgatcatgaaaggtagaagcacatgctaatagatataagctagaagagaataagtaaatgttctgttattagtgaactatatgaaattaagcaacctcaggtttctaattaaaatgttcagtgtgtccaatcgtgaatgtctgtgtggaatgtccgtgtttttaattcaaacactggcatgaccaattggaatggctgatggaactagtgaacatatagtcttcatccagctggaaacataggtat

SEQ ID NO: 685856 - DNA, 349 bp, Homo sapiens
tattcccaaggctcaaaccctattagttgatgactctagggagtatagatttgtatttatattatcagagcaaattgtgacgttttttgtaccatacttatatattgccagtaacttccctttgtcctacaacaatgtgagttgtttacgaaagcaactgaatttattcagacatcaatagaaagttcctgaaagcattatgttatctgatttacaatattaaggatcacctgaggtcaggaaatcaaatcatgaaaggtttattaacattaacctttaagaggatgaggttggcggggctctattaccttttggtctatggttaccgaattcaccaggagcaaggact

SEQ ID NO: 685857 - DNA, 414 bp, Homo sapiens
  misc_feature (267)..(267): n is a, c, g, or t
  misc_feature (304)..(304): n is a, c, g, or t
  misc_feature (351)..(351): n is a, c, g, or t
tgcaagatgtatggtggcagtgtgggctctcagccacccccatgtggctccagtagccatggtcctgttccctcttctcccagcaggagcctccaccaagcgggagtatgaccagtgtcgcatacaggtcaggctgccagatgggacctcactgacccatgacgttcctgggccctgggaacaggctggcagcgtgtagaggctctatttgtggagctccacccgtggggacggaactaaggtggcgggccatggacccttgtgcanattgcctcagtggcttccccatgacgggccttctcangaagctgacattggagcggcctctgcaggagcctgggactcgtgccnttcttgctgttctcatttgttggcaagaaatgtcccagctgaggggcctttgtcccattgtcc

SEQ ID NO: 685858 - DNA, 584 bp, Homo sapiens
cacaagaacattatacaagttttaaatttacatttttgcaataaaagttatcaatatatgcattatttgtataacttcatcatggatggaatttgaatcagcggtataaacatgttgcagtcactaaatatagatcatcatcacagtgaaccaaaatgcatagttgttatgaaatgacaaatgaccactaaaaggtgaactcacagcccatacaccaatataataaattaattatacagatatatttttcttcaccatatcataaaaattctcactagccccttaccaaacattagaaaaacacagttctggagccatcctggtgaaccagtgccttcacattctacacttaaaaaaataaagtgacttagttgcttggttggaaggaaacttcataagcataaattgtttgcaatgattaaaggtaaattaacctaggaccatttgaaccaaaagaagaaaaccctgggggcttgggggcagcacttgaaaaatacccttatttacagtgcaaaaaatttgaaatcaaattcaaatacgggggacccccatatttaaaagggggtctttggcaaaaaaaaggc

SEQ ID NO: 685859 - DNA, 863 bp, Homo sapiens
tttgccgccagaacagccaggtgtcgtgaaaactacccctagtgagctaccatgggaaaggactagattcatatcaacgattgtcgtcattggactgcgtagattcggggatgtccaccattactgggcatctgatctataagtgcggtgcgcatccgacagaagaaaaaactcacttgaagagaattttcgtggcataggagcgtccgtgtccctcgtaccgcatgggcacaaggcctcacttcatagatatgcgctggcgtgtcttggcatagagcgtgacaaggctgcacgccgtgagagcagtggtagtcaaccagtctgatatcgtcctatggtgggaaaaatttggagacccgagacaaagtatgtgatgattggacctaatacatatgaatgagcgcccagggaagcagcacgtgagaagcgttgcatgcgaagaatagccactgaatttaccagggtagccagtcctcagtgctgtactgtggtctgatccctgtagttggtatcggctgacttgggtggtaggatgaacattttggaaagactggatgaattctcactaaaggaacaattgggccgccaagaatccccggatgtaatggcaacttgccaccccattttccttggggtcattgtaaacaaacgaagcttggagggggttggtttgataacaaagccaacaagccattaacagatatggtccagatgtaggcttgacgagcgaagagactcttggggtagtttcccgcaaacgttgggactcccccaaaagcggcgtcaaccaatggccaccaagcacaaagacatggcatttacctcgacggggacaagacttcgaggtatagaagcggatgcga

SEQ ID NO: 685860 - DNA, 955 bp, Homo sapiens
agaaggggtgcgagcggggggggggaggtgcatggacgacgaggaggagacgtaccggtctggaaaatccgcaagaccatcatgcagtgtgccacgaccgtgctatctgtgacccaggagagttgacagaccctggaggagtccaaagcccaattggggccaagccgattgagggacggcgcgggcggcaaggaaccatcaccgtgctgttgcccacaagatgacccccaaccgaaccagaatgttgggtgtccttccagagcacgcccaagtgtggcaatacaaggaccatcaacgtgtgtacgtgccaagcccaatgcaaggcaaggaagaacatcacacggcttctcaatcggggtgccagacagggcttttcacccccctccggcacaagcaggctccccttggtgagaattggcccccgaaagttacattctggaagcaagtttcgtgccagcaaggaggcctggttaactcaaacatcagggacgcaggagctaggaccacctgagacagggtagtctatgaccaaggagacgggtgcacaagacgtgtggcccgaatattagctccgagaaacacaagtggcccagagattcaggcaggaggaccctgtggcgccgcacttgggaaaacacgcgttgcacgggggtacagctctcacgggccagtagcaggtggagagacatcacatacggcgtgtagcaatcaaccgctgaaggccctagaggcgccaacagcgaccccaatcctggagaacggcctggctcaaaattggcacaggtaggcgtggcactagtcagtgagtggccacccagttcccagctggagagcggggcagccacacacgtggagaaagcacaaacaggcagtgcactgcgaggtgggacaaacgccctggggagtgcccactcatagacatatccgggcgctttacgctttggtaaaatatccg

SEQ ID NO: 685861 - DNA, 404 bp, Homo sapiens
gccaactctcggagctcggagaacacgaagcaaatgatgagtagcttcatgctgtccatctctgccgtggtgatgtcctatttgcagaatcctcagcccatgacgcccccatggtgataccagcctagaagggtcacattttgggccctgtctatcccctagggctgggctttgggtggtaaacctgctgccttcaactgccatcctgggcttccctgaatgaggccgtctcggggcccccagctggataaagggaacctggccctttcctagggaacaccctagggttacccctcctgcctcccttcccctgcctggtggtgggggagaagctgtccatgtttttagggggattcatttgctttttcgttgaaacccggtgttaataaagtttttccctttga

SEQ ID NO: 685862 - DNA, 179 bp, Homo sapiens
caatatacgcctacatctcaattaaagctatagagagtgcaggcaagtttccatccagtctgggtcttagcgtgctcttcttgtcttcacccagtaaattcacggtagctttcttcgcttctttagtgatggcatctgcagtctctttggcctagtctttcaggtccttgaccacactg

SEQ ID NO: 685863 - DNA, 98 bp, Homo sapiens
tccgcgccttttccgccgggacctcgagcgaaagacgcccgcccgccgcccagcccttgcctcccagtgccagaaaataaagtccttttggattttga

SEQ ID NO: 685864 - DNA, 659 bp, Homo sapiens
  misc_feature (447)..(447): n is a, c, g, or t
accagctctaccatactggcatacggccttcgcgcttatgattctccatggccgagtacatgccagagcccatatgggaatcatgcattagagccgagtcacgatgggaaagatgaattactcctgcccagcattatatcgctcggactaacccgctatacggtatgcctacagactgagatacaaatcacttccaacggatggccaaagctcaaaccctcgagaccagactatctacctaagaccacttatatgagcacacgcgtctatgtgacacagtcgagataagatttatgagttgatgcgacatacgtaccgagcatggcgattactggttgatcatgatcgagtcttagttcaactgataattgaccacagaaccctatatatccccatgcatgtgaaactgatagttcgaagaggatcagctctctggacactaggaanatacctagtacagagagtaatgctgctaacaggcatgagatgcctaactgtcctgaatcataaggcgatcattctcgacacccactgcctcatgtatcccatacatataactgaactgctgagacccaattggaccaatctatcaccctataggagaactaatggcagtatatgtcacatgcattcatcgctcggattaacctgcgtctttt

SEQ ID NO: 685865 - DNA, 614 bp, Homo sapiens
gagtaattgcccctcagaggagaaattgatatataattttttttaccttctttcacttttctttgtcttccatgataatacctatcacgttatttcattcttcattacagtagctaactctgagtcctaactaacacagtgatttttgaggctgactttctctttaataaaatggaaaatgatcctttaacaacaatttataaaagtgttaaatgatcttggagggtccttcttgttttaccaaaagaaattttttcccataaaaagtaaaaagtctcaatcctgaatggcaccctgttataatctagaaactgccatgctgggttaatttactatcgcacagcccagaaatgatctcattgacagagaccaaggcaccattttgttccttggtcatcctctatatgatttccccaacatattagccatactttccaagatctctagcttaatttactaactcattatggacttagagaaatgtgaaatgtgtattcaattgtttctctgaacatttaagaaatgcaccaacaacatttcttacaaatttttttttgttctatcaacaatattactttgttgtaataaattaatgagtttggtgcttctctttc

SEQ ID NO: 685866 - DNA, 351 bp, Homo sapiens
tggaaattcacctgaaggttgtttaaccagcccagcaaaaactgctaaatgcaattgaccccccccattaaaatgtgattttggtccctttaattcctctgggggcttggtttggttacggttgggcaaaatcctccaatggggcatattgggcaggcagttgaaaccatcgtggtctggcgggcagggaacaacatctcgaagtgggtgttctcttccccccaaaaattgcacttagatattaaacattggggcgtgctatataaagaaaagcagtttaacaacaacaacatgagggatggctccagataaaaaaatttccccaaagagcaaacaccaccacaaacagag

SEQ ID NO: 685867 - DNA, 1976 bp, Homo sapiens
ggaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaataa

SEQ ID NO: 685868 - DNA, 870 bp, Homo sapiens
ggaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaagggaggtgaacatctgtgatttattcacctgacagttttgcaaccgatgaggatatgggactgatc

SEQ ID NO: 685869 - DNA, 535 bp, Homo sapiens
tcgcggaaagcgcgccttgtgtgtggaacggggaattcgcccattaggcccgggaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaataa

SEQ ID NO: 685870 - DNA, 587 bp, Homo sapiens
tcctcgggaaaagcgcaccctgtgtgtggggtacccgagaatttcgcccattattggccggttgggtgtagtatgaataaaattgaaagggttcaggggcctcattaagaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaataa

SEQ ID NO: 685871 - DNA, 395 bp, Homo sapiens
  misc_feature (328)..(328): n is a, c, g, or t
tgttaacacatgtgcatgacccaaatccttcatctaatgcctgctatattctttgtgtttagggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaaggtagatatccttgtgctttccattcgattttcagctattttctgggttagtgaatagcattcatacgcttttgggcaccttnccctgcaacttgccagataagcactattcagctcttattcccagtctgacatcagcaagtgtgattt

SEQ ID NO: 685872 - DNA, 150 bp, Homo sapiens
gcggatcctctcgatccgctgatcagcacacacagattcagtgtccgtctgggttgagggctggtgcccaggcctgctgaccaatgtccgcctccttacccgccttctgtcttccagtgtcgattcctcgtgcacccatcagtctcacct

SEQ ID NO: 685873 - DNA, 247 bp, Homo sapiens
tgatatcctctacagagctagaagtggtagctgcttttaacatagaatgtaagtaaaaaatctctccatgtaattattgtaacccaggtatgaagaaaggctcacaaggatttaaaaaccacctctgtagccaggcacagtggcttacaacctctaatcccacgactttgggaacccaaggcaggtgggttgcttgagcatgagaattcaagaccagcctgggaaacatggtgaaacaccatctcta

SEQ ID NO: 685874 - DNA, 2033 bp, Homo sapiens
ggaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaataaaaaaaagaagaaaagaaattgtggggcgcgggcccggaaagtttaaacaaggggggc

SEQ ID NO: 685875 - DNA, 557 bp, Homo sapiens
atgagtaggtatctcatgtggtttgattgcatttctctgatgattagtgatgttcggcattttttcatgttcgttggctgcttcttcgtgtccttgcctactttttaatggggctatttgcttttttcttgtagatttgtttaagttcttttctggatattagtcctttgtcagatgcataatttgcaaatgttttctcccattctgtagtttgtccatctgcttcgttgatagcttattttgctgtgctgaagctctttaattaggtcccaactgtcagtttttctttttgttgcatttgattttggggacttaatcataaattatttgcctaggcaatgtccagaagagtattttctagcttttcttctaggatttatatagtttcaggccttacatttaagcctttaatccatcttgagtttgtttttgtatatggtgagaggtagacgtctggtttcctatttggatgccttttatttctttctcttgcctgattgctcaggctaggacttgccgcatactgattgcggtggcttcgataaaggggatctcta

SEQ ID NO: 685876 - DNA, 2359 bp, Homo sapiens
ggaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaataagttaatgttttcttgttttgtaatccacacattcaatgagttaggctttgcacttgtaaggaaggagaagcgttcacaacctcaaatagctaataaaccggtcttgaatatttgaagatttaaaatctgactctaggacgggcacggtggctcacgactataatcccaacactttgggaggccgaggcgggcggtcacaaggtcaggagttcaagaccagcctgaccaatatggtgaaaccccatctctactaaaaatacaaaaattagccaggcgtggtggcaggtgcctgtagtcccagctacctgtgaggtggagattgcattgagccaagatctcaacactgcactccagcctgggcaacagcgtgagactccaccttc

SEQ ID NO: 685877 - DNA, 2279 bp, Homo sapiens
  misc_feature (1984)..(1984): n is a, c, g, or t
  misc_feature (1990)..(1990): n is a, c, g, or t
  misc_feature (2002)..(2004): n is a, c, g, or t
  misc_feature (2047)..(2049): n is a, c, g, or t
ggaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaataaaaaaaaanaaaaanaaaaaaaaaaannnaaaaaaaaaaaaaaaaaaaaaaaaaaaaaaaaaaaaaaaaaannnaaaaaaaaaaaaaaaaataaaaaaaaaaaacaataaaaaaaaaaaacccaatgtggggcccctttggcccaagcaatttttaactttgggaagttttttccgggggcccaaatttgggctcatttggccaaattccctttatggggggcggttaaaaaatacatggcccggttttaaaaaagtgggagtggggaaaaccctggggttccccaatttaaatcctttggaag

SEQ ID NO: 685878 - DNA, 2189 bp, Homo sapiens
  misc_feature (1977)..(1979): n is a, c, g, or t
  misc_feature (2022)..(2024): n is a, c, g, or t
ggaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaataannnaaaaaaaaaaaaaaaaaaaaaaaaaaaaaaaaaaaaaaaaaannnaaaaaaaaaaaaaaaaataaaaaaaaaaaactggtggcccgcttggcccaagcggattttaaccttagcaaggtttagccttgcgcccgaatttgggcctcattgggccatttggccctatagggggccgaataacatttaatgggcccgggtttaaaaaggtcg

SEQ ID NO: 685879 - DNA, 1581 bp, Homo sapiens
gcgaggagatgtgagctcaaaggccataatactctgccttcaccctggcagagaccgtcccatggagtgagtcactgctgctctttgaggcaatgcgcacagggcaacgcttttcagagcggcgacggccaccactacgtgcatgcaatcctggctgatgcgaggatgcgcaagcactggcaccctgtacgcctatcgcagtcaacgtatacacccacaccaccgccacacgggtgcacaaactggtgcatctactccccaccctacgaacataccacaccacctgccctcctgctcgacatccactccaccccacactccacctccaccttcacctcctgcaacccacagctgcacacttccccacggcccccccgaacagctacctctccctaacccttcttgtccctctctgccacacttgcccaccctgcgcagccgccctcctactctggcccaccctgctctgcccacgctcgcgggacacgctacacgcgcccccgccccctcccactcgctgcccaccgcccacctgccctcgctcgactccctcctctacacccacgcgcacccactccgctctcccgaccccttctgccttacgcccacaccccttgctcctgccccctgctggccctcgcccaccactctcccccccctgccccccccacccgcgccctccctcccacccacccctcccaccgggcccccccctgcctgctcccctctcccgtcgcccgccctccaccctagcccccttcctcctccctaccccccccccgccccccttctccctgcctgcccccgcgcgccccatcccacccccccttgcccccctgcccgcgcccccccagcccccccccacacgcccccgcccccccccccctccctcctccctacccacccgtcccccggctgcgcctcccccctcccccgcctcgcccctcccccccgccgcgcccccccgcccccccggccccccacgccccccccgagccactgtctccctgtcccgccgccccccccccacgcgccatccaccccccccccctccccccgcctccctccctcccgcctcgccctcggcccacgacgctaccctcttcggcgcgagccatccccatccgtcccctcacgccacgcacccctccccgacggtcgaccgtcagcccgccgccacactcgcctctacccccgctcccgccccccccttgcctgccacccaccccttcgccccccctccctcgcccccccctcccaccgccctcaacagcccccgcaccctccctcaccaccccacacacccccccccccacctctccccccaccactccaccgcctcccacccctcctacccccctccccctccaccatcactcacctcccctacactcgactcccaccacccaccaacgctaccacatcaccacctcccacaacctccttcgccacccactcaccacccttaaccaccacactcctctcctcccctccaccctacacccaccttcacctccaccacacgaccacacacccctcacctaacacccctcaccctcctcactccccccaacctccccc

SEQ ID NO: 685880 - DNA, 84 bp, Homo sapiens
aagacagcagcatatatctctgcagcgttgcagcgggagtcatcaatgagcagttcttcgggccagggacacggctcaccgtgc

SEQ ID NO: 685881 - DNA, 1982 bp, Homo sapiens
  misc_feature (1941)..(1941): n is a, c, g, or t
ggaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttattgcaacagagtctggtttaattaataaanctttttggaagtttttttgccggatccacattaattgtttt

SEQ ID NO: 685882 - DNA, 402 bp, Homo sapiens
gttattaatatggtagcgcttacaattagtagcatgcgtagattgcttgcagtagtgtccatcatacctagtatgagtataatggccgaagacgtgccctgtggtacccagtaggctagggcacagttagtctcagagtgcaagccatatcatctatgcgcccgctcactagcgtatgtccattactaggtgtatggctagatgggtagttgagtgttaagtagctcaggcagtagctcgaacagcatagtcgaggcactataaattactaagtatactaggatgagatatcaggttagtcccaatctgctgtggatggccatcattcatttccaaagtatgcttcaagagtcattgttagctgataaatagtcggttgacctcgtgccgaattcctgcagc

SEQ ID NO: 685883 - DNA, 985 bp, Homo sapiens
ctgtctgagccttactttcctcgtctgtaacatgaaaatgccaaatataccagcacctggattgccacgaggatgaggtgattacattgcgtatggtcctgaaacagtggtgtccctcatccccgatcaccactcgtttgacccaatgctcctggtcttcaaactcgaccttgtaaggcaggtatttggatgttctgctttgcagatgagagaaaccgaatagctactggtaataatagacaacgatccgggagaatgtgagagacctgcggtctgcaccatccgaggtgtgttcttgaggtcatagagctgagacatttgcctcactagcccatgtggtcccactctcgtgtcattctgatcttggcctggggtcagttgttctggcaatgcacctagctgttctggctgggctcagagctcgtttatgacccatgatggtggacttacaccccccaaactaattaactaactgacaagctgtgtcatgaagctgcactcctggtgacgtgtaggtggcatgataatcatcctgttttttcacttattcagcaccttctgaagggtctttttatgagaccgtttaatggattatccattgttctgggcagtttattcatggcaaatgaaagcctcaacggtgctcccatgccggtctgctggaacagtgttttataagtccattttttccccgaaagctcacagaagacagaacaaaagaaaccccccgctggttgtgggcgcctgcgcccctaaagaggctcaacaccccctctggtgtgccgggcccagtcgggatgtaacaggcacactcgctgttccaagggacctggcacggaaggcgtggcctccaaagcaacgccgggcccgcgcgcgtgaacccacgggctgaggtcttggctcctcgccgcatcaccccccgacagagagcagcaggagagagaagagagaaaaacacagagcaacaagaagcagagacactgcc

SEQ ID NO: 685884 - DNA, 564 bp, Homo sapiens
  misc_feature (1)..(1): n is a, c, g, or t
  misc_feature (72)..(72): n is a, c, g, or t
  misc_feature (116)..(116): n is a, c, g, or t
  misc_feature (120)..(120): n is a, c, g, or t
  misc_feature (128)..(128): n is a, c, g, or t
  misc_feature (135)..(135): n is a, c, g, or t
  misc_feature (147)..(147): n is a, c, g, or t
  misc_feature (152)..(152): n is a, c, g, or t
  misc_feature (154)..(154): n is a, c, g, or t
  misc_feature (158)..(158): n is a, c, g, or t
  misc_feature (162)..(162): n is a, c, g, or t
  misc_feature (165)..(165): n is a, c, g, or t
  misc_feature (173)..(173): n is a, c, g, or t
  misc_feature (175)..(176): n is a, c, g, or t
  misc_feature (186)..(186): n is a, c, g, or t
  misc_feature (195)..(195): n is a, c, g, or t
  misc_feature (198)..(200): n is a, c, g, or t
  misc_feature (205)..(205): n is a, c, g, or t
  misc_feature (208)..(208): n is a, c, g, or t
  misc_feature (218)..(218): n is a, c, g, or t
  misc_feature (225)..(225): n is a, c, g, or t
  misc_feature (234)..(234): n is a, c, g, or t
  misc_feature (236)..(236): n is a, c, g, or t
  misc_feature (238)..(238): n is a, c, g, or t
  misc_feature (256)..(256): n is a, c, g, or t
  misc_feature (269)..(269): n is a, c, g, or t
  misc_feature (274)..(274): n is a, c, g, or t
  misc_feature (301)..(301): n is a, c, g, or t
  misc_feature (315)..(315): n is a, c, g, or t
  misc_feature (333)..(333): n is a, c, g, or t
  misc_feature (338)..(338): n is a, c, g, or t
  misc_feature (366)..(366): n is a, c, g, or t
  misc_feature (377)..(377): n is a, c, g, or t
  misc_feature (379)..(379): n is a, c, g, or t
  misc_feature (406)..(406): n is a, c, g, or t
  misc_feature (414)..(414): n is a, c, g, or t
  misc_feature (449)..(449): n is a, c, g, or t
  misc_feature (475)..(476): n is a, c, g, or t
  misc_feature (508)..(508): n is a, c, g, or t
naacaagtatacaaaacagttgattactaatcgtgtattgaaagcagtaagaagttccacgacaccaaatanaccagttctgaagattccccaagaaaaatttaaaaactccagcntcantatttatnaaaatanaaaaaaaaaaantagangntgtntttntcnatggcaantnngccccttgcnggccgccgncgnnncagcnacntcacacaccncggtggngtgctcccntngngctgtgggtctaggtggnccgcctgcccggnttgcncgcgctcctgctggtgagggcccaganatcctgccaaagtntctgagcgagctcgagtnttggngacgacggacccactctggccacacggngaccgtgggananatggggccctgcgtcccataggttgcntgatggtnggtagggcggcctgcggcatagtggggtggttgtnggctcccagcttggtccctgggaacnntgggagcacagggacaagcacatggttatggnatgcagggtgacccaaggtcaagcgagttgtggggatctctactgtgaccatgcag

SEQ ID NO: 685885 - DNA, 859 bp, Homo sapiens
tctgagaggaagtaaggactggtgtgaggcacgaggtctgagaggaacccttctctgaggatggacacttctcacactacaaagtcctgtttgctgattcttcttgtggccctactgtgtgcagaaagagctcagggactggagtgttaccagtgctatggagtcccatttgagacttcttgcccatcaattacctgcccctaccctgatggagtctgtgttactcaggaggcagcagttattgtggattctcaaacaaggaaagtaaagaacaatctttgcttacccatctgccctcctaatattgaaagtatggagatcctgggtactaaggtcaacgtgaagacttcctgttgccaggaagacctctgcaatgtagcagttcccaatggaggcagcacctggaccatggcaggggtgcttctgttcagcctgagctcagtcctcctgcagaccttgctctgatggtcctcccaaatgacctccacccttgtccttttatcctcatgtgcaacaattcttcctggagccctctagtgatgaattatgagttatagaagctccaaggtgggagtagtgtgtgaaataccatgttttgcctttatagcccctgctgggtaggtaggtgctctaatcctctctagggctttcaagtctgtacttcctagaatgtcattttgttgtggattgctgctcatgaccctggaggcacacagccagcacagtgaagaggcagaattccaaggtattatgctatcaccatccacacataagtatctggggtcctgcaatgttcccacatgtatcctgaatgtccccctgttgagtccaataaaccctttgttctcccaaaaaaaaa

SEQ ID NO: 685886 - DNA, 882 bp, Homo sapiens
taacatggcacacttaagtgagatatgcacggttggtctgtgtctagcttatttcatttaacataatatcctccaggtccatccatgtggtggcaaatgacaggatctttctctatcttttcttttttgggttgagacagggtctccctctgtcacccggggcttaagtgaccctcccacctcatttccctgagtagctgggactgcaggtgcatgccactatgcctggttaattttggtatgtttggtatagatggggtttcgcgatgttgcccaggcgggtctccaactccggggcttaaaccatccttctgtttcgcttccaaaagtgcggggattacaggcatggactgccatgcctagcccaggtcttctttttatttttggaaagggagtatggctctggtggcccaggcggagtgcacggggggcgaacctcagctcagggaacctccacctcccaggtgtcaagtgattccccggctacagcctccagagtagctggggtcaccaggtgcatggcacccagggcggataaatgagcaatcctactcacagaggggttcaccatgtgggtccggctggtcttaaaatcctgaccctaaagtgatccaacccacttgcgccccccaaagactgggactaccgggtgtgaacccagggcctggcaagggttcctataaggccaaaaggtcagcgaggcgcgtgtgtgttgctttgacgattttcactaccctgtgagggacaaaaggccgatttggagggaaaccgcaatgaacgagtcatacggatagccagtatcaaagatggctatgttgaggagggtacaactcatgccaatttagagactaaagtgtacacataagtcttcactctctttcg

SEQ ID NO: 685887 - DNA, 935 bp, Homo sapiens
ggagccattgtggctcggcggttgcgcgggccctcggaccctcagtgtaggctgagggttcgagggcacgagtgcgaggccaacctgtccacatggataaaacaagtccgaacagacacaaaaatttgtgggcgcactctcaggccgaagaagaaggtgttttgttagccaccattttcgttgtggtggcgcgggcaggagtcgccaggggaaggtaacggtagacccttggaggtcgaaagccgttccccccaaggggcaagtcgtcgtctttagcatcgcgtgtgttcggttgtctttcccaataaagaatggccgcggggtcccaccccgttgttgttttgcgaccaaagacccaaagaaggagggtctgacaggggatcctgggagcgtttatgaaccacacgggtgtcccaaaagggaagcgcgccggcatttaatattcacggccccgcgcgcgggtgggtctaacggaaaacacccagaaattatcaaggtgacagcaacttatattaagacttgggtccccccggggctactggggtaaaggcaatatttcctattggcttgagagtaaaactcctagaaccagttcctgtttctgtacacaacgatgttcctttagagtcaaagtgagaacacaacaacctacaaattccatgcaggggaacatccgtggaagttctttgaaaaaaggaacgaaaccttgaaaaatgccttctgtgttgtgggaactacaatgattgatcttttaccccaggagactcgtggaatttgtgtcttgggcacggctcttgacagatggtgtgggatattcaagtttgccaggtatgcaggatttaatgctggatataaggaagtgagaagtcacaaaactttacagggccctcattggaagattttccgaaacagggcatcgaccggaaataccaggg

SEQ ID NO: 685888 - DNA, 665 bp, Homo sapiens
agtcttttagacagacagcctctctgttctggaaggacaacaattgctacatcaagacaggattgtcagcatattatagtacatcccatggattttatgaggagaagaacgtggaagaagataatcagcttcagcaaggtattcctagtgatgtgtattgcctagttgatccgttcagagatagggcataggaacagagtggtgactagttttggggcaaatttcttctaagcatgcttgaatagcaatagtcgctaaggattcacgtcacattttgatagtagccacttgttattgtccaatgcgtctaggtttgatttgtactcgactaatggcgagatcggtttttcttgtgtgctacagattaaacggtatatatacttttgaacacttctgggggaagaaaataacttataggggaaatcaatggcatggtggggggcatcacgcattggcgcgcccgtttccaacttttaggttcgcccctgattggcgacgaggccaaagacgtaacactaaactgatatccgtcacctttcccaagatggaattcctccggcattccctcagtaaaattaggcctttagctttgctatatcaattcgaacccgttacgtgggaaactcttgctcccaagaaggggcattcgggaacatcggacctgt

SEQ ID NO: 685889 - DNA, 340 bp, Homo sapiens
ccctttcccccaagtggttttccattcccagggtcagtgcaggatccaggcctgcatgtgtggcgggtggaaaaacttaaaccggggcctgtggggcaaaaaaaccagggggtttttttttcggggggctcctacctagtgctgcccaatggcccaaaaaaggtttcccctttgcccctgtggataggccagcagtcatcccgggatgagcagggggcctgttccgtgctggctgtgcccctcaacccgctgctgggagagcggcctgtgcagccccgcgaggggccccctgcagatgttcaataaaggagacaagggctttcccagctcttttcctgca

SEQ ID NO: 685890 - DNA, 335 bp, Homo sapiens
tgccgaggatccccatcgacctgaatatcattcatgctgttgtaatatcacttaggaggagcagagtgtgcaacagaacttagacgggatttggtagagccaagtatgctaagtgtacaatatatttaattaattttacaccttaaacaaagaaatgtggtcactaaaaataaaagtatatatctcggaattaatgtactcttgctttgtcaagctgtaagctatagtttccaaggtattcatgttactctaactctaaaaagtgatgtaatctggtcagcaaatgtagtaattcaaataaaggcatttacataataacatttcagggttgcatg

SEQ ID NO: 685891 - DNA, 301 bp, Homo sapiens
gctcacatcaaactagcgggactgcggttctccccaagagattctcacccgttgcagagcgtgaggttgtgtccaacataggtgtccatgctccagccctgtgcagggcatgcacatctttgagagaacgcgggtcctggccgctcttcttgtgggtggctcgcggggtcctctttgccgtcttcctcatccttctgcgcttgtaccgtatgaagaagaaggatgaaggcagctctgcactgggcaagaaacccatctacaagaaagcccccaccaatgagttctacggcttcgtcggtca

SEQ ID NO: 685892 - DNA, 109 bp, Homo sapiens
tccggccaaaaaattttttggggaagcctttaaaaatatttttgggggtcaaagcctgtttttttttgggctaaaaaattacccggattaaatggcttatatttttaga

SEQ ID NO: 685893 - DNA, 372 bp, Homo sapiens
gggcttttaattccttgatgctaaaagaaaaggcatgggttttatgagcttcccagtccccttcccctttaaccttttaccaatctttcagagggctgcctagtagccaaggttattcctgggcacaggaaaaacgggccctccaagggcccaaagctttaaaggtggccttttttttcccaccccctggctggaaaaggggccaaccccctcccgggtgagtgatacttttccgttttttttactccttccacaaaggaaatgtggggtggggcagaggtcttttttcctttaatactgggaaaatatttaagagcctccctgttcccttatggctggttttgctataaaaattgggaaataaaggcccct

SEQ ID NO: 685894 - DNA, 179 bp, Homo sapiens
gtgggcagccctgatggctgaaggggactgtctcctctccggagtccagcaccaaggggggttgggtcatatacgggattcttctgtatgggaagttcccagacacggcccactttggtgccctcacccagttacgcagtatgcctggtatccccctctttcctcctttctcttcaatg

SEQ ID NO: 685895 - DNA, 296 bp, Homo sapiens
  misc_feature (244)..(244): n is a, c, g, or t
ataattagcctcagatgtatatatcagtcaattcaccaatcgccttttgtcccacacattattcctcttccaccccattactgacccaaacatggatctcagccctttttcttcatttccagagtagcaacagcaatacaaaaaatctagtcaaagacacatgtataataaattcagctgtactcggagaggagagtgtggaatgggggcagaggaattaaaactcaaggtcaacaatttttanaaactcaggagactaatattcataatgcataaagaacttttacaagctgggt

SEQ ID NO: 685896 - DNA, 168 bp, Homo sapiens
tagggctgcacctacagcacatggaagttcccaggctatgggttgaatcagagctgtagctgctggcctatgccacagccacagcaacaagggatctgaaccgtgtctatgacctacaccccaactcatggcgatgccggatccttaacccactgagcgaggccaggt

SEQ ID NO: 685897 - DNA, 568 bp, Homo sapiens
tcgtgatagctgatctccagaggatcccccagagaaacagctgaccattcttgatgattacctaatcgacatgtaagttatctttctgccttaaatatgtataacaggacagagcccttaaatctgattcaattattaattcctgatttacaagtgctatggtgagctaacagaacttatcaatgcctttattgcactttactagccaaatttagaaggttggaattagtctctcctatctagtattctgtcagtttgcccagcttgtacttttaattttgcttctaatggtaatcagccctatcccttgaaataaaataatctacattttgggagggctaattcttcattgtgccaggctgtcccatgcactgcaggggtgagtgtctttaggcttaaatgccaacagaagcccctagtaaatatgacaaccaaaaaagtgcccctacacatttctcagcatcctctggaatgacaggttactgcctctagttgaaagccactggcacaactttggtttttaagctcttatgccatttattttaattgcccagacatcaattccacc

SEQ ID NO: 685898 - DNA, 912 bp, Homo sapiens
gcagcagctgtggcatgtgtgatgtgaccccatctgcctgtgggcagggtgagtcccttccctccccagtgcctcgcttccccagccttctgaaagaaggaggtttagtgtgttgatctgatggggctggcgtgggagaagcagacaccctcccagcagaggtggcatgtgatgggtgggcatgtgatgatgttatgcaaatgtgtgacaatcttctcgtgtggtgtgatgcctgagacttgctgcaatggcattgtgtgtggtggttattgtgtgccctgttccatgtgcagaaagatgcaatgatgtgggcatgtggatgtgtggatgctacatgtggtgttggccatgctgtagtgtgtccatgcaactgtggtgtgttggtaccccatgtgccgtggtgtcatagacatgggacagtcggcatgtggtgacacatgtggacattgatgtggtgtccccaatgacttgccaccgtcacaccaacactgcaaatatcaatattaagtaagcatgtggcagcatgtggtgcatgctcctgggacaactggctttctcatgtgcctattgcctgtgatgccttcggaagggtgcttgtgagatgctgcggaatgaacatgtgcagttgctctgtgtggagtttgcaagcagtgagctgtcaccatgtgatggtgctgaagcttgggccaactgtgtgatgttggggggtgcccccttgtgggaccacttttgctgccatggccctgggatgggcttggtatgggggctcgggccttgcttggggcgcccgtgtccccagggaagtgcactgtgtggccatggttctggtgctgtgatgtgccccgtgtggggcttgttgcgctgtatgcctcaccgtcatgcccttggggttgttggctacgtccagatccg

SEQ ID NO: 685899 - DNA, 365 bp, Homo sapiens
  misc_feature (56)..(56): n is a, c, g, or t
  misc_feature (142)..(142): n is a, c, g, or t
  misc_feature (165)..(165): n is a, c, g, or t
  misc_feature (200)..(200): n is a, c, g, or t
  misc_feature (248)..(248): n is a, c, g, or t
  misc_feature (296)..(296): n is a, c, g, or t
  misc_feature (323)..(323): n is a, c, g, or t
  misc_feature (347)..(347): n is a, c, g, or t
ggtcatgaagcatcctttcattcttcttcttcttttttttgggggggcggagcggnggagggatctcaaagttttagtcttccagaatccaaattaaaggttgcccctgatgggggccaggttccgccacagaacatcttanatgtcagccttgacctcacttancagggattacagaaatgagatacattttgaagganagttgctggtatgttcactgtattctaaagtgcctgggataaagctgnctcatggggtgcttccatatatattcatatataattgggtgaagtganttaaatgaattaagaagtggctggcanaagtaggcagaaaaaggaccttgnaaatggcatttgttcttg

SEQ ID NO: 685900 - DNA, 810 bp, Homo sapiens
  misc_feature (281)..(281): n is a, c, g, or t
gctttcttgcggaatcaccatggcggtgggaccctgtacacgtatcctgaaaactgagggccttcaaggctctcatcgctgctcagtacagcgggctcaggtccgcgtgctctccgcaccaccccacttccatttggccaaaccaaccgacccctgaatttctccgcaaatttcctgcggcaaggtcccagcatttgagggtgatgatggattctgtgtgttgagagcaagccatgtgcctacttatgtgagcaatgaggagctgcggggaagtactccangaggcaagcagcccaggtggtgcagtgggtgagctttgtgatcccgatatagtgccccagccagtacctggggtgttccccacctgtgggcattcaatgcaccagaaaaacaggccactgagactgcaacaggaggaagtgaggcgaattctggggctgctgaatgcttacttgaaagacgaggacttttctggtgggcgacacgagtgacatgggtgaccatcaccagttgtctgccaccctgttgtgggtctattgagcaggtctagagccttcattcgcaggctttccaatacaacggtggtcctactggataacagcccagtcgggggttgggcgatgactgggtggaaatggcagttgtgcaaacgtgggacaccacctaaggacaccggaaagagcttcgggcaaacaaaccgtgggaggggaaaggcgcggctgagaaggaaagggctgggggcaggagcactcgcaaaacggggaaagacagacactgcgtgcagagggggacccaccacactctaggagg

SEQ ID NO: 685901 - DNA, 1313 bp, Homo sapiens
  misc_feature (426)..(426): n is a, c, g, or t
  misc_feature (620)..(620): n is a, c, g, or t
ggtgcaccgtcgcgggcccccctggtcccggccagctggtgaccgtgcttggtggagtcattgccatcttaccctctcatctcgctgtgaccctgacaaaatgtattagtgctggatgccatacgctgggcgctgatgacgtcgcccccggaggaggaggatcgagggaagcgcccgagtgccaggagcggacggagccatttgacccgggactcccgtacgtcctgttagagcaggcgctgaccatccccagccgctctccgtgtgcactggtggatcgtggcttgatggatgccaagtaatggtgcaatctttgcattagtggcgagaacagttgccgaggagacgtgcctgtgctgtccctgtggaacaacacgctcgcgacgaagtcgatgacagggagctgctaacttgaggtccccttgnaaagataacgagccgtgtttaagctggcaagatgcgagttagcctcgcatggatcttgatcggggctagaatagcagggaagccaaactcgtgcgattagacgctttcgttgtggacatctaggctgctcttgctcgtatctgaaggggcacggcataaggtatgaagtctcgagggaaatagccccatcgagntgtgcttgcgcttgcgcatagtagccttgcgttgaagccgaacagaaccaatgaagactggtgcgcaagagaccaattaccatgggtatgggagtctccagactattcgactccttgcacgtacctatggaaaacccttctgctgaatattgctaactgagtgcatcctggggcagaatcgggctaccagatatgccccaattctagctgcgcttgtcattctggcagagttgtataccccttgcttgcctttgatgccaccacgggctgtgacgggagaaggcctttggaggcccctcgcgagtacttccaagcacatgtgttagcggccgatgaggttcccggggttgaatgggtgactcgcctggttacaccgagggcaaacagacccttcggacgcgcgtcaagacgccaaggccctggcccccgaacgacacatgttggggcgcgcacacgactcaacggaaaggacaagagttgtcaccggcccagagggacggggccaatctgaagcccacattgcgggcgacaagcggagatggggactctactctccgggagcaaacatgcggcaacaaaagagaccgcgcagaacgggcgccaccgggagaaccacaagatccacaagcagagaattgtggccaccagggcataagtccagcaacaacacgagtcgacgagacaaccgctgag

SEQ ID NO: 685902 - DNA, 389 bp, Homo sapiens
ggagccttgggtaaaacctaaacactagaatacagcgtaccaggctataagcacaacatgaactaaaatgctacgtggcctacaagtagatgaagtttgcatacgctatgagcatatgtactatttttcacaatgcaagttcagtcaacattcccaaataaattccctcattgggtgggaactacaaatacacatgccatgggaacctaaagggaggaaagtctatggaacaaagagatgggacgcctctggaaatatctgcactgttactttaaacatgaacgcacaggccggtgcagtggctcacgcctgtaattccagcagtctgggaggctgtggatcacttgagctcatgcgttcgagaccagcctgggcaacagagtgagagt

SEQ ID NO: 685903 - DNA, 104 bp, Homo sapiens
caatcttattaatctctatgaacctctcacggtaggcatgagacagtcaggatcctacagccccctaacaactctcattttctctcagtggcacgtggtgcacg

SEQ ID NO: 685904 - DNA, 548 bp, Homo sapiens
ttcgaggagcatcaaaaatcagtcagcaacattgaaataatgcatatttgtcacttcattagcaaatgtacaagtccttgcgagtacaagatcttgtgctaggtgttgagggttccgtattgataaaacacttgttaattttaactgaaatacaattttaggcaagcaccccaaattatgccataatgaaatcaatggataggaaggcggtgggagggctttaggaacacagttcagaaggagctattaatttttccgggtagaaccaggagtgttttaagacagagctgaaatttgcacaaggtctttggtaaaattttgccaggtaaggtgcagaagtgtaattcaggcacagaagataacaagagaaaaacttggaagcaaaaaaaacccaacaaaaatccccccaacaaaatacagttgttcgtgtgattcaatataatttcttaaaaatagtttagtgtgacacaatatacagtgctggagtagaaaaaagaaggatagttgagaccagattttaagggcattgtatgacttgatgaatgcgt

SEQ ID NO: 685905 - DNA, 294 bp, Homo sapiens
gggtagtaatactacccctagacatttctcagaacgaggtattctttttttttcttataagagatggggtctcgaccaaggcttggtggctcatggccaggtgtggtggctggcgccttgtaatcccagctacttgggaggctgagacaggagaatggcttggacctgggaggcggaggttgcagtgagttgagatcactgccatttcactccagcctgggccataagagcaaaactctgtttcaaaaaaaaaaaagggggggatttagaactttgggtgcggaatacggccac

SEQ ID NO: 685906 - DNA, 434 bp, Homo sapiens
atccgatttggtgtgtgattcagaagaaagagcaaagaggggaggggacactagcctggcagccaggggacacagggcagccaagctgcttcaggctccaccttgtcccagcccctgccagccacacgagggctgaagctctgctcctgggggaggttcagccaatgctgggtccagcagctgctgcagcttccaggagctttaacccttcctggggcacccaggctgcctgggacacagccatgagataggcaaggggacagggaggtgacaggagggccagtgtatttgaaagtgcatgcaagtgggtgtgccagtgtgtgtgtatgtgtgtgtgtgtgtgagagagagagagagagagagagagagagagagaaagagagagagatgggtaggaagacagtctgtctctttgaagccctcaggaaaggaca

SEQ ID NO: 685907 - DNA, 854 bp, Homo sapiens
agcggggaggatgcgtcatagagggcgggggcgacgaggggtggcggcgtcggagtgcgcctccgcggggacggtgtgcggtcccggctggtgaggccgcgtcctgtccggggatcgtcgagggactgggggagctgtgggcacatggggctggggtggtgtggagactgccagtggctggagtcaacggtctaggggcaaggtcttggtggctatgggagaggctatgttcgtgcacgagaagtctgaggtggtggagttatgccatgctttatggcttgtatgagtgataggcacaattggatagagaatgaagcagtcatattgttggtacgttccacgagagctgaaggtagtctgggggaagttctcgatcgtaccataactggtggaagagttgcatgggaagacgtgttggatgggccattggtaggcatgagacgcgagcgaagttggatctcgatggtaggcggtattacacaatggatgccacacaattggaaccttttcagttccaggtatataccagaatgtggggtagaatgtgttgtgaagcaactctaggaacgacaccgtgaggtacaagagttattaattacctggggcacagttggtggcgtgggggatcgagggcgaaagtagtggatttcccaagaggtcgttgaagtgggcggttgtctttcagagacaggagttcgcggtggaaattggttggcagtagcttgtgtcgggtcgtattccaaaggattccgaacgttgtcctggaatacgcgctggccgaagggaagttgggggtatcttgcatttacttgctccgcggaatgacaaagtggtagtgttggaacaggagaagc

SEQ ID NO: 685908 - DNA, 708 bp, Homo sapiens
cgcaatcccggcttatgtccagctgctggtggattattccaagatggaaaaaatttctttccgaaatcctgtacgacagggccaggggccactggtcctcagaccgccccgctgcactttagaatccctgggggaaggctggatccggtggtttcatgccttttgggagggctaaggcaggaggattgctgaagcccaggaattaaagcccagcctgggcaacatagtaagaccttgtctctacaaaattaaaaattaagtttgagcgtggtggctcatgcctgtaatcccaacactttgggaggccaaggcggatagatcacctgcagtcgggagtttgagatcagcctgagcaacatggagaaatcccgtctctactaaaaacacaaaattagccgggcatggtggtgcatgcctgtaatcccagctactcgggaggctgaggcaggagaatcgcttgaacccgggaggcggaggttgtggtgagctaagatcacgccatcgcactccagcctgggcaacaagagcgaaactctgtctcaaaataaataaataaataaataaaattagttgggtgtggtggtgtgtgcctgtggtcccagctgctctggaggctgaggcaggggcatggcttgagcccaggagttcaaggctgcactgagccgtgatcgcaccactgcactctagtctgagcaacagagtgaggcc

SEQ ID NO: 685909 - DNA, 1069 bp, Homo sapiens
  misc_feature (264)..(264): n is a, c, g, or t
  misc_feature (301)..(302): n is a, c, g, or t
  misc_feature (974)..(974): n is a, c, g, or t
  misc_feature (1058)..(1058): n is a, c, g, or t
ctccgctctggggaggcagcgctggcggcggggctggggccactgaggaaatccatccgcgccgccgccgccgccgccgccgccgccgccgcctccgccgcggaggaagacagcgccgcccgcgcaccgccagcgacccccgccgcagagtcccaccgccacaggcctcgggccagcggccaggagctgcctcccccgagccccggtccgcggcccccagccgcccccaaccctgccccacgggcccggcgccatgagtgagcnggagcaactgagaaaggaggccgagcagctctggaannattattcgggatgcccgaaaagcatgtggggactcaacactgacccagatcacagctgggctggacccagtggggagaatccagatgaggacccggaggaccctccgtgggcacctggcaaagatctatgccatgcactgggggaccgactcaaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgaggacaacgtcagggtcagccgggagctgcctggccacactgggtacctgtcgtgttgccgcttcctggatgacaaccaaatcatcaccagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctttcttccccaacggctacgcnttcaccaccggctctgacgacgccacgtggcgcctcttcgacctgcgggccgatcaggagctcctcatgtactcccatgacaanatcatctgtgg

SEQ ID NO: 685910 - DNA, 762 bp, Homo sapiens
tccaagcagatacctgatctaagctgaacatctgagaacctaattaatctctgacaaactggtacagtcttttcaaatgtgaccattattgagcaaatgattagttaggaggtctaacctaatggaaataatgtgtcttctgtttctgttacttttaaacttttaatgtgtcttgtttctgatacttttaaacttttattatgtattaagtttctttagtgttttgtgtttgaaacctgttatttttggaacttagtattatgtttgaaaatcacttataaaaacagtggagttcattaaaaggaataataatatcacaatcaatttacacttaaaatgcttgactgagcttccagctttttgtttattctaggaactatcgtgagcataggtgaccctaagaaaaaatatacaagatatgaaaaaattggacaagggtaagtatttgtgactgtattacgataatattcagtattcagtatttcctggctttatagcatgatgtttattttgcctgccgacatcaagtacttatatagtattctgtgagtggtaccctgggggattgtgtaaataaatatgcagtttttgtagatgctgttaaaaaactgtactagtgtagcatgacgtgttatattttttcttaagtgtcatttcccatctgtgataattagagggaagaattgcccataaaatatatttaaaagacaataagaatatttactgcatgactataagcaataaaaaatgcatttaaatcaa

SEQ ID NO: 685911 - DNA, 1078 bp, Homo sapiens
  misc_feature (264)..(264): n is a, c, g, or t
  misc_feature (301)..(302): n is a, c, g, or t
  misc_feature (457)..(457): n is a, c, g, or t
  misc_feature (460)..(462): n is a, c, g, or t
  misc_feature (487)..(487): n is a, c, g, or t
  misc_feature (543)..(543): n is a, c, g, or t
  misc_feature (554)..(554): n is a, c, g, or t
  misc_feature (561)..(561): n is a, c, g, or t
  misc_feature (581)..(582): n is a, c, g, or t
  misc_feature (587)..(587): n is a, c, g, or t
  misc_feature (591)..(591): n is a, c, g, or t
  misc_feature (595)..(596): n is a, c, g, or t
  misc_feature (600)..(600): n is a, c, g, or t
  misc_feature (609)..(609): n is a, c, g, or t
  misc_feature (614)..(614): n is a, c, g, or t
  misc_feature (621)..(621): n is a, c, g, or t
  misc_feature (623)..(624): n is a, c, g, or t
  misc_feature (629)..(629): n is a, c, g, or t
  misc_feature (633)..(633): n is a, c, g, or t
  misc_feature (637)..(637): n is a, c, g, or t
  misc_feature (640)..(640): n is a, c, g, or t
  misc_feature (646)..(648): n is a, c, g, or t
  misc_feature (983)..(983): n is a, c, g, or t
  misc_feature (1067)..(1067): n is a, c, g, or t
ctccgctctggggaggcagcgctggcggcggggctggggccactgaggaaatccatccgcgccgccgccgccgccgccgccgccgccgccgcctccgccgcggaggaagacagcgccgcccgcgcaccgccagcgacccccgccgcagagtcccaccgccacaggcctcgggccagcggccaggagctgcctcccccgagccccggtccgcggcccccagccgcccccaaccctgccccacgggcccggcgccatgagtgagcnggagcaactgagaaaggaggccgagcagctctggaannattattcgggatgcccgaaaagcatgtggggactcaacactgacccagatcacagctgggctggacccagtggggagaatccagatgaggacccggaggaccctccgtgggcacctggcaaagatctatgccatgcactgggggaaagaataaangannntgaataagagcctcaaaaaaaaaanaaaaaaataaaaaaaaagaaaaaaaaaaaaaaaaaaaaggtcaaaaaaaaaaaganaaaatcataangggaaanaaaaaaaaaaaaaaacgaannaaagnaaanttgnngcanaataggggnattanaaaaaanannaaaanaaanaaanaanaaaaannngagaggacaacgtcagggtcagccgggagctgcctggccacactgggtacctgtcgtgttgccgcttcctggatgacaaccaaatcatcaccagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctttcttccccaacggctacgcnttcaccaccggctctgacgacgccacgtggcgcctcttcgacctgcgggccgatcaggagctcctcatgtactcccatgacaanatcatctgtgg

SEQ ID NO: 685912 - DNA, 355 bp, Homo sapiens
ctccgctctggggaggcagcgctggcggcggggctggggccactgaggaaatccatccgcgccgccgccgccgccgccgccgccgccgccgcctccgccgcggaggaagacagcgccgcccgcgcaccgccagcgacccccgccgcagagtcccaccgccacaggcctcgggccagcggccaggagctgcctcccccagtgctgggatgaggaggaaataatgagatggaagagattgaagagaaggtgttagaagagaagagaagaagtgtagtgagtaggttgtgtgataagatctgaggtagttaagggattttgtatgattaaaagtattatggatagaagagaatagtga

SEQ ID NO: 685913 - DNA, 181 bp, Homo sapiens
  misc_feature (179)..(179): n is a, c, g, or t
  misc_feature (181)..(181): n is a, c, g, or t
atgcgttttgcctcgtctctagaagtttccccccgcatctggggctggtagcagtgagccctcactctactcagatgtcacaaggtatgtgacacagtgaccctatgaggtgtgaaatagcagaacccagtgagtgcgaagccgcagatgacccagatctccttggaatgtcaccttantn

SEQ ID NO: 685914 - DNA, 93 bp, Homo sapiens
cccagcacggagagcggcccgcggcaggcgagcgtaaatgtgtgctaagtgcacgagtgcgtcccgactggtagtggtgcattcatgcacccg

SEQ ID NO: 685915 - DNA, 344 bp, Homo sapiens
ccaatctggcccgccgctcgcccagaacttacctcccctaaaagcaccctcagactgatctggctattatctgagggcaagggcatggtgccacacccgctcaagtgtaaggaactgcgtgcctgctcctcaggcccccatggggggcagggatcggcttggaaatcaagcgtggttgtccccgtccaggccggtggaaggtatggagcagaccccagggaggggggcactaggtgtcattgtgcccgatgtctggctcccctgcaggagggaggctccagggtaagacagggctggcaggagcagactgcctcagcccatgtgcccatgccggcagggcgtgg

SEQ ID NO: 685916 - DNA, 315 bp, Homo sapiens
cgttagtagttgtgggtaggagtatgagaccagctatggcagatagtgagacctgtctctaccaaaaaaaaaagaaaaagctgcgtagaggtggtacatgcctgtagtcccagctactcaggaggctaaggtgggaggatcctttgagcccagaagctatgattggcccaatgcactccagcctgggagactgtctctaaaaaaacacacacaaaattgcgcggcacagtgcctcatgcttgtaaccccgaaatttggggcaggccgaggcaggcggaatcccaaggtcggaaaatcgagaccatcctggttaac

SEQ ID NO: 685917 - DNA, 185 bp, Homo sapiens
tgctctggtaccaggctgagtgaagtggcgcaatctcggctcactgctgcctcgactccagctcagatatcttcccacctcagcccccaaggagctgggactataggcatgtgccaccatgcccagctatttttttgtatttttttgcagagatggggcttcactaatgttgcccgccaatcgaa

SEQ ID NO: 685918 - DNA, 358 bp, Homo sapiens
gagagcgcaatgacgctcgtgggcgcgagagctgtgtcatgatgctgtacacacggctgtggaacgacgcaccgtgtgacaccgagaaggaccgctggatctgtgagggcacaactggtgaccccgcccagtgcgcctggagccgcgcccattggagcatgtcggattctgggggctggtcacacttcctggcttctggagctgattggcaaagaggtttttctttctcatacaccgctggtgagtctcagaaacactctggccaacataggcctgtgcagaccagagcctgggctctgggaccttcatggcgacctcatactaacttcacttacgcagacccactcttcactggttc

SEQ ID NO: 685919 - DNA, 110 bp, Homo sapiens
ttgagggcccacctgctcttcttcatcgctggccaggcgtaccggtgcaggcttgtggtgaggcgcgagaccaggtgcagtggagcgcttttagagcagggtctccagta

SEQ ID NO: 685920 - DNA, 198 bp, Homo sapiens
  misc_feature (19)..(19): n is a, c, g, or t
  misc_feature (51)..(51): n is a, c, g, or t
  misc_feature (89)..(89): n is a, c, g, or t
tgtgttggctcgacctcanccccaaatcttacatctcaattcccatcctangaaagcactcatactttatgcatccccgcagctacacngacacaacacacagcacacgcatgaacacagcacacacacgagcacagcacacacacgagcatacagcacacacacaaacgcacagcacacacagcacacagatcagca

SEQ ID NO: 685921 - DNA, 1195 bp, Homo sapiens
agcgggtgcagcgcgctggccggcgtggggacccgcgcaacgggtggcgcccgctgactcggccctgcctcctgtgctgggcgatgcctgcgtcccggaccatgatggcgcagctcagtgtcgccctcccgggtcgatcatgcttgcaaccacgttgctgggggcctcgtgcggacgatcggccgggccgctggttcgatgccgaagggacccatatcgacggacggtgactcagtcacgcagtgctggtcgaccagctcgaccgttctgctgtgtactctgttctggactcagtcgccaatccatggacggcagcctgaagcacgcgctggatgcgagggccgccacgattgatacgaactggagaaccactcgtgcgtacgttggcagcgttcctgatgcccgaagattgagactcggggtgcgacccacgccgaggccacgagttgacccccaagctttcgtgcgggaacagtaggagctggttgtggcttctcaggcgtagttacgcttgtaaaaaattgccctctgtcgggtgcggtgaaatcccttaccgcgacaaggaagccaatcctacttggtccttggaatcaactcatggtgtgttcccccttccatgtgcctatgggactagcacccgatgatggactccacggtggaggcgcagaataagaggggcgcatgactccttggggatgactccgaggggaaacaggtcctttcacacagggaacttgtccctgcagggccaagaaatcgaagggggcacgccttggggggcaaggctcacgtggggaccaacaagtcgaagaggagacacggagggggcggacttgtctctcttgaacatcgcaaaggatgcccccgggttcgacaatgtctttaccttcgcagcactgtttttgtggcctcgctttcgctttatatgtaccccacatttgggcacggaaattgggcctttggacgaattgcgccggtgggaaaggccatagggagaataattggggggagcaaggaggagggtttcttttaaaccccacacattgaataaaccacgtgaacccgagggcgcgcccttaaggtaattggccccaattcggaatcatatcacacgtgcggcaattcactttgggcgtgaactgggacgcaacccggtggttcctcgtcaacttgggggaatgaacaaggtgttgga

SEQ ID NO: 685922 - DNA, 386 bp, Homo sapiens
ggcagaccctgattgggacccagtccacagatattcctgcgccaactgagctgaagttcactcaggtcacacccacaaggctgagcgcccagtggacacacacccaatggtcagatcactggatatcgagtgcgcgggacccccaaggagaagaccgcgccaatggaagagaatcaaccttggttctgacaggtcatacgcgggtgtatcaagacttatggtggccacctatgaagtgagtgtctatgctcttaaggacactttgacaaggagaccagcttaaggtggtgtgaccactctggagaatgtgaggccaccaagaagggctcgtgtgacagatgcttctgtgaccaccattaccatttggtggaggaccgactgggacg

SEQ ID NO: 685923 - DNA, 290 bp, Homo sapiens
aggaccttgggagccttaacccttaaatagtaacgcatttggtcacccccagcccaaaggggtaaaaggggcatacaacatcacaaaacacagaacggggagagaagtcccggcccgggggaagcaccgggagttttaagagtctcagtacatatctagcagaaggaagaggaaacaaggtcaactataatgcaaaccgaagaggactaatgaagctgatagcataacaaaatcggggacaaccagactaggaagaaaaggaatgactcttacaagttcatagtatacag

SEQ ID NO: 685924 - DNA, 253 bp, Homo sapiens
cgtccccggttggctactacgtcacggttggctactcgtccacggtgggctcctcgtcgcgggttggctcctcgtccccggtcggctcctcgtccacggttggctcctcgtccacggttggctcctcgtccacggttggctcctcgtccacggttggctcctcgtcccacggttggctcatcatccacggtcggttccaattccattcccagcgtcacatagtcagccacacgtggcatagtgggtcaccgca

SEQ ID NO: 685925 - DNA, 120 bp, Homo sapiens
tacgagacacacacatcgagcggacactagattgtcagcacactacatcatatgtgtgacaccgtctgtctgtgtgtctacacttttactgacgtactgttactgtgtgagcgatgatac

SEQ ID NO: 685926 - DNA, 198 bp, Homo sapiens
  misc_feature (38)..(38): n is a, c, g, or t
gatgatcactgctcgattagtatacaaaataaattatnttcactttcctttcagtcatatcattatgatatggtagtgatatggtgtggtagagattcacaagaagatgggtcgaaaacatataattgaatgactcatatcatgtcacgaaaaatgataccaatggcttaagttcagatttcaatattcctttatctt

SEQ ID NO: 685927 - DNA, 1315 bp, Homo sapiens
gagagcgaagaaggaccgtgcctgtcccttcctatagctgcagcccagagcgctggctttaggccggccaggaagggtgtgttgagtgtgtgtccacagccacaagaaaagaagataaagatccgtcacagtcacccttacctgtgccgggcggccggacaagtagacgtagctccacgtgcccgagagaccagacattatcattatcgcgtcggaacagcaatgcctgctccgccaagagaacgaaagcctaagcatctgatcatcgttatagctatatcaatctaacgttgtctcggactgcatcgagttgtagtctatggcaattgaaagaaagactagacagaacaacccaaacatctaagcttatgctgttccagcttgggtggggcattgttcaccagcgccagcaagaccgacacctctagatctctaagcgcgtgcgcgtgatagcacacatgcgtcgtgaacgatgacgagtagtagttgctcggcgcaatcggagctccaccatcgcactatgagcttcgtgcacttgtgagtgcgacgcaccgacacggacatgtgctgtatctggatctgaagctgcgtgtcctttgacagtaaacgcgattgcggtcattggtagtgctaagccaaacaataagagtagtcggactctcatctatagaacgttgacagtcctagcgctagcctttccttatccttgattatcatattcatcataatactactattcttatctccaatcctaatacacacaccccagacaacacacacaaaacatcacccacaaccgcgtgaggtctatttatctatgttgattgactggtcgaatcccgacgaacaaaaacacatcgcgtgtctcatcggtacaccacgatctgcccccaagtttggtccctcgcatcttctctttgtctactcccttcagacactcccacattggtacttctgagcaacaaccgaagtgaaatacatcaactctagaatgcacccactatccatcactgaatcagagtgcaacatctcatttcactcactcaacgacaagagtcagggcgtttctccgtagacaaagctttgtcgtcaacgcgatagacttctgtgttgataacaattaccggcctaccctattggggtctagtcatgctactgaattacattgagagtagtatgtgcagtcttaggagagaaatacgcgcaggagagcgacctcctcacaatagtaagaaacggcgtgagtacatgcagttatatactcagtcacgatgcgagctcggttcaacacgcacgtagcagtcctgtacgtaca

SEQ ID NO: 685928 - DNA, 96 bp, Homo sapiens
gaaagatgaggcggcaactgcaagagaggcagcgaggagcgctgtgagcagcagagagagagcacttattgacattaattcagagggcggttggac

SEQ ID NO: 685929 - DNA, 403 bp, Homo sapiens
cagagctcggtgccgaacggtcgcgagagctcggcgaagcgctcgatgatggcggttccttcctcgatgcctgcgaggcgcggacgcccgcgacgatggcgggcatctttccagcccagcgagatcggtgtcagctcgatcgagcgcaatgtcggccgtccgttcgagccgtgctcgtagcgtagcgtgggcaccaccgactcccagtagcggcggtcggccggaaagcccgcctggtcgccctgcgtgcgcttctgatagacctgccccggcgtcagatgaggctcggcgcggaagcgctcgtagccgtcggccgggatcttgggcaccagctcgttctggccgatgaagttgccgaggctgtagaagatcggctttcccttgtagagctccagcccgcgca

SEQ ID NO: 685930 - DNA, 286 bp, Homo sapiens
  misc_feature (151)..(151): n is a, c, g, or t
  misc_feature (213)..(213): n is a, c, g, or t
aagtagcaaaatagccaagcctcattctaccagcttaaacaaccctggcagaaaaagagtatagctttcccaatagctacagcaaataaaacaggggtgtctgatgagctcagctttcatcgcccagtgatcttttgtcatttaataaggnatttatctgttgggtactgggcttaatacctcagtgatgacatgtatatcaaacccccatgncaggtgtctatctatgtgataaaccttcacatgtatccccaaacctaaaataaaactttaaataaataggctg

SEQ ID NO: 685931 - DNA, 446 bp, Homo sapiens
  misc_feature (35)..(35): n is a, c, g, or t
  misc_feature (73)..(73): n is a, c, g, or t
  misc_feature (106)..(106): n is a, c, g, or t
  misc_feature (158)..(158): n is a, c, g, or t
acaggggaactggcgtgtacccccactttacttangaattgtattccctggaaaagctgcctttaaatccagntccccaatttcattgactttggggggagttccngtatttaatggaaccccctatggggaaacccctttacatgtgaattagtccncctcctaatttgtttcttctgtctttatgtttttctataacctggattttttaaatcatattaaattacagatgtgaaaataagcagagcaactttttccctcttcccagaaaaccagtctgtgtttacagacagaagagaaggaagccatagtgtcacttccacacaattatttatttcatgtctttactggacctgaaatttaaactgcaatgccagtcctgcaggagtgctggcattaccctctgcagaacagtgaaaggtattgcactacattatggaatcatg

SEQ ID NO: 685932 - DNA, 106 bp, Homo sapiens
  misc_feature (65)..(65): n is a, c, g, or t
ggcacgaggatcgccatcatgaacgacaccgtaactatccgcactagaaagttcatgaccaaccnactacttcagaggaaacaaatggtcagtagatgtaccatac

SEQ ID NO: 685933 - DNA, 259 bp, Homo sapiens
gactctgaggatcccctgcctgctgcgctactaaggtggtagaaaagcaaatttaaaagtccaactgtcagtaaactgacttttaacaaaggtgccaaagcaatccaatgagaaaacttaatttttttaaaatggtgcaggatagtctggatcactggataattatgtggagaaaaaaaattaacttcaacccctaactcacaccacacattaaatttattagcattttgtatcagacttacaatagcgacagcaggca

SEQ ID NO: 685934 - DNA, 177 bp, Homo sapiens
  misc_feature (147)..(147): n is a, c, g, or t
  misc_feature (176)..(176): n is a, c, g, or t
acatgaagtgcaggaatgtgtgcgggtagaaaaagtacgcactcaccaagcgaagcgcagcattaattgaagtgaacaagtcaaaggaacgctctggtagccggtcggactttccgtgtaggggacagcaagtcaagtgcttatcangcggtcctcagagagagacaattttgatnt

SEQ ID NO: 685935 - DNA, 244 bp, Homo sapiens
atcagatcatatatctgaaacatatgtaggcatagcatacgctcacctcttcgcgcaaaagctgtcacaacttcgcttctgtgccatctacttccttccatggcatctctcttgaaagtaatcttgtataggagattgaacgatgctgtcatttagaaattaacatgatatcttaaattacctttatgaaatatagttttgtataatagcatagatattccttcaacaaatgaacatttatata

SEQ ID NO: 685936 - DNA, 508 bp, Homo sapiens
ccctggccccactgtgggtttgggggcatcatttttgggccatcttcatcatccagggagggggcaaaaaacaatacacccaaacacagggggcctctgttaggcacatggagggagtggtggttcttaaaaaaaagatccctgaagaaacttttgctttaatgactttccaaagctggccatttttccatccttggcctcagtgaaagccgttatttttagggtttttcagccccataaccccccccagggggggtttgcccccccgattggtccggactttaacatctagctgggttccccgtttattgccctttcctggatttattttcccctatttcccatcctttttttttccccccgccaggcctttggaataaaaccacccggggtttgtttttgctatggaatgccccctggggccttttttgggggcttattgtttaagggttccccccactgtggtttttttgaaccccataaactttttttatggttttggggggga

SEQ ID NO: 685937 - DNA, 1023 bp, Homo sapiens
taaccccatacggattacgggatgattaatcacaccattcattaaatataaaacatggatctagcaaccagtttcctccaaaaacagatccattgggaaatgggccacactggtagaaggcaatctggtgactcccttctagtggttatataaaacaataacaaatcggtcagggagtcgggtacaaaacagtgggtacaaaagctatgaatagatacgcctttatcaaaaacagggtgcctcatttctcatatgtgcgaaacacttctaactcttagaatctcgtgcattttatagaaacactatcacgtgcgtgggtcacaattgtgctctgcggagaacggtttcttctcaccacgctctctatttccacttccttaccttccccttggacataaaaactccactgtgaactgtgacacaaaattacctatagatatgtgggatctcccacatgtggaacccaaaaaattcccacaagtgtgaaatgtgggagtctcacatgtgcattcaagccacagaggggctataccgcggtttaacaaatctgtggcttcaacccacaggccctcaagtgctattttaaacggagacgtggaaacttccgacaggcccatagaagcggcccccccagacgcacttatgcgcggcacttactcggggaaacctccatacattccccagatgtgttgcccaactgtgggtacaccatttctataaagaggagctccccccaagtgtgttacatacgcgagaacttcgaccgtggggaatgctaccataaaccaagatgtggacacaactaccaaggggcgacacaagaaacacccgctgaacggacaaaaagccccccaagaaagaaggggggggccacggagcaacaacctgcgcgcacaacagacgcgaacgggtgagaatgaaacacaagccccctactatactcaaaaacgccccgttccaacatcaaccaggcgtttagaactaccgggcaagcagagccacaccacaagagacgccccaccc

SEQ ID NO: 685938 - DNA, 1186 bp, Homo sapiens
gctgcgggtgaggctggcgcccgtaccatgagcgaggcggacgggctgcgacagtggccggcccctgcggccgctggtcgtcccgagacgcatgatggtcaggctccctgcaggctaagggagccggcagcgtcctttagacggcagagttttgccgagtgaccttcttgatgcttggcgtgtctcggtctcaccgttcccctgcttggagccattgatgctgcttggaactctcctagtatgatccaacatgccctactcagctctccgagatgatacgcccccgcgtctctggcctctggctgttcctgtcatccataattagcgtacaccgctgcgtacgcatgtgctcacgaaatccgggctggtgagactacactacgatcttgattgcggcaccggaaggtgccactaaggcaacaatagttggcggactggtgactgctcttaactcgtgggatcacggcaggattgccaccggtggcctcggtacatacagcgtttgcaagagattgtgccgtacccactcacgaagtagctcacttttgaccgcgggggattccgcgaactgccaggcccctcttgcggacatcagaaaccggaattactcgacctcaaaggcccttgctcgttgaataggagacgaacccgacgtcggggttattcctgcttgtcaagggaaccccacttgcactggcgtagattcctgccgtcatatgccggctggggctccgcactggccgatttagcaccactgtgcggagccgtaaactcttcgcagaacgtagacaattccccccttcggggatccgacccggttcgaccaacgtttggcacacttctgttggacctccgactttggctcacccgtcgccgcacttaaatcatgccccccaacgtttgggaagcacgtgcgaacagggaaaacccactttgtttgccctctttaggcacggtaacagttgacactccttttgtatcctcatgagatacgcgaccttatcccaggccgcaaactggaaggtacggggaacgcagcaactgtctaaccttatattgagccacatggagttgtcccctatagaccactggcatacgagcacttggggtcgacaacttctgcgacacagaagcgcaagccgtatcatgcattggcctttaccaattgggcgatggaacgttgcga

SEQ ID NO: 685939 - DNA, 141 bp, Homo sapiens
agagctcttatgtctgtatgtcgtatgcagatgagcttgttataattatagcctcatagggatagtacaaggaagtgggtatcgctatgtgtttctgtcagggggttgacgaatgagtgtgacggcgtattataccagaaa

SEQ ID NO: 685940 - DNA, 433 bp, Homo sapiens
acggagaatgacgcgagctgtaagcagcgtccagatcagcagcgtcactcggatgtgagcctgcgtgctgtacctgggagctgcagtcgtgcagcgggactggggtctctcggagcagtactcgcaaagtgctggagaatgccatctggccagggctgaggcgagcggaggcctgcggcagtgcagcgtgagaaccaggagctcaatgccacaaccaggagctgaacaaccgcctggttgcagagatcacacggttgcggacgctgctgactggggacggcggtggggaggccactgggtcaccccttgcacagggcagggatgcctatgaactagaggtcttattgcgggtaacggaatcggaaatacagtacctgaaacaggagattagctccctcaaggatgagctgcagacggcactgcgggacaagaa

SEQ ID NO: 685941 - DNA, 239 bp, Homo sapiens
gtctagcaggagcttatgggtaagctgggattacaggcgtgacatcatgcccagtaattctagtatactccagtagagacggggtttcaccatgttgcccaggatggtctcgatctcctggaaccatttgttgactccagccccggcatcgggcattccaaagtgctggggttacaggcgtgagccaccgagcccggacattgctttttatttttaatctatacccaggacccgggaat

SEQ ID NO: 685942 - DNA, 295 bp, Homo sapiens
cccggttagagcggtctagtgcagatcagaggttaacgtccccagatgtattttccatcgttaatcttccgacaagcaaggcctctttatctggatttgtttttacaaagttctaaatcatggatattaatcagggttaactaattaactgattgattaatcaaagcccatgttcctactctaaccacccgaattgttattctgcctcagtgagacgcggggtaccacagacggactctgtgaggcgccgcacctgtgctgcatctcgacagatgtgaagtacgcagtaggcttg

SEQ ID NO: 685943 - DNA, 180 bp, Homo sapiens
cttagcactgtatcatgaaaagcacaccagtaaggaacacttcctgtacaccgccgaggaagaactgatcggcgccgatgagcagttgccggaaaaagccaaaatcgaagtgctgctggccacctccggtggcatggacgtcgaccaactgagcaacgaagaagtgcagcgctacgtacg

SEQ ID NO: 685944 - DNA, 164 bp, Homo sapiens
taagattaaagagaaaatatgacgacttagaagagtagcatgaggaaggacaagataaacggtttctaaaacatgacagaggttgacatgaagcttcttcatggagtaaaaaatgtatttaaacgaacctcgagagaaaggactacagagccccgaattaatac

SEQ ID NO: 685945 - DNA, 1289 bp, Homo sapiens
tgtggtatgatggcttggtgactacagccaatgggattcatgtgtgtgtgtgcctgtgtgtgtgacactgagtgaatgctgcccaatggcttttcaatgattggcatgcatccatactgcatggtcatgcccatgtcacttctactacgaaagatgcacaaagctcatgaatgaccagattggtccatagaacatccatagacaacacaacatttttgactattcttagaacaatgacaatgacacacaaactatatatcaacatgtgctgacactttggaacaacatgcttggtttctctgtgaatattctcaacacttcctgttcagactgctgcttcaaggttacaacatgatgctttgaacgacatatgcatcattggctacacttccatttttcgtctacttgttcgtcactgacaagctttctgtaattgatgctttgtattcagataatataagcacggcacacaactgtgttcacacgaagctcactgatttggcatagtatgtggtgtctctatcccagttcttttgggtttcactaaccatggacgcctggcaatcaagtatcataccgtaccactgtctaacaaaaggcacgcggtcctaatccaattggctgaccgctctgtcacaacaccaatgacactttcattggcgacttcctcgtagtactacccacgcattactgcttcggactcaattaacatggtcctataccattattgcacgattcgccgagacccttgcacaacactctccaactaactacgttacccaaaccaatcaaatggtagtcgaaacattggcacaacctggacgttccaatacacgaacgtaccctcgccctgtcacagacaccataacccgtacccgtgcaaccaaccacaaagtcccggtgcccctccgcgctcacaacaaacactcacactgctccccaacaacctgcaagaacacatgctcatgcacccacgccaccatgacgtcaaactcaaggaggcgagcggacaagccggggacgaacggcagtcagaccacggagttgtcgtgtggccttgctcgacgatacgatgatttgtcgtcactgacacaacgaaatgccggctcgtcgatacgatcaattactagattgagatatcgaagaaacagtcgagagagaaaacacgagccaaatcactcagaggacgtatcgtcgcagtcgtccactcacctgaaagacgatcagagcaaagagatcacgtcatatgaacacgttagatatcacatacacatgataacgtagattgc

SEQ ID NO: 685946 - DNA, 373 bp, Homo sapiens
gaggcatgcagctgatctgcagtcgatctaagatcccctaacgattaaactgtgctgacagtgatctgactgttattaaacaagcatcgcgaagccgcggcgggtgttgacgcgatatgagattggccaatggtcctgatgttcaagtgaagaaattcaatgaagcgcgggtaaacggcgggagtaactatgactctcttaaggtagccaaatgcctcgtcatctaattagtgacgcgcatgcatggatgaatgagattaccactgtccctaccttaatatactatcgaaagcacagacaatggaaggggcttggctggcatcatcgggggaagaagaacctgcttgagcttgagtctagtctggcacggtga

SEQ ID NO: 685947 - DNA, 210 bp, Homo sapiens
  misc_feature (210)..(210): n is a, c, g, or t
ggcctgctcctcccgctgctgctgccgctgccgcccctgagtcactgcctgtcgcagctaccggcccgtcctggcgacccatactagttcgtcgcatatttggagttcttacaacatggcagacattggacaacatgggagcagatctgtaacttgatcaggatttggattatgtttgtaggaggtagaagaggaggagactggtgaggn

SEQ ID NO: 685948 - DNA, 1230 bp, Homo sapiens
  misc_feature (146)..(146): n is a, c, g, or t
  misc_feature (959)..(959): n is a, c, g, or t
  misc_feature (969)..(969): n is a, c, g, or t
  misc_feature (1000)..(1001): n is a, c, g, or t
gggcgtactcgtcgttggtctgttgtattttgtgtgctctggtgtgcgtgcttgttgttgatctcttatcgtcgtccttggtgcgtactccgtcgttcgacttggcgtcgacttttcctccctggtggttgtgtttggtcgcttgngtgcatggtgttcggccgctctgcctgtgggtgttgtgttctgttctgggctgcgtgtgggatcactggtggttgtcgttccttgctctgacgccctgggcgttggtgtttcgtgtcgctcgcacggcatctttctgctctgtggggggcctgtgtgcacgaattctctgttgctattaggtggggcgctcccgtatgcgttctgattgccggctgtgtcgcctcgtgtgttgttaccgtgggtctgtttggtctccgcgccggtactgcatttatggggggctcccaagtttctttgggcctggggtaccaggttaaatcccgacttgtgcagtgacccctcttttttaggctggacccttgagtgccccctgcttttttgccagaccttgatggatccctgtcttgcagctagtttcttcattgggccctctttaggccacgtgccggaggaggcatgctcctcgttctatgcccccggacctaccctactctagcagagcctttcttgccctttaaagtgagattaatttaggctgtaaatctgggtaaaaacttccttagagagaaaattaagtctactgatttggtataggtaaatggacacttaaacttttttaaagtaaaggagatggtagataccgcttagattatagttcttgaggttcaatgtgaagccacagtggtgttaacttatctttgaatttccttgttcacggtcacgggcctggaaacgcctgtgcgcgggaggtcactccaattccaaattttctgtatgaaagcactttttcaccccaaatgagcctcatcccnttaatgccanaccataacctctactgagggagggaaatacnngaagccaccccttttatttctcttcacctgtgtaacaagttcaccttgttgtcttgaacacctgtctccaatacctgctttttgttttggatagtaccttgtctgtataagaagctggcccttccactagagaggccctcggagtctaaaattatgagaaccattaatttatttgtgtcttctattatgatctcgttttgaccaataaaaatccttactactttctcca

SEQ ID NO: 685949 - DNA, 444 bp, Homo sapiens
  misc_feature (53)..(53): n is a, c, g, or t
  misc_feature (65)..(65): n is a, c, g, or t
  misc_feature (89)..(91): n is a, c, g, or t
  misc_feature (125)..(125): n is a, c, g, or t
  misc_feature (262)..(262): n is a, c, g, or t
  misc_feature (268)..(269): n is a, c, g, or t
gagatcctgtttgtgatcctctggacggtcttctagggtaggaaccttcctgnctttcccagctnctgggggctcggggagtccctgannncgtgtcagatcactccagtctctgcctccgtctncacgtggacttctcctctgtgtctgtgtctcctcttctgtcttttagaaggataccggtcagtggatttaggacctaccctactccaggatgatctcatctctagatctctaactaattacacctgcaaagttcttnattttnnaataaagtctcattctaggttctgggcttcgggatgtggacagatctttctgtgaaccaccattcaatccactacaattatatccagttccctccagaggctctaggggagggcccttcctgcctctcccagctcctgggggctccgggcatccctgaccctgtgcatgcacaaa

SEQ ID NO: 685950 - DNA, 708 bp, Homo sapiens
ggctggagacgtgtggagctgttcgaggactcgcgggtgtgcaggcacctatatatgtgtttagaaataggcgttaaacgttcggttcgaatgaatgaatgtctctcaatccgagcgtatatttctcagaagcgaaggtggaagaacaataggttcaaaatttgtggtaaactaaaacaggtcacaaactacttccatagcttcagaagatccccttcaaacacttatgtcttaagcatctcaagaagttcttcagagaaagctcagcaaagtgggagatcaaaatgtctcaaatgtggtggttccagaatgttctactgctatacatgttatgttccagttgaagaatgtacctattgaacagattccacttgtgaagcttccagttgaagattgacgagtcattaaacagtccgaaatgaaacgagatggcaaaagtactggctatacatgcaaacactcttagcacctgaatccgtaaacgtttacacgtatccgtgtattccagaatatgacgaacaggaccgtgacagacaggtctcactatgttgcccagactggtctcgaactcctagggactcaggtgatcctctcaccttggcctcccaaagtgccgggattacaggttgcactcatttttactgggactcagtctatctcaataaaagatatttcttgttcatctggaaacacaggatccagaatacg

SEQ ID NO: 685951 - DNA, 450 bp, Homo sapiens
  misc_feature (92)..(92): n is a, c, g, or t
  misc_feature (100)..(100): n is a, c, g, or t
  misc_feature (113)..(113): n is a, c, g, or t
gcggccgcctactactactaaattcgcggccgcgtcgacatccatcaaaaagcagctgatagcctattacaaccagatacaggaaggtaagnccaatccncgccaatcaagcnccttaataggtcaaactaaaagaggggtttctacatcagagttaattgataaagagggtaaatatcgtctgatagggcagcaagcgttaaaggaaattagggctaaaaattcacaaagataaaggttaaagagtttaagtagttaacaaggctcgaccaagccattgaccaataaattagaggcaggccaaaatgataatcaaagacccacttacacacgagtcactcgtgcgtgataacccacctatattacctgatgatggattggaccattcgccatgtcatctcgatcgcttgcatatagccgcgagagctagaacgaaagcgccacatcagc

SEQ ID NO: 685952 - DNA, 126 bp, Homo sapiens
gcggccgcctactactactactactgctcgaattcaagcttctaacgatgtacggggacatgctatggttgcatttccgttttctatgaatgaatttgcattcaataaacaaccagacccaaaaaa

SEQ ID NO: 685953 - DNA, 198 bp, Homo sapiens
ttgtaatcagcatctgggctcccctggggtgggcaggaggacccctggtgtcgtctccacgaaggaagatccaacggtgctggcacgccactcctcatccttctccacaacagagctcctcctacagccgctgctgtgagtagcaagacaccgatgactgattcccaccacgagccactggagaacttggctggagat

SEQ ID NO: 685954 - DNA, 266 bp, Homo sapiens
cttctagctgaacgagatggacaggtcaggcagaggctgtgccatggttattatgagatggcaccttgggatcgtcagaccagggagcaaagtaaacgatctgaaatatgtcggaggcacttgctgatggataccatataaggcgggatgaagaaaaagagaatcaaggatcatttctaagcatccaaatttgaacacacatgatgcagtggctggtagtgcttaagtcacaacatggggcagcacatgagcagcagcaagtaggt

SEQ ID NO: 685955 - DNA, 1246 bp, Homo sapiens
  misc_feature (36)..(36): n is a, c, g, or t
  misc_feature (41)..(41): n is a, c, g, or t
  misc_feature (46)..(46): n is a, c, g, or t
  misc_feature (71)..(71): n is a, c, g, or t
  misc_feature (73)..(73): n is a, c, g, or t
  misc_feature (77)..(78): n is a, c, g, or t
  misc_feature (81)..(81): n is a, c, g, or t
  misc_feature (89)..(89): n is a, c, g, or t
  misc_feature (96)..(96): n is a, c, g, or t
  misc_feature (100)..(100): n is a, c, g, or t
  misc_feature (116)..(116): n is a, c, g, or t
  misc_feature (126)..(126): n is a, c, g, or t
  misc_feature (128)..(128): n is a, c, g, or t
  misc_feature (131)..(132): n is a, c, g, or t
  misc_feature (150)..(150): n is a, c, g, or t
  misc_feature (196)..(197): n is a, c, g, or t
  misc_feature (200)..(200): n is a, c, g, or t
  misc_feature (202)..(203): n is a, c, g, or t
  misc_feature (249)..(250): n is a, c, g, or t
  misc_feature (257)..(258): n is a, c, g, or t
  misc_feature (276)..(276): n is a, c, g, or t
  misc_feature (316)..(316): n is a, c, g, or t
  misc_feature (321)..(321): n is a, c, g, or t
  misc_feature (324)..(325): n is a, c, g, or t
  misc_feature (328)..(328): n is a, c, g, or t
  misc_feature (339)..(339): n is a, c, g, or t
gtcccaaagtgccgagattgcagcctctgcccggcngccancccgntctaggaagtgaggagcgtctttgncntggnncgngccatcgntcggggnatgntgaggagcccctctgncccggtgcgncnagnnctgggaagtgaggagcanctcttcccgggcgtcatcctgtctaggaagtgaggagcgtctctgnnccngnncgcccatcatctgggatgtggggagcatctctgccccgtcggcccnntctgagnntgtgaagagcgcctctgnccggccgtgaccctgtctgggaactgaggagtgtctctgncccgncgnncancccgtctgggnggatttttctgccgtcatcttgggcaaataatgggcaaataatgatgctgttctgaagagactggagcagaagggtgcagaggcagatcaaatcattgaatatcttaagcagcaagtttctctacttaaggagaaagcaattttgcaggcaactttgagggaagagaagaaacttcgagttgaaaatgctaaactgaacgaaagaaattgaagaactgaaacaagagctaattcaggcagaaattcaaaatggagtgaagcaaataccatttccatctggtactccactgcacgctaattctatggtttctgaaaatgtgatacagtctacagcagtaacaaccgtatcttctggtaccaaagaacagataaaaggaggaacaggagacgaaaagaaagcgaaagagaaaattgacacgacacggacgagacgacggcgaaaaaacagcaatcaatagctggaagtgccgactctaagccaatagatgtttcccgtctgggatcttcgaatcggttgcatcataactactaagatatacacctgatgcagattctcgcatgtgcagcagttgatgtcggagaaatagcccaggacagtgccacgggcctgggatcaaggtcccttgaacgaatgaaaacggatggactacattggaactgagactgcaaagaagggagataccccagcaggcctgtggcactaccaagaaagaacctgggcgtcaagggttggtcccggaaaaacaatggggtaccggagctaggaggaacctaaactggtggagaccactgacgtgagggtcatacgaactcggagaacgaagtgagccacggatataagtgcgacaaccaaaatgatacagaaggtcagacaatgccatgtgctcttttttttatcatacatgaa

SEQ ID NO: 685956 - DNA, 952 bp, Homo sapiens
ggcttcctgctgtggctgtctcggaacccgtggtcctccgcttcatgatttttctgccgtcatcttgggcaaataatgggcaaataatgatgctgttctgaagagactggagcagaagggtgcagaggcagatcaaatcattgaatatcttaagcagcaagtttctctacttaaggagaaagcaattttgcaggcaactttgagggaagagaagaaacttcgagttgaaaatgctaaactgaacgaaagaaattgaagaactgaaacaagagctaattcaggcagaaattcaaaatggagtgaagcaaataccatttccatctggtactccactgcacgctaattctatggtttctgaaaatgtgatacagtctacagcagtaacaaccgtatcttctggtaccaaagaacagataaaaggaggaacaggagacgaaaagaaagcgaaagagaaaattgacacgacacggacgagacgacggcgaaaaaacagcaatcaatagctggaagtgccgactctaagccaatagatgtttcccgtctgggatcttcgaatcggttgcatcataactactaagatatacacctgatgcagattctcgcatgtgcagcagttgatgtcggagaaatagcccaggacagtgccacgggcctgggatcaaggtcccttgaacgaatgaaaacggatggactacattggaactgagactgcaaagaagggagataccccagcaggcctgtggcactaccaagaaagaacctgggcgtcaagggttggtcccggaaaaacaatggggtaccggagctaggaggaacctaaactggtggagaccactgacgtgagggtcatacgaactcggagaacgaagtgagccacggatataagtgcgacaaccaaaatgatacagaaggtcagacaatgccatgtgctcttttttttatcatacatgaa

SEQ ID NO: 685957 - DNA, 422 bp, Homo sapiens
  misc_feature (23)..(24): n is a, c, g, or t
  misc_feature (193)..(193): n is a, c, g, or t
  misc_feature (209)..(209): n is a, c, g, or t
  misc_feature (215)..(215): n is a, c, g, or t
  misc_feature (219)..(219): n is a, c, g, or t
  misc_feature (223)..(223): n is a, c, g, or t
  misc_feature (232)..(232): n is a, c, g, or t
acatcgatacgactttttttttnngaagcaccagagtccatgaggcattttatttgtaaatatatgtattacatccctagaaaaagaatcccaggattttcccttctgtgtgttttcgtcttgcttcttcatggtccatgatgccagctgaggttgtcagtacaatgaaaccaaactggcgggatggaagcanattattctgccatttntccagntctntganttgcacgtnaatctggggctgatcaccccacacttgtttagcctgcctgtgaggttaacaacaattttcccagctttgtggcataaatgatttcaaattcgccaatgtaaccatgcttcatcatcacagggagaaaccggacgatgactttggagcacggcctaataagcaccctgcgtttgcctctcttttcgggatt

SEQ ID NO: 685958 - DNA, 554 bp, Homo sapiens
aagctgttcctcaaaagataaaggagcttaatggtcgtagttgcaaaatatctggcaaagcttagaaaactactgtccacatattgtttgatagagctcactttggaacaagataaaaataagaaaagacatagatattcaaaggtgtctaaacccagctgatcccctattttgttctcagaacacaaggaaacaagtggagaagaaaccaaacggctgggtttttttccacatgaccatgcattttattggtggtcaaatgacacatttagaaaaaaattttttttccctctcaggcatatttttgggggaaaaaggaaagttctataaaaaacaacagaaaaacaagctttaaagaaattacatctatagcttaacacagactgatactaaatgtcaggctttccaaatagtggtaatttaaactggtaaaaactcaatattcaaaaaaggatggggggagagggagagtgagataattatgtaactcaaattctactttggtgtgtgtgtattggtctccggcttatagttaatacctagagatctttaga

SEQ ID NO: 685959 - DNA, 148 bp, Homo sapiens
  misc_feature (23)..(24): n is a, c, g, or t
acatcgatacgactttttttttnngaagcaccagagtccatgaggcattttatttgtaaatatatgtattacatccctagaaaaagaatcccaggattttcccttctgtcgtcttctcaacagccgtatagtagtagtaggcggccgc

SEQ ID NO: 685960 - DNA, 116 bp, Homo sapiens
tgtgacttagaggatcccgactgcatcaacgccgctccggatcgggtcagatcccgaatcggagtggcggcgttggatgcagtcagcggcgttggatgcagtcgggtaccgagctc

SEQ ID NO: 685961 - DNA, 135 bp, Homo sapiens
agttcgttgacatctgcgttggggattcaaatgagtattggtgatatgctgagagactgggtgctccgagctccactcaggtgaaagaatttgcggcaattgttgacgtgaaagaagaatctcattacatcttgg

SEQ ID NO: 685962 - DNA, 153 bp, Homo sapiens
tctagaggatcccacagaatcgtgtgagggtgggaatagtgttaatgtcattaaggagagaatgaagagaagtaagccgggggcgtctttgattgtgtagtaaggctgaaggtgattttatcggaatgggaggtgattcctatccttcgcacg

SEQ ID NO: 685963 - DNA, 1311 bp, Homo sapiens
ctcttatctccttcatcatatcatccattccactccattccttctattcacatcatattcttatcccatcatctcatcaccacgacatcatccatatcccatcatcattcatcttcatttccattttattctcgtcttcatcatcatttcattattatcatttcaccattcatattcattcatattccacatcatcatcatcatccccatcatctccacatcatagtgtatatcaacgctatagtacaacaataaaccaaagtggccactaccacgcgacacgacagaaacaaagcgataacacgcgacaatcccacgaaaccagaccacccaaccaacacacaacacaacaagcacaacacaaacaatgcagaaaagaaccaaagacaaagacaccaaaaactaaacaaacgaaaaaaacaagaaaaacacacaacaaacataagcgcgcgtagaacccagccaagaggagggagccaaacacagaacaccaaacaccacgagcgaacgacacactcgaacacagaaaaacaagaaccacgcgagtatgaaaacgacgcagacacagacggactacagaccagaccacaaacaacccgagcgacacacaaacagaggagcaccaagagacacgcagcacgataagacccaaacagagacgcaaatggagtacgaccgacaaagaaacacagggcgacaacgagcacgacacgacagaggaagcagagcgcgtgaggagcacgcagaccacagacgccacagaagcagaaagacacaagcatacacggagcacgtgacagagaccagaaacgcccggcccagcgaacgaaagcaagacaacacagcgggcacgaaggcgacaacgcaagcgagtagctaagagacgacaggggcaaggaagacgcgcgctgaggacggaaagagacgccgagatgacaagaaggcaaacatcagaaggaggagacaggaccgcaaggcccgacgacgcacggacaaaagaccaggagacaagcagcacgagagagcaaacgagcgacgcagaaaccgggcacgcgaagcgcgaggaagcacaggcgcagggagaagagcaaaggaagatagcagggagagaagagcaaacggcagcagacagcgaagaagagggagataaaagacgaacggacacaacaacagagtagaagaaaagaaaaaaacagcagaaaagcaaaagcgagagcaacagcagaaaaaaaagaacaaaacaaaaaaagaggaacaagggagggaacagacgcaaaccaacaaaagaggaagtctcccagaagcgaacaa

SEQ ID NO: 685964 - DNA, 595 bp, Homo sapiens
ggaaacaaaggctggctctgaaaaaaaggagggggggaaagggaacaaaatcggacaacggaaaccccactgcaaactccaccggggtacaagggagtttccggccccacccccccaagaggctgggtcaacaggggcccaccaccaccccgggtgagcttcagcattttaagaagaaaccgggtttaaataccccggccaaaagggccgataccccgggccccaaaaaaagggcgccctttccaagaaaaaaaaaaaaagcccggccaaaaaagcgacccgggcgtaatacagggaaaacgcggttcctgggggaaactgatgccccccacaaacgctagggcccctaaattgttggcgccccggaacacacaaaaacccccctggaaactcaaccgggaacacccgcgaaaaccctctcccgggggaagggccaaaaaaaccccaccccactcttccgcttaaccccccaccctccgcgggaaaaagcggggcctgccctgggcattcaaaaggggcaccccaaaaggcggcggggaaaaaagggcacaacggcggaccctgcgggaaaaggaaaccccgccacaaaaacccc

SEQ ID NO: 685965 - DNA, 270 bp, Homo sapiens
taacgacgctagggatgtagcaattcaatagtatgtaaagccactttctgaaaaccacaagggtcccttaaatacatgtaaggcagctagactagtcccaaaataaaagacttatgtataataaaatacttacgactaacaggggtttggacgcaaaagtcaaatattttgcaagccaaaacattgaatttgactcttatctaactctacttccaaacaatgatctataaaatgtggtggagagtggtggtctatgtcaagcagccttat

SEQ ID NO: 685966 - DNA, 626 bp, Homo sapiens
gggaactcatggtttggctatttctcattctttctgcactgtttcaaatttttacaagtgtatgttattgtacttttaaaaagattaacttggcaacaagtctaacctgaaatgggtgctattttgactaatctgagtgaaaagtgaggatttaaatgaactaacccctaaactcaaccagtcccatgtttttttaacacttggaatatctaattccatttacactgcattcttcaaatgtaattttcaaagatgccttttaccttcatcccttacttttaaatattattataaacttttggagactcacaaaacaagcaatccctaaattctcacctaagaaagtatcttggattaaatggtttttgagaaccttgatagtgtatattctatgaaatggaaaaaacaagaactatacagaatcacaaatgctgttgatcacataccaatcttttccatccataaaggtaatgttatacatcttggcgacctggtgtaatgtgaaactttgcacaggtgagggatggaactttttaaacttttacaaactcttattctttaattttcccaaaaagaaaactcggcaaaaagaaaaaaggaccattttcctttcaactattctgaaa

SEQ ID NO: 685967 - DNA, 144 bp, Homo sapiens
cgctcagctacgtttctagtataaggtctctggggtagcactagagagccaacagagaatagataggggtagagaatagggctcctggccctatccctttggattaagagttatacctagaggtataaggaagcagacttcttc

SEQ ID NO: 685968 - DNA, 168 bp, Homo sapiens
tttaaataaaaaaaaatcctgattaaaatagttttggtgaattaaaaataagagtcgatgagctagaggctgggcatggtggctcacatctgtaattccagcactttggcaggccgaggcaggtggatcacttgaggccaggagttcaagacccacctggccaacata

SEQ ID NO: 685969 - DNA, 366 bp, Homo sapiens
agcctcttaccgtgcttgttaagccatagctcagggctcctcttgactacacacccaagactccttggaacgcgttctagtactgcttctccccaaactatgtcgagaggaagaaaaggtctggtattctgagtatctactttttttcatttccagtagtaagtcagtgctgctccaccaagctgagaagaaaatggcccttggctgtcctcggggccagttgtaagaactctggaccagccgtctgtagtggggcatgacttcgtgctcgaacaagtggagggcgaattccaaggccactaacaccgggaatacacaggcaatcagttctcgccctgttcagccggaacttctcttccagtttgt

SEQ ID NO: 685970 - DNA, 100 bp, Homo sapiens
gggagtgggaaaggggaatcagagcaaaccaagataggtcctagggccagcctagtgcctccacggacccggccgttgatagccgcggatgtgtgcggat

SEQ ID NO: 685971 - DNA, 362 bp, Homo sapiens
catgagtttggggcatgcggggtgtccaaaggtccttcctgtgaccgagtgctgcacctcctggcactacgtgcctaccgcaaggctgagctgctgctgcgactgcagaatggacggcctgacgcaggcggacaaggacgcgctggatggcctcctccagcaggtgggtgccgccccgagtgtcttgtctttaccacgtggtctccgccagatagtcttgtgcggcgtgcgatgggccagaagcatggagaactgggattcgggactggcaagtgaagagccgcttcctgggggtctctcacagtgttcagaaacctgcactgagtagccagggccctcctggatttagaacaaagcttagg

SEQ ID NO: 685972 - DNA, 666 bp, Homo sapiens
aagcctcgtacgcctatccaggatcgtcagaatgtattaaaattggccaccgtccggtccgatccagcgatcctcgactatactccgaccgccagtactatatttacccggaccgataattcaaaacatcataatgacaagaccggcgcccaggacaaccgatcaaaaattcaccactaggcactaaaccctatcgaagtatccgagaccataaattctaccgaagaccagacctgccagacgggaagttgcgggatcaagtagcattggagatcaacgttcccaatatgagttccccttgtcctagtctccctcaaagttctcagtctttctcgactaattctacttctagagcagccggtaaagaaactccttctgtactccttactaacgctcgcatctaaagacggtgcgttcgtactagtcggatccacaactttgttacactcaaactacggtaaatactacatgtaggcctagcttatagagtcccgctgcgatgttcaaccttctgaaaaagttatcttctcatattactaatcgtcctattacccgctctcgccgccggggtatcaatagatccaattatcgttaatctaatacgaatgtttcctattctatccgaaaagcaccctttcgtgttactactcatgctattacgggctc

SEQ ID NO: 685973 - DNA, 651 bp, Homo sapiens
tggaaaaagtcatggaggccatggggttggcttgaaaccagcttgggggggttcgatcccttcctttttggtctaaatttaattgtatacgggtttccttcgaatgtgttggtggtatagggagtggggggcactccatattagctcacctccaggtttaagtgggagggttctctctatacatattataggacttttctcgcctctcgaagcgaagggcttcctcaaatctccatgtgaaaatttatttaattatttagcgtggcgtggtatagaagaaaaagtgaagtggagccctacgagattgaatgaggaagtgtttcacagtggtgggtggtagtgccatgcggggttaagactccgaagttaaagcggtgcggggccatccccggaaataggcccggagaaagagtgtgtttggtgggcaagaaagagtttaagatttatacgccccgaattataattattgattagtgtggaacagtggggacatttggggccgtatagggttgtgtggctcctaaggggtgtgtttaccccgtgggaaaattagggggaaatctcaaggtgaatgtgaaagccctcccattgtggagtgggccaatataacaggccccccaattgggaatggggacaatagggtggaaattt

SEQ ID NO: 685974 - DNA, 540 bp, Homo sapiens
  misc_feature (45)..(45): n is a, c, g, or t
  misc_feature (132)..(132): n is a, c, g, or t
  misc_feature (238)..(238): n is a, c, g, or t
  misc_feature (309)..(309): n is a, c, g, or t
  misc_feature (446)..(446): n is a, c, g, or t
  misc_feature (481)..(481): n is a, c, g, or t
  misc_feature (523)..(523): n is a, c, g, or t
gcccctacactcaagggagcaacgagacccctctgccggtgcctnagaaaagtccagaaacccaagcaggatggggacgtggggagttaacttttgaaagtttttagggctccaggagccttgggcaccccnagagaacctgccgggggccagctgatttcttccacgccctctccgggctttccaatgtccacaggagctactgcagcactaacagtggctttggggcctgtatgtnaatgactgccatgtgtttgagggtgaggagagtgccatggatcttcattactattgaagcttctcatttanaaacatcagcgtgctctattttctactctccaacagctacatggcggggaggccaggtttcgtgtgatctcacttcagaggctcacccgagtccaccatagtcagagtggccactacataccgtactgggaaagctngcttggcaaaggggatggatgcttagcttttgccnaccggccatgggagatcttcacatcttctcgggggctggganagtggtttgtcttgccg

SEQ ID NO: 685975 - DNA, 913 bp, Homo sapiens
tcagtgagttgtgtctattgtgtaccagaacttggcgctccttgttgcagtgtgtagagtttttggacgcagtgaattctgtgcgccatattgcccatatgggcctcggttcctacaggtgtgcccccacaaaagtgtggcgtgcgccagagccgtttttacggggcgctaattctcttaattcggcccgcgctgtccccaaacacaagggggtggggacgtcccccccccctgggtgggaaccccccgccctcccgccgtggtggaagcccgccgaccaaaggtttcgtcgcaaacctcgcggattttcttgcgccctgttctggtgttgccaaaattgagggacccacaagtgccggcccgccacaggttgtcaatatttaagggcgggtccccaacgaccaggggttctgaaaccgcccaacatacgtgggcgcttccatttccaaaagggacactccccgggttcctccacgccctatcaaagaagttccggaggcgcccaccccgaacgagtgtggcgcgtgtctcctccagagggtcgttccctacatatgttatgagggtccccccaggtcgtggttttttataaaccccagaggttattgattaaagtcctctcgcacagcaaccctcctggcaatcaaacattccagatgctcccagtttggacacaacacagatcagatccccccctgctgcagatggcaaacttcccacaaaatccgtccttcatgagacaatccctccccaggaacaccttcttcagagcaaatatctggtgcgaccagaaaacaaaccacggtcccaattctttcggagcttgtaccatcgttaccccgacaagccccacaattcaatgggccatttgcaccccaacaaataaaacagattcccaaaaaccaacaaaaca

SEQ ID NO: 685976 - DNA, 336 bp, Homo sapiens
gtatagtaaaatcaccaagaaaaacacatgtacacaagaacactcactaaaagctcacgccataaggtaagaccaacgattgttgaaaaaaaccttatttccacaatctggccatgtttacagttttcccactttgttctcatcaaccttccctagtacaaatttaattacatcatcttactgaacactactgactttactggatcttttccttgattcgatgttacctttcataccgatcacagtagaaaaacgtatgaagttttttcaactacagccaagatgctgggttctcacctgtaactatagttttcacgactggtaggcgataagatt

SEQ ID NO: 685977 - DNA, 878 bp, Homo sapiens
  misc_feature (562)..(562): n is a, c, g, or t
  misc_feature (681)..(681): n is a, c, g, or t
  misc_feature (840)..(840): n is a, c, g, or t
tcacaaaaacaaatactgcatgattccatttaaatgaggggcctagaatattcaacttcatagacagagggtagaatggtggttgccagaggtgggaagagggggtaggggttaggttttaataaatatcatttcagttttacaagatgaagagagttttgcagatgggttgtggggatacttgtacaacattatcaatgtatttaataccactgaattgtacacttaaaatggttaagatggtaaattttatgtgtgtattaacacaataaaaactgaaaaaaggaatatatgttaccctaaataaaaatttcatatgctgaactcagaacccccagtacctaagaacatgaccttttttgaaaatgggattgttgttaatgtaattagttaagatgaggtcatgctgtaatagggtgggcccctaatccaatatgatttgtgtctttataaaaaagggaaatttgtgcacagagataccacaggggatatgccatatgaagatgaagcagaattctccagcccagggatgcgaagattgccagcaacgaccggaacctgnggagaattgtgagtggtcctctccaaggctccgaggaccagcttgccagaacttgttctgctctagctccgaatgtagcaatgccttgtgtgtaacgcctatgttgtgcattgttttgngctaggatgagaaagacatgatgcatttgcacgtgcaaaaggtttgctagataacatggcaagtgcttaaaaaaaaaaagattttttggccgtatgcccgtgcgttccggcgattggggcctggcatccgccgtgcgcgcccccccgtgagccgcgggntcgggacggtcctcccgaaggccaagcgccgtatcctg

SEQ ID NO: 685978 - DNA, 121 bp, Homo sapiens
tagacgatccccgtaaaggaaaaacaaaaactgcaaatctacgaaaactttttagagaaaaactatttaaaactgtcagatcccaacacaacatacccccgcaggcgtgctccgcttactg

SEQ ID NO: 685979 - DNA, 994 bp, Homo sapiens
ggcgagaatgatgactattctcagcaatctgactgtcgacattccagaagatgtcgacattagtctgagcgggacgcacagttatcgtgaagggccccagtaggaaccctgcggagggatttcgcatcacatcaatgtactaactcagttcttcttggaccgctgaaaagagtaggctccgggcttgatccaaaaatgggtggcggtagactaggaatagggaactggggctttaccgttctctgggcactcatatttagtgcgtacaatgtacacggagacatgatcgaatggcgtgttacaactggagcttccgtgaatcacacgaatgaggtcctggtgtatgcgtcacttccccatcaaatgttgtaatccaggacaatggggtctcttgtggaacatcgcgaaaatttcttgcgcgttgaactacatatatccgtcgagcggattcggaaatgcacgaacccagggtgtgtgcgtgtggtgttcgagtactctacaaggccactagcccaaagattgatagtttaacatacccgtttgtacaggtgcacacactgaccactctagtaggtcttgtgtttcacaacttcacgtgggccttttggatttcacgcaacgccacaaacaaggttaataaaatcaatgggatatcacggaacattttccggactggtaatctatgtctctgaaaaaaaggaactgttcaagcagcgctgatgaattaacgatcctaaaagaagttacgccggccttaccgggaaccggaaaggatggcctcgaatgaccacttaagaagcctacgttggtgaatatttcaaattgattgcagtaaaaaggacctatgggttgggaccacgcacacacaaaacctccgggggcccactgcgggcgggggagcaagacggctgcaccgcgccggtgcctacgcggccgaacccagtttgcaaacgggaaaccgcgggcccaaaggcagctaaatcaaagcgacgag

SEQ ID NO: 685980 - DNA, 130 bp, Homo sapiens
  misc_feature (82)..(82): n is a, c, g, or t
  misc_feature (91)..(91): n is a, c, g, or t
cggtacccggtcccatgcaagtgttggggacgccgagtgggggtactagttagcatgcagagtctcgttcggttaatccggngcaaaaatntaaccagacaaatcgcgtccaccaactagacggcatgac

SEQ ID NO: 685981 - DNA, 159 bp, Homo sapiens
atatccccaaaagctacagtcttgataaagtaaaacattcagtcttaaaacacctgatttctgttcgcagttgagagtgcagatagctgactctcacagacactcatggagtgtcccccttcaggaaggcatgaaagcactcgatatgaagggtaccga

SEQ ID NO: 685982 - DNA, 467 bp, Homo sapiens
  misc_feature (414)..(414): n is a, c, g, or t
cacgagggcaagtttgacttgggggagattcgtcgtagaataaacgcaatgcaggagacgctcgaccgcgcgctctccgagcaggatgagttgttctagccctgaacccttgatgggctggaacgccgccgaatgtcccctgcggtgttcgtcgatcgggccaatattcttggaacctacttgttgcgatctggttgcggactcaagtagcgttggtgtgcgcgtcccaagcggaagcacctgagacgctcggaaagcgaccaccttgaacctcagggttcaggatgaaggccggacggcattggcggggggctcctgttcgatgcgggcgaaggctcgtgcggcgaaggggggttgcgggagaccggaaccccccttagtttttctgccgagcgtttccagtggatgatcggncggcagaggagcgacggcctgacgatcggggccgcgaatctgatgggtaatct

SEQ ID NO: 685983 - DNA, 238 bp, Homo sapiens
gaaattccattttttaaaaccttttcttttttggaaattttgaaaaaaaaaccagaaaaaaacctttttaaaaaaaggggagggggttaaaaaaaaagttttggttttgttcccaccccccctgcttttggcatttaaaaaagggaggggccagatcaaccccaaaatttcctttttttccccccttcccggattaacttccaaattttttggggaatttttaaaatgggaaacccca

SEQ ID NO: 685984 - DNA, 385 bp, Homo sapiens
actctacaggatcctcttagcccgacatgtcctgacagtgacgcatcgaaaattactcgatacttcatgacattaccgaagctgcgccacttgtcattcaggcaggatcgatgggcttgggcggcgacgtgttcgtttctggatattggcgaaacggtcacaaatcgttggagttggcttggacacacagctgatcaatctttctgggcttagtgttcgttccgcagcaaaaaaccggcatggtgatatttctcaatttgcaagttccaggtgaggcctatccggcccaagagccgcaggaaaactcttattgaacgaaggtggttgacttggcgactaaacgttggccccacatatcggtgctccaaggggtaccgcagctcga

SEQ ID NO: 685985 - DNA, 165 bp, Homo sapiens
ctacaggagcttagctgagcaagctgggcagggtcaagggtaattgaagggcggagggataggtgggggtctcagggacagagttcgaggcagcatcgctctggtcctccaaggcctgggttgaaccactggtaatgaagccttcttctctaaagtctcaggtcc

SEQ ID NO: 685986 - DNA, 591 bp, Homo sapiens
caagaactgcctgtagttttcaaaatgacatgtgggtttttactgttatcattgttatttcgatagggctttttcctgattttgggtatacaagtttccaaacttgcataataattgctaacgcactaggcgatatctagggccagtctgttaaaggggacctctaatgtagctataagacaggttggtaaagatgaactaacataagtttaagctaataattcagtagttgatgcagtatttcacagtagagcccgagcttactcatttttttcaaaatttggatcctgatactcctttttcagagttcagaactgaactgctcccctaagacctcagaatcttttgcattgagacatatgatctatttataaataaaggttatcaaatatcttgttgaactaattaggttgatcaaattaggatcccaaatattggggtccctgacatctgagcctttatctaaaaatgtttctgtaacataatgacagcctttatgtttgttaattgcctatagtaaagaagcaattttaagcctattctcatttccctctcccctacaaaaaatgataaaagctttccaattactta

SEQ ID NO: 685987 - DNA, 107 bp, Homo sapiens
agtcggccctgtgaatccgctggtgcgtgtgaggtgtgacctgcggttaaaagcctttagtgatagggcagacctcattcgccacttcagcatccaggtgctcaatg

SEQ ID NO: 685988 - DNA, 848 bp, Homo sapiens
  misc_feature (9)..(11): n is a, c, g, or t
  misc_feature (473)..(473): n is a, c, g, or t
  misc_feature (656)..(656): n is a, c, g, or t
  misc_feature (792)..(792): n is a, c, g, or t
  misc_feature (810)..(810): n is a, c, g, or t
ggcggggannncaatatacgctaggcgaggctggtgttaatcggccgagggcagcgcgccgaacccggccgacgggacccctaaagttctgcttctgtcggggcagcccgcctccgccgccggagccccggccgggccaggccctgccgctcatggtgccagcccagagaggggccagcccggaggcagcgagcggggggctgccccaggcgcggcaagcgacagcgcctcacgcacctgagccccgaggagaaggcgctgaggaggaaacggaagaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttgggggatggatgccctggttgcntgaagaggaggcggaagccaaggggaatgaagtgaggccagtggccgggtctgctgagtccgcagcacgtcagactacgtgcacctctgcagctggtgcaggcccagttgtcacccctccagaagatctccccagtggattctggcggtattgactcttcagattcagagtctgatatcctgntgggcattctggacaattggacccagtcatgttcttcaaagtgccctttcccagagcctgcagcttggaaggagctcccagaggtttacccagaagggcccagttcttacaggctcctttctctgtcagtgggggncgtcacagccaagtgggngccttaatgaactaattcgttttgacgccatttttcca

SEQ ID NO: 685989 - DNA, 109 bp, Homo sapiens
gcggccgcctactactactactactgctcgaattcaagcttctaacgatgtacggggacatgctgctgccctccagcttgggcaataaagcaagactctgtcctaaaaa

SEQ ID NO: 685990 - DNA, 112 bp, Homo sapiens
aaaaagaacaaaatataagctcaaattgaccaaacagacctatagtgaagccaaataacaattcaaatgcacgacactttacaacgtcattaaacggcaaaaccttggagaa

SEQ ID NO: 685991 - DNA, 270 bp, Homo sapiens
tggccctgaggcgtttaatggccacgcaaagacttctccccgctgccgtcctcgtagaacaggcaggaggggagatgtcgttcagggcgcgcagagcgcagatgcccttaaagaggatgatgtactccaacaggcgcttcctgggagggtcgagcagcaccagctggtttacattgtccgtcatctcagcctctatggcactgggcgccctcgatgggctgtgtgcacttcttgttgtccagggccgggcccgtggccacctgttggtcc

SEQ ID NO: 685992 - DNA, 194 bp, Homo sapiens
actctagagtgatccccaggaatccacctggctgggaaaacatgtgaaaggtgttcagtcttcttagtatattggtaaaatgcaaattagaaccaaatgaggtaacattattcaagaattaacagtactaatgttgataaagatatggagcaatagtttatgctgtaatagtttatgctgtaatagtttatgct

SEQ ID NO: 685993 - DNA, 354 bp, Homo sapiens
  misc_feature (20)..(20): n is a, c, g, or t
  misc_feature (30)..(30): n is a, c, g, or t
  misc_feature (46)..(46): n is a, c, g, or t
  misc_feature (70)..(70): n is a, c, g, or t
  misc_feature (88)..(88): n is a, c, g, or t
  misc_feature (96)..(97): n is a, c, g, or t
  misc_feature (102)..(102): n is a, c, g, or t
  misc_feature (128)..(128): n is a, c, g, or t
  misc_feature (131)..(131): n is a, c, g, or t
ccttggtgctttttcccggngaacgtatgncgagaacccaaatagnccatcccctgagagagagaagtanaagtcacgcacatgctanagtcactnnagatngtattatctatcacttcatcagaaanatngaaatgtcatttcattcacatatcactgacaatttttttttctgatgaagtgattgttccccgctaagtgattgttccccgctacagtgattgtaccccgactaagtgattagttccccagctaagtgattgttccccgtctaagtgattgttcccctgctaagtgattgttccccgctaagtaattgttcccccgctaaactcattgtaccccgcttaagta

SEQ ID NO: 685994 - DNA, 793 bp, Homo sapiens
  misc_feature (124)..(124): n is a, c, g, or t
  misc_feature (525)..(525): n is a, c, g, or t
aaagcacatataaagaggcacgcagcttcctcctggcagctctcgggcagctgcccttggagcctgactgccatgctgtgaggaagcccaggtggcagcgaggcggccatgcagattgcagccnatggccctggcagaacctgacaaagtcagcaccagccactagacctgccagcaaggatgctctgagccgacgtccactccagctgtcgtctgactgcccacgagacaccctgagtgagcactgcccagctgagacccgtcaactccagaactgtgagaggcgatggttccacgacttcctggctgtagtcactgctgttgggcagctgtgggtgaccctgaagggacactctgataagggacatctgcctgcatgtgtgacctgagtcccagcctcagctttctcatgtgaaaaatcaggaccacggtagaccctaccttataaggcagctgcaagagtgaaatacaatggaaaatgtacacaagatagggtggctgttcgacgccctcttggttcttcanatctaaggcccatgtcaagtttaccatcattttgccatcatgatgagaaaagaaatgagaccagcctgaccaacatggagaaaccccatctctactaaaaatacaaaattagctgggcatggtggcactcgcctgtaatcccagctactggggaggctgaggcaggagaatcactcgaactcaggaggtggaggttgcagtgagccgagatcgcaccattgcactctggcctgggcaacaagaatgaagctctgtctcccaaaaaaaa

SEQ ID NO: 685995 - DNA, 457 bp, Homo sapiens
gagccctggtgctggcaccatggacactgaagttatccgtgaggcagactggacggggacctgtgctgctgcatgcatgatctgtgggtgggcgggcggcgcctgggagtggctcttgctcaggaattgataggaaccctaaaaactaggataccccctcctcggcccatgaggcacgcacagtgacttatgttaagacttcaccccttaatatatcatgcccacaggatgcgtcagtcatgatacagtggtcagcaggcgcacctccaccccaccgccgacgtgccctcgccatcgtggtcagacccccctcccgacacaacacgctgctggtctgtgtcagccatttgccaacgtgggaggctctgccagtgtcttccgggtgaacagtatttggattgcgcgcatgtacggtccgccatgggctgcaggcgcccattcctctggaccctgcaat

SEQ ID NO: 685996 - DNA, 124 bp, Homo sapiens
  misc_feature (86)..(86): n is a, c, g, or t
  misc_feature (101)..(101): n is a, c, g, or t
gacagtggcggccaggccgggactcggagcctgcaggcctgaaccagggtgatgctgaagatgatgaccaaaatacacgctacatnaagccgttttcctgngccaggcaccctttacttgccta

SEQ ID NO: 685997 - DNA, 144 bp, Homo sapiens
  misc_feature (1)..(1): n is a, c, g, or t
ntctaagattaatccaaatcatactgtatttacatgcacggtcagccaagatacaaattcaaaccatggtgcgttagacaatggtttgttccaacttaaattaaacagataatactcttattcacccccttggacatgtacaat

SEQ ID NO: 685998 - DNA, 691 bp, Homo sapiens
  misc_feature (691)..(691): n is a, c, g, or t
caagacctgaaactataaacatgctagaagaaactctagaataaactcttctagacattgacttgaacaaagaatttattactaagatctcaaaagcagatgtaacaataacaaaaatagacaaaaggaactcaaactaaaaagctcctgaaaatgagctttttaattaacacagtgaaaagaaaacctatgaaataagataaacgtttacaagtttcgcatgtgacaaagatctaatgtccagaatatacaaggaactcaaacagctcaacaaaaataaaacaagtaacctcattaaaaagcaagcaaagaacatgaacattaaaaaaaaagacactgaaggtcaatggtcaacaagtacgtaaaaggtgctcaacattgtcaatgatcagagaaatgccaattaaaaaccacaatgagataccaacttacaccatgccgaatggtattactaaaaagaagaaaaatgagctatcggcaaggatacagagaaaagataacatttatacactgtctgtgggaaagtaactttctacaatctctatggaaaacagtatggagatttcaaaatagactaaaaatagaacttccatttgattcagcattcccactacttggtatctacccaggggaaaataacttgttacataaaagaaaatacccatgctcacatgtttatcacaacactatn

SEQ ID NO: 685999 - DNA, 109 bp, Homo sapiens
  misc_feature (88)..(88): n is a, c, g, or t
  misc_feature (99)..(99): n is a, c, g, or t
ggccgtttgggccgggaagcgatgtagtagctgccaggctgtcccccgccctgcccggcccgagccccgaaaaaaaggtgccgtcccnggtgttttgangaagcagctc

SEQ ID NO: 686000 - DNA, 257 bp, Homo sapiens
gaaatttgggccattatttataatcagggtagcattaaaatggagaaaagaaatttttctgaaaaaatgcagtaagtgtaagccacatttgtaaagtttatgtgtatgaaagcttctggtaagatgttgaaatctattgtgcattcccaagagtttatgtttgttgtgttttatatgatctacaacgtataaaattgtgtatttttctttggttgtccctggtaacaaaaaagtattttaataaaaaattgaagtga

SEQ ID NO: 686001 - DNA, 431 bp, Homo sapiens
  misc_feature (5)..(5): n is a, c, g, or t
  misc_feature (21)..(21): n is a, c, g, or t
  misc_feature (114)..(114): n is a, c, g, or t
  misc_feature (119)..(119): n is a, c, g, or t
tccangaaatactgaaatgcnctggaaaaggcctggttgcagcatgcttgaaatctgggatgtggaagacccttccaatgcagctaaccctcccttatgtagcgtcctccttgngccgngattgtgccactgcactccagcctgggcgacaaatcaaagaccccgtctccaaaaaaaaaaaaaaaaaaaacttgattgggatccaaaatcatacaactatacactaaaatcagtgaatattaccttatgtaaattaaaaattaggaaatcaaaagaaaagcatacatataaaaaacagttttttctaagcatttctcatttgtagggtgtttgaattacgttgtatgttgtctcatttcacccccataacaaatctatgaaagaggtacttttatccccatgttaacgtgaataaacccaggtttggaaaa

SEQ ID NO: 686002 - DNA, 190 bp, Homo sapiens
gagcgccacgcgatcgatgcggtagaagacctgttggactcctgccatgcgctgatgaattagggcgttgaccgctataaacgcccctatccgatttccgcagaagaggagcgcctgcgccagaaggaacgcgaggagcacctgcagaaacagatcaacgacctgtggcgcaccatccccaagcgcgccg

SEQ ID NO: 686003 - DNA, 215 bp, Homo sapiens
cagttcctgcttctgaaagcatgtggatcagaggtccaaatatgcattacattctggagtgaaactcatgaagatctttggaagctgaacttgctgaggctaaagaattttcatccagcaggtaagatatcacagtgggaactaaaagagcaagtagctggactctgttgtgttcttcaccaagagcaaccagtgtttcaagaagcaggaactgg

SEQ ID NO: 686004 - DNA, 691 bp, Homo sapiens
  misc_feature (324)..(324): n is a, c, g, or t
  misc_feature (542)..(542): n is a, c, g, or t
tcaaggaatttgatgggaagagcctggtctcaggttaccaatggagggtctggagctgcctgaggatgaggaggagaagaagaagatggaatgagagcaagggtcatacacgttgtgagaagcctctgtcaagctcatgagaagaaatcttagataagaaggttgagaaggtgacatagtctcgcaatagacttgtgtcttcgaccttgctgctattgtgaccagctagccgtacggctggacagccgaactatggagcggatcatgaatagcccgaggcacttcgggacaactccaccagtgggctatagtgagtggccgaantagatgcgacctggtagatcagaccctgaccgaccccatatgtggagactgcgtgcggcagaatggctgaggagcgacgagaatgataaggcatgttaaggaccgtggtggtgctgctgtttgaaaccgccctgctatcttctggcttttcccttgaggatccccagatccactccaagccgtcatctatcgcatgatcaagcgtaggtctaggtatngatgaagatgcaagtggcagcagaggaacccaagtgctgctagttcctgtatgagatccccgcctctcgagggcgatgaggatgcgtctcgcgatggacagaagtcgattaggtgaggagttcatagttggaaaacttgtgcccttgtg

SEQ ID NO: 686005 - DNA, 1472 bp, Homo sapiens
  misc_feature (794)..(794): n is a, c, g, or t
gttgtttttatataaagtattcacccatttgtatcacaacaacatgattgttgttgttaaaaagaaaacaaactgataaagttgtttttataaaattaaaacagagaaattttttgtctttctcttacaatatgtttttttcccgcacatgtctttatgtcgtttttagcggtattatttttcccccccccacccacccctgtacatctcttgggtggtacccaccgagacgcccccccacacattgttgttgtggggttataaaccttgtcaacctccacaagaatccccacatcctggggccccccaccgagttgtgtttgctcctgttcaagaaaagaaaagattgtgctcttttgtaagaggaaaggtgggatatttaaaccccaccacctaattttagggtgtgtttaataagacgcttcttgcccccaccggttatataaataaaatatggccctccactacacccacctccgttatggtgatcacccctcgtcggagaggacaaccccccccgcctggtgtgaatatgtctccgcttgtgtgctcttaaaagccacgagtactctctgtgtaaaatatataaagtgtgtaaaagtatgtgttctcttattcccacacagtgaaatattgtcgccccgcgagtgtgtacccaccacaagacacaccccactactgtgtgtgtgtgtggttgaattatgtcccactattctgcttgttgttgttgtgtaacactgcacataatgtgtgtgtaaatagtgagataaatattgtgtaatacacactttctncttgagtaccacacacacacaggtgtgcccacataagtgtaacacacacgctgtttataatatctctcacacacagtgttctctgttgtataaaggagacactctcttgtatataaagtggtgaacacacaacagtgtcatcacgccacacatatcactctctcaatgatatagggggtggtgataaagaagagagaggatgatgatatagaaattgtgtggggagacaccacttgttttgtgtgtggcgccatatatagttagagtgtgagatgtgtgcgggtggtgagaaaaggagatatagaatatagatatataccacaaatagtagagagagatatgtgcgccgcgcgagatatgtgagagaagtataagagagagagctcaaaaggagatatgttttccttctcccacagtgtgttagtgagaactcggacacacttgtgtacttattgaacacctcaggcgttttatgaaaatagcctaggtgcccacataaatattttatatgccaccgtgttagtgatatttaatatccaccgtgccagcttgtatataatagttttcctggtacacccacttaatgaattttaaattcacccaaaaattgtctacaccagctcaccacgatttataaaatgaaactagcactcactttaaataaatttgataattttt

SEQ ID NO: 686006 - DNA, 203 bp, Homo sapiens
gaacaagagagatcaacaagattttgctaaggtttatactcatatactatattacctagctcaagtctaccagcatctggaatgtttcgagacggctgctcactatttgccatagtacactaaaacgccagctcgagcacaatgcctaccatcctatagagtgggctatcaatgctgtacctgtcacagtttacatcattagc

SEQ ID NO: 686007 - DNA, 468 bp, Homo sapiens
  misc_feature (4)..(4): n is a, c, g, or t
  misc_feature (18)..(18): n is a, c, g, or t
  misc_feature (35)..(35): n is a, c, g, or t
  misc_feature (88)..(88): n is a, c, g, or t
  misc_feature (183)..(183): n is a, c, g, or t
  misc_feature (282)..(285): n is a, c, g, or t
  misc_feature (298)..(298): n is a, c, g, or t
  misc_feature (435)..(435): n is a, c, g, or t
tcantggtgcccagatgnctgtggttgttggtcancctcttggataacaaccctctttccgctttgcccaccccttaacataaaaagnccctgaaatatgttttgacttaagacagcaccttaggatactagtccaccatcttctcagattactggctctccagataaacctgctttcttacncgccatcgctcctctcctgtgtttggcttttgacaggtgagcagctgaacctgggtttgatgacaacatcgagggtcactgatcacagatcaccatgannnntataataataatnaaaactttgaaattttgcaaggattataaaaatgtgacacccaaaccgaaagtgagcacatatgttggaaaatatttgaagaacatctaaatatattaatagaataaaaaatctataatccaaaacagcataattanaaaataatagacatttttaataaaaattataaa

SEQ ID NO: 686008 - DNA, 138 bp, Homo sapiens
ttccggaactatgctgaactactataaggagcagaaggtctggtggaggggcgctcaacaacctgcgtgagagccctcatagcagttcagcaagccacggaagctggtcaacactatcaacccgggagcccgctatca

SEQ ID NO: 686009 - DNA, 775 bp, Homo sapiens
gaaaacgctgggtcagcagcaagctgtagtttttaaaaatgtttttagttaaacgttgaggagaaaaaaaaaaaaggcttttcccccaaagtatcatgtgtgaacctacaacaccctgacctctttctctcctcctggatggtatgaataaccctgagatcacctcttagaacgggttttaacctttagctgcagcggcttacgcttgccacgtgtgtatatatattgacggttgtacatttggcacataccctgtggatccccacagttgggtcctcctccaagttaccccttttatagtatgacgagttaacaagttgggtgacctgcacaaaggcgagacacagctattataatctctggccagattatcgcccctctgggtgcgatgctgtacagggtctctgtaaaaaggtccttgctggtctcagacagccaatcacatttatagttaatttttttcggggtattaggtataggtttggtattactttctaatcgaggtgtgaaaaagttctaggttcagttgaagttctgatgaagaaacacaatggagatttttccagtgataaactctggcatattggtatttcaagcaatggtagctaaaactggatgtaaattcctcctttttttgccttttggggcttaatgaatatcatttatgcagtattgacatcttgatacctatagttgttcccaggttgttaaggacattacgtggtacattgacacttctggcacaaagaaacagaacaaacaacaaaaaaaagtt

SEQ ID NO: 686010 - DNA, 186 bp, Homo sapiens
  misc_feature (19)..(19): n is a, c, g, or t
  misc_feature (92)..(92): n is a, c, g, or t
gggctcatgtgatctctcnactctgcctcacaagtagctgggactataggtgcacaccacgatgcatgctggctaatgtttctgtattttcntgtagagatgggggcctcactatattgcccaggttgttgtcaaactcctgggctcaaatgatccacctgcctaggccccctagagtgctgaaga

SEQ ID NO: 686011 - DNA, 116 bp, Homo sapiens
cttagaggatcccgtcatctccccctcctccagaggctgaggccctcagcagcagcccctgctgctcatccgcggacccctggagtatgtgccatctgccaaagtggaggtggtgg

SEQ ID NO: 686012 - DNA, 400 bp, Homo sapiens
tattaaactaagggcttaattttaaaggattatgttgccctcctataggggataaaaatggataattgcccattggttggaaccattatttttttttaaatgaaagggtaagaatgccttctgattcccccaatttggtatccaaccggttccctatccccttttttgatggagcataaaaattgtcccgggttgagttataactgcccgtagatggccagtccccagtgacccccttttcaggtgcccatcttttgctcctattaaaaaccccctcccaaaacttaggttttggatctaatctctgattattaaaatgtttataaagtttttttttccccaaaagatgccattccttttgagaaaggattgcctaataaattttgttttttacccttta

SEQ ID NO: 686013 - DNA, 406 bp, Homo sapiens
aggctggaaaccgcagcccagctcgccccctgcaccccgacaatgaagctaccaagcggccttcatctgttagagcccctcccctcggggtcaccccatattctggtatttccctccccaaaagaccttatgggaaccctccctcctgctcaccaagcttttgacagaagagtcgactatcaggaaaaacagagagaccttgaaataggcataaggaaaaaaccctttgctcaacctaaggagtctaagcagccatccaggtcctctccacctttgctctttgctgttcattgttcacagctcgaaatcgtaggaagctcaatgtgcctgcccagtgggatgtgattattactgtggattttgaccttttgccagtttgaatctatttgcaatttgtcttagcaaa

SEQ ID NO: 686014 - DNA, 203 bp, Homo sapiens
atgctcttatacaaccatgatcattaagggtggaatatatgaactcgtgactgtatagcaatttgcagtaataaatatagtaatttatttttaattgtttcatgtctatattataattataatgatttgctagatataatagtcttatattacaatattacaatgatttgctagaaaaatgttatttacattttttttccaaa

SEQ ID NO: 686015 - DNA, 242 bp, Homo sapiens
  misc_feature (52)..(52): n is a, c, g, or t
  misc_feature (72)..(72): n is a, c, g, or t
  misc_feature (77)..(77): n is a, c, g, or t
  misc_feature (102)..(102): n is a, c, g, or t
  misc_feature (105)..(105): n is a, c, g, or t
  misc_feature (136)..(136): n is a, c, g, or t
  misc_feature (143)..(144): n is a, c, g, or t
  misc_feature (164)..(164): n is a, c, g, or t
  misc_feature (176)..(176): n is a, c, g, or t
  misc_feature (183)..(184): n is a, c, g, or t
  misc_feature (189)..(190): n is a, c, g, or t
  misc_feature (214)..(214): n is a, c, g, or t
ttgctttatttggtgttttatacaagtaactaaaataaatagaataacaaangcagctacatggcccaaatntcccngcttcctcaggctgctgtctaggangantaaccccggggtaccgctgacaaaccccaancctgcanngggcagggctgtgggtaacngggggggggggncgcgttnnggggnnggggggggcccaggtgggtggggnttcttcatagtggaagaggaaatgccta

SEQ ID NO: 686016 - DNA, 224 bp, Homo sapiens
gtggaagatacgttagtctccaagctccactggagcctccacaactggttgccagtcactattcatgagctctggacagaaagatgcccctttcgccaggctggtggcttgatgggtgtacctcgagagggggtttggctccctgcccaagatgcctccagccctgccaggccccctccagcggaaggcctcatatgtctgtagtgtcgagtgtcttcaagagc

SEQ ID NO: 686017 - DNA, 528 bp, Homo sapiens
atgggcgacattcaaccttaaaaagagacgctgcttcgccgggcacagtggctctcacctgtaatcccagcactttgttaggccgaggcgggcggatcacgaggtcaggagatcgagaccatcctggctaacacggtgaaaccctatctctactgaaaatacaaaaaattagccaggcgtggtggcgggcacctgcaatcccagctactcgggaggctgaggcaggagaatggcgtgaacccaggaggtggagctggcagtgagccgagattgcaccactgcactctagcctgggcgacagagtgacactccatcctaaaaaaaaaaaaaaaaaattttattatttacccacacacaaccccctaagccaggtgtagcactgcggtcctcagggttgggggaggctaaataagtttggaggcttcagggcaaatgagtccctctggagggctacctactagcagtaacggtcaggcacaggaggaggatacagtctatgctgtgcataaggaattcagaagtccagga

SEQ ID NO: 686018 - DNA, 904 bp, Homo sapiens
  misc_feature (820)..(820): n is a, c, g, or t
gtaaaattttttgcagccaaaataaaaggcctctgtcgccctaatttgcccccccctttgtaacaccccccccttttaaaaaacgagagttttttgaagaaaaccccgctcctgtgggagccacacacgacctcctgcaatatcttaatcctgtctcccagcttttcgctgtaacccctccgccgctatattcttcctgggtcgccatatcaacatgtgtcaatcagaaagctcccacccccggctcacgaaataaaatttcctccttgagtcaaccccccctccttttccccccgccaattttttcttcgccccacataccatttccgcacactccgcatgggttgtatcctccaaacagaggctcttccgagggtcattattcgtgacagtccgccaatccactttcgcactaaatcgtgtctatggtgcggcaccacaccctggcgcctcatctattctgttgtatgctttggaatactacgcccccgggagtggtctatatctggtgctggcatccttgcccacacccaccttgttaacttgtgtgcaccactgacaacatttaggcgagccaggcaacacatgctcttgataaagattagaaagttgtgctatcttcttctcgccccccactaagagggtcaaggcggaggatttctccgcacatacagacaggcaagacggcagggcgcgcacccccctgcgacaagaatccttggtttgcatatgacagaacatttcgctggtcttctggaacgccgggcactttgtagcaaggtggaaggcattcgcccccctcaggaaaatatcggacatnctgtcgcagctttccctaccagagagacagagcaacgtcggacctataaaaaatagaaaaaaaaaacaaacacccataaacaca

SEQ ID NO: 686019 - DNA, 423 bp, Homo sapiens
acatcactttgatgtggctatagggctgcaaactgctgaacatgatcgcttccacctgacgtcaagagattgtaatatagccagcttagttaagccattaaagcagaagtgcttcatttactcttctctctaggaaacgaccagtcatctccatgttccttcatgctatggccccctgtgttctgttgtttttgctttagcgcaatccctttatcgtatttgcatcttctctcttctgatgcccaccatacccatcaatctcggcccagggcgacataccacgttctctgtagtctctgtgagaaggcttggtgcatcaaactcccattgcttgagaagaggctcatccaagccccagtgctccaccctgcagtcgtaaacgtcctcagttgagggcaggaaggggagatagtggaacttgcg

SEQ ID NO: 686020 - DNA, 123 bp, Homo sapiens
ccggtacccttattgttgaatcttgaactattcttaatgaatggtgagccaaggagccccagtgtggagagagaactactgcactaaatagtgagttttgttctacttccagtgtggagagag

SEQ ID NO: 686021 - DNA, 262 bp, Homo sapiens
gttgtaagtgatcaaagcacagtaagtcagcatatccatcacctcagatgtttatcatttctttgtgtttgggaacattcagaattctctcttctagctttttgaaaatatacaatcagattagtagttaagtatatttaccttgcaaatactgcagagcactagaacttattgatgctgcaattttgtaatcaacactcaccctactacctactcctcccacctaaccttacccagacaagtcagaggtaccgaaggctcg

SEQ ID NO: 686022 - DNA, 858 bp, Homo sapiens
agcgggggggaattcaaacgtgtatgcggaaaggagttgggttccatcttttcatttccccagcgcagctttctgtagaaatggaatccgaggatttaagtggcagagaattgacaattgattccataatgaacaaagtgagagacattaaaaataagtttaaaaatgaagaccttactgatgaactaagcttgaataaaatttctgctgatactacagataacacggggaacaggttaagccagaaatatagatagataggcaaacaacccagaggactaggttgagtattggttgctacaaactaagagaaaaacaagtgttccgctaagtggatagctacttttaaatacaattgatatggtcgtatacagtcaagcaacttgaaggcggcttcccccagattaaataatggccaaaatgagagtattgggctaagaatacaagtagagattggcaagaatataaaaggcaaatcaagagccagacagaaagcacgtagactaactaaacaaataggccgagagcaaactagcaagaaataaaagcttttgagttcatagaaaaacgaagggacacagagaataaatcaagacacaaagagaagagacaggaaacaaggaaagacgaatctaactagtcaagaacaggccaagtaggaaacggaagagaatcaatgtaacccagcgaaagaaacatgaaacgaaaggaacggatgagctcccgagcaggagagaaaagataggctatccaaatataaaaaggcaagttaagcaagccaataattaaagacgaagatagcaacaacatataaaccagtcctaacgaacgttgaagaaaaactaaaccccaaagaat

SEQ ID NO: 686023 - DNA, 964 bp, Homo sapiens
  misc_feature (20)..(20): n is a, c, g, or t
  misc_feature (182)..(182): n is a, c, g, or t
  misc_feature (274)..(274): n is a, c, g, or t
  misc_feature (350)..(350): n is a, c, g, or t
  misc_feature (456)..(456): n is a, c, g, or t
  misc_feature (473)..(473): n is a, c, g, or t
  misc_feature (541)..(541): n is a, c, g, or t
  misc_feature (585)..(585): n is a, c, g, or t
  misc_feature (647)..(647): n is a, c, g, or t
  misc_feature (691)..(691): n is a, c, g, or t
  misc_feature (697)..(697): n is a, c, g, or t
  misc_feature (708)..(708): n is a, c, g, or t
  misc_feature (710)..(710): n is a, c, g, or t
  misc_feature (712)..(712): n is a, c, g, or t
  misc_feature (717)..(718): n is a, c, g, or t
  misc_feature (720)..(720): n is a, c, g, or t
  misc_feature (766)..(766): n is a, c, g, or t
  misc_feature (792)..(792): n is a, c, g, or t
  misc_feature (804)..(804): n is a, c, g, or t
  misc_feature (807)..(807): n is a, c, g, or t
  misc_feature (813)..(813): n is a, c, g, or t
  misc_feature (815)..(815): n is a, c, g, or t
  misc_feature (817)..(817): n is a, c, g, or t
  misc_feature (843)..(843): n is a, c, g, or t
  misc_feature (858)..(858): n is a, c, g, or t
  misc_feature (882)..(882): n is a, c, g, or t
  misc_feature (930)..(930): n is a, c, g, or t
attaacaagcatcacatatntaagcataccggtggtctactctcctcaaattcagttggaggcataaaaacatgcagaaaagcccccagccctactttcctagcatgcagcacccacatagagcaggtatatttacaaggttaccatgcaagagtttctggcttgtcttccatcaccctgcntttcctctatcacctccttccttctatcttttatccagttaaaatgaaaacatctccactaagaggacttcctagtatagaaatggcaagtntgttctatctaccaatttgctactagcaccaccattacctatttacatgccctttgcatttgtggccaactgatcnacagcattgtgccttagtgtattcaagaaacttggaattggcagttgagatgattatttgccatccccaacctagagatgatcatttactgagttccttctatatnggaggagagttaaagtnagatggccacagccggcagtttgattttcttagaggagatgctgagatcagcaaagtcattctgagtnctaaatcgggttctgaggtcctcctcccaggtgtctagaatgtncctcaggcctgggaacaaactctctgggacactaaaagaatagagcaggattgggggtaganctagcaaccatgagaaccgggcagtgaatactcgtagtggagtnagagcnaagcagttgtnancnaaatnnancaggtgacaggtatagggaacaggatagcccaggaggatcccaaanacagttcacagattccagtttgaggnatggagcctgcngtnggagantncnagagaaaagtccctctccagcccctnaaaatgtgtaaaganctaagccacgagggcctaaaagtnctgaagcggggtcagggagcagaaagaagggtgaagccggcagccggnaaaatccacaaaggctatggtaacaagccgcccc

SEQ ID NO: 686024 - DNA, 367 bp, Homo sapiens
agtacagaacctttcatatactatgtttttccctagccatacatacctaagagaaagtttaatttataaatcaagcacaggccaggtgtggtggctcacgcctgtaatcccaacactttgggaggccgaggcgggtggatcatctgaggttaggagtttgagaccagcctggccaacatggtgaaaccctatctctacttaaatacaaaaattagccagccgtggtggcgggcatctgtaatcccagctactcaggaggctgaggcaggagaatagcttgaacctgggaggcagaggttgcagtgagccaagatcacgccactgcactccagcctgggtgacagagcgagactccatctcaagagag

SEQ ID NO: 686025 - DNA, 297 bp, Homo sapiens
accccagctcaggatactcctgcaatagccatcgctgtagtatatccaaagataaccatcattccccctaaataaattaaaaaaactattaaaacccatataacctctcccctaaattcagaataataacacacccgaacacaccgactaagaatcaatactaaacccccataccaataggataaggcttagaatgaaaaccccacgaacctcataaataaccacagcggagatcatctacaatagtcctgctggcggtatgcctcgttggagtgcgcggcgttacacaagtaagcg

SEQ ID NO: 686026 - DNA, 817 bp, Homo sapiens
aacaggctggttccctcggatccaggaccccctggttcccaggctatggcccccagtgccctgtagatctggcaggccccccgtgcttgcgagccctattggggggtctgggtggctactggagggccttgtggagtgggcatgagaaaggcaggaccatgaatctagggcctctgaactttctccggggcgcaggtgacggatggcatcatcattgtgggcgatgagatccttaagggacacactcaggagcaccaaacacctgtctttctgtgccggacacgtgagcgttccctatgggtccaggtttgccgagtgctcagttggtacgtgatgaggtagccaccattgcagactgaggtcacttctttcatccaaccgcttcacccatgtcctcacagcagggggcatcggccccactcatgatgatgtgaccttgtgaggcagttggcacaggcctttggagatgagctgaagccacaccccaagttggaagcaggcaccaaagccctaggaggggaaggctgggagaagctatcattggtgccctcctcctgcccgccctgcattatggcacaagatccttgccgcttggtcaacctttcagattccctctggtctccgtccgaaagtctagctcttcccaggcattccagagctgctgcgggagggtggtgggaggggatgaagggactattcaaaacccaagtgttccagttacatccacaggagctatatgtggtgctgtgaagctccacgcccccttctggatgaggccaagcccctttgcagtggttgggctggtctaactgatggg

SEQ ID NO: 686027 - DNA, 859 bp, Homo sapiens
  misc_feature (565)..(566): n is a, c, g, or t
  misc_feature (569)..(569): n is a, c, g, or t
  misc_feature (573)..(573): n is a, c, g, or t
  misc_feature (575)..(575): n is a, c, g, or t
  misc_feature (577)..(579): n is a, c, g, or t
  misc_feature (585)..(585): n is a, c, g, or t
  misc_feature (587)..(588): n is a, c, g, or t
  misc_feature (590)..(590): n is a, c, g, or t
tcatggaggtttgaagatgccgcatttggattggatgaattccaaattcggcttgctggctttttaatagtgatatgcttatacacttacacctccccaccaaaatgtagggttataataatgttaacatggacatgatcttcatttatacccactctcctctttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttgtnngantaananannnaaaagncnntnaaaaaaaacacttgtggccccttttgcccaaatcgtctttaaacttgggcaagttttagtatatggggcccaatttgaggtctcttgggcaatattccctctatggggaggctttaacacattcatggcccgggttttaaacaccttggaatttggaaaaacctggggtttcccacaattaaacccctttgggaaaaaaccccttttttccaaggtggggaaaaatgaaaaagggccctcaccatgggccttttacatgggccctgggc

SEQ ID NO: 686028 - DNA, 849 bp, Homo sapiens
caaccatcatgaatgctgatattctagcatagtgtctgcaaggaaggcatggtgcatatattgagcttcttctatcttctagtcatcttttttactgacctatatggcgatgatctatgttttatggtgcagctcttcagcaacataagcgacgacagtaagaattgtgtcccagttcaagtgcgatgctaaaagagccaccaaatagaagggattctatccagcaaggatccgtgtccaaagagtaagcctgtggaatctgatcagaatacgtctctaaaaaatgactcctctattcttttacatgtttccacattttggcttgtggaacagactgtttacagtactgttatacttcacgactaacatgattgtaatagtggtattacgtatgaaatataatagtagaagaactggttcacactctggtgtcgttgacgcggttagaacttgcgactatcttaatggaacagccataatcctcctgattgactcgcattattttactgacggtcctagtacattggcagcttgagttacactagggaactagtaggggctcattatggtctcattgaagaccggcatctaagtctataaattaaggcagtagatatcacggtgcattctgatgaagtgaaaatgtgtatctgattagtgggaaacttcatgggttactcatagtgtcatgtcgtatgataagtctttggctaccttgtccagccttaataaagggaggatctgcgccttcgcgtgatattatgcctgtatatttgcatgattgcaaagaaaaccatattcatcaatataagccaaattggtgtagtaccaagctaagaagtgacttta

SEQ ID NO: 686029 - DNA, 815 bp, Homo sapiens
tcatggaggtttgaagatgccgcatttggattggatgaattccaaattcggcttgctggctttttaatagtgatatgcttatacacttacacctccccaccaaaatgtagggttataataatgttaacatggacatgatcttcatttatacccactctcctctttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctattagacaggcatggtggtgcatccattgttttcccagcttctgggcaggcgagaggctcaaggaaacagctgaagcgggaggtgagaggttgccgtgagccaggatcacaccagtgcatcccaggactcgcggaagagcaagacgggggcgacaccaccacaataaaaagggcccggggtaacgcgaggctttcggaaaatcccagatggatcggggcggactaacgggtcttgcaccaggggcccaggagtcggaaaaaacagccgccgggg

SEQ ID NO: 686030 - DNA, 155 bp, Homo sapiens
  misc_feature (7)..(7): n is a, c, g, or t
gtagtantccagagggtgatagggggagtcctaacaggagctgtgatcagtgtgccagcagttcacggagatgtctaggtccggacgatgtagtggtacctgcctgccatcaaggactcccaagtgaggtggatacttgggagggagcagccagg

SEQ ID NO: 686031 - DNA, 811 bp, Homo sapiens
tggagaatgatttaacaacatggaaagagtgctttacgaatgtatcatttaggagacaagattgtatctatccaagatatgcatcctggcattatcactagtatttaccatagaattctgggtgcaggcagtcagcacagagtacattgaagtcactaggcgaaccgctgaacctgcagagatccacccaagaggtcgggagtgtcagatggcaccatcgcggctcaccggtctacctccacctcctggcgttacaagcgattctcctgtcctcagcatccccgaggatagctgggattacaggtgcccaccaccacgcctagctaatttgtgtatttttagtagagacgggtttcaccatgctggcctcgaactcctgacttcaggtgatccacctgtcctcggcctgcctcaaagtgccgggatttactggggatagccagccaccatgtcataaggacaaatgcagacccctgaggagaaccaatcccttggggaggaactcggcccccagtcagcagccaatactcaacttgcctcatgtgtagaagttatgtcatcacctatgaaataggatctgttgtcccagccaagccttcagatgagacgcacagctctggccaacaccagatctcgcagcctcatgagacgatcccagagaagccatcctgttgagtctctgcttgaacttcttggcccactagaaattgctagtgatagtaaattattcttgttttctaaaccactaagttgtaggttaatttattacacagcaggaatgataacttttcactgggactattgtggtcaa

SEQ ID NO: 686032 - DNA, 229 bp, Homo sapiens
cgtcgacatcgacacaaaatatctatgttttgttccacgagccactttgttatcacttttgcctcatggcaaggtgctccattatgctggaaaaggcattgttcgtcaccaaactgttcctggatggttgggagaagttgctctcggaggatgtgttggtaccattctttattcatggctttgttcttaggcaaaattgtgagtgagcccactcccttggcgtcgacgc

SEQ ID NO: 686033 - DNA, 928 bp, Homo sapiens
tgctgtagcagccactagcccgtgctggtgttcctaatcgcacagtgcagctgcgtacccgtgctagtctgggagctctcgtgtgtatatattgtcctgccctgttgatcacgcgcgctttttcatcccaatgtcgttcgagtggcggtaaatttgccctcttcgcggttatgtgttctctccttttggggtggtggcaccccccccccgggggtggtttcccgaagcgtccccgcctccatgtttctggggttcagcctcctaacggtctgggtgaaagaaccccgctcgtccgtcccttgagaaaatgccaagggtttgttcaaactaacagaggggatgcgggttctttataagggcccccaagggtggctaacccgccccccccccggtgagaagactgttggcctgcaaccgccgcgattgacagatgtggtgcaccagccccaacaccggaggaaatgcctgtccccacatggggccccccgacaagtgctccttgggtgctctggcaacgcacaaacaagtcaatccttggttgccggcaacaatggaagagcgaaatgtgtgccaggccgccatcgagtgcaaggccccccctcctttcgcatggccggccaagttgctcgcgcgaacagggcgaagaggccgattttctgaaaaaaaaggtaaaccccctcgttggcccccacaaaagcgaaatagggggccacgatgctcagaaaaacagagcgcgtcacccagaggatggtcccgaaaagacatacaatggcgagcaccatcccataagacacaacgggtggtcccgctaggctgggcacccccggggctgcgtaattgtccgcccaggcggcgagtccacacggcaaaaaccacgcatcaattccgttctgccccagaaacgaacatcccccgccccacatgacgc

SEQ ID NO: 686034 - DNA, 2665 bp, Homo sapiens
gcaggggcacacatcggggcacacacgacacatacgcacaaatctcatcattctctcccatttctgcacagcattttagaaaatgtaataaaggtatagaagcccccacattgtgccatggaagcaacatgtatttaaaactcttgatttctggcttagaattcagtttatgcctcagtaacgtctcctgcatacacataaataggtaagtgtaaacttttcaaaagtgggccattttgcaatgtgggagccaagtatagtgatctaggggattctgaagttatatccattgttgctatgggaactaataccccttttctttgactcctgcctaacccaagttctgtgtttctcttaaccaggtttccatctctatcacaagttgcccacgattgtgccggagagctgtcttctcataatggttgggcttctactaggtgggattatcttcggtgtcgatgagaagtctcctcctgcaatgaaaacggatgtatttttcctatacctcctgccacccattgttctggatgctggctacttcatgcctactcgacctttctttgagaacttgggcaccattttctggtatgctgtggtaggcacactgtggaattccattggcattgggctgtctttgttcggcatctgccagattgaggcgtttggcctcagcgacatcaccttgctccagaacctgctcttcggcagcctgatctcagctgtggaccctgtggctgtgcttgctgtctttgagaacattcatgtcaatgaacagctctatatcctggtttttggcgagtctctgctcaacgatgcagtcacagtggtcctgtacaacttgttcaaatccttctgccagatgaagaccatccagaccgtagacgtgtttgctggcatcgctaacttcttcgtagtggggattggcggggtgctgattggtatcctgctgggattcatagcagcgttcaccacccgtttcacacacaacatccgggtcattgagccgctctttgtcttcctgtacagctacttgtcctacatcactgctgaaatgttccacctttcaggcatcatggcgatcacagcctgtgccatgacgatgaacaagtatgtggaagagaacgtgtcccagaagtcctacacgaccatcaagtacttcatgaagatgctgagcagcgtgagtgagaccctcatcttcatcttcatgggcgtgtccaccgttgggaagaaccatgagtggaactgggctttcgtctgcttcaccctggccttctgcctgatctggcgagcactgggtgtctttgtcctgactcaggtgattaattggttccggaccatcccactgaccttcaaggaccagttcatcattgcctatggagggctccgcggggccatctgctttgcactggtgttcctcctccctgctactgtgtttccccgaaagaagctgttcatcacagctgccatcgtcgttatattcttcactgtcttcatcctgggaataaccatccggccactggtggaatttcttgatgttaagagatccaataagaagcagcaagctgtcagtgaagagatccactggtgtcggttttttgatcatgtgaagactgggattgaagatgtttgtggacactggggtcacaacttctggagagacaagtttaagaaatttgatgacaaataccttcggaagcttctgattcgggaaaaccaacccaagtctagcattgtgtccttatataaaaagcttgaaataaaacatgccatagagatggcagagacagggatgataagcactgtcccctcatttgcatctctcaacgactgccgtgaagagaaaataaggaagctcacgccaggagaaatggatgaaattagagagatattgtcaaggaattctctatcaaatccgccagcgaccttgtcctacaacagacacaacctgacggcagacacaagtgagaggcaagctaaggagatcttgattcgccgacggcacagtcttcgggaaagtcttaggaaggacaacagcttaaaccgcgagcgcagggcttctacttcaacctcccgatatttatccttacctaaaaacacaaagcttcccgagaagttgcagaagaagaataaggtttcaaatgcagatggtaatagcagcgactcggacatggatggaaccactgtactcaatttgcagcccagggccaggcgcttcttgccagatcagttctcaaagaaagcctcaccagcctacaaaatggaatggaagaatgaggtggacgtgggttctgcgcgaccgccccccagcgtcactccagcgcctcgcagtaaagaggggggcacccagacaccaggggtcttgaggcagcccctgctctccaaagaccaacggtttggccggggcagggaagacagtttgactgaagatgttccacccaagcccccaccaaggttggtgcgacgagcatcagaacccggaaataggaaaggccgccttggcaacgaaaagccatgatatgaagccaaagcagacttgtggtgaatgggcaagcatggttgtgacttgttactcaaacccaatcgaccgtggaatccacttaaagtcctctatccagaggcattctttgggaagtagagtcaagccactgattcatgggaggagcgc

SEQ ID NO: 686035 - DNA, 297 bp, Homo sapiens
gagtggcattaatcacggtgtaaagacatgccagtggtggtgattactggggaatcttgaacccgggtgagtacggcgtgactggccacgcgtggggctacaccccgagtgccaagacctgcaatgttgactatgatagtcggtgccacgtcagtgcaatttcatcctggctcgttccaattggaatcgcatccgggagatcgtggccatgaacgggaaccggcctatcccacacatagacccatcgcgccctatgaccccccaagagcgactgacaggccaagagcgactgacagg

SEQ ID NO: 686036 - DNA, 567 bp, Homo sapiens
tacaactatagctaaaatttccacatatagcgcacgaggagatgaagcgaggtataggttagcctttgttcgcttgagacagttccaaagcgaacgtggttactataaactacaggcaggcaaactgttcagactgagctataacatagtgtactaaatttcagtctcaaagttgtgctaattgctcatcattagtatggcacatttggtccatgatgtggtttactgccaagacagatcgcaatttgttacagaaacacatagattactgttgcttttggtttgtaagtacatatattgttagaaagccaggtatacttccacatacaaaggcaggtttcccaggagaaatttataggaagtagtctggggtgcgccgtgtaacatgaggctcaccacgacgaggcgctgggtcaaattgaaggaaggaatattttaaagtgtcatctaattccatgatagcagcctggttcccacaacgataacagtaattgggtgcactgaaaatggtaaccacattccgatcatgacaccaattgtatccctccattacaagctggtgggcac

SEQ ID NO: 686037 - DNA, 839 bp, Homo sapiens
  misc_feature (839)..(839): n is a, c, g, or t
ggcgcatgcattcacccacacagtatcgtatcaggcgagtatgaaatgtgtatcacctgtgcgcaagtatagtataagtaccgaaaggtcaaagatgagagaaattatatatcccaaagcatatagtactagcgatggatctaatgcccatagtacctgtctgctaatcaatggaaactttacatctcagacagaataatctctctggctgggaggacgaagcccgagtagctgagatgaacccacggatcatccacggaggtagcgtacctttatgaactagctccacacgcagtcgcgacgccccgtctaatgatttgcattgataagtggcgtagaggtagtgtattactgagcggtaaagagggggtccgaagcgaggaaccccatagctcgttacgggcctgtgggtgcactatgcgctggtgtgtgctgccatacgcatgtatgtacaatgctccatgtgttagcagaccttatcgtatgattgtctgggcctcacccgggaacctggcttcctacaatggcccccttgccctaagactctgtaaccacgtgcttcccgttttccccacataggaacgggggaggacccgatttccttccttccttttggcaactcccttcttaccggcgaaaaggacccaccagctctgtggtttacgcatggaacgcaccgttacacaatacaccaagttgttacgaactattgccccactttacgttcccggggcccttgagatgaggcccgccccggttgccacggcgcacattgttggacctggactacacggggccgaattttcagagggaccttttcccttttcaccccccgctan

SEQ ID NO: 686038 - DNA, 614 bp, Homo sapiens
  misc_feature (123)..(123): n is a, c, g, or t
agcggggctttgccggcctgtgggccaccagctgggggctccccgcttccagtccacctaccacacccacattcctgaccgccatcccgtcctgtctggttgctggttggacaccaggaactncgacagagccgcaacccactttcccagaggaaacctaaggcggccattccttcttccgctctttcgattggcctaggaagacaccgcccgctcataggggtcccacatttctccatcatcggtacttccggggtctccaacccgattgaatgcttctccctgtaaagggcctttaccttaaagtgggtttcccaaactgtgtttcccccgtgccacagttaacaagtttcctgcggcgtccctgggagcgttcctcccgagtgccacacgttccccttgtattcgtattacacatcccagcgtgcgcatctggttcccaggggggacactttttgcccgtccgttgaacgttggccccgcggtagccagcttagtttccctattccattattccttccgtcgccgccgcctttggtaaaccccgcgtgggccaccttttttcccggccccgggttaaacccgtttgtgtggttcgtttagcggtgcctcca

SEQ ID NO: 686039 - DNA, 303 bp, Homo sapiens
cacgagggttgttccaaacacttgtgctatcaattctacagatgatccacaggttatcttcaactctaattacattgatatacacagtaattcagacagtggatctacattcgtaaatgtaaatgaagattcggtccctgaaaacacttgcaaagaaagcttggttttgggccagaaacagtctacttgggttcctgaatcacaatctccaaactgtatgaactgccaagtcaaatttacttttaccaaacggcgataccattgccgaacatgtgggaaagtattttgtggagtctgttgtaa

SEQ ID NO: 686040 - DNA, 617 bp, Homo sapiens
ttgacatgaaacgtggtgcaatagatatagtaccgcaaggcgaaagattaaaaattatgaccaagcatatatatgcaaggcactatcccctataccttctgcatattgaattatctagaaataacttagcatggagagccatagctaagacccccgtaaatctagacgagctacctaagaacagctaagagagcacacccgtctatgttgcaaaatagtgggaagattctataggtagaggcgacgaacctaccgtagcctggttgatagctgtttgttgcaccatagaatcttacttcaactttaaatttgcccacagaaccctctaaatgcccttggtaaattccactgtaattccactgaggaactgctctttgagacactaggaaaaaaccttcaagagagagtaaaaaatttaacacccatagtaggcctaaaagcagccacacaattaagaaagcgttcaagctcaacacccactccaccttactaccagacaaccttaaccaaaccatttacccaaatcaagtataggcgatagaaactgaaacctggcgcaatagatatagtaccgcaagggaaagatgcaaagttataaccaagcataatatagcaag

SEQ ID NO: 686041 - DNA, 538 bp, Homo sapiens
atgaaatttggccacccgtgttatcgaagtaatacatgagaacttgtgttcactttcgtgccgtcactctcaatcgtcaggctctgcgtgtatagcttcacccggatcacggctgacctctggccaagctatggcatgcaggtgctccgggccaggatcacatggatcttcctcctttgcatgtccaggtctcgccgctgctgaaggtagacatagtctctgttggacatgggaaaagggtacttcacttcccagtagtccacagtcctgtaatctgagtccatatacatgtctgccagtaaagttggtcatcagtcctccataactccttagactttatactcatatagtccagtcttcttgtccagcagtcggtagatgttgatgtccaaggtctccactaggagctgccagtcggctctggccagaatggtctgctgaagctcgtcgcaggcctcgcagaactgctcctccgagtagcttgtgacgcccaactccatccttccacagttcgggctcctactcctgtagagcaggc

SEQ ID NO: 686042 - DNA, 963 bp, Homo sapiens
acatggatgggatggcaggccaacaatgatcctggatgatgggggagacttaacccactgggttaatacacgaagtatccaaaacgtgtgttagagatagaatcctgaggatgttgtggaaggagagcgtgactggatgttcacaggcgtgttagtcagactcctccaacatgctgggtaacggctcatgttgtttccgggtcatgaacgtctaattgtattcgtaggggactcaatacatgaagatggagtaaagctcgtgacgtgcatgactcggacggatccatggttgggtaatgggctgaaggtaggaatactacaatggatgttgatgattgtgggtcgtggaaaacaagtgtgatggttgtgtgacaatatgtgtgagggtgggcaaggggcctgcctgctgctgctctttatggattcttgtgccgcattcgtcgtacattgatcgtaaagtcgcatccccttctggcgctctggcgggcttgctggtattgcgtgtggcgggcgtggtggagctagttgaaggtcgttcggtccagtcgaggtcgttagagtcttgtccaggaggtagggatgtagtgtctctggtagctcttggctcgtttgataaacgctgttccagatggcaaggggggcacttccgccagagttcgtgtgacaggcgtccgtagtcctgagctaggcgtggggagacgaggttccgtctccggggggcactgggaactgggcactctgaaaaaggtggcctctgggagaggtctacaagcccattaggggggcacagggacaaattgggtggacacaagcacttcacggttgggctggtaaacttaataggccgggcggtgcaccgatggtttgtgttacaaagggaaagaggcgagagatggttaaccaaagggggagccgaaatgacaagaggaaagtatgcaacaagggaaaaaatcagaaatatac

SEQ ID NO: 686043 - DNA, 198 bp, Homo sapiens
ctcacagatctatccgcagcgcagaggaggagcgcagcccgttactcgaagaacttctgcttgtggtgtgctgaactacatgactctatgaaccctagagtcattgccatggcaaccaaaggaggtactgtcaaagctgcttcagtgattcaagtgccatgtgcagatgcccatgaccctgtagtgaaggccactgaa

SEQ ID NO: 686044 - DNA, 933 bp, Homo sapiens
  misc_feature (687)..(687): n is a, c, g, or t
gggcgaggtcggggccatggcgctgggcccggatcttcctgcttctggctggcatctgcccttgtgcacctccgggagctgtgctgagccccacagttcttcgttataacctcatcggtgctgtcctgggatggatctgtgcagtcagggtatcttgctgaggtacatctggatggtcagcccttcctgcgctagtgacaggcagaagatgcagggcaaagccgccagggacagccgggcagaagatgtcctgggaaataagacatgggacagagagaccagggacttgacagggaacggaaaggacctcggtgatgaccctggctcatatcaaggatcatgaaagaaggctgtgcagttccctcgcaggagattagggtctgtgagatccatgaagagaagcagcaccgaggagcgtcccagcagtttctagctacgatggggagcttcttcctctcccaaaaactggagactgaggaattggacagtggcccagtcctccagagctcagagcttggccatgaacgtcaggaatttcttgaaggaggatgcctgaagaccaagacaaaattatcagggtatggctgagactggcttgcaggaactacgggcgatatgctagaaatccgggagtaagaccggagagaagcagtgtcccccagggtgaatggtaccaggcggggaggnctccagggagaattccggtgactggaggttcagctcaaccccgggaatcatacgacggggcaggagggaacttggggcccaccagaatgggcgagtgcccgggaatgaaccacgcgcggggtcacagaagcgggagacaggacccagaacaggaacacaacggcgccgagggtacaagagagcagagggggcgggaatacaaaggaacacgaggcggacacgacactgaccgttgagacacgcagc

SEQ ID NO: 686045 - DNA, 912 bp, Homo sapiens
gggtttcacccgcaactcaagcagcgtatcaccacacgggtacgtgcgagcacatccccagagaccaattataatccgtcaccacgagcatgaacggatacggtctgccggaagtgtccaatggggcggtcccccaccttcctcaacggctcagctgccaaagtccccctatgccatagttgccatccagccccaccagtggcctccctccaaaagcctcccccttcaaagtgcagaccagtctcctcgggggcatcttctcctttctcaaccagacaaaagtggttctcaagcggtggacacacaacgaacgacgtggtttttcgcacccagtcgtcaggacccaagaacttgcgccaacttcccaacttggaaccagagcacccaagggggaaccagcgcctggcaaagcgactatcctggaatgaatgtgtccctcctattgtggaacgacaatggctttgacgactggtcatcccctcgccagacggctgactctggcaacaggacgaggaatctggtaccaagtcccagaagggatcctctacactccgaggcctttttaagcggcatcacccaacacgtgcacattttacacacaacaaattcaccgacctggcatactggaatcggccgacgcaccgcactgcaggggtggtaacgttgcccctcccaggtatgggggcacatctaatctggattgcagagccgacccctcgccgtccccataccacacgcaagcggacccttggctacaaacggaaggccacgaggccataccaaccccgggtactagcgcaccccgtggcagcaggcgcttacaggcaaacagccggaacgtgggcagcgcactcaacacgggcccacggcgaggaaaagccgacgtgggacgcaaacctgcgcggacacccc

SEQ ID NO: 686046 - DNA, 135 bp, Homo sapiens
tcagtcggtcctcacgccatgtccacaatgtgcgtgttttcagctgctggcacctggctcagggccgttggagggctggctgccgctggccgcaagggtctcttggcacctgtggtggctgcagccaggcggggg

SEQ ID NO: 686047 - DNA, 229 bp, Homo sapiens
atataatgataaaagaggcccccaaaagggtgatctttattagcctcgtcagtttgcccgtggtagtgagcgagaatttcgggattaatgtcactttgttggatctatatatcactggtcttcacagcaggagcttgatgaaactctcatcctcctgcccttgttgtctcttccagctcctggctttgccagacactgtaaagtcccaggccgtgagagctcacttgtc

SEQ ID NO: 686048 - DNA, 214 bp, Homo sapiens
ccggggcagatcatgaacaacaaacatttataggagctctagccaatataaggggcctctgggtaggcaatttaagatgcagagtttacttcttcaacttcctttattggttttacttttgattgttcaggatcttaaacaatagaccttttccagcaggaactggttagaaacaagcctatggtccaaaggtcagcaatgagggtatggattt

SEQ ID NO: 686049 - DNA, 318 bp, Homo sapiens
gtggggaacaataaggaagggtccccaggttggggagagccccaagttgagaacaataatgaacaattattgtatgaacaattgttagagacagctaatcacaaacaacctgcgggcacaatgacctcattccacacgtagcacccttcagcaggaccctataaaactctcctccagcccttgcctctttgcaggtagccccttctctgctgagctgcccactgcaacatattttcacactggatctagtaattatgcccttctttacctagaaatatcttggtgaatggctttaccacctgcaaaactgaccctagg

SEQ ID NO: 686050 - DNA, 113 bp, Homo sapiens
tttcgctctaagattaaaaatgccctagcccacttcttaccacatggcatccccaatactagtggtggcattcaatgtcgtcaggaataaatctgctgtaaaatcttcagtca

SEQ ID NO: 686051 - DNA, 112 bp, Homo sapiens
  misc_feature (59)..(59): n is a, c, g, or t
attcgagctcggcaccgtgttttttgcctacagccctagatcagcacactgctccttanctggcttgggttcttataattgttagaagcaaacctgggcatggtgcctattg

SEQ ID NO: 686052 - DNA, 139 bp, Homo sapiens
gatgcctctggggtcaagcggctctcctggtatagctcccgagtggctgggaccacaggcgcctgccaccaccacgtctgagtattttttttgatttttggtagagctaggtttcgccatgttggccaggctggtcttg

SEQ ID NO: 686053 - DNA, 1040 bp, Homo sapiens
ggggactaccccggggcttatcagtgttccctcaggtaacaagggttgtctttttcagatccaattggtttcttgcatacgtagtctggatttcatgagtcatctaatcttttaaaacatgaatgtcatcccaggcgatgcatcctactcttagtatgtcactgaattcgttatattaaaatatcgattggtttcatgttgtaaattactctttggtgtatccaacgttattgggttactggtgtccttttatctgagcttggattaattccacttttttgcataaatttatggggtttcgcggtaatcctaatggttcgttccagtaccaagtgtgaacagtacctgagtaagtcatcctgtataggttattttctcggggtctacgctttctccaagaattccatggatacggttggtttattgccgtgcacctaagtaatgccgcatcttacatcccataattttgccgctttgtagggcgcgttctgcccaagtctgtgagtgacccatttggtttcaggcccgttgttcggtactcccatatgttttctttgttaatgtaccgcgttctttcactgatgagtacgatgtttctgtgaagcactttgcctgaggtgtcaaattgtcatgctcttcttagccgtttttctttctactaaaatgtgttaaatgatgctaaatttattgtttgttgtggtgtctttagcaaagtttttctatcaatttttcccccatcccatccccacgctggactcattttgagaagacttgagagaggtcttagatactcacactgctgcatgtagctcatctgcatgtatgttacgtggtctgggatacaggatgtatttccgttttgttcaaagccaattgacagtttacacctgaaatactcctccttttgtatcattcagccttttgctttagtttggtaagttttaagaaattgcaagcagcaaagttgttattccacgtgggcacgatggactccaaatgcctcatagttatgtattactgtcccggatgtaaacatgtca

SEQ ID NO: 686054 - DNA, 351 bp, Homo sapiens
ccaacgtggtagccagccacttggcgtgctggttgagcatcgagtcgacgatgtgcacgaacgcctcgtagcagttgaagagcccgtgccggccggtcagcaggtacccctcgagccagccttggcagaggtgctccgacagcacctccatcactcggccgtccggcgcgaggtggtcgtcctcgggccccatctcggaaagccagacccggtcagtggcgtcgaacaccgcatccagccggttggaggccgtctcgtcgggccccatcaaccggaaccggtcggggttgcgcttgatgacgtcacgcaggaacgtgcccagcacccgggtggcctcgtgggtcgcggccg

SEQ ID NO: 686055 - DNA, 1005 bp, Homo sapiens
tgggaatacaaaaataaaccccttctttggtttaaaaaaaaaaaaaaaaaaaaaaaacgaaaacccccaaaacaaaaaatttcaaaaccgggaccccggggcccccccaaccccccccccgcccgtggcaaagacaggccaaagcctctctttctgcttggcgagagtttgggggctgcccccaaaagagaattgaccccttctcttggcggtcttggggatttggggggggagaggcgcgacggcagccccctattccgggcggcgtctcgggggccgcccaagtctccctcggggtgtcgccgcgccatgggctttgcgcttgtagaagtggcgcgggagatgtagagggagagccactcctcaacgactagcgcgtgcctccgagcgcccgggggggtgtgtgttggtttgccccccgcgtcggttgcagccgcgctctctcatcgagatagagtgtggaacccactcccacggcggtgtggttgtctgtgccggcgctgtctttgtgtgagaaacctcctctgagggtgggaggccgccggccctctgtgggggttgtgataggagctcctgtgttaacacgcagaccaccgcggataactgtggagtactcttctctgaacaccgtgctttgtttgtatgatgttgtttttcctccgcagcaccaaatttcctccgcggtggaaagagacagccgctgccctctgtgtgcgcctctgtgagccgagggtgtctccctctggtgggggagcacactcgggctctccccccctgtgtctgtgtgtgctcacctggcgcagaagtatttttaagagcgcgccccgctctgtggggctccccacgtggggaacgtcagaaccctgtgcgtgttcccacaagggtgggttgtctgcggttctcccccggagaagagagcttttgggagaagggggggtccgccagccctagtgggcaggggggagtatgttcgctccctttgttgtgcaccactgacccgtgggt

SEQ ID NO: 686056 - DNA, 235 bp, Homo sapiens
atccatctctccacacccagaataccagtctcattatcaccaaggaagaaattagaaaatgacgtttccccactccaaagtgaagtggaagaagtatccaagaatcacgcaatgcagaatgagaaagccaagaaggccatcactgatgctgccacgatggctgatgagctgaagaaggaacaggacaccagcgcccatctggagcggattaagaagaacctggaacagacggtga

SEQ ID NO: 686057 - DNA, 113 bp, Homo sapiens
gacgctgcgagggcagaggagcgtgcggcgccgtctgaactaaaatgtggtgacctggcagcagagctcaagaatgttactaacaatctgaaatctctggaggctgcctctga

SEQ ID NO: 686058 - DNA, 330 bp, Homo sapiens
  misc_feature (259)..(259): n is a, c, g, or t
  misc_feature (262)..(262): n is a, c, g, or t
gacgctcctctctcagtccaaaagcgccttttggttcggcgcagagagacccttgggtctagcttttcctcgaaaagcgcgaccggcgccttggccccgagaacagacaaagagcaccgcagggccgatcacgctgggggcgctgaggccggccatggtcatggaagtgggcaccctggacgctggaggctgcgggcgctgctgggggagcgagcggcgcaatgcctgctgctggacgccgcctccttcttcgctttcnacncttccacatcgccttctctgtcaacgtgcgcttcagcaccatcgtgcgcgccggccaagggcccatgt

SEQ ID NO: 686059 - DNA, 112 bp, Homo sapiens
gtatgcttttaggaatatatggagcaatgtggcataggcaccaattcagagaactcgctcagggcaggcagactaatgaacacatttcagtgtggcacagaccgctctaccg

SEQ ID NO: 686060 - DNA, 713 bp, Homo sapiens
  misc_feature (583)..(583): n is a, c, g, or t
agcgggttggctgccgaggctcggccggatcgtggagcccgcgccgctggcccaggacctgcgcccgcgcctttgtccgcgcggcgtccaccgtccgtcgctccgctcgcccatggacgcgctgcctgcgccgtcgcgcctgggtcccgcttccgctgctgctgctcggtgtgccttgccgctgcttggcggtccggagtggacgcggagtgtcctcctggaggcctgctgtgcggactggacaccggatggccacgtcatcatgaagggactgctcgtcatgccatatgctacggtaatcctgaagaatgcaggatggtgcacggagcaagttgcttgctcgagcaggtcgagcctggcaggtagcgtgctacatgtgccacgggcagtcatgctctggtcctaagcagtaggctaggaccgcgtgttgccacgccccacggtgactaacggccatgcctggtaggccacatttgtgaacgcaggtgcttgccatatgacttgtcttgctggagagacggtgcaggtccaagtgcccagggccaagatgctgcagagtacagcctcatggttggctaccagntgtgtgcaccagtgtcttcctgggcatgctagtgtcacagagccaaggagacctggagatttgcgattgtctgggggcctccaataaacggatacagatcattgaggttgaggaggaacaagaggaccca

SEQ ID NO: 686061 - DNA, 362 bp, Homo sapiens
  misc_feature (29)..(30): n is a, c, g, or t
  misc_feature (154)..(154): n is a, c, g, or t
  misc_feature (237)..(237): n is a, c, g, or t
  misc_feature (273)..(273): n is a, c, g, or t
  misc_feature (303)..(303): n is a, c, g, or t
  misc_feature (312)..(312): n is a, c, g, or t
  misc_feature (348)..(348): n is a, c, g, or t
ttccacctcccaggttcaagtgattctcnnacctcagcctcccaagtagctgggactacaggaatgcaccactgtgcctggctaatttttgtattttttggtagagatggggttttcaccatattggccaggctggtctcaaactcctgtcctnaagtgatccacccacctcgtcctcccaaagtgctgggattacaggtatgagccaccatgcccagttctgataactttaaaatnaacagactcaatacaaatttccaagactctaataanagattaactggtttatgacttttaattaanaacattggntacttttatgcaaatactttggtttccccaaatttntttctctttgcttg

SEQ ID NO: 686062 - DNA, 640 bp, Homo sapiens
tggagagagagcaaaaccctatctcaaaaaaaaaaagaagaaaaaattagaaaatccaaaaaaaaaaaccaaaaggccttgcgggcgtataaatcccggggcgggttcctgataaatggcccgtgtgctgtcagccccgtgcacttgcactggctggcctccccatgggtggggtggggagaccccagaagcggggggcaggcgccactggaggggcttttactgggagtcggccagcaggccacgcagcatccggcaccctggggcggggctgggctagctggccttctaaggacatctctacttggaagagatttaaccgcaggaagcaatagcagcgctgggccatgggtggctggatagacaagcatggggtctgggtagagaggggaacggggctgggaaacgcagaaagaccccccacagaggcatagcggcatgggtcccgagagctggctcagccagggggaaggggggtcacgcctacagcacagccctcccatttgcccgcccaggggcccggacacaaagcgcgcctttccataagaagggtcaagtccataaaggtctctctagctctgggcataaagacgagatgtaacattggggaatatcgttaagaagggcagggaaaccccag

SEQ ID NO: 686063 - DNA, 743 bp, Homo sapiens
cgagtgtaggactagcaccgggtccggcagcgccagccctacactcgcccgcgccatgtgcctcgtctccttgctacccaaagtaaactaacgccacccctctaccatgaggatccggacactgaaacgaaattatatgttgtcatgtaaccaataaagccagcttattacaaaaatttttctttgggggggccggacacagtcgcgaacgcacacataccacgcggcccaaattgcaccctagatgaccgctgctgtttgtttaagaacgcttacactacaaactgccaaaccccaaaatagctccagttaataccattgctaaacacaccacccacacgacaataccagcccatattaccattgctgctgtagagcccaaaatagagttgcgaaaaaagggagaagcctttaccttctcggagtatatacccataaacgcagggtaggcggggataatttttccccacacctataaattaccatcaaaaaaaaacacaccccgcgagccatatcacacatttaacgacgacacacaattgattaggtcacgcatctcacctcaaaacaatgtgaactttagctaaacggcctggccacgagcctaaaattgatataactgtattacattccaaacaatgttaaggtttaaaaaaatgccaagaatcgcgcaaaccttacaacgccgggtaatccaaaaacgtcccaaataacagccccacaagattggaccacattacaat

SEQ ID NO: 686064 - DNA, 956 bp, Homo sapiens
ggggaagggtgttggggggggcagcgctgacctcatccgcaatctccggtcccgggtggacccccaggccccggaacttcctgagcgcctgtagcctccgcggggagccccctatggatgcacggatgtacccatgagctgttccgtcgcctgacgcagcttggacagatagcagctgacccctcctacgatgcggaactcttttctcacatttgatccccatctcagctgccttgggaggccatgtggcggtcacagcagaccgcgccaggcacattcatcagcctctgcccattctgtccgcagctacatgtcacacagctttaacaaggtgcgcagcgggcaccggttagttctgtcctgaacgggctacttccactggcagagggacctgcggaggtgaccatacggccactccgtcccccacagcagggcccggctcctggagaagtggatccagcgtggcagacggagtgccggctgcatccgaacacttctcttcagatctatgccgtggtgtcacgccctgaagtccaaccccatccacagcgctccgcagcaagcctcggtgagcgcaacgcaacccaggggacacgccatcacaagtctctcatccacgtcatctgcccaccactacctctccgcaggacgcactaactcattcccaacacatcggcgagcctggctccgatgccatcgaacggctgcaacggatagcatgcttcctccccttctctgaaagtcccacaacttcccccaatgtaacatgggcccacgagcacgcttacctcgcgcttccccctggagcgtatggcagcgagctgcttgagtccccacactgaaccatctttctcgcgcacaccgtccccgctcgagactcgtacaccatttgatgcacatgcattcgcaattggccgcacctcacaaccgcggatcccgacctcccgaatcaaacg

SEQ ID NO: 686065 - DNA, 385 bp, Homo sapiens
acagagagagagaatcagctctgagcccccccccccccccccgcagagacgacgctccgtcgcgccttttagcgaggtattactctcgggtaacagctccaaatcttcaggtctaaggaatttcttcgttctagttctttaaagcgtcaggaccacattacgtttagttaagacacgatccccaaaagaaaatagggcgaaacctaaacgcacaacgagcatagaccgacctacattacccacagacaaaccgccccaagaccaaaacaaacgcctatacggaaagcgaatcatcgaaagaatcgagtcgctatcccaacacctcctatccgcaaacttccgtccctacgacagtggatacggccctagccgtcgtacgccccgt

SEQ ID NO: 686066 - DNA, 84 bp, Homo sapiens
cttcctcgcactggctcaagtttctctactcggacgaggtgcagattggcccggagacggtgatgaccacgctatacaccgcca

SEQ ID NO: 686067 - DNA, 546 bp, Homo sapiens
  misc_feature (472)..(472): n is a, c, g, or t
cttttccccgagggagaagaaggataggatctcaaggctgtatgcgatgacggctatttagtttgtggcacagcagctctttggcgtgctgatgtcaagcgttcgttttagataatgacatctgttaaacaggaaaaacaggtttgaaaattctaggtaggatatctagtgcaggcaaagaggacatttgaaagtgtcatcaatgaatttgcacacagcctttccatcacaataatataaatttataccttcaatcttatgcagcagcaaaaacacagggagaaagacagcaattgcttctgaaagaaaatcaaagaagcctatagtggtgaattttttctaaaggatgctagggagttgaataaggcctgcttctccatgggttgacaatgtttggctgtgaagggaatggcagcctcctttcctgtgatttttttaccgatggcacacacttcaggggtgggccaggctnctaggccctgctgaggcataatcttttgacactgtggatttcagtggggcgacttctcccttatggggtgcacg

SEQ ID NO: 686068 - DNA, 609 bp, Homo sapiens
ttagttctttcgaaagttgccaaaaatgaagccactttgagagtctgcctcacttatcagcaccattctgacagcaaactgtattcgactattttattttattcagagagttttgcctaggccaacttttttcaaataaaggaatagtgccttgcacagtatggttttgccctccatcgtttttttggagagggataaattgcaggacagtaactctgtgcaagatctaactagtcacttgttattctcttccactttccctttagtaacatttgcctaaacttccaatttactagattaacccaatgtagagcaatctaatgcaacatttttagtacatcgagctgtgtggtgcagcgccaaccactcttaattaagttttctagtccttttttcgggggtatggcttttttgagtctaaatttatgcgatagtgggacacaccaccaaatcacttagttctctatacctgttagtgtaagtttaggttacttagccctggtgccacactttgtgtgctacacccagatgccttctagtacaggtaccaccattctcttgcttccctttatacctgcatctcttgcctgtggcatctatagttcgctt

SEQ ID NO: 686069 - DNA, 192 bp, Homo sapiens
  misc_feature (2)..(2): n is a, c, g, or t
antagacggtagtgatcggcttgacggggcatcacaggacatgcccaggtactgggcttgcttctcagttagcttggtcacttcacattcagcttgcccaggtggagcttcaagccaactgccctcatccaggcttcttgggcaggaaatgtaaccccaacggggtacttgtctggcgctagttgatgagca

SEQ ID NO: 686070 - DNA, 1002 bp, Homo sapiens
  misc_feature (520)..(520): n is a, c, g, or t
  misc_feature (680)..(680): n is a, c, g, or t
  misc_feature (808)..(808): n is a, c, g, or t
  misc_feature (812)..(812): n is a, c, g, or t
  misc_feature (818)..(818): n is a, c, g, or t
  misc_feature (860)..(860): n is a, c, g, or t
  misc_feature (882)..(882): n is a, c, g, or t
  misc_feature (892)..(892): n is a, c, g, or t
  misc_feature (894)..(895): n is a, c, g, or t
  misc_feature (901)..(901): n is a, c, g, or t
  misc_feature (909)..(909): n is a, c, g, or t
  misc_feature (967)..(967): n is a, c, g, or t
agcggggtttcctgggcggcggaaggagacgcggccgcgtgaggacgaggctatttgaaaacacgctccgggagctagagcctgaggtcggcggcgcacgctgttgccccgtgggcttctgctccctcgcttgtcttctcgggcttctcgccccggccgcggccgggtcctcagtagtcgagaatgactaagtagaagagaaaacgccaacatgattttcaaaaagtaaaattgaaagttggtaaaaagaagcccaaggttacaaaatgctactcctacaaactttaaaacaaagactatacatctgccttagcaactcaaagaggatggaacacttccaacaaacaatagaaaacttaacataagaggattttgctgtcacagatgcatcacgtacaatgctggggttaaacaaagtgctcttcttggacttaaagaccttttgtctcaatacccatttataattgatgcacacctttcaaacatattaagtgaagtgactgctgtgtttacagataangatgctaatgtacgattagcagcagttcaacttcttcaattcctggcccccaagaatacgagctgaacaaatttctccattttttcctttggtaagtgcccatctctctagtgccatgactcacattactgaaggaattcaggaggactctttaaaagtntggacattctgtggaacagtacccagctctaattactggcgtagcagcatattgcttaagaattttgtagaacttatttctcatcagcagctgtccaaaggactggataaatagagacagatcccagncctngatacnttctgtaaatcctaatcggagactcacttctcagcaatggangctgaaagtcttagtgagaatnagtaaattcntnnagaccntggaaganggatccagtaggttgagaaaaagtgaaggccttcgggacagaaagaaaatcccctgcnctagaaatcctttttttacactggaggaaaatgcc

SEQ ID NO: 686071 - DNA, 455 bp, Homo sapiens
gcattatcaagtctgaaaggaaaataaaatttccctatgaaaatcgctatgccaaaagggaaaaattcagctgaaatctaagtcatgcaagaaactgctcttccttttgtccctaagcacacggctgcagataaaaggccagatatctccacaggtagctactctatgttcaccttatcttatgtaaagtgctgatttactgagcaccagacaaatacataattggcttttcccctacctgctccttttctcgtgcaacacgtggattcagtaatgtgaccacaccttctctctttcccctccaaactgcgtttcccctttaaatactgaagcctttttctctttggagaaaggcacacaggacagactgtttctgtgatttctgtgttcctttcttcaggggatgtccttaatgttgacaaaataaacttttaaattgattgagaaaaaaaaaa

SEQ ID NO: 686072 - DNA, 536 bp, Homo sapiens
tgggtctaaagggggtaaagggggtgctatagggtaaatacgggcccaattcaaaaatttaaggggaataattctaggagatgggcttgaaactgtggttggtccacagattcaaagcatggaccggtagtatacccccgggtcgtggtagcgggtgaaagtgggtttgggtttaagaatgtccgggaatggcatctggttttaaagcactaatggtggggacagctcatgagtgcaagactggtcttgtgatgtacttcattatacagaattgggggtaccaatacgggacctacctacccgatggtcaaacggccacaggagatcgccacgatccccgtggatcactcagggcataagcgggcgcacaccttgccacgcgagtctgaacaactccatcccgcacgacccacacgactgtccccacgccacagctcccattcaccccacgaccgccccacaccacccacgacccccacccgcaggcaatcgaccacccccgccagtcatgtcaccgcatccccccgagcgcagcc

SEQ ID NO: 686073 - DNA, 154 bp, Homo sapiens
gagtccatatcatctggcatccgttcaatgttgtatctatggttagacatgtacatgataggaactccaggaatcttacggattcttctttacaggtcccggtcaactgtggacacaaatgtaacactatctgcatgagttactctcatgtact

SEQ ID NO: 686074 - DNA, 129 bp, Homo sapiens
gatgaaggggtctcttcagtggctgaatgtacagcagagctatttccttccactagggtggtcttgcatgggaagggtccacgtgacttgatcatctttaacgattgctgtctctgtccccattgcgtg

SEQ ID NO: 686075 - DNA, 346 bp, Homo sapiens
actacatacttccgtaaggaaagtccctcacatttttcaaactaagctactatatttaaggccttccaagtgcttctaactcttccaaaagccttctgccttaggtttttttaaattacaccagtccttttggtagctttttgatgtgattttaaaccaacttccgcttctagcttcaagtattcttctaaatgggctctggtctacgtaagcaccctcatcttctcaagctttaccttctaacttgtgcaccaccagaaattaaatggatgggcttttaaaataaatgggctaccaataattccctcatttttgcagcgctattatatccaattttgggctttat

SEQ ID NO: 686076 - DNA, 84 bp, Homo sapiens
tctggtttttggttttttttttggggggggtttaaaaccaggccctggccataataaggggcccaataaaaactggttggttga

SEQ ID NO: 686077 - DNA, 195 bp, Homo sapiens
tcccatccagtgctgctgccaaccctatgcacatcttacagtgccagagtctgtcctcgcctgcaggtactcctgggaatagaggctggatccaggctggctttgagtgcatgccccgtccagcgaaatgtcacttcattttagactttggatccacagcatcttttgatgcatctgttcatttccgtttattgc

SEQ ID NO: 686078 - DNA, 386 bp, Homo sapiens
tttagtagagatggggttcaccatgttggccaggctggtctctatctcctgacctcgtggatctgcctgcctcggtctcccacagtgctgggataacaggtgtgagcccaacgcacccggccgatggtcttcatttttaggaaagtttaaggttcatggccaaagttgaatagaatatacaaagaatgcccatgtgcccctgttcccacatacgcatagctttcactgtcaacatcccgtatcagggtgtgtacatatgtgagaactgatgaacctaacattgaggcatcgttaccacgcaaagtccatcgtggacgttagcattcactgtgggtgttgcacatagatgtatccagcaatacaaaatcagatagactcatttcatt

SEQ ID NO: 686079 - DNA, 923 bp, Homo sapiens
gcctggatggtaccggatggaacagcttccaagtcgtcggatgccactgagccccagcccctggctctggccaggcccccagtatggaaagccgacccccagagcagacatccctgcagcaagcagcggtctggacgacctagaactcctggggaagaccctcctgtctggtagtcgctgcccccggaatcccagcaagtgcggtgggagaagcaggagccaaccccccggctcaacactccgggagctgcagaataagagcagcagctgagactcccgcagctccaggcccagcagactactccacaccgtgtcccagaggcccaccaggctccgcagcagaccagtagcaaccgagctcctcacataggccagcatcactgtgccccgtggagtccatcaaacccagcaacatccgtgcccgtgactgtgtattgacaccaagcacggattccgcattcgcctcttccattatggcccgggacccactgacaagggcagctcccgaccgtgctggtgctggtggttagcccatgctgggcacacgcccccgaggccactccagcaaaaattcgatgtaccaggtcaagctgtccccagggttatgacgggtcaagcttggagcaccccatccagggcaacggagcgtggcaggttataagccccactcgtcaacccctcagaatcaccaggtctgctgctgcaagcccccagaaggcgaaggtcgctcagaaacagctcacctccaccagggggacagactacacggcgatggggctgtgcccagaaccacactgaaaccggggtgcccacaacacaggcgggaaggaggaacggacccgacatgcacccggacggggaatggcccggacccctgtgctgccatacccggggtgtcccaaccggtgcaaggagtacacagc

SEQ ID NO: 686080 - DNA, 518 bp, Homo sapiens
  misc_feature (179)..(179): n is a, c, g, or t
  misc_feature (204)..(204): n is a, c, g, or t
  misc_feature (227)..(227): n is a, c, g, or t
  misc_feature (289)..(289): n is a, c, g, or t
  misc_feature (328)..(329): n is a, c, g, or t
  misc_feature (332)..(332): n is a, c, g, or t
  misc_feature (336)..(337): n is a, c, g, or t
  misc_feature (340)..(343): n is a, c, g, or t
  misc_feature (385)..(385): n is a, c, g, or t
  misc_feature (389)..(389): n is a, c, g, or t
  misc_feature (403)..(403): n is a, c, g, or t
  misc_feature (406)..(407): n is a, c, g, or t
  misc_feature (409)..(410): n is a, c, g, or t
  misc_feature (414)..(414): n is a, c, g, or t
  misc_feature (427)..(427): n is a, c, g, or t
  misc_feature (442)..(442): n is a, c, g, or t
  misc_feature (446)..(446): n is a, c, g, or t
  misc_feature (448)..(448): n is a, c, g, or t
  misc_feature (450)..(450): n is a, c, g, or t
  misc_feature (513)..(513): n is a, c, g, or t
cgagcgggcgcctggcggcggcggcggcggcaccagcgatcccagcagcggccacgacgcggacgcgcctgcggcccggggagcagcagcagccacagccacagcagccgccactgcagttagagcggcagcagcagcgacagccacagcagcagccgccgcggagagcggcgctcggncgggcgcgccctcctgaaggaagcngcccgccccccaccgccgccccntccggcgtgttcatgcccccggggccccagggagcgccatggcccgcgcacgccaggagggnagctccccggagcccgtagagggcctggcccgcgacggnncgngccnnttnnnnttcggccgcctggtgccctcggcagtgtcctgcggcctctgngagnccggtcttgttgcngcnntnntccnccccaccctcctncccgctgcctacctntgcncncncaccgccccacccgccgtcaccgccgccctggggggttcccgctggcctggggggtccccgcngccgg

SEQ ID NO: 686081 - DNA, 1205 bp, Homo sapiens
aagcttggcacgaggagcatggccaggcttggaacctgaatgtattttaaagcaaaagctcaaagggggcacgtggcttgaactggcttgaaggatggcacctgctacactgcaatgtggccgcggccctgcttctggtgtgtaggtaaaggtaaggctggtggaatatatgattccatcatttcggaccaaagttactgaaacctgtattggttgctggacctatctccaaccttctcagaatgcagaaacgtctgggacaacacgagcatactctctccacacctgtacatagcttcagcttctacatccccaaaccacacttgtaaatttgggagtgaaattctgtcctgtaagttcaagcattggttcgtccccaccgccattcaacttaaggctctctacggacagggcgggagggcatgaccaggggcaagggacaggggcccactctctcggtaaaatgtatgcttcgccttatgtgtgctaatgattgcccaggaagcaccatcatttatcttctctttatttggttcttttgggcatggagtggcctgaaattgaattattctttcttgagaaaggcataagtactttctttctgtatcctcaaggtcaaatgcacatttatggagttgtgacacaggatcatctgcatccaataatgtggtctgcttatcaactttcctaattatcaatcttgggagtgccatgccagtaactgagcacacaagtttgactgtttgtccataatgaatgtagccatctcagactgtgaattcttctccttctgatccatcatcatccaagaataatgtaaaatgctccccattgctgtgaactagcatgaaaattacctctttcctacgtgcaagtatctggtactaactgtctgggatagtagtcgattaaacagagccacctttcttcctgaggcaatgcataagtcagcatttttcaatgactgcttctttttggaaggtttggacgacttgctgaggaacacaccaatgtcatcactgttgccatagaacacctttacagacaacatgaagtgcttttgcttgtctaaatcagatatgtacaatgttttggctgtgcaatagttctttccttccaagtttagctgctgcatttcttggtcactatttcctatgccaataaatgcacatggttgagacccttgttcagaacaaaaaaaaaaa

SEQ ID NO: 686082 - DNA, 236 bp, Homo sapiens
cctgagcagggctgagccagctgggagggccggggaagaagtggagctagggaaggtgcaaggctgagggctgttgggttgagaaaagggaaactggagagctggggccgctgcagggagctggctggccagagggtggtggggactgatggagagggactgaggaagtcagccaggcagccaggacacgggtctgttctatctgttgctgtaaataaagatatttgtacatctca

SEQ ID NO: 686083 - DNA, 602 bp, Homo sapiens
  misc_feature (13)..(13): n is a, c, g, or t
  misc_feature (66)..(66): n is a, c, g, or t
  misc_feature (77)..(77): n is a, c, g, or t
  misc_feature (110)..(110): n is a, c, g, or t
  misc_feature (112)..(112): n is a, c, g, or t
  misc_feature (146)..(146): n is a, c, g, or t
  misc_feature (168)..(168): n is a, c, g, or t
  misc_feature (170)..(170): n is a, c, g, or t
  misc_feature (182)..(183): n is a, c, g, or t
  misc_feature (186)..(186): n is a, c, g, or t
  misc_feature (261)..(261): n is a, c, g, or t
  misc_feature (339)..(340): n is a, c, g, or t
  misc_feature (363)..(363): n is a, c, g, or t
  misc_feature (366)..(366): n is a, c, g, or t
  misc_feature (376)..(376): n is a, c, g, or t
  misc_feature (420)..(420): n is a, c, g, or t
  misc_feature (467)..(467): n is a, c, g, or t
  misc_feature (477)..(477): n is a, c, g, or t
  misc_feature (480)..(480): n is a, c, g, or t
  misc_feature (507)..(507): n is a, c, g, or t
  misc_feature (514)..(514): n is a, c, g, or t
  misc_feature (523)..(523): n is a, c, g, or t
  misc_feature (533)..(533): n is a, c, g, or t
  misc_feature (538)..(538): n is a, c, g, or t
  misc_feature (546)..(546): n is a, c, g, or t
  misc_feature (558)..(558): n is a, c, g, or t
  misc_feature (590)..(590): n is a, c, g, or t
gggcagattgggnggggggctgggtgctacaataagggggggggtgccggggcgacagtgcagggnaaaggcagggnagggatctgggctgcctgggggtcatctggggngnggagtacaaagctttgcaagggtgtggttttggnatgacgctaaactgaaggtggngngaacaggtaagnnggntgggggttgcgcactgtacactgttaagaagttgagcttttatcttagaggcagcagaaggtttggggccaaggnatgaaatgatgaggcgtccttcaggtaatgaacttcagctgcagtgtgaaaggggcaggaagactggcagctgtcaannctgggacagtccagtgggtgtgngcnggcccgggcntgggcaggggcgggggcagggggcacacatcaatttctgcggtnccttctagaggaagacccgacagagggtcaacagagttgaaaggggnaaataattgnggntggggtccaagtttttagtttcagagnctaggcntatggttantatttaggtnggganttcggggnaaggggcttggngggcgggggggaaggaacggcagcttggggcnctctgacatctt

SEQ ID NO: 686084 - DNA, 413 bp, Homo sapiens
agcgtaccgttcgccttgtaccctgtccgcgtgtctccttctccgtgtgatctctcgctgttgttgtcgaattggatctcgaagtaggcttcgttcggtgtgcggtaccaggttctcttcggacactacgttgtacgttgcttcgtatggtcatatctagtttttttcgggttgtggtttcttttgctcggtgcgcttggccagctattcgtataagggggaagagctgggagctgctgaaggaaggtttacttttaggcgctagaccagggcagagagatccaggctcagaacttcttctccagcttacaccctaataaagctgaggcactcctccgctctagagtgggccagcctaggggcccaggcaccatcgggcacctactcccccaattgaactatagcgcccaata

SEQ ID NO: 686085 - DNA, 382 bp, Homo sapiens
gccccaaacccccggtttaaacccgtccccttcccccctgggttgggccccgggggttggggggggggtttcccctggggggggttgggccccccccccctttggggtacccagggaaggggggcccgggcccccctggggggcaaaaccaaaggggagttttttgggggtccccctggggccctttgaaagcccttttttgttttcccccggcattgaaaaagacggggtacccctttttccctggtgggcccccccggggaggggggccggcccccttttttccccccttctccttttttttccccttttgggggggccccccccctttggggggggggggggggggccgggaaaaaaaaaaggtttttggcggttttta

SEQ ID NO: 686086 - DNA, 275 bp, Homo sapiens
  misc_feature (5)..(5): n is a, c, g, or t
  misc_feature (246)..(246): n is a, c, g, or t
agacnttgtgtatatttttacactttaaaaaccccatgctgggcatgttggctcacacttgtggtcccagcactttgggaggctgaggcaggtggatcacgaggtcaggagttcgagaccagcctggctaacatggtgaaaccctgtctcaactaaaaaatacaaaaattagccaggcatggtggcatgtgcctgcctgtagtcccagctactcgagggctgaggcagaagaatcacttgagcccngggagcagaaggttgcagtgagccgagat

SEQ ID NO: 686087 - DNA, 137 bp, Homo sapiens
cgatcccccttgactccatgtggaagacgatctagataccgtcgtagttcctgaccataaacttcgacatcggactctgcgctcgatcggaaacgttgctgccatcgagtgccatctggaaacttcgccgtcggggt

SEQ ID NO: 686088 - DNA, 306 bp, Homo sapiens
tcacgctgcaggtgttcgtgtctgggctgcccaagctgctggagaggcacgagcaccatgctgactgaggtagatacacgtcctgacggactgtacgagacaggccgaggaagtgtgtgcacgctcgctgagtcaggcctgcctgtacttccacgacgaccgtcgaccgcgttcgagggaagttacgtccttgaggcaggcacgacccagggctcgtgtgctgccaccaagtaggtgcctcctggaggcaggccgccaggggagaacgaccgagtgggtcccttggaaggcaagctgagagagacg

SEQ ID NO: 686089 - DNA, 993 bp, Homo sapiens
  misc_feature (17)..(17): n is a, c, g, or t
  misc_feature (56)..(56): n is a, c, g, or t
  misc_feature (59)..(59): n is a, c, g, or t
  misc_feature (92)..(92): n is a, c, g, or t
ttagtattagtagtagnagcagtagtagtagtagtagtagtagtagcagtattagnagnagtagtagtagtagtagtagtagcagtagtagnagtagcatcatcattacttgcattactattagtactaccttctcttgtactcctcttctttgctcttctatctctctcttcctctcttccttctttgtcttcccttcttctcttcccactctcttctctatttctgtctcctcctcctcttcttcttactttcttctcctctcctctctcttctttctcctctctttctttctctctctcctatatcctctcctttttccttcttcttctttctctctctttaatcaatccttctctcatctccttctcttctttctctctcctctctcttcccttctcttctcctctcttctcttctcttcattctctcccttcttctctttcctctttttccttttctcttcttcttttcttcctcttccctttccttatctctctctcttctctctctttttctcttctcttttttctctctctttctttcttctttctcctatttctttctctttctccttttcttctccttttctttctcttccttcctcttttcttcttcttttctctcttcttttctctcttctcttcctttctcttcttctttttctctcctcttctctctctctatctccttttctcctttctttcttctcttccctttctctctttctctcctctctttctccttccttctttctgtctcttcttctcttcctcttctcttccctcttcctctccctcttctcacctctcctcttcttcttctgtcctctttttcccttctctctctctctcccttctcttcttgtctctctctttctctctcttctctctctatctctcttctccttttccctcctcttctcttcttccttctctctctcctctctctttctctctctctcctttttctctctcttccttctctcctcct

SEQ ID NO: 686090 - DNA, 217 bp, Homo sapiens
agccatgaggatttattgtctgcagagtgaagtgggccatagtccgttacaatgatgattcgatgtataagtagattaacattctaaggcatagctaatatctgtcctcttgccttctggtgtgttttaatgtattcttataccatgtctttgatataacttttatcctccagatcttagtcttgctcattgctctcttcatgcacttaccgagact

SEQ ID NO: 686091 - DNA, 934 bp, Homo sapiens
  misc_feature (44)..(44): n is a, c, g, or t
  misc_feature (452)..(452): n is a, c, g, or t
  misc_feature (669)..(670): n is a, c, g, or t
cactgcggtagtagctttgggtgatggtgcggaaccgctcctgnccggccgtgtcccagatctgcagccctccagacagcttccttgtggcactcccattccaggtattcaacatatttaatgaatggctactacaggcgggcattgtcctggggccttgtaatgcacctgtggacaaagcagacaaaaatccaggagaaaaggggaaagtcttcaagctgaaggagacttcgcagagagcaagtcccccagtgccactgtgaggaccccagccaacctttcaggtcaagatagaaagggactgaatgagcagtctgcaaaggcagaccccgtggagaaggcagaagagttgtttcttctgaaagtttgaactccactcccactgggaaatacccaacagaatcagacaggaaaccccaagtgccactgaaaagcaattgagagccccactntggtacacctgatgggagcggagagttagagaggcaggaaataacctccactccaggtagaagtagacaggagatgggatggaaggtttctgcatgctgggactagctcaggtcaaagtccagaactccagaaaacaaggcctgcccccagctcagagcagctaccacagcacaaaatggtgtggaatccaggagccaggatgaagcgtaggggtanncggtggttggatagctaactggcctttccactgctctagcctggaactggttgggctggggcaggggacatgttggtctgagtatagattttgtcagaaaacccaggcaccactcccttgcctttgcggggtgattctaaaattggactgtggtaagggttgcacaactcctcaagtttattaaaatcattaaaatgtaaacttacaacctgtgggttttatggtatgtaaattatacctcaataaagctgtctaatatctgca

SEQ ID NO: 686092 - DNA, 879 bp, Homo sapiens
atcatatagtaaaacccagcccatgaccccataacaggggccctctcagtcgctcctaatgaccgccggcctagccatgtgatttctactttcgcgactcccataacagctccatcattacttgagagccatacataagccgaacacgacatatactcatattaccaattgtatggcggctgatgtagatcgacgagtaaagcgatcataccgaaggaccaccacacaccacctgtccaaaaaggccttcgaatacgggataatcctatgtattacctcagaagttatattatatcttcggcaggattgtttcatgagcctgttgaccacatccagacctagctccctaacccccaaattaggagcggcacgtgggccgccgcaagcaggcattctaccccggtcgtaaaatccccatataagtcccactccttaatacacatccgctattacttctgcatcaggacgtatcatattcaccttgcagctcaccatagtcctaatagagaacaaccgaaaccgaagtaattcaagcactgcgtatattacaagttttactggtggtctcgtatatcacccttcctacaagcctcagagtactgcgagtctcccttcaccatttccggaggaatctacggctcaacatttcttgtagccacaggctaccgacggacgttcaccgtcattagttggctcaacttgtgctgcactatctgctgtcagtccgtcaacataagtaatttcagctttacaatccaagacattcagttctggccttcgaagccggcgtcctgatacttggcatcctggtacatgtgcgattgagcatattctggtatgtctccatctattgatgaaggccttaagacagaaaaacag

SEQ ID NO: 686093 - DNA, 182 bp, Homo sapiens
gacttagaggatcccccccgactagcctgacagacccaggaggagcggatctgccagagaggccagcagggggctgagcttggcagtgatggagctgcagaaaggatgttacagcccccacttctccctgccatcgtgggagcagatcagtgggctcagtgtggctggtccacatgaggcca

SEQ ID NO: 686094 - DNA, 155 bp, Homo sapiens
catcagacaccttcaggaagaaaggacatttctcatcttagtgtgacagactctgaataagaacacacagcactgtttcagtgacacaagagtaaatggtacagtgtatttttagagtacttgcaaaagtcacgtcaatagacaattaacatttg

SEQ ID NO: 686095 - DNA, 599 bp, Homo sapiens
actaatgttgtatgaagctacatcataaatgagcttacggagtgtaagctatatagtaatttgattaatttctatcgtgaaaatgtctaggttccactgtttatctgtgaagttaccagctcgtaagtcttcagtgttttgattacagaacacataactgctcttccatcagctgtgaattgagagcccttttttacgagcaatgtcccttttatcactgagaagtacatttttattcacttggcttgtgtggctgctagattggattagcatagccttgcaactctaggaggttttaacttcatcaggagattaattacatcagaaagtggtaccgtctggagaggcttagtcaaattttacagtccttcctctgaaagcctacctagtgtggtggaaacatgatctttgtagacaaatacgtttgccctgattctatattcttgaccttaataaatggcactaccatcagtcctgcctgtaatccttgtcttccttcctgtccactatttcccaataaaatcagtcaccaaatcctgtctctccctgaaactgttcccatcagcatacaaattatgttctggtatccttcacaccct

SEQ ID NO: 686096 - DNA, 213 bp, Homo sapiens
actggcgagtatctcgaactcctgactcaggtgatcaccacctaggctcacaaagtttcggattacaagtgtagagccaccacgcccagatattttacggttaaatggaacccgggtcaaatatatgtacacccaaaatgaagtgcagtggtgccatctcagttcattgcagttataacctatctgtgatcaagcaaccctcccacctcagcc

SEQ ID NO: 686097 - DNA, 233 bp, Homo sapiens
  misc_feature (115)..(115): n is a, c, g, or t
  misc_feature (136)..(136): n is a, c, g, or t
ttcacatccttatatattattaaagatacagaatgggcttttaatagatcctacaggccaggcacagtggctcatgcctgtaatcccagccctttgggaggctgaggcgggtggntcccatgaggtcaggagtttnagaccagcctggccaacatgacgaatccccgtctctactaaaaatacaaaaattagctgggcgtggtggcaggtgcctgtagtttcagctgttcggg

SEQ ID NO: 686098 - DNA, 603 bp, Homo sapiens
ccagccagcgctttcagaagggcacagagcccttgggcccggcggaccagttcgaggtgggcccagacagcctgaagcccgaagttgaaagagctcggacgaggagccggtggagtccggggcccaccggttgcggcgcaccggattgcaaaaggtacagagcctccgaagggccctttcgggccggaaaggcccttcagcgcccccgcccaccccggtcaagccgcctcgccttgggcctggccggagcgcagaagcccagccggaagcccagcctgcgctggagcccacgctggagccagagcctccgcaggacacccaggaagattccgggagacctggggcttccgaaaaacctttgcctccaaatgaagaagtgtagctaaggggctggtgttgcctgcctcccctgggcttgggccttgtcccaaaataaatcctttcagaatgtagccctcccgccctaataaggagcgaatcctacatcccccaaggcgggcgctttggccctcccttccttaagcccagtcctgtgtcctttgaaaaaggtgcagtccctcccccctgcttgcgctccccctcaataaaagttatttcccccca

SEQ ID NO: 686099 - DNA, 145 bp, Homo sapiens
  misc_feature (49)..(49): n is a, c, g, or t
tacttaagtagtatacatttttaatgagatacatgatatgtataatatnttgtaacctttttaggcttaatgtcttgtattttaaagcttagagagtttaaacctatattagagttataaccatgagagtgttttgtggataggg

SEQ ID NO: 686100 - DNA, 311 bp, Homo sapiens
gtcgacgaaagaccctcgtttgagaatccctgcttttatgttctgctttagtccaggcaacagatagcttaggttgtcactttacaactggagcagcaggtagggctgagaggctcgcatactccaaattaccagtgccagtcccatggcccaagacaggaaaggcaggcactcaaacagaaaggtagtgcaattaattgcttcaaattctttactcagggctgcccttagtcatgatcaaataaaatgtacacattgtttggcacttggtaaaatgttgtttcctttccttcctccttccccggtcgacg

SEQ ID NO: 686101 - DNA, 120 bp, Homo sapiens
ctgggaagggtccacaacatgcagcacccaacctgcaacccacaacagccgagacaggagagagagaagaaaggaagagagagagaggcgcggacgcgcgagacggagcggcagcgctag

SEQ ID NO: 686102 - DNA, 1183 bp, Homo sapiens
gagggcaggcatccctaccgacggcgaggttgagagcaatttatagagcagccgagacagtatccgcgacgcgttcagtgcgtctgtcaccctcacgggtagtgcgtccgcccgcgagagaactggaatcttctaccgttggactccgggtcccgtggacactatccggcggtggatcccggctcgtccgtccgctgacctcgcgcatgtcctcgtcgtgctcggagcggatcctgcgtgccgtcgcattctctcaactggactctggcactgcttggagaggtggctcgcgaggcggctggttgcttgagagagtgttaccggtgacctgctgtgagctccgtcaagtaggaccgatggtccgtgcactagaggcgtagacgtgcgtagtagagtcttacagtggtcccgctcagaactaaagggtgcacagtgtagtctggcataagtgctcttgctactgacttggaccctataagcctacaagggggacgagccctggcgaattcaaactgattgcgaatgcccagcgtggcctccccatggtcttaaccccccggttacccccaggccatctttgcagtgcttagacaaaggggcgcgcgagcgcccaagttacgagtggcttacggaaaactggatcatacccttgagaggctagggtgccgacctggcccccgattgtctcacaacagggaaggggggtcaaaccctctgggggaccaaaaccttcggggaagttaggtttgaggggacgaccccccattcccgcaagagatcgcggaaaagcccttataacctttcccgggcgcgagcgggctggcaacactcattgggggagtggaccgaacacccatatacaaccatggaaaacggtgacgcaccaaatttgtgttgagccatatccatgtcccacaagggggagggcccacaattccttattatgcgcgattcctcgggttcccgacccaccgtggtgggtcacaaaacgagggtggggaggcgtaagatacacccataaacttccattggacacttgatcatcgtgcattcatccgccgatgcccgtatgagaggaaaagcgctctagaggggagcttaagggcatgagaccgagcagtctattgagcaaattgatcggtcgacgagacactcgtaggtttggttcacacactaccccggg

SEQ ID NO: 686103 - DNA, 173 bp, Homo sapiens
caaacttctatataacttcaaattactttaaaaaaattcctaaaaggtattctgctgcctttctgaggcatgaacatttgggtgtcttcccaagaccaaccccgggccagcaggtggcgcctgtgaaatggaaaacattcggaaaacagcatcccctcaatagcgggtaccga

SEQ ID NO: 686104 - DNA, 220 bp, Homo sapiens
ggtatatatagaggaaataagggccctactaaaaagataaaaggcgacataattactaggacgatgggcatgaaactgaggtagctaccacagatatcagagcatagaccgtagtatacccccggacgagtagcggtgaaagtggaaaggaaaagacgtccgttaataagcatactagtaaaaaagcctaatgtaggggacagctcatgagttagcaaga

SEQ ID NO: 686105 - DNA, 134 bp, Homo sapiens
aaaccttttttttccccggttaaaacccccgggggaaattttttacccccttttttttttttaaaaaaaacccgggctttttttttttttggggggaaaaccccccattaaattttttttattttttaggggga

SEQ ID NO: 686106 - DNA, 899 bp, Homo sapiens
  misc_feature (395)..(395): n is a, c, g, or t
  misc_feature (802)..(802): n is a, c, g, or t
  misc_feature (843)..(843): n is a, c, g, or t
tatagtaagagatgtattaatattaaccactcatattcatagtcggatacaatggaaagcgtgttatacccatgcccttgcaaatgtacaaacctgcacctatactcatgcatgaatatttatatcctgtgagcagaagaggacaggctgcctgagtgccagggaggtccaggtctagcctagctgggggagacttcccactctgccttcccagccccaggacccttaggagaactttcttgctgccctgtggtccccagggcaccagaaccctggatagccggctctgtggttttcctagagtgttaattgttgcccaggagcagggaatggggaatcgggagctccctccttcccaggagaaagggctgcagtggctggcctgggagccaggngagagtcttcacgtcccagcagttctggtgcagaggcagctcagttggattattcgtcccggttcctaatgaaagtgaaagctgctggtacctgccagccctctcttggcacacagcgagctgaaaatgcagagactggagaacgttgccaccagagtcagcttgtcctggtgcagctcagatttggagctgagggttatcgatgcattggtctatcttattccaggatttcctaggcttcagttatctcccaactaggaaccacagctgctccttcctaacctggtccctccttgccaatctgtggcctgtgctatcagcagaacccctgtgccggacatagagctgcccaggtcagaaacccaaacctttccacagggacacagtcagatttgagttatgggagntcccacagccagggggtcagggcggatgcaggaaaccaggncaggaagttgtgggtgttcatttaagcaagagacagacattggtgaacacagggag

SEQ ID NO: 686107 - DNA, 154 bp, Homo sapiens
  misc_feature (4)..(4): n is a, c, g, or t
  misc_feature (15)..(15): n is a, c, g, or t
  misc_feature (100)..(100): n is a, c, g, or t
  misc_feature (107)..(107): n is a, c, g, or t
gatnttcctagactnaccgtgcctggagagccaggaagaagaggccagcctggaggaatgggcctggtggacaggaggcagagcaggctcagtggccttnccttctngggagcccagacagactgaaatgctatcctcccacaaccaccactgc

SEQ ID NO: 686108 - DNA, 791 bp, Homo sapiens
tatatcatagcgaataaatctagtagtataaattctcaaaatgccgtcagtagaaagcacacaaggttatggatcagttttgaattactggcttctgagtttctgtcacttcgtgatccttcttcctctttctgcagatgtagctgagtcttgatcattttaagacaacgatgggtagaattttagagatgtaatgctaaagtctatgtcccttgtttgttaaatttcagtcccctctcactatgctttatgtccagaaggatcaagaattcgaccatcccttgggtctttagtgtataagacaatgttaaataaaggtagactcagtctttaagatattagacagtttttgtagtccatgggattgtaaatataaacattaacgtttccgtagtaagaatattttaggctgatgtaatctatagcctcaaattggtatttattatggattcactagacaaacagctgtttccttattgtcttttttctttagtgtttctgatttgctatcagtagctgtttttaaagccgtccaaggaaaataattatttacagatttatgaagtcactgtttgagccctcatcaagctctcattgtgagtgggagggatacactttttgttgttaaaagcgtattattgttaaaggcctatgttatggaaaccaacttggaagaacaacattaaatgtggatgtatgagatttggtttatcgagccatgggagagaaaacaaacactaagtttagtttactagtacatatacagtacaatggatagtatattgtcttaa

SEQ ID NO: 686109 - DNA, 412 bp, Homo sapiens
tcgaaagtactgggattacaggcatgagccactgcacctgtgcctgttcaaataactcttaagggtggctgtatctccctgggcaagttacattgagaccgagggactttccattttcctgctttctctctctcatatcggcttaatcatactaggaggagagaagatgccttagtttggatacactcctggtcctcctgtataaccctagggaccaaaagggagctgctggaccacccccgtggccaccacacccactcatggttcttccctctcacccctaggtaccttggccaggctggcagtgaagagaacaccttcaaagagttcccccatgtgtctcaggaactcatccacataaggcctcttgagcacatacacctgaggaagagcagagcagcagggaaagaca

SEQ ID NO: 686110 - DNA, 515 bp, Homo sapiens
aaaactgtatttgttgtaacttgcaggtgaaatacattcttttcacatgatattgtaatcggcccttatttatggtcttttattattattccttgagtcctttcccttcactagtttaataagtcacttctggcttgtctagagagcaatcctagcacaataatgttacaacttgcacggaagaacgcccttcattgagttgatagaactccaccagctgtattagatctgtaaatctagtgtggccatcatccagtgtgtggcaccatttcaccgtcatctactactggtataatttgaaagtgcttaatttaatgtccatgactcattgacagtacgaaagtaagggggtatactctgaattatcccgttaccaagaaaagtccatccactattccttgctgaatagtcaatcgctgagcctcatctctagtacattgtgtggtgaaacccattggctgggaccggagaatagccatgttagtgtgcagagctctgttaagaggccatggagc

SEQ ID NO: 686111 - DNA, 757 bp, Homo sapiens
gccgggcgctgtggctcacgcctgtaatcccagtactttggaaggctgaggcgggtggatcgcttgaggtcaggagttcattaccaacctgggcaagggcaacatggagaaaccccatgtctctacaaaaaatataaaaattagctgggtgtggtggtgcacgcttgtagtcctagctactccggaggctgaggcatgagaattgcttgaacctgggaggtggaggttgcagtgggctgggattgtgccactatactccagcctgggtgacacagcaagactctgtctttaaaaaaaaaaaaaaaaaaggaaacgaagaagagttaaaataaatatagggattaatggatcattctattaaaaagcaaattttatgccttgagctgggagtagtatcggataaattggtaaagtggccttcccaacggtgatatttgggtggattttataacctccttttatctccttcctattttggggtcccctatctagatccatcatcttctctcacattctatcctctttttttgttttcccaactggattttagcttcccccatggttgtggtggaggttaaccctttcttgtgcgcgaaccatattcccccagcggtccaagtatgcctggtcgaaacatctgggggtgtgccctctggagaattctacacagatgtctcggcttacagtttgccttgaaaaaaatggggcgctcttaaccgggaaaacggaaaatacgctgggacatgggtcccagaac

SEQ ID NO: 686112 - DNA, 179 bp, Homo sapiens
  misc_feature (45)..(45): n is a, c, g, or t
  misc_feature (72)..(72): n is a, c, g, or t
  misc_feature (77)..(77): n is a, c, g, or t
  misc_feature (85)..(85): n is a, c, g, or t
  misc_feature (132)..(132): n is a, c, g, or t
  misc_feature (136)..(136): n is a, c, g, or t
  misc_feature (154)..(154): n is a, c, g, or t
  misc_feature (162)..(162): n is a, c, g, or t
  misc_feature (166)..(168): n is a, c, g, or t
tttttataacaatagttaaagtaataaaaacatacaaaactttgntttttttttaatatatatacacagtgnaaggntgaagcanctttgacttttctctcaaaatttacgtctgtatgaaaacccaacccnctgnagtaacaatctggggggngtgaagcngtgnnnacccagagctc

SEQ ID NO: 686113 - DNA, 1681 bp, Homo sapiens
  misc_feature (1)..(1): n is a, c, g, or t
  misc_feature (614)..(614): n is a, c, g, or t
  misc_feature (932)..(932): n is a, c, g, or t
ntgctgcgcggtcatcgcggtgctgcgctctcgtttccgtgcctcagctcgtcttgattggatgatctgattgcttcagttgctgtctcccccctgtctggttgggatggttgtttatgctctatccccgctggttctttatcagatcagccgctgcattttactctcttcgctgcggctggttgtgaggagccacccacgcgtgtttgttggtgatcacccgtgggactgccgccctcgcccagaggtcgttattagacggcgtccttccttcaagttgttgttgtcccccttatgacggcctgttgtttggtttccgcgaaggaactccctcccgcgggggtttgccccttttggtgggaatttccgccgagggttcttccttgaatttgcccgcattgagtttccccttgtccgagggccctctggtatgtggaaaaagttggattttttgtggggctccccccgagattggtaggggggtttgaaaccttatttctcgaccaagctgctattctccttctcgggtaggattctcaccccgtttttgttgtggttaagaccgccaccccttgcgcccccggactccggtcgccgcccttgtgggatccgcncacatgtgtgttgatggaatgcccttatttggtgcttgtttgtgcccgccaaaaaaaggggggaccaccatatttaatatggctttattattggagatttgttgaacatccggcgtttaacccacacccccgggtcgcataatgtatagtaaagcccacgggtttccacccgcggttttttaagaaaagtcacacacaactgtgtcctgccggaattcccccagcaagaggtgtagggcggcaataaaactctctgtcgccttcaactcgctctacgctcacggggattcccaacgcgggggaaaccgcagagaggtntcaaaaggtgtccacagacacttttctttccctctcgaagcggagtttcacaacgagtttctattttcctctctctctcttcgctatagagtctcaaaagaagattcacagcctctttcaccttctcaccgagagagagatttctaacagtgttctctgggtgttcttaatataaagaagggagtctccgagagggtgatttttttcgccactgtcccccgctctcgagagggttcacaagagtgtccaagaatgcccacaggtgtctatttttcaccgcgccccacaagagagcgcaccccgcagttcacacaagtggccacagagttctcccactatctctcccacataaagagatatgtctgttgtccccactccacgcgaggaagttcctctcccacagaaagtgcacacagtcctcgagaaagagaattgggactcgaaagcttctcccaagtgtcacccctcttaagggagaaaagttattttttgtgtgtaccacattattatatataaagggagttttgtggagatagttctgtataaagtgtaaacctatggagaagatatattctcacccacttctatatccaaaatggagttctggagttatctaatgtaaaatttcccaccccgctaaagagataaataaaaaattttgttgagaatgtattaaacactcactatatggttctgtaaatttgggtttttatttggccaccatttaaataaaatgtttttaaactaga

SEQ ID NO: 686114 - DNA, 142 bp, Homo sapiens
agtcaatttgtcttgtctgtctgtctgcacaccaaattttcctaccaaaccctctcacatagtctttctgggactcgtgcttctccgtattgccttgatactcaaagccaacggcgctcttatccactttggccttatcgag

SEQ ID NO: 686115 - DNA, 196 bp, Homo sapiens
  misc_feature (1)..(1): n is a, c, g, or t
nactagaggatccccgataccccattttgtgttcaacagctactagagggacgggtgtatttaaaaaaacctagggcagagggctttgggaagagtaagaagaattgggagggccttaaatatagtagcttagttggaaaattgtgagggactttcgtacgggaggtccttcaggggtcccgagctcgattccgat

SEQ ID NO: 686116 - DNA, 461 bp, Homo sapiens
  misc_feature (56)..(56): n is a, c, g, or t
agtcgactctagccatctatgtcatcccccttcgtgagggggtgcgtatagcaggnaaacgtataggacatctctccaattcttcctctactggcagctccgcggcgacctcctaggcaacatctcctaggactttctacaagctctagtacttagcataaagtgggaccctgtggtaccctattccgaaatgagtctagcagtcaccggctataaggtgaggaagcaatcaagctaaggccagaatgggaaggaacagctcctctgtgtttccagtgaacataaagcagcagcaatttataagcaatatggcatctgagtgagacataagcaaagggtttgtgactgtgagaggaatgacattcatggaactattctctcagtaacttgcagtaggaaactataaaaaacgggcagatggtatcactgcagaaaggcagagttcacaggggcagtgatgg

SEQ ID NO: 686117 - DNA, 145 bp, Homo sapiens
ccgtgggcttcgagtgctgagacacaggcgtgcaccacacactctggctaatttttgtattttttgcagagacgtggtttcaccttgtttttctggctggtctggaactcacgtggtagaccaagcatctctacagccccaagcg

SEQ ID NO: 686118 - DNA, 162 bp, Homo sapiens
  misc_feature (116)..(116): n is a, c, g, or t
  misc_feature (139)..(139): n is a, c, g, or t
ctatcagcgcctccgtaacgtcctaacacctccgtaacgagcgcctccgtaacgagcgcttccgtaacgagcgcctccgtaacagcgcctcctacacccctagaatggtttatatncgggatcgcgatttttcttttcnttggtggcgctctgttacggggt

SEQ ID NO: 686119 - DNA, 603 bp, Homo sapiens
agtacgacggcagactctcttagcttgtaatcatttactttatttaccatatttttttaagtggcgacgttagatacatcctgaggatagtcagtaagattcgtctacttgctttgtcttctcctttgctctgtttgtgcgttgagttgcattatttcttcgtggttgacacactaaatagcatcatgttttgtcactggaatccccattacttgttcttaattataaaattaaacatatttagtccttatccagaagcctcacatgatgttggtcttactgtgcagtaagtaggacatgtctaaaaaagccatcgcaggaacaaggttttttaaaatcataaatatgcatgagtgttctacattccttagacatgattcatagttaggatgaataaaatctcatctcactactgtgttatctgtgtcataatcattaaaccatttctggattatcatcctgtataagatgttgctatcaagaagtctattatcaatataaacttcttatcctttgaccttcatgctcaaataattgatatgattatttcaatttttgttcttagaaataaccattacatgggtattactattcttgggctaa

SEQ ID NO: 686120 - DNA, 257 bp, Homo sapiens
acctcccgtgttcacgccattctcctgcctcagtctcccaagtagctgagactacaggcgtccgccaccacacccggctaattttttgtatttttagtagaaacggggtttcaccatgttagccaggctggtcttgatctcctgacctcatgatccgcccgcctcggcctcccaaaaggctaggattacaggtgtgagccaccgtgcccagctggaaatgtttaaatttgataatttagtgttgggcgataacatca

SEQ ID NO: 686121 - DNA, 174 bp, Homo sapiens
  misc_feature (1)..(1): n is a, c, g, or t
  misc_feature (37)..(37): n is a, c, g, or t
ntttctcctccggccagaatcaacgaagcggtttggnggcaatgggagcccattggcggtctaattcgcgcaccctggttcgggcgtatagtaacgaataacgtgtaatatcggctcatcgcgccatttgcaactcgcttttttcaagccgtgttcgttccatttcgggtaccg

SEQ ID NO: 686122 - DNA, 694 bp, Homo sapiens
  misc_feature (415)..(415): n is a, c, g, or t
  misc_feature (423)..(423): n is a, c, g, or t
  misc_feature (476)..(476): n is a, c, g, or t
  misc_feature (554)..(554): n is a, c, g, or t
  misc_feature (556)..(556): n is a, c, g, or t
  misc_feature (567)..(567): n is a, c, g, or t
  misc_feature (593)..(593): n is a, c, g, or t
  misc_feature (620)..(620): n is a, c, g, or t
  misc_feature (623)..(623): n is a, c, g, or t
  misc_feature (625)..(625): n is a, c, g, or t
  misc_feature (628)..(628): n is a, c, g, or t
  misc_feature (630)..(630): n is a, c, g, or t
  misc_feature (632)..(633): n is a, c, g, or t
  misc_feature (639)..(639): n is a, c, g, or t
  misc_feature (644)..(644): n is a, c, g, or t
  misc_feature (653)..(653): n is a, c, g, or t
gatctccaggctgctgcaggtggatcctgaggcacgcctgacagctgagcaggccctacagcacccttctttgagcgttgtgaaggcagccaaaccctggaaccctcaccccccccgccagcggttccgggtggcagtgtggacagtggctggctgctcggacgagtggccctaagcacccattgtgtacggccactgtagccaagaatagcacatcgttgtaggggagcaccctaagcgcgttcggttaatgcccgcacccttaattcgaaccacctggttggccttccggctctacgggcactgggtaaagaaaggggagcagcagaaccgggcggctctctttcagcaccggcccctgggccttttcccatcatgggccctgaacgaggagggagactctgctgctataacngaggatgnggccgtgcttgtgctgggctaggacctcaaccccagggattcccaggaagcanaactctccagaagaagggttttgatcattccagctcctctgggctctggcctcaggcccactaatgatcctgctaccntnttgaagaccancccggtacctctctccccactggccngactctgagatcagagctggggtgganggnanccntncnnaagccnggtgnccgtcagtngttgatggtcttcattaggaactatagtttgtttacgctcc

SEQ ID NO: 686123 - DNA, 269 bp, Homo sapiens
cgggggggggggttcccccccccccccccccccggggggggagggtggggtttttttccccccccccccttggggcggggtttttttgccctttttcccgggggggggggcccctttttcccctttcccccccccccccccccgggggggggggggttttttcccccccatatcccttttttggcccccccggtttcccttttttccccccgggttttttttcctttttggggccggggttcccttttttttaaggggggggtttttga

SEQ ID NO: 686124 - DNA, 180 bp, Homo sapiens
cgataatggcccatttggccaaaaagccggttagcgtttgcaggcctcctagggagaggagggtggatggaattaagggagctagtcatgttagctcgtttcaggggccagatagtaacagcgtcgtgactctgaagaccagttgagtagtaggaatgcggtagtagttaggataatata

SEQ ID NO: 686125 - DNA, 749 bp, Homo sapiens
ccgatgaatcccgagggggcgcccatcattttgggagtaaagaacagtgcgtggcaatgggtctgtatcgaaacagaccggcggaggatatatgtggggccccagacgaaagatttggtggaggccgaccccacgcctctcgtctctttgtaagaaccatcctgtctcagtatccaccacgcgcgcccctcatcagcgccggcgcgaaaattagccgctggatatgcttgtcgccgcctccctaaggactgtcgcagacatgagaaagaggggcgtattcttggtatatgagacaaaagcgcgctccggcggtgtgtatttccagcctcctcgtggaagcggtccaaaaacgggctatcgccctcgaagtgcgtgggacatagagagatatctcgctcaggctttctctcaacaacaatttccacgcacgtggtcttcgagtgaggctcacgcgcagagctctcgcccccgtgttgtgcggaggggcgcatcttggaaagcacccgtggccgtttcgacgagcacagcctatccatgggcccagacatggtgcgagtgcaccagagttctccctgccgccttgttacgacgactactacgggaagtgccgcattcggacggcttcgattccaacaactgtcttttgattgaagaggcagtccacggctggtaaataacagtctccgttgccggaaaacccgtgcgggtcaaacatcggggccccaaggttttttcacgccaacataaca

SEQ ID NO: 686126 - DNA, 483 bp, Homo sapiens
tggccctggacacgacgtggatactgggctgctggtagggcccagctaaggccctgagagctccatgcaggctgggacgttgggagatgcgaggaggtccctggtgcagggctgcagagagggcttaggatgagcacgagaggagttcaggactgggtgtggccaagggggaggacagagactacgagttagggtggggagcaggtggctgagatctgctggtcacatcgtgtgacacagatggactcgattccaaagacagtgacaagaccctgtggcgatcctcgcctgatcaggaaagtgtcatccgcaaggtctgggtgatctatcaataatattggccatcatgaaagggggctccaaggagtactggtttgtgctgactgctgagaatctgtcctggtacaaggatgatgaggagaaagagaagaaatacatgctgtctgtggacaacctcaagcggcggtaggtatgtgaaggacg

SEQ ID NO: 686127 - DNA, 765 bp, Homo sapiens
  misc_feature (133)..(133): n is a, c, g, or t
  misc_feature (153)..(153): n is a, c, g, or t
  misc_feature (229)..(229): n is a, c, g, or t
  misc_feature (239)..(239): n is a, c, g, or t
  misc_feature (256)..(256): n is a, c, g, or t
  misc_feature (279)..(279): n is a, c, g, or t
  misc_feature (316)..(316): n is a, c, g, or t
  misc_feature (345)..(345): n is a, c, g, or t
  misc_feature (351)..(351): n is a, c, g, or t
  misc_feature (357)..(357): n is a, c, g, or t
  misc_feature (367)..(367): n is a, c, g, or t
  misc_feature (413)..(413): n is a, c, g, or t
  misc_feature (447)..(447): n is a, c, g, or t
  misc_feature (462)..(462): n is a, c, g, or t
ggaaaaaaaagaacctacttaagatagaacatggttttggctatggcttgactcatgggctttcagtgcttttttccatttgttgaaagtaacatttctctctctctctcttttttttttttttttttataanagcaaaccattgtttttgtnagtgttaagtacctttggtctatgggtctcttggccagccctccccttttcccaatgaaagccatgtcaaattaantcacgggatngacggcttcatcttttnattttaatgaaggggtgtaccanggttgtaaagcaataagatttgagatgaacactatgnaaacttcgcttttggctaaaaaatagcangttgantagtantcaaaaaacntagaaagattttagttcaaaatgatggctcctttctctaccggganttttaaaaaatcaatggtcatctaatatgagttnattggtctatagacncaagtatcaaggtctaaaaaaaatcatgattttaaacttccaccgatgaggcaggtaggagataaagatgaattctgaaggttactaaagagtacgtcatttttctaccttgtagggcagggtgggcaagggggttacctgaccttattgggggtttgggctccttttattcacccttgtttttccagagactcggccccgtgatccttttattctgcacagcttggggctcaacaaaacaaagggggctccacacttggtttttttctcctttttttttcccgtttcggtcacttcccaaga

SEQ ID NO: 686128 - DNA, 750 bp, Homo sapiens
ccatgcagcgctcctgggcggtgctgcggacgaggctggcctactccttgcctgtggctggccctgcgggagctggagcctgggtgcgtgctctcccggtcgggggctggcggggtgccgcggcctgggcctggaagacgaggcggcgccctgcgctgggccgcagagggaatgggcagcggcgtgcccctgaggccggggcggacggactgagcctgcggggagcggggtccccggcgcgcggcggttccgggagctcagcgcgcagcctgcgggcagcccactgggccagcctggcgggggtccgacggcggcggcggtggcggcagctgcccgatccagcggcatcagccgtgggctacgaccagcgccacggcagcccgcgctccggtcgctcggacccgcgtccggtcccgggccgccttcggtgggcagcgcccgtccagcgtttccagcctcggctcccggggctccggcctggcgcctacgcttgacttcctccctgcccggctgccttgcccccggccgctcgctccccggagcctggcggggccggcccccttcccgttgcctgaactcccgattgcccctggccgggaggggcggcccaaagcgcggccggaactggcggcttggaggcgctcacccggggaagctgagctgggcggctcgaggcgcgcaacggcgcgggactacttcggcatttgctcaagtgtggcttggcatctacggggccccagcagggtttca

SEQ ID NO: 686129 - DNA, 100 bp, Homo sapiens
aatttgattgtagaggatccccgtgactacacaggcactgtcacagcccttactgtcccttttccaaaaatcaaacagacaagccaaatcccacagcata

SEQ ID NO: 686130 - DNA, 799 bp, Homo sapiens
  misc_feature (799)..(799): n is a, c, g, or t
ggcagtcagcccggcccgggtcatgcgtggtagggcctgatgggttgtatcggccgtcgcatgtgctctccgctctgggagcctgctgccgtccgtcgaggtctcggttagcctaagtgccgcgctgccgggctcgagcggaggcggcgcatggcgcttgagggcatggcagcggatgcgggctgcggggcctgtcgcgtgtgcggaaagctgctaggtccagccctgcgtggggacgttttctgccagacagatttgtggaagaacctgaccgtggacgagggcaccatgagaggtatgaggtgcttggcgtgccctgaccgagcaactacatgtaccttggtcattgatgatgagaccaaggaggctgccattgtggatccggtgcagccccagaaggtcgtggacgcggcgagaaagcacggggtgaaactgaccacagtgctcaccacccagcaccagtgggaccatgctggcgggaatgatgaaactgtgtcaagctggagtcgggactgacggtgtccgggggtgactgaccgtatcggggccctgactcacaagatcacttcaccttgtccacactgcaggtggggtctctgaactgtcaagtgcctggcgacccctgtgccagagcttcaggacacattgtgttacttcgtgagcaagcccggaggctcggagccccctgcctgtgttcacaggtgacacctggtttgtggctggctgcgggaagttctatgaagggactgcgggatgagcatgtgtaaaagctctgctggaggtcttgggccgggtccan

SEQ ID NO: 686131 - DNA, 144 bp, Homo sapiens
ggtgattacaggatcttattttagcaggcacttttacccaggctttatggagaggagggtggatggaattaagggtgttagtcatgttcagctatgttgtatggtgcgagatagtagtagggtcgtggtgctggagtaaagttg

SEQ ID NO: 686132 - DNA, 552 bp, Homo sapiens
gaatattatcacagcaaaacctcattaattggatgctatcaaaattatgaaaggaaatctgagtgagcacacttgtttgaaaagaaattggtaaatacttctatgatgcagttttaagttatacaattaactcctatttggaatttaataagtccactataagcaatgtgcctgcacaccaattaaaggttggatctgtctcttcttgacaattttttagaagccattatttcgttaccaaataaacctgaagttaagaaatatttatatttacatctatttatatctgttggagaatatttcataactcagacttggttgttttacacagacttctccccattatccaacatagtgagatttttctatagttctatattttactctagtattaatgtggttttataaatgattatatgccttatattctggggggaaagaaatgtgaaaatgtgctaagtagacagaaacagaatatataagtcgtttcgaatgttatttcttttttaaaaaatttgcttggtgtcatatagccaaaactattcatggtga

SEQ ID NO: 686133 - DNA, 205 bp, Homo sapiens
atgctgcagtgatctagaggatccctgcgggtcttcacgtggggtgctgatgtctacatgtcgggcccagcttcgctggccagcatttctacgccgtggcgcggcgggcatattgcgagggctgctacgtgagcaccctggagaaatgtgcccctgtggtcccagcccatcctggggccggctcctgcgggctatgggggaaggg

SEQ ID NO: 686134 - DNA, 474 bp, Homo sapiens
  misc_feature (1)..(1): n is a, c, g, or t
  misc_feature (62)..(62): n is a, c, g, or t
  misc_feature (193)..(193): n is a, c, g, or t
  misc_feature (356)..(356): n is a, c, g, or t
  misc_feature (390)..(390): n is a, c, g, or t
ntttttaagaatctcactcctgtatctcagcctggagtgcactggtgccgtcatggctctcnagccttcgacttcccgggttcaaagcgatcctcccaccttagcctcccaaaagtgtttagggttacagacatgagccactgcacttggcccgagagttattttttacaaaaatgggatcaagcccaagtgngtgttgcgcctgtagttccagcttacttgggaggttgaggtgggaggattgcttgaggctaggagtttgagaccagtctgggcaacacagcatgactctgaccagtctgggcaacacagcatgactctgtctcttaaaaaaaaaaaaaagtgggctgagggtnggtgtaacgccggtaatccttgcactttgggagncaaggcaggtggatcacctgaggtcaggagttcgggaccagcctggccaacatgaatgaaaccccctctctaccaaaaatatat

SEQ ID NO: 686135 - DNA, 146 bp, Homo sapiens
cgtggaattccactccggagggtgactgtccgcgatggccatgccggacagccccccacttgccgttccgccagatgcacacggtgtagtgcaccctggactcctgctcctccaccacctaggcgcctccctcctgcggcgggttc

SEQ ID NO: 686136 - DNA, 172 bp, Homo sapiens
tcgctccctcggctctaggattcggcgagtgctgctgccgggggggctgtaacactcgggggggggtatgaacaacagtgcaagtatgaacaacagtgcaggtataaacaacagtgcaggtataaacaacagtgcatgtataaacaacagtgcaggtataaacaacagtgca

SEQ ID NO: 686137 - DNA, 174 bp, Homo sapiens
  misc_feature (34)..(34): n is a, c, g, or t
cacgagggacacggggtttcaccgtgttggccangctggtctcgaactcctgaccttaggcgatcccaatgcctcaacctcccaaggtgttgggattacaggtgcgagccaccatgcccagccaagggttgaattttgaggtgactaacgctgcctggtggtgggggtaggggg

SEQ ID NO: 686138 - DNA, 106 bp, Homo sapiens
tgggtgctgtttgcattgatagtagaggtgagtgtagtagagatggggcgaggcaggaggagagttgcggtgagtgagattgtgccatgttctcagctggtgaaca

SEQ ID NO: 686139 - DNA, 285 bp, Homo sapiens
ctaattggttcttcgatgacgaacggtcgcgccgatactgacgacgaagtgcttcaggccgaggtgctcatgcacaacgagcttcaatctggcgaagtacgcgagttcgtagcagtagccccaaaagccgagcaaggctactagcaggccgttgaaaaagtcgatgcgggttcaaaaaatggtgatttcgggggtgcctcaccccttacccactcttaaaaaatcgcttgtaggtcgttctgaaaggtcggcctttgggtccttcgtcatcgaagaaccaattag

SEQ ID NO: 686140 - DNA, 1010 bp, Homo sapiens
ggtccccggggtctccgggcgaactgaggctgcggtggacgtgacgccgcgtgggtgcgagctagccggctccggcgcttctccgcgggatccagacgccgtcctgggtgctgctggctggagggatcgtgagagcggctgcggacaatggacgtcacctccggggcatttgcgcaaccagcacatctcgagatgagaccctgagagtagctcttcagcaagactcgaccgcatttggcaaggtgctcgtacggggaggtctacacgggcatcgaataaaccagacaaaaggaggtggtgtgccactcagagactcactcggacctctgtgaagtgatgggccgacggattgacgctctgaggactattcctagctagggatgagtcatcgtgtctcttcatgtcatgtggcggaccaggccctaggattcgacgcacgctacgtttgagctcctagccctaaaaggaagcaccaagaggctactaggagtcaatcaattgggaaagtacccgtgaggcagagcgggactcgaggcaccttgggaactttgcgttataaacacgaaggatccgcccttgggaagggacagaccagtacaatttggccgatcggaattcgctgtgccgggagaaagaacttcttggaaacgggaggcactggggccagtttactactgccagcttcacggaaatcggccagatggaattcacaggccggaccggaaccaatttccacaatggattttgggccaaagacgggttggccgttaacttcagtgccgtgaaaggactgagggggatggatcgtgggtggaagacggcacttggggtctggtgaaccctttagggggacgagagtaactgaccaatgtgtgtgagaaagagcgatcctatcttagagagacaacttggctcaggcaaaattgtaaaacggaagggggcgaaacggaacaagttaccagttggaaggggcatagcaccactgggtattgtctattggagaaatgggg

SEQ ID NO: 686141 - DNA, 114 bp, Homo sapiens
ttagactcactgcaactctgcctctcaggtacaagtcattctctagtcttcatcgctctccgagtggctggcgcattacagtgcgtgctgccaccagtgcgcgaggcataattt

SEQ ID NO: 686142 - DNA, 375 bp, Homo sapiens
  misc_feature (6)..(6): n is a, c, g, or t
  misc_feature (112)..(112): n is a, c, g, or t
  misc_feature (117)..(117): n is a, c, g, or t
  misc_feature (201)..(201): n is a, c, g, or t
  misc_feature (331)..(331): n is a, c, g, or t
ggtggnaaaggtgggaagttgttttccaagcatgaagatagggttcaaggctgtgaaatcaagaagtctagagccctaagataaaagaagataccccagggctgggcccacnggttntttcgccctgtaatccctagcactttgggaggccaaggcaggcagactgcctgagctcaggagttcgagactagcctgagcaanacggtgaaaccctgtctctactaaaatacaaaaaagtagccaggtgtggcggcatgcacctgtagtcccagctactcgagaggctgaggcaggagaattgcttgaacccgggaggcggaggttgcagttnttggagatcgcgccactgcactctagcctgggtgacagagcgag

SEQ ID NO: 686143 - DNA, 187 bp, Homo sapiens
tgtcagaggatcccaatgatgctcaccgctcctatttagggaattaggggcatggtcactcacacgttagtggcatgtcatcaaagccatttatattatatatatcctaactttctcgggtgcagaaggaacaggcaacaccttgggggatctggtgccttgaagagaatcaagatctatcctgcca

SEQ ID NO: 686144 - DNA, 240 bp, Homo sapiens
accaatacaagtaccttagaacagtagtacccaagttcacgctattaactgtaattatgggtcccgtaaatccttatatgaaatcctttggaccagattgttttagaattaatttttcagatacttaaaaggttatttggtacatatactgcatattacataaataccctaatggggtctaggcagtacacccataatcatttaagttggtttggtttgtttttttgctttgttttggga

SEQ ID NO: 686145 - DNA, 396 bp, Homo sapiens
cggcacgaggaaaataatgagaaccaatgggcacaacacagagaacaacagacactggggataactagagcggggagggagagagaggggaagggtgtttctaactatcaggtgctacactcaatacctgggtgacaggatcaatcataccccaaaccccagcacgttacgttacacccatgtaacaaacctgcacatgtactcccaaatctaaaataaaagttaaaattatatctagggaagagagtgggaggagggagaggatcaggaacaataactatcaggtactgtgcttagtacctgggtgaagaaatggtctgtacacgagacctccgtgacatgagtttgcctttgttaacctgcacatgagccccagacctaaaataaaaaaaaaaa

SEQ ID NO: 686146 - DNA, 864 bp, Homo sapiens
tattttggatctttgttagttgcatactatatttcagtgtttatcttcttggtgaattgacccttttatcattatgtaacttccctatatttatatctttatatttaaaatagatttccttaaaccataagacatttgagaagtaaaaataaaataaaatagctttcttgctgatagcatatagtcgggtcttgttttttctttttccaatccgataatctttgtctttttttttttttgggaaatgggaatctgtgctctaccaccgtggacgggaattgcaagtgacgtgatcctcagctcacgtgcagcctccacctcccaggttcaagcgattctccgtgcctcaagcctcccgagttagctgggattataggccacccgccaccagtgcccagctaattttggtatggtcagtagagaacggggttccaccatgtgggtaaggcggggggaagttcctataattaattcctggttaaatttgggtatacgccagaagaacatgctttatgtgggtttcatttaacatttggtcacgttctattttatgacccagaatatgatctatccgggtatatgtccggtgggcctgggaccgaatatgtatcccggtggtcctggggtaagaagtgtttgggtaaattgtccctttattttaacccagttgaataccgtttatccaggcttggcataatatccctttttgggaattccattctaatttgtttatcagtccattggaaagtgggccttattgagttctcccagctaatgactgttgcaatttttcccaaatttttctgtaagttctatcaacttttgggtccataaattggggacacgttgcaacgcgcattaaat

SEQ ID NO: 686147 - DNA, 388 bp, Homo sapiens
ttttgtagcgttggaatctcaccaggttgttcaggttggtcttgaactcctggcctcaagtgatcctccctcctcggcctcgcagagtgttgtttttctttccttagtacgggggtttagtgctgtaaattttccccagagtactgctttagtggcttcacacaacttttgataatttcgatatactttttattttcatttcattttaaatacattctaattaatttactttttaattttatctttgacttgtgtggatgttttgttttgtttttagatatttgttagtttccaattatttgaggatttttctagatttttttatttgtttctaatttatttctggtgtagtcagagaataaactttgtacaattgagtcttcgtaaa

SEQ ID NO: 686148 - DNA, 164 bp, Homo sapiens
cgaaagatagtgaactatgcctgactgtcgctatcaaccaacacctttatcatggggatctgatgagacgtcgagaatcgggcgccattaacccggacgattcgagttcatcccgacagcgccagattctgcaataccaaacaatggcccactagagcactcgc

SEQ ID NO: 686149 - DNA, 120 bp, Homo sapiens
gtttccatcctcaacaattccagtatactctggataataatgttctaaccctggaacagagaaaattttattgaaggaaattgggtttctagtaatcaaaaatcttgtaccctatgcccg

SEQ ID NO: 686150 - DNA, 672 bp, Homo sapiens
  misc_feature (21)..(22): n is a, c, g, or t
gttccagaatatctctcaacnntatttttagcattatggacacttacaagaaaaaatttgactgccaattttaaatgcaatgaaagtacttttaagattaacaccttaggactttacatttggcatgttttggtaacaaactgctttataacaataactataaaatgctcccatagaactatgagtttcaattctcctctatactcaaactcaagcaagtcagttgccacatctcttattgggaagtcaagtagggaaagtgataaatacatgaaattctgaagagaaagacaagacagatttattggtaatcctccagattttagataaatattttgctgtgtagcaaaagccatacctgtgagaccatagatttgtttgatagtcttgatatcacctgaaagaacaaacagaagtattaatcattttacatatactggtggtttgggactgggtgaaatgcagcaggcagaggaaagagaagtatgtacagagtttgtgggagggaaggagcacaggaaggggtgtggatctacctgtgcaggccagagaagagagaacaccttctacaatgtgccaacaactgcctcatactatactctaggaccactactgatcagagtgtgtaatgagggagcaccaagttgaatgtgtaccacaggataccaccct

SEQ ID NO: 686151 - DNA, 103 bp, Homo sapiens
gcaggaagctgaacaggcgtggctcgtgagctcaggaccacaggtcgacctgtctggatgtttgaagtaggactgctgtgattaggacggatcagacgaagag

SEQ ID NO: 686152 - DNA, 389 bp, Homo sapiens
aaactcggtctcaaaaaaaaaaaaagaaaagaaaagaaaagaaaagaaaatgttcataaataaaagaatggaggaaaagttgtaagaaaaacttaaaaaaaaaatctggcttggtgcagtggctcacgcctgtagtcccagcactttgggaggccaaggtgggtggatcacctgaggtcatgagttcgagaccagccggaccaacatggagaaaccccgtctctattaaaatacaaaattagcagattgtggtggcgcatgcctgtaatcccacctactcaggaggctgaggcaggagaattgcttgaacctgggaggcagaggttgcggtgagccgagatcgcgccattgcactccagcctgggcaacaaaagcgaaactcggtctca

SEQ ID NO: 686153 - DNA, 284 bp, Homo sapiens
ccccaaaaccccccccagggggggtttgcccccccgaatggtccgggctttaaaaattaagtgggtttcccgtttaatgccctttcccgggaatattttcccccatttcccatcctttttttttccccccgccaagcccttgggattaaacaaaccggggtttgttttttttatgggaagccccccgggggcttttttttgggccttttgtttaagggttcccccacaccgtggtttttttttaacccccaaaaacctttttgttttgtttgttggggggaaga

SEQ ID NO: 686154 - DNA, 717 bp, Homo sapiens
  misc_feature (537)..(538): n is a, c, g, or t
  misc_feature (544)..(545): n is a, c, g, or t
tatctgaatcctgcgtgtcgacacgcggactcaggacgtcatggaacatagtgcatagcgtgtctcctaatagatactgttcttcagtaatggttggatcctcatgattagaaaatgtcctgagctgtgggatctcataggccgtccttgatcaaaggactagtactcggagaagtccatagagcggtcgagtcatcgtgggagacgtactcaagaaggagagagtccatgagtgaggctctgaatatcacatggatcggacacgctgtccggatggtagaattcctctaagtacaatggatgggcctttaaaaccactttcctggggccatgtggcattaacagaaattaatgcctgaattaccaaaggtttgttgtggccagcttgtggcgctctagtggggaagaacttgtggcacggtgcccttgcagatcacaacagtcaatacccttgtctgtgcaacgacggtggactgcagcgtgcgttcctggacaacattcgcgggaactgaagcaacgtcgccagcagtgtctgtnngaagcnncgcagcattctgtgtcaggtgtttggctgactatttgccccgttgcgtattggacggacgacgtctaacaaaactactttagaaggtttgtatttgacatacttctttcaggcaaggccttcccccagagcccacggttggaccaaagttcagaacttatgtacactggtgg

SEQ ID NO: 686155 - DNA, 258 bp, Homo sapiens
tacaaaaaaaaaaaaccatcaaaagttgggaccggtatctccatccatccacctatctattcaatcaataagggatatccggagcaccaccgggatggcaagcacggggcttaagtgtcgaggataaaaagagaacaacactttctggccactacaagcaagccttatagtccagaacaagaaatgagacatttttcctttaccaagtccagtccctaggatctctttaatatattctctttattccaatactattct

SEQ ID NO: 686156 - DNA, 890 bp, Homo sapiens
  misc_feature (35)..(35): n is a, c, g, or t
  misc_feature (62)..(62): n is a, c, g, or t
  misc_feature (64)..(64): n is a, c, g, or t
  misc_feature (72)..(72): n is a, c, g, or t
  misc_feature (81)..(82): n is a, c, g, or t
  misc_feature (103)..(104): n is a, c, g, or t
  misc_feature (113)..(113): n is a, c, g, or t
  misc_feature (133)..(133): n is a, c, g, or t
  misc_feature (135)..(135): n is a, c, g, or t
  misc_feature (146)..(147): n is a, c, g, or t
  misc_feature (153)..(153): n is a, c, g, or t
  misc_feature (164)..(164): n is a, c, g, or t
  misc_feature (174)..(174): n is a, c, g, or t
  misc_feature (186)..(186): n is a, c, g, or t
  misc_feature (198)..(198): n is a, c, g, or t
  misc_feature (215)..(215): n is a, c, g, or t
  misc_feature (233)..(233): n is a, c, g, or t
  misc_feature (237)..(237): n is a, c, g, or t
  misc_feature (244)..(246): n is a, c, g, or t
  misc_feature (261)..(261): n is a, c, g, or t
  misc_feature (276)..(276): n is a, c, g, or t
  misc_feature (301)..(302): n is a, c, g, or t
  misc_feature (309)..(311): n is a, c, g, or t
  misc_feature (336)..(336): n is a, c, g, or t
  misc_feature (362)..(362): n is a, c, g, or t
  misc_feature (390)..(390): n is a, c, g, or t
  misc_feature (460)..(460): n is a, c, g, or t
  misc_feature (465)..(465): n is a, c, g, or t
  misc_feature (478)..(478): n is a, c, g, or t
  misc_feature (541)..(541): n is a, c, g, or t
  misc_feature (556)..(556): n is a, c, g, or t
  misc_feature (705)..(705): n is a, c, g, or t
  misc_feature (734)..(734): n is a, c, g, or t
  misc_feature (741)..(741): n is a, c, g, or t
  misc_feature (754)..(754): n is a, c, g, or t
  misc_feature (756)..(756): n is a, c, g, or t
  misc_feature (775)..(775): n is a, c, g, or t
  misc_feature (794)..(794): n is a, c, g, or t
  misc_feature (829)..(829): n is a, c, g, or t
  misc_feature (875)..(875): n is a, c, g, or t
tctgaataaatcactttacaattactgaaaaacangttcattaccttagctatgtacttaangnaccaaatnccccaaacnnaataaacaccccaatataaannccttaagantttacaaaacagtacaaaanancttaaaatttnnaaattngtctgatacantctgtaaganctcttcgagagngcggtccaattncagatctatatactttncttcagaggggcaaaganaggntgctttnnngcttctctgagagtnattcttttggctggntcatactccaacattttctgaatgnngtcaaannnacgctcatgttcaacatcttgaganagcataaattccttcagaggtttacngcgtcttgaaacatatctgccggcaganctgtgttcatcccagtctaatcgatcgtggtgaaaatatttacgtttcctggttttctgtatcatatgtnttggnagaggtccaagantcctttccatcattgctaaatgctccttactatcgtgtgttggaaatacggtaaacccaaganagtattcaataagantgcatcctatgctccagacatcacatggttgggaccaccctagggctaaaataacttcaggtgctctataatgtcttgtagataccaatgtactgtgatgttcgtcatcatatgttgcactaccaaagtctacaactttaatatctggntttattaaggtgcgttcatcacgttttantttggcnttatacgcctctntntagtcagactgcacaaatnagatgttttcaggctttangtctgtgtgagtcaacttattactgtgcaaaaaantcacagacttgcatatctgatatgccatctttctgatatgatccantcgaaatggtagaaa

SEQ ID NO: 686157 - DNA, 215 bp, Homo sapiens
  misc_feature (41)..(41): n is a, c, g, or t
  misc_feature (45)..(45): n is a, c, g, or t
  misc_feature (47)..(47): n is a, c, g, or t
  misc_feature (60)..(60): n is a, c, g, or t
  misc_feature (193)..(193): n is a, c, g, or t
ggaaggatgagaaacagatttctgctcacttcatgggctgncctngnattgacgatggtncaaacccaagattatcctcatgtaatttatgaagattatggaactgcagcgcatgacatcggggacaccacgaacagaagtaatgcaatcccttccacagacgtcactgatacaaccggtcgggcacatctcncggcctatgctgccggtggtgc

SEQ ID NO: 686158 - DNA, 250 bp, Homo sapiens
ggcacgaggtgagccaagatcctgtcactggactccagcctgggcgaaagtgcaagactctctctcaaaaaaaaaattataattgtgggaattaataatattaattggaatttgttttttgggctccttttatgtcaaaggacactttaacaatttaattaaccccaagggaaacccttggggggtatatccctccatttcaaaagggggaagggggggcccccccggaacacggggccggtttcccccc

SEQ ID NO: 686159 - DNA, 558 bp, Homo sapiens
ttcttacaccattttacatttgtgccaccagaaatgaatgagggttccaatttctctgcatccttgccaacacttgttcttgtctgtctttttttttttagccatcctggtgagtttaaaatgacttggaactagtggctaatgatattgagcatcttttcatgtgcatatttgccactcatatatcctctttggagaagcatcagatcctttgcctatttttaaatcaagtcattagtcttttttttttgagatggagtcttgccctgttgcccaggctggagtgctagtggcacgatctcagcttactgcaacctctgcctcccaggagaatcacttgaacacagaagtttgagaccaacctgggcaacattgtcagaccccccatctctataaaaatttaaaaaattggccaggcattatggtgtgcacctgcagtgccagctactcgcgagacttaggtgggaggattgctcgagcctggcagtttgagactgtagtaagtatgaccacgccactgctctccagcatgtgtgacagagcaagccccatctcaaa

SEQ ID NO: 686160 - DNA, 352 bp, Homo sapiens
aactcgagctcagtaccctcgaataagggccaacatccttgatacagcgaatatatatacagcatagtgtagcattttatcaagcaatggaaatacagagaaaaatactttttttatatttataagaaagggatatcttcgctcttttcgtcccagtgtggaagtgtaaggggggtgtgatcttagctcactgcatccttgtgcccccgtgtgttaatttgttttctccaaaaatcagcctcctgagtagctgggactagaggcgtgcgccaccacatccgttttttttggtttggtttcctgttttttaagtagagatgggatggggttacaccatgtgggccttatcgag

SEQ ID NO: 686161 - DNA, 381 bp, Homo sapiens
tatcatgctgaccttactctacaaagcatctatctatcaagactatgattatattgctatccctgagaagacatcagagaagcataagatacaatgaaagagcaagtagagttgtcatcctggacttcattcccagattacctgcagcaacccatagaaagtgatttaactcattgctcgatccttacttcccgtcctgtagtaccattattttagcagctggtaatagacttcatttcaatctctaaaaattatatgatctcacaaaagcctggttgcaaagggataggttggatggttgggagcacattcatcatgaccaaagattaatactaggaaagaggcctaggcaggatcttgttctacaaaagaatacagcat

SEQ ID NO: 686162 - DNA, 126 bp, Homo sapiens
gggtgacctagaggacccgtcacttctacacaataataagtaataataataaataataaataaataaataaataaatattatggatgatgaagggtatgtggtgtagatagagcgcggaccaccgc

SEQ ID NO: 686163 - DNA, 342 bp, Homo sapiens
gagtggcatgtgaattgttccatttttggctttgagggggtcagtttgggtgcttgttgtttccgggttggggggaaagttggttgggctgggagcggagccaggttgggatggagggagtttacagcgaagcagacagggccaacgctcgaagcccgaattccaggctctgggcgcaccacacgatccaaggcgcgccacactcgactgaatgggcacggcgcggagggctcttgcgctggctctctcgctacttcaactcacatgctcttgccccccaggcctccgcgtgtgactcgctgcagcccactcgcacagctgaacgcctgctaggctgaaagc

SEQ ID NO: 686164 - DNA, 99 bp, Homo sapiens
cgccgcccggtggcccataacttctcgcgtccgggctccgccgccgccccgggcctgcgctgcgacgacccggcgtcccggaggccgcgcggtgtccgc

SEQ ID NO: 686165 - DNA, 202 bp, Homo sapiens
actagtccaacatacgcctagatttaacatctgactgtgatatgctccatgatgctgtgtgtattggtagtaagaaaacaaaaattgggaggcttaacaaagtgtggctttgtataggtagtaacaactgctggattcttcttcactcaaatattttggggctaacacttcacagcagggtcacatgtccatgcatctgacc

SEQ ID NO: 686166 - DNA, 116 bp, Homo sapiens
cctgggggctggccacactagcccagcggtccgccctggccagctgcagcgactgcgccagcgccgggtctcgacccatcaaggccacacagctggtccggggccatggtgcagct

SEQ ID NO: 686167 - DNA, 199 bp, Homo sapiens
cgcgaagatctatgaatattcatgaaggtggtccttatgcacgcatatagtacattcatgtggcatgtctcgtgctgcttgcactctgagatgtagtcttaacatttacgtgtatcacagttaggccctaaatgtcaaaaaggtcttttcaggacttgaaggcactcaagtgagcagcctctgtaaagcaaccagctcg

SEQ ID NO: 686168 - DNA, 94 bp, Homo sapiens
gaaaaccttcatgcctaagcaacgtagcttacagagtttggaggcaagcttgcatcgtcatcggagtactaccagagagtcattgaaagcagaa

SEQ ID NO: 686169 - DNA, 407 bp, Homo sapiens
  misc_feature (407)..(407): n is a, c, g, or t
ccgtcatatgctaggtacgagctgttaatggacgagcagcctgcggaaagagcgggaccggaaccgtcccggagacgccgcctcgcgatccccgcgcgggcgggacccgggcggcgcatcatgaccctttcacttcggactgttcgtcttgctacttccctacttcatcacctacaagtgcagcggctgtcgagtacaacgccttctggaaatgcgtcaggctgagtcacctacctctttgtccaactctgcaagatgctgttcttggccactttctttcccacctgggaaggcggcatctattgacttttccatttggggggggaggttccaattggaaaaaaaggggggcccaagcgtgggatttggcagacctgataggtctaaaccttgtcatgtcccggaan

SEQ ID NO: 686170 - DNA, 837 bp, Homo sapiens
  misc_feature (119)..(119): n is a, c, g, or t
gtgatttaagaataaagagagtactttgatcatgacacataggtatcttgtccctctcactagaaacggagtgtcgtgtgtggcgcgccacgtgcttctatggtggtgctttgactctngtacaagattctagtgccaaagatcaaggttgtctgaaggagccaaatgtgtgaatgtgggtgtcggctgcggcagttaaattcatcatctcaacccagagtgtctggtctccctgctctttctgcatggttgtgtccctagtcctaacgcttcgggttcttctacggtgactgtggtaagaaggatatttagatcagtgacatgcgacggcacacgtacgagtatttagactgaaacaaggttttaccaaagcagtatttactcgtgaatgtgcgtagtggcattcgtggactagtttttgagcccatgcctatcggggtcctacttcaccctaataagaagagtacaacactaaaaatcgtggatctacaagagaaataagagacacaagaaaataaaagagaaagcacatacatagacaactacaggtgggagtggagccgcgagacctcaggagaatacaccgcgctactggaaggccgccaacagcgtctgcccggcttgtccaccaatcctggtcttgtaagccaaacgagaaggattgcccgccttcatgaacaaatgggagaccacgtcaaaattactgacaatgaacaagcacccatttggcagagccctgcgtacttgacaatgcatcacttggcaggaccacacgtcgcagaaaagacctgcgctaatgacctggtggctaaaccttgcaatgagagaagaccttcc

SEQ ID NO: 686171 - DNA, 217 bp, Homo sapiens
gtagtactcatcatcttgtgtttaaagcaatttccttggttcgggtcctcaccactttcgtatgccagtctcccatttatgtccctagtaatgcctatgcacaaaacaaaaaaagagaaaaaagaaacaacggtgggatgaaccctacggggtcaagggcttaacatctcagaggtgggttaggaggtacaggagcgttgcaggggatacggagctc

SEQ ID NO: 686172 - DNA, 884 bp, Homo sapiens
ttccagcgctcattgacccagtgcgctgatcagaattttcagactctttctctccgtggtatctgaagaaaggaaggcgatgcatattattatctcagccatttctcagaaatgcccggttggcacattttttgctggctcatgaccatttcagttgtggtagatgaaattgatagtcaagaatgagatacaggtcagttgtagcacttctgtgtttggcaaattatggaaactcgttactttgcaaagaagaaaacccttcttggttgagtaaatgggtgcattagcttcagacttttcagaggatatgctacaagaaaaatttgaagaaatggtgagcaggagcgctttctactgcatcaggagaccctacctgaacagctgtggcgggagaaacagctaaatctcagtgcgatgccagtattgacgtgcaccacaactcatgggtctatatatctgtgaagaaaatagacggagtaagtgaatatgatttccaagaaaagctttgggcttgtgggaatatattgatgaggacgaagatttaattttaatgattttaaaactggaattcgtttgcaaggggtttttcaaagagataagtgcccagtctgatgggaagatgatccatgaagtttttacgacagtatttgtgagatttccgaactttaaggagggattggccaggagatatacgggggaagacggtaaagggtaagtggagaaggccactattgggtgtggagattgaattttccggaaattattcaaggggtgtaaagtataggcgctcaatgtgcaaaggtgtgcaaaggggattatgaagacaaataggagtagtgacacgggggggatagggtgttgacatgtgtgtaataatatatatc

SEQ ID NO: 686173 - DNA, 598 bp, Homo sapiens
  misc_feature (303)..(303): n is a, c, g, or t
  misc_feature (362)..(363): n is a, c, g, or t
  misc_feature (365)..(365): n is a, c, g, or t
agatggtatccaaatggcatttggccagagaaccctgggaagtctgaaggcttcagccgtgattatgaggctgccacacaagggtgatgagggaaataaatgacaagcaaagtgaggtaggcaatatgacctctattatcagtgaggtgagagcatccaaatctttgtaagcagaataactgggttgagggcttctttacccagttaagttaatgacattaggacatcacacttgccttttcaacttccatgacccaactgcagcccctctaaatcaagctccttaacttaccactctattgnaaccagaaaacttcattctcctacagtacagggaaagtaccagagagaaagacagaganntntccagaaacggctaaaactggtctggtctaggctgacctagccttctctgggggagaatacaaaaaggtgtgggagagaaatgatgatgatgaagaagaagaaggcggcaaattaatttggccagttttaggggagaaccttggtctgtgttacccctcagccaggtcctgagggtagcagagaacggacaacatggctgggctctggatctcttaaccaaacccagcagctc

SEQ ID NO: 686174 - DNA, 133 bp, Homo sapiens
tactcatatgtgccagtgtgggtctgagtggggtgggattcccatcagactcagtaaacagatgaaccccgagagtaagccatcactgtgtctgtgcagtggacttctcccctcctgggcacacattatggag

SEQ ID NO: 686175 - DNA, 938 bp, Homo sapiens
cgtcagtgggtggcggcattgctcaacacaatttgccctatattattctgttccagattgaagagctgggttttagcgggttctttgtagtggcatgccgggtgttcctctaaacacagctgtcttctggaacgcccgtaaaacaattatcgcgtggtagtctcaaacgtgtgagtgctggagcgtcttttaatggcccccgccagcgtccttaaaaggggcaaaagcaatggattgtgccagacaggaaaacctaccagtagattttgggcccactccatattcaacgctatgagttttccagccccgagtgagaaccggggggccccctgttccccgagtgacaaaatacggggagaaccttgtatgcagagaatagatgctctgagaaaggtgaggctataaatgctttttcttaaaaaattaaagggcgcgacccaagcgcacacgaagtttagatgctattgtaagtagattttccggcccccctgttctctttgtgatgccctcgtccacctcttcccctcgcggtgtcatgatgtaccacgacacaccctcctgtttagtaagcacaaaataacacaccagagagcgttggatccagttgaacacgacatcctaattgaatgggagaatgtacatgttcgtcaaccccgacagtagggaagcacactcgaaggagtgtctctgtattacaaatggagagtagtacagtgtgtgtgccacgcaaaggcaaattgctttccacggtcgcgacgagaaatgtccacaacaggatacccgggatagatacgggcaactgttttgcgagaaaataccagttaaactctgttgcatggggctcatagacaataaacactgacgcacgaaagatacttgttcttgtctatggggcttcttgaccaaattggtgcccaaaatccccgatggaataccca

SEQ ID NO: 686176 - DNA, 812 bp, Homo sapiens
ggaggtcgtgatggtggcgccggaagcgcaggttctgtcctcagtgcgcagtccctgatttggagtggtatgagaagtccgaggaaactcacgcctcccagatagacctacttgagacatggctctacggcaggagcctctcaagcgcttcggagtgccttttgtccaagagactgcggatggtaccagtggtgttgcctgggcctgtgagccatggacggctgctgtcatggttcactgtgtgaactactaatagctgtatcatgtatcaacggccagactgtattcccttctgccctagttgaagcacgcttaatgacaacttattaagcgaacaaccgttctccccaggcagaggaggactgctgatagaagaaacctctggggccaccacttgatggtgatgcagtcggggaatgtgccaaccaagccactgggcaggagagcttggatgagttgtcctcacgtgcatcctgggaaggacgtatcttttgcaatcggagcctgctaggtaccggcggagtgcttgatgctccttgggtggcaaatgccttaaggcgccccaaggagtccttctgcacgctcgacttgtcttctgcgtggcccccctactgctgttggaaccagtaccccgtaaatccccggtgtgcttggtctgcgctgtcctctatctggggcccatattcgtggctgattgccttgtagcgcagcttctggctcactccactcctgggcaccgtcgtcgtggcacgggaacccgcactttggacaaggtggtttcacccgagctcagtatcgagtgccgcggggct

SEQ ID NO: 686177 - DNA, 296 bp, Homo sapiens
gcggccggtgcgggtgtgtcgctactgtgtcttcttgccgtatgctcttgcctgtctcatctgaattaaatgccgcgcatcgctggttgaccgcgattcccactgtccctctcttctagccaccgactgcctcgccatctaatcggtgttgcgcatgtctgggtgaccgaaataccctgtggcccttgcttctattctgctacagcttcagcgcggggcatcgtcttatgagtcgcacttgccaggcatacaaacttgcgtgttgaccttcattctagcactggtacggattcacg

SEQ ID NO: 686178 - DNA, 120 bp, Homo sapiens
cccccccccttttgggaaaccaaattcccctggcctttaaaaacgggtttttgaaccttttggaccggccttccgggttttcccctttgggcctttaaaaaaaattggttttttggggga

SEQ ID NO: 686179 - DNA, 430 bp, Homo sapiens
  misc_feature (51)..(53): n is a, c, g, or t
  misc_feature (55)..(55): n is a, c, g, or t
  misc_feature (58)..(59): n is a, c, g, or t
  misc_feature (61)..(61): n is a, c, g, or t
  misc_feature (82)..(83): n is a, c, g, or t
  misc_feature (86)..(86): n is a, c, g, or t
  misc_feature (168)..(168): n is a, c, g, or t
  misc_feature (183)..(183): n is a, c, g, or t
  misc_feature (204)..(204): n is a, c, g, or t
  misc_feature (217)..(217): n is a, c, g, or t
  misc_feature (220)..(220): n is a, c, g, or t
gatctgtgcatgaacagtcacgtgaccagtatatggtagctactaaattcnnngncgnncnacgtgagcagtgcatgatagnnacntgatgtgtgcatgatgagttacgtgagcagagtatgatcagccacgtgatcagtgcatgagtgccacgtgatcagtgcatgntatgtcacgtgacangtgtgtgatcagccacgtgancagtgcatgttcngcnacgtattcagtcatgatagccacgtgatcagtgcatgatcagttacgtgagcagtgtatgatcagccacgtgatcagtgcatggtcagacacgtgaacattgtatgatcagccacgtgatcagtgcatgatatccatgtgatcagtgcatgatcaatcacgtgatcagtgtatgatcagccacgtgaacagtgcatgctcagtgtcgacg

SEQ ID NO: 686180 - DNA, 426 bp, Homo sapiens
cgagcggggatcagccgaagtcgggagaggggcgcttccacggggcgggaaactggcgcgcgactctgggggaagtgcaggatggggggacaggggcgctcccgcgggggtggatgggggaccatagcggggctggcggggcaggggccggcgcacgaggctggaggaggggagcgcgcgcttctacccgggctgggtcgccgaggtccgcggcgcatcgtggcggcggtgggcggaggggggcggggggcacctcttctcccttgtggcgcaggtgggcgcgctctggaccggcttgacgacccctccccgccgccccacctccctggccaaaggttctcagcttctaatcagggacatttctagtccacagcctcgaagccatgggttctccccggccctctgaagccgccacacctgtgccag

SEQ ID NO: 686181 - DNA, 135 bp, Homo sapiens
actcatgtgtcggtgatattgacagcattttcccaaattcatttgaccaatgaaccattttttccacgagccataccatgggacacgtcgtgaaaagaattgtcgttacatccctctttctctcttggcccccgg

SEQ ID NO: 686182 - DNA, 748 bp, Homo sapiens
  misc_feature (528)..(528): n is a, c, g, or t
cccttttgcattaaggacactggaagggttgctaaaatgattcttgctttcattgtgggaatagattaccatgttctgatgtgcagctatatgtttgatgcctgagtagagttataatcaatcgtgcagcgtatccgctctagataggaagaatagagtggacttgtacagctatactttgtgactcttgcacgtaattcgtggcagttagacaaggttgcgttgcgtgaacatgacagtcgcgccagcagaatgacaactaggagcgagcacgcttggatgctaccgatgctgtatgcagttttctaggcgtgccatcattgaaaatggattacgtgaagttgctgttgctacctcaggctggcaaagaggcgagcgtaagaagtaacgtccatgcgagaagaagatgaagcttaactgcttttacatgcacatggacatggcaggtaatttgaagtgttaagagattctattcttacgaagaacttccatgggcacatgatattattagttaatactcgtggcaantccaagtgccttagagtacatagttcatcaggagcatgttaggtggaaagatccagagtcttctcgagagctttgataaaggccaactgtgcttggttatgaagcttgtggctcttgaggtatagattcaagattgcttgtcgagctgtaagtatgaatagtgttgggtggataagaacagagatggttgtggagtgtgatgtctggtatgtttcgggtt

SEQ ID NO: 686183 - DNA, 1017 bp, Homo sapiens
gagttcattctcatgttctaccgggacacggcccatcgagcgggctcctggaccatatactgtgggtgaaagtctgctaactcgagaaggatgcgagagcactgtcgaccagtgtgagacaaggcaagcctgcgagataccgcttgctagatagccggtcgccgtctttccaggcaacgttggtgctgctcatcgtccgtcggcgtggcttggcgaagatccagatgactgataggacatagatgagcttttgcgataaagcacggcggcatgccgtgcaaggatgcgatgtgaaccgcgtcatgacatgaggtagacgcgacgacgcctgcaagacatatcaggacttcaaccgctggaggaaagactacctgcgacgaggacatccgttctgggccattcaagtcccctgtcagcgcggcgtgacttctatcgcgcgttccgaacttgcttccaagctcgtaaatgcattgggagacggattcattcttccgcagtgggaacatcgagcacccggaggacaatgctcttcaacacgtctgtggaggtgctgcccttcgacaagcctcagtcagacaaggaggccctgcatggagggccgacgcggcaccctccggtaccctcggagccccgactggctacctccagcatcggctccttctacaagggagtggcagagggggagaaggtggacccagccttcggacctctggaagcactgcgcctctcgatccagacggactccccatgtgtgggtgattctgagcgagatcttcctgaaaaaggccgactaagctggcgggcttctgagggtaccctgtggcagccctgaaagccacatttctgggggtgtcgtcactggctgtcccccggagggccagatacggcccgcccacagggtctgctgggtcgggcttgggccggcctgggatcgcagtggcccggaggcctaggagctggtgctgacccgccgacggacgcggagaggcacgcggccccaatgtgctgaggccggac

SEQ ID NO: 686184 - DNA, 1796 bp, Homo sapiens
tgcctgtagatgccagctaccaggtaggctgaggctggggcatcatgtcgagtccaggacgtcaaggctgcagtgagccatggatcacgactactgtcactccgagcctagcacgtgccataacaatcagaatagcagtgcagaacacatcaaatcaaatgccatggatggatggcatcagatagatgtgcaatccttattcttataagagaataaatgagtacagggtaagactgcgtggtcatataatagctggccagagcttgtcaagacaacagaggcccagtgtacaactttttgagaacttggcctatgatcaggtaaagcaatatatgtcacggaagatacatcttaacacatcagccgatagagaggcaaccatcaggtcttcagtggtggtcccgacaacgtgcactagcacatcagcatatctctgcgctcacaatcgtctctctcccttcacatcattaagcaaaaataccccaggttaatttcaggtcgcttaccaagtttgatatcttaaggagccattggttcgttagggtccatatcacggcctgaaaaacgcagggcctcttaggcgggtaaccattaacttagttgtacgcttatacattgttagtattatgcgctagagacacacttacgttgccaaaccctatgcgcggttcccaagcatcccagggtggaacttatcgttccccttgggatggaccccaccgaggcatctgttcacccgctagacccattatgctaacattcgcaggggcactcctgcgtggcgtgccatatacctctcatggcagacaaggactgataggctcatacggagaacgtgcaccttcgggcgcgtggccttcacacagcacgctacttcggttacatctcaagcctcacccatgtcttacacacacccggttctagcatacactgtgcaaacgggttacacaacacccactactacccactagagtatgctacacctccgtcactaacaacgtcaccccccaacgacctcacaccttcaaattgacacacctctaccaaacaacgacctggggggctgtcacgtcaacatctgacaacctgcgcccatggcactacaccacaaccacccctaacttctcacagtacacacgcctactttctaccaaagccctcctaaccacgccaatactcttgcaacgacccccatctccttacacagacacacaacatcctcccacgaccaccacccagctactaagtctcgccaccccacactctctcccgttctaacataacaactgtaactagcacacgccacacacacccgtcacgccactacttccataccccactcacacctaatcacccacctctgcagcccacccacctctctcacaccaactccacaaccacctccctccactaatctacacagcacctcccgtcgaccactacccagcgaccacttcacagtggcaagcagtccacgccacagaacgggagaacatttcacatcgcacccactcatgagcacccccaccacccctcaccaacccatgcccccaccccccgccacacaccacacaaccacaccgccacccgtgctcatacacactacctcatccccccacatcacccctctctccccacccactacacccccaccctccccaccacactcacctatcctactcaacactacaaccacaccacccaacccccacacactcagctccctctacccacgcacgccacccctcgacccccaccatcacacctccacatcaacactcgcacttcccatcccc

SEQ ID NO: 686185 - DNA, 496 bp, Homo sapiens
gaccctccttcctctctacggtcgtctcactatttcctaaaaagccccgtgctgtataaatgctaggcatatgttattttatttagcccttacaataaagccttggcttgtgagtgatcagcattggctgcagcaccctgcctccaaccacctgaaggtgtttacagacggcctctgcctctgagtagctctggagtccgagccatgcacaggacatcaccaagcctcagcttcctcacgtatgaaaccaaagaaaacgccagcctcatgtcaccatacagctggagagtcacagagcaaaggtgccaggtccccgccattagctggcgctcaggaaatgctggctgcccctctcctgccccgtcccacagccttcacgtgagattggcccactactcacacacctctggcttcctggcacttctgtcaaaacctcacatctcttaggaaatagtgagacgaccatggagaggtggaggaagagagaagggaaaga

SEQ ID NO: 686186 - DNA, 425 bp, Homo sapiens
acggggaacaatcactttggtgaggatgtgggatgagcgagctacgcggggaaacgtgccacttggcttccaggaaccacttgcactcagccaatgagcatgaagtaaaaacatgtggtgttggcatgggccaagtggaaaacagcgagccctatgcaccatctggtggcgcagtggcagtgagagagccaagtgactggcccttccctctggccagtggggtttgcaaaccaaaagctgccttgaggtatagaaggggattgtgccacagatatttgtgacttgtagaattcgtaaccacaaaatgctggttgccggcccacatggcccaggtggcagtgacaacctctcaccctggaatgccccaagaggacccaaagcacaacaggtggattatttcagcccaggtgatgtgttccctgctt

SEQ ID NO: 686187 - DNA, 427 bp, Homo sapiens
agctagcattgggaaagagtatgattttatcgtatcgacagttgttttgatgtttttgcaagcagaccgcattcctgcaattatcaaaaatatgcaggagaaaactagtattggtggctataatcttatcgtttgtgccatggatacggaggattatccttgctcgattaacttctcattcacttttaaagaaggggaattggcagactattacaagaactgggaattggtcaagtacaatgaaaatccaggccatttgcaccgtcgcgatgagaatggcaatcgtattcaactacgctttgcgaccatgctagctaaaaaatcaaataaacatgaatgaagattgggaaatttcctgatcttttgtctttttttcgaataataaagaaaaggtgggtaatcatgtttgttgctagagatgctagct

SEQ ID NO: 686188 - DNA, 240 bp, Homo sapiens
ctacagatgaagtaccaggtcgtagaaggtgagcagcaacgcaagacttgtcaaggaaaatgctaagggcacgatgctcttatacagctggtctcagctaaggctgcagaagctattcgagcagcagcacaaacaatgctgccagagaggtactcacgcattttacataactcgttcacagatggcagcaactccctgcaagactgacaaacagccaattacactatgtatgtcattgaa

SEQ ID NO: 686189 - DNA, 406 bp, Homo sapiens
  misc_feature (1)..(1): n is a, c, g, or t
nagaagaaagagtgtctgacacatcgagaggagtccgtctgggctctgtcagagagctcagccttggaatggccaacccccaggggaagattatcttctcactccatcggctttccagctccccatccatcctgctgaaagcttcttccctcatccaataaaatctcggtattcaccatccttcaagtcgtgtaggacctgattcttcctgaatgctagcacaaagacccgggtaccaagagcacagggcgtaaaaggctgccaccttgactctcctctgagctggtttaactctatagccatccgcgacacagcatctgctaaaagcgcattaattgtcacacacccatagatgctgacatggggctagagcccaagagcgctcaccgtgtctcctcgcgtgccg

SEQ ID NO: 686190 - DNA, 262 bp, Homo sapiens
attttttgggatataccaggcctgggtacaggggggtcttaaaacaggttttattaaaaggatttttacccaaagaaggttatccccgcaaagagttttgaaaagaacacttgaataaattttgccttttttcatccaacctaactggtttttgaaccccttgaaagcacgtttgtaaacggggtgagacttttccagagactcttaaggttgggaattattaggctgtattaaggcccataacgttatttcggggttccag

SEQ ID NO: 686191 - DNA, 122 bp, Homo sapiens
tggacacattgttgttttcttaatatgtcattccaaatatcagatgcgttgttatacagaagtcccttgccatcctaaaagccagcccacttctctctaaggagaatggcccatttcctcat

SEQ ID NO: 686192 - DNA, 416 bp, Homo sapiens
tgtaaagcacacccggcccggacatcgtcgcggccaaccgcctgatgatccaaggcgaccggcactatgactacgacgccttcggcaacctcatccgtgaacggcgcggcaaaagccagcaactcgtcactgaataccgctacgactgccggcatcggttaatcagcatcacaaagcccaacggcgaaaccgccagttatcgctatgacccatatgggcggcgcatcagcaagaccgtagacggcaagaccaccgggttttctggcaaggcgacaagctgattgccgaacaccatgcagagcgccatcgcagctacctctacgaacccgacagcttccgcccattggcgctgttggaaggtttcggcccaaaagaaaccacgccctaccactaccaacttgaccacctcggcaccc

SEQ ID NO: 686193 - DNA, 888 bp, Homo sapiens
tttggcccctgtcggttgtgtgcactgaattcggtctcaggccaccggcctccaccttgggtttcttcctggtgtatggtccccaatcgctggtgggcccagtgtctctgggcatgccagtccgtgttacccttctgtactcgtgcctgctttctcctcaagcttcctctggagacctgatatgttgatgccgttgctgtgctcaatgcaatgcaagagtggctaccgtctatcgtagcccctgggatcggtacggtactctggtgacggtatgctatgccggtgatacgacgactggatatgaaagacctcatttgtgatgtcttgtactcaatctcaccgtctggatccctatgctgctctatgctgtcacgcgtggtcccaagccccgtcgtgcagccaccgctcgtagtctcaaaggggtggataatacgataagtataataatgtaactcttaagcaacaaaggcatgtcctgtttctgcgacaatctctggttccatcctctggcatgatgagagtgacggatgactggatcaacactgtgctgtcacagtttagagacgggcgagaagcgaacaccactgatgggacatcctggggtaggaggccaggcggtcttggggtctgactggggacaggtgctctacatgggacagacttcacgagacttgctgaagtagcagtcgccaagctcacagggcaagtcaagggcacaggccagagaaagggtcgggcctgcagccatgcacccccacacgttccccaagcccattcctcaagagactgaagggatcccagcccctaaggtgggcagaggcagaccctccccagagctccttaggaagaagacagacatgggttcattgaatgccgcctaggagttaa

SEQ ID NO: 686194 - DNA, 335 bp, Homo sapiens
tctcaaagagtctgacacagggtaatttcatacaattgttgatgttgataaagcattcgtttttatagctgagccattggagcttattatgaaccgtaaactcatttagtcgcatggttgtaaccttagtgcaaagtaaaaagggaaaatttgacttaatagaaacaatagtagtattgataagaacaaaagtcatcctccctgcctctctgagaccttgaagtcctgtgaggaagggaaatcgtaatgtaaccaaaggtaaatctgtgtaactcatttccaacaatgttgaaaggcttgtcttagaagcattaaaggagtattatgtaaaatca

SEQ ID NO: 686195 - DNA, 258 bp, Homo sapiens
cagtggtttctttttgggagcgtaatgtttatggatatcaaggtgcttcataaaaatcatgcatatgtgatatggccagtggcttgacttatcttgctttgtcttccacgtgtgcacgctgtatataggggtcaatgtgttgtgctggagtcgagaataatgtggtctagaatagtgcactgtatttagtgtggattgatcagggatgtcctctttaatagccatatgcaattaaattgagtacattatttatgaaat

SEQ ID NO: 686196 - DNA, 248 bp, Homo sapiens
ggagaaagggccagtttattactcacagggaacccagcagccagaacaggatctttagtcactttcccatgcccctattcccaaaaagagggcatggggatcgaaccagctgggcaggcagggggtctgcatcccaggagagggacccgaaactgggaaacttggaaattttatcagggctggggaggacctgccttttttttcctccagagatagatgactcattttccagcaacacagaggtcagc

SEQ ID NO: 686197 - DNA, 367 bp, Homo sapiens
cccttagtgtcactgtccaagagacaaacagatgtgaatagcttaaacatcttaaaaatgcaccaagcttatgaagatctcaaacaataacttgaatgtgctgtacatactcctgtcaaatgaagtattgcctgtacaccacttctcttgcaaactgtcttctatttcctttcatttgacctagatcgactacgagacctagagaaggatcgggacggcttgtgatttctctcccgagacagcgatctctctcttctcctatctctaggaagggacctgctccggctgcgagagaagcttctccttcttggagatctgcgacgagttggaggactcctcctacgatcatcatctcgagggcgacgac

SEQ ID NO: 686198 - DNA, 279 bp, Homo sapiens
tggtcgtctagaggatcctcacatagaggcaggtagaataggatcttttcagcttttctgctaaggaacaaatggccagctaggcatagtggctcacgcctgtaatcccaacacttggggaggcagaggcgggcagatggctttgagctcaggagtttgagaccagcctgggcaaaatggcaacgcctgcttttttttttttttttttgggaaagggatcgggctcggcgggccaaggtcgggatgtgcagggcaggatcgggcttcaatggtcagttt

SEQ ID NO: 686199 - DNA, 220 bp, Homo sapiens
  misc_feature (61)..(61): n is a, c, g, or t
gttatagaatttcagtgttgtgcttggcatggtggagtgtctggttcagtctcctcttgtnttatcgagtatttattcctgtgcttcaggcggtaacagccgaattatcggtgaccatcactacatggagatgtttggtcgtggctcactctcttgcttccgctctatactctgggctcctctctgtggcaagacactacttggccttctgtcgtcttct

SEQ ID NO: 686200 - DNA, 1471 bp, Homo sapiens
  misc_feature (1471)..(1471): n is a, c, g, or t
gtctctaccaagaaaaaaaaacaaaaaaaaaaggttaaaaaaacaatttagctggacctggtggttgcacactcagataggctgaggtgaaaggattcctttaacctggggagactgaacctgcagtgagccatgatcgtgccactgcactccagttctgggggacaaaggtgggacccttattcttcaaaaaaagaaacaaaaaaagtctgttcctctcctctccaacttactggtgatttgccattattggactcactcggtatgagaccccttccctgtgcattccgggatctccctataaagggttcctatttaaatagctttgaggaagagggcagaacttttaaacagaggaacgttgttgttagaagttgaacaatgaggatatatagcccattatcaccacgcgtgggcccgaggacaccttgaaccagccgttccccaaattctctatatgtggccaaccgagtggggcaaactcaaagaggtgtggccatgcccaagagtttcaaacctctcaaagggggcgcctgaagggtaaaactccccacattgtggtctcccaactatttacagagggacacaaaagcccccctggagccactgagaagagctgggtagtgaaagcccccctcaaggtggaagcaaaaagagagacgcccagtgtgtgcttgtgcgggaacagaatagaaatcccccctttgtgtgttaaccccagtgagtatgtgagggggggagtgtgactcctctctctcagcagtgagaatatttaaacaagctctctagtagcgccccctatttttctcatgaggggataatggcgcgtgggagagagaaacttatgggggacaatcgggctaccacgaagaaatatttattctccctggaaggaaagacacgccctgttatcacattatatgaggggcggcccccccccagacgtgtttttaatatgagcagcgcaccccccaaaagttctctgaattaactaccactggaggggatagcgaacaaaacatccctctccgttgacacggcgggcaacagcgggggtgtttcccgacggtgattggcgcactaagttagggcgcgcaccccggtggaaatagaaggccaaccacaagagaagtctctgctatcgcacgcaacatatctttcatatccaacatagtggtgtggtggttccaccacacaattatatatatttcggcgacgatagtaagaagaaactcttccttcaagacgaaaaacacactacagcggggggagctaaacaagacgcatattatcccacctttataggtagcgacgaagtcttaaaacagatcgaaccgtataggaatttacgacggcagcacgcaaaaacgaaggcgtcggccgcaagagacgaacacatggtggtataccaccacaagagcccagaggaagaagacagcggtatagaagtagtactagaatacatcacccn

SEQ ID NO: 686201 - DNA, 137 bp, Homo sapiens
gggcgattcggatctgtgcttggtgtgtctcctttaaagctgcagtctgacatttcgagggtagtttggtgttcctagagaggtgtttttgagattcctgagacaaagtggtctacagtgaaggccaggcttacgta

SEQ ID NO: 686202 - DNA, 558 bp, Homo sapiens
  misc_feature (439)..(439): n is a, c, g, or t
tgatacggaaggcatgagcaatcgtagagaaattctcaggagagtcggacaagaagagtcggagagagaagtacatgaaacagcctgtaggggtggctagaagccagggagggggtgggaaacaattctagagctcccagaaggcaggcaagatggagtcacacttccaacaaagccctctgcacaccaaaaccccaggaagtatggttttgctaggtaagttggctttggagacagaatctcactctgtcacccaggggggagtgcgatctcaattcactgcaccctcggttggcttccgggatccaagcgattctggtgcctcagcctcctgagtagctgagattaggggcgggtgccaaaacacccatctatttttggtattttaagtagagacagggtttggctatgtgggccaggcgggtctcgaactcccganctcaagtgatcgaccggtctcagcctcccaaggggtggggattacagacgtgagcccacgcacccgtccaaggaagtatggttcattgaaatacagtgcataaggttcctagcttggtt

SEQ ID NO: 686203 - DNA, 93 bp, Homo sapiens
ctgatcaagaccttgatccctcagacttgactttcttccttgtcatcactcgatttctgaccagtatgccctcacttcaacccgttctttgcc

SEQ ID NO: 686204 - DNA, 490 bp, Homo sapiens
tgatttcgaaacgaggagggtggtccaactgccaaagtcaagcaatggccacatcacgcttcaatggttatattccagcgatgatctcacttgagctctaaatcttgcaatcccagagaaattcctgacaaaagcgttgccacctatttattttcgcgtcaggtgccaggtcttagttaagattcacaatctttaaaaagaatgagattcacaataaattaactccttcctcatcttcttgataaattcccgcatacctacccaattcccaagtaagcatcttgtagcttacatatacctactataccgtccatgcagcttggacattggggagtgcgacagtcctatctagcacatcatacaccatttgccacagaaaggatctcttggggcttcccgtggggtgagattcaagcaggacaataacaagaggctggaacaccctacagatgtctttgaagtcaccagttgtttgatatatctcccctgt

SEQ ID NO: 686205 - DNA, 100 bp, Homo sapiens
ataataatccccccccccccccgagcagagaggcaagatggctacggcagggggtggctctggggctgacccgggaagtcggggacaccaacgaacaaag

SEQ ID NO: 686206 - DNA, 411 bp, Homo sapiens
cgaggcccatctctactaaatatacaaaaacttagccgggtgtggtggcgggtgcctgtagttccagctactcgctgaggcaggagaatggtgtgaagccgggaggcggagcttacagtgagccgagatcgcgtgactgcactccagactgggagagaaagcaagactctgtctcaaaaacaaacaaacaaacaaaaaaaactagttttctgtctttttctttttttgagacaaagtctcactctgtcatccaggcttacgtgcagtggcctgatcactgcccactgcagcctcaatctcctaggctgaggcagaagaattgcttaaacccgggaggccgaggttgcagtgagctgagattgggcccctgcactccagcctgggagacagagcaagactctgtctcaaaaa

SEQ ID NO: 686207 - DNA, 295 bp, Homo sapiens
gccgcagaggccggagacctcctcggactagttcggcgaggagactggccactggggggtggctgttcgggactgagagcgccaagggtctttgccagcaaaggaggttctgcctgaattgagcctctctgatgatggagatgaggtgaaggtcttaggagcgggccctggggcgaggccatctctgcctcctccttagaagacgccacggtggagcctgagtcgcaggacacatccgccagttattcattctagcacttaagggtttgtaagttccctggatctcacggcacaa

SEQ ID NO: 686208 - DNA, 139 bp, Homo sapiens
actactcatgcagctaatggtagcgcaccctagcaagatcaagcattaaccttccctctacacttatcatcttcacaatcctaattctactgactatcctagataatcgctgtcgacttaatacaagcctactaagcta

SEQ ID NO: 686209 - DNA, 345 bp, Homo sapiens
ctgacgcttggtaccacctgaatggatccaagtatactgagatcaacataatcatgaattcttctcccactgtaaagtttgaggaggtaagaatctccttgacttagcaaatttgggcttataaatgctaggtccaactagactttactggcctcaatcccttagcattatcctgcaaaatactgatgtatactttttggttaatacctttgtatcactttcgaccacctagtgagggttaggttgtatgaagagatgccattttggttaaataatctcaaggaatctgtgtcaccgactaagactctagttctcgtccgggttccaatctctggtctcttgcct

SEQ ID NO: 686210 - DNA, 103 bp, Homo sapiens
aacatagaatgcagtaactagcataaaacgattcttctggctcatgttctgaagccaacagcagaaccctgaagttataagtgacatgacatgtgaggcagaa

SEQ ID NO: 686211 - DNA, 934 bp, Homo sapiens
gctagcatactcgtcgctgtttattacgacagtttcgccggatcctggggtgcccctcgtgtgtcgtacacccgtaacttttgggggaccccctaaggtgtttgggaccactgacacctgggggtgttcccagtccggccatgggcgggtccccctgcgatgtaaggctgggccgggttcaaacctgtgcccgtggaaggtaatatcatttgtgcggggggcgtgaatactaatgctgccttccgctcgcccgtgggaccaccctgttcaccgggggtcccaaaaaaggggttgtgctgcccccggaaaaagacagaagggcggggctccccccgccatgaaggcttttaagggccccaaccacgtaatgccccctttgatgaggcgtccccaaagccatgcgtagcgcgtcccccatgcatttgtcgacattggggacatcttccctcaccccccctcacttttttcccctctgttcgcccccaaaattattcggcggtcttatgcgagaacgttcgctctcacaactatcatcgaagatcatgcgttttttgtttgcgtcctcctgtttgtaacactcgccccctccacaccagagggtgttcctcgctccccttatctgtgattattgggccgttgccggagaataagaacactttttgttgtttcgggcgtccataggtatagaaggcaaaagatcccctgtttcctcacgttgacaagggaactctctagacatatttgatcttttgatccacacatgatggcactcaaccacctcccatagccccctctgagggggtagacacatgtcgtctaggaaaacacaatagtggagttagccccacccggtggttatacagagttgacttgttcttaaaaatcgtcggtacctcaccaagtattttaagggcagcccgcaaacgcacatgaa

SEQ ID NO: 686212 - DNA, 191 bp, Homo sapiens
gaggatccccgctcagccactggtgatccacccatagaatgcagtatccataactgccacatgtacataatagtgggttataactcaccctcctttgatcattgagtaaacttttgtccacatttttgacatacttgtgatctagcgatttgaccacgattccagcatgattcacataatcgttttctctc

SEQ ID NO: 686213 - DNA, 378 bp, Homo sapiens
ggggacaaggccaattagccatctgtgtgcctatactcataatatcctggctgtcatcaatataataataacacttgtatttgggccgtgcttcgcatttgttaacaaatggctgtgatagtatggagtatcatgaaagtggcctgcttcgatttaagcaagtatctagacatgggagtgatccaccctcttaataaaagcacagtaggcggacggcgttttgccactttggtcatcactggcaacaaccagcctatagtatcacagcaagggacaacacagctcagtgtagaaaacaacaaaacttctattacaagtgacatcggcatgcagttaactgacccgaggactcaacatatcttcattcagcacagcact

SEQ ID NO: 686214 - DNA, 115 bp, Homo sapiens
tgagttaccataggaatccaggagcactttacacactaatcatcttgcccaggttcacagccttgtttcgttatcgttcgttggtcatagatgtagcattttactcatggtcttt

SEQ ID NO: 686215 - DNA, 212 bp, Homo sapiens
agtcatgatcatctactcagcctcccagtagctggatagctcacagcctactatttttggtatatttagtagagaccgggtttcactatgttggccaggctggtctcaaacttctgacctcatgatccgcctctgccttggcctcccaaagtgctgggattactggcatgagccagcgcacctggtgcccgattcttctaagaacaggtgtc

SEQ ID NO: 686216 - DNA, 952 bp, Homo sapiens
gggggcggtgggtgcgaagcgcgcatgcgcgtcgcacaagggtgcgaggaagtagtgagcaaatcgcggactaccggggctgccagtcgctggatcccggcttgtgcgctcataggcggcggacaaagggtgcgggctcttcgccctttgttgtgtcctcctttctttcactaactttgcttgactttccagcctcttccgaagttcgttctgtgccggcaaacagccaaaggggtttgaaaaaccgtccacgatgaccaagctagtgaactcaggtcttctgcgggggagggtggataacgggccattgacccaagggcttcgcaatttggacgaagaagtttggggaaaagaatcactctttgtctccctggtggctccgtggggaaagggtgattgggtgaaatgaacagtaggacagagaagctttaaccaattgaaataagggcactctcacaaggggggttgacaagcaaaggttagtaaggattaacatttattcaacaagtggctcgtgttatgaggggaaagggggagcacccagggagtcaagtgtcgatatgaacataaggtacattgtacaaccgtgcaaaattgagggagaagaatattggtgattacggccacatgtttctggaagccagggaaaaccactgtgctttaccctctgggggatctggaccaacggagggcaccggaaatataagtgcacagggagagacacaaaacttgggagttgagagaaagggagtgtactaaaggaaccacaggtaatataagtatagattggacaacaggtaattttgaaataacgtagcaaccgtgtaacaacaaaaaacaatgtgtcgcgtctgcctagaaattaacaatatggggggccaagtatgatggattcgttcagagaaggtgggagtgtgttcaaaaagcggggggaggtaaaggttggagcatg

SEQ ID NO: 686217 - DNA, 877 bp, Homo sapiens
  misc_feature (34)..(34): n is a, c, g, or t
  misc_feature (96)..(96): n is a, c, g, or t
  misc_feature (107)..(107): n is a, c, g, or t
  misc_feature (110)..(110): n is a, c, g, or t
  misc_feature (155)..(155): n is a, c, g, or t
  misc_feature (174)..(174): n is a, c, g, or t
  misc_feature (191)..(191): n is a, c, g, or t
  misc_feature (209)..(209): n is a, c, g, or t
  misc_feature (213)..(213): n is a, c, g, or t
  misc_feature (216)..(216): n is a, c, g, or t
  misc_feature (249)..(249): n is a, c, g, or t
  misc_feature (264)..(264): n is a, c, g, or t
  misc_feature (274)..(274): n is a, c, g, or t
  misc_feature (288)..(289): n is a, c, g, or t
  misc_feature (293)..(294): n is a, c, g, or t
  misc_feature (305)..(305): n is a, c, g, or t
  misc_feature (308)..(308): n is a, c, g, or t
  misc_feature (316)..(317): n is a, c, g, or t
  misc_feature (335)..(335): n is a, c, g, or t
  misc_feature (348)..(349): n is a, c, g, or t
  misc_feature (353)..(353): n is a, c, g, or t
  misc_feature (370)..(370): n is a, c, g, or t
  misc_feature (446)..(446): n is a, c, g, or t
  misc_feature (456)..(456): n is a, c, g, or t
  misc_feature (504)..(504): n is a, c, g, or t
  misc_feature (869)..(869): n is a, c, g, or t
gtggtactgactgtacaatgaaagcgaaaaaganaaaaaataaaagcaatgtacatgttgccaagataacctgaaagaccaccatgaacggggggnacaaccatggntgngtggtggctccgcagagctggctctccactcactcgccaatttcngggtacagtggtggggtgnggtgtgtgcgtcggtgnacgggcaggcgggaccangggnggngactaccatgggtgggggggtctttgggggggngtgggccttggggtngggggggggntcgggggggcaggnntaanngggttgggggntgngctaaggnntggggggggtccctttcnagagggggactgnncggnaacgggggggggggggntgggcaccatcccgggtcatcgggggggggggaagtgtgctcccaggtaggcggggtcagaccacccccaggggcntcacttttcnctggtgggtctgcatgggctggctcttagggccggaggcgggtgagcnttctagccaggaagccggagggaatcttgacaggcacacagcatccaaaccaacagcacttctgcagccggggcgcggctggcagaggggtgctgcctgctgcctgcaaatcctgccagagtcaagggtttgctttcctactggtcttcctttggctagaaaagtgacaaaactgagctgggtggggtataagttacaggggcgagagcttcagtggcctgtttatcgggaggagttggagctggagcggctcctgtggcggcggcggcccggggaccgtgatctccggcgcacgggggacctgcgcctcgggggagcgggaccttctcctcatccgtgggggagacctgcgccacataggcggnggtggcaa

SEQ ID NO: 686218 - DNA, 153 bp, Homo sapiens
accaatactatctgctactgaatcacagtctacatatgtagaccacactagtaactgaccttgaggatctggaatatgacgactgtcattaatgacacttcagctggtcatatagtcgcagcataagtgcatcatgtcagcatatcagtacag

SEQ ID NO: 686219 - DNA, 135 bp, Homo sapiens
gaatgtgtgctgtgcagttatctccagatacatgttattgaatcgagagtctcttccccatttagaatgcaggtttatagaggtgaaaaaggagcgtgtgctgatacaaatgctgttagacctggaactctcagt

SEQ ID NO: 686220 - DNA, 218 bp, Homo sapiens
ggggcgggcctaaaaaaagccttttgggggttttttttttcccggccgggggtggggacccccccgggggggggggggggggttttgggctttttaaaggctttttcttttgggttttggttttttttcccttttgggtccgggcccgggttttggggggggggggttttttgtttttcccccccctttttaaaaaatttttttattggggtttttta

SEQ ID NO: 686221 - DNA, 309 bp, Homo sapiens
gaattgagaactcaggagtctaatgctctaaaatctcacttcttcatcttctttttttattttttaagacgggaggttacgctcttatcgcccaggctgggagtgaaagggcgcaagctgggatcaccgcaaccccgtgcctcactcatttacaccaaccacccaactatctataaacctagccagggccatccccttatgagcgggcgcagtgataacatggcagtggggtggttggtgataaataagtaaggcaggagtccgagaaggtaagtgggggcaatacaaaatgataaaggatactagtat

SEQ ID NO: 686222 - DNA, 190 bp, Homo sapiens
ctcctgagtagctgcgacttacagggcgcccagctaattttttgtaatttcttaaatttttagtagagaatgaggtctcactatgtttgcctataggtcttggtgaaagacagtgacccctccctgtaatatgttgacttgtaatcttctgggcacgaagcacggaagcgcgggatcctcttagagatcg

SEQ ID NO: 686223 - DNA, 200 bp, Homo sapiens
tggcgacctataggactccaagaaagaaagaaagaaagaaagaaagaaagaaagaaagaaagaaaaagcaagcaagcaagcaagcaagcaatactcagattgggcacggtggctcacacctgtaatcctagcattttgggagactgaggtaggaggatggcttaagctcaggagaccagtctggagaacttggtctctac

SEQ ID NO: 686224 - DNA, 363 bp, Homo sapiens
aggaaaagttcggtgtctgagatatcagaacagtggcttagaagcaaagaccaaggcagatgtctaccagtaaaattacctctcagggccaagcatggtgtcttctacctgtaatcccagcactttgggaggccaaggcaggaggatcacttgagtccaggagtttgagaccagcctgtgcaacatagtgagacctcatctctacagaaaataaacaaaattagcagggcatggtggtacatgtttatactcctagctactcaggaggctgaggtgggaggatggcttgagccccaggaggtcgaggttgcattgagccaagatcacaccactgtactgaagcctaggcaacagagtgggatc

SEQ ID NO: 686225 - DNA, 1296 bp, Homo sapiens
taaagacaaagtagtattatgtggcttcagtttctttaaatacctcgtttctttggaaaccaaaaatttcccattcaaggaaattaaactcagccgtgattttaacatttttacattatttacattgtgcctttaagcactagtgatgtggagtggctttttttcatattgtgttaaaataatctccttggggctaaatttcacatgtgttattctaagaggaaaatagcgtgagtttacgtgaatttctattaaggggaagaaaaagagcattttattttcagcatgtgattacacttggaaaggtggaaaaaggtaagagaacattttacgcgagagaaataatttcatttataaaaatataattttatagaaaaattcagagacattatttctaagaaattctatagggtgggattctataatcccgagcatagtgcgtgcacagtgtctctatacactataactacagtgtgggtccacacagtgtctgctgcaacagtgggggcctcattctacgagacagactcagagggtacacccggagggggttacaccacaacgacacacggggcgcacacacatataacggcaaccaaaaattcggcagaaacacacgtgtggtctccgcgaacacacagaaccaacacaatatatatttccacctcgggggatactgggcacacactattctatattattctccacaaagggttgcggggaatccccataatttattctccacaaaaatgaggtgaaacaacgatggggttggtaaaaaatatcacatcgttattcgaaggcgaattctgcgggggtcgcaccttttattggggtcaccccaagaaattttccgggtcggcaccacaagaacaagcttattaaatgagggtagaaaatgtggttcactacaacattctgaaaaacaacacttattatgcagaggggacatctaatagagtgacgcccacctatatgggcgaccaagcacagaacagcccacaccgacccgcaacaaccaaaccgctaacggacccccatcaaccacaaacacataaaagggtgggcgaaaaccagcgcagcgggaatacacccaaacacgaagcacggaaccaccgtgaagccagggctaaaatacagtggggggaaatccaaaaacacacgcgtagagtactccaaagacgagcgcacccaagacgcagaagacacacacagcacaaacacgaaacaaccggccgacgcgcgccggcacagcccgcagaaaaagaaagaatatacccacccacccaacagggg

SEQ ID NO: 686226 - DNA, 146 bp, Homo sapiens
agaaagggtggggcttagggacagaagccccagagcatcacaagtctatatgtaaaggagaggtgtctattaggacgtggaacactactaataaactgactgaaacctggacccctaaactggtcccagtgagacccagatatatc

SEQ ID NO: 686227 - DNA, 830 bp, Homo sapiens
  misc_feature (100)..(100): n is a, c, g, or t
  misc_feature (106)..(106): n is a, c, g, or t
  misc_feature (156)..(156): n is a, c, g, or t
  misc_feature (167)..(167): n is a, c, g, or t
  misc_feature (177)..(177): n is a, c, g, or t
  misc_feature (185)..(186): n is a, c, g, or t
  misc_feature (194)..(194): n is a, c, g, or t
  misc_feature (200)..(200): n is a, c, g, or t
  misc_feature (219)..(219): n is a, c, g, or t
  misc_feature (248)..(248): n is a, c, g, or t
  misc_feature (268)..(268): n is a, c, g, or t
  misc_feature (276)..(276): n is a, c, g, or t
  misc_feature (282)..(282): n is a, c, g, or t
  misc_feature (294)..(295): n is a, c, g, or t
  misc_feature (322)..(322): n is a, c, g, or t
  misc_feature (346)..(346): n is a, c, g, or t
  misc_feature (373)..(373): n is a, c, g, or t
  misc_feature (377)..(377): n is a, c, g, or t
  misc_feature (445)..(445): n is a, c, g, or t
  misc_feature (453)..(453): n is a, c, g, or t
  misc_feature (475)..(475): n is a, c, g, or t
  misc_feature (484)..(485): n is a, c, g, or t
  misc_feature (490)..(490): n is a, c, g, or t
  misc_feature (537)..(537): n is a, c, g, or t
  misc_feature (556)..(557): n is a, c, g, or t
  misc_feature (588)..(588): n is a, c, g, or t
  misc_feature (592)..(592): n is a, c, g, or t
  misc_feature (608)..(608): n is a, c, g, or t
  misc_feature (623)..(624): n is a, c, g, or t
  misc_feature (647)..(648): n is a, c, g, or t
  misc_feature (651)..(651): n is a, c, g, or t
  misc_feature (654)..(654): n is a, c, g, or t
  misc_feature (657)..(657): n is a, c, g, or t
  misc_feature (659)..(659): n is a, c, g, or t
  misc_feature (661)..(661): n is a, c, g, or t
  misc_feature (672)..(672): n is a, c, g, or t
  misc_feature (687)..(687): n is a, c, g, or t
  misc_feature (701)..(701): n is a, c, g, or t
  misc_feature (716)..(716): n is a, c, g, or t
  misc_feature (725)..(725): n is a, c, g, or t
  misc_feature (748)..(748): n is a, c, g, or t
  misc_feature (793)..(793): n is a, c, g, or t
gtcttcctgttggccctgacaatcatagccagcacctgggctctgacgcccactcactacctcaccaagcatgacgtggagagactaaaagcctcgctgnatcgcnctttcacaaatttgtgaatttgccttctactccatcgtgggactcagcanccttggtgctnaggtgttagntgtaaagnnagcatgtncctacntcatatctaacctttatcncagcaatgtggattccctcttctacgctnctctagtccagccagtgccntctcaggntgtganatctctatttcnnatgagactaaagatctttttctggcanctgttattgaggactcatctgttntctagatctaccatgcagttgcagctntaantggttttggtcttccctttggtcatcctcatatgaagcatttagttgcttcttactgcttgtcttatntaggaggngactgtgctggtaatagttcangttctgcanntagcnatcccacctgtttcagcatgttgacctgatggatgcatcgtggaggngattttggtcttgttgctnncctggatgaactcgggggcgtgtatctccantttnaagaaggactggaaanaacagcgttatttgnngctgccacctacaagctcatggnnatnggnacngngnatccattaatnaggatcaggtcatcnagctgatgaacgcnatcttcagcaagaanaactttgantcctctccgaagccttcagcgtngcctctgcagctgctgtgctctcgcataatcgctaccacgtgccntttgtggttgtgcctgagggctctgcttccgatactc

SEQ ID NO: 686228 - DNA, 377 bp, Homo sapiens
gtgattcccatgcctcaactaccagactaggtggagtacagacacgcggtacttctccaagctaatcattgtatagagagactacacgggatctcatcatgttggccatactcatctctagcttcttacctctaaagattcacgccgcctctaacttctaaagtactcatattacctgtgttaatctcactgccttggcaggctccaagaactttcatactttccatgtacgatcttgagataatacctacactatcatctatgaccaatactctttatctatatgctactgtactctaaagtgccctttggtgagactccaaccttcacactgctcttgacatgtatgtcattctcatgcatgtttccgtacctac

SEQ ID NO: 686229 - DNA, 365 bp, Homo sapiens
  misc_feature (91)..(92): n is a, c, g, or t
  misc_feature (123)..(123): n is a, c, g, or t
  misc_feature (127)..(127): n is a, c, g, or t
  misc_feature (143)..(143): n is a, c, g, or t
  misc_feature (158)..(159): n is a, c, g, or t
  misc_feature (182)..(183): n is a, c, g, or t
  misc_feature (186)..(186): n is a, c, g, or t
  misc_feature (189)..(189): n is a, c, g, or t
  misc_feature (192)..(192): n is a, c, g, or t
  misc_feature (194)..(194): n is a, c, g, or t
  misc_feature (196)..(196): n is a, c, g, or t
  misc_feature (207)..(207): n is a, c, g, or t
  misc_feature (222)..(222): n is a, c, g, or t
  misc_feature (236)..(236): n is a, c, g, or t
  misc_feature (251)..(251): n is a, c, g, or t
  misc_feature (260)..(260): n is a, c, g, or t
  misc_feature (283)..(283): n is a, c, g, or t
  misc_feature (328)..(328): n is a, c, g, or t
gtcttcctgttggccctgacaatcatagccagcacctgggctctgacgcccactcactacctcaccaagcatgacgtggagcttgttgctnncctggatgaactcgggggcgtgtatctccantttnaagaaggactggaaanaacagcgttatttgnngctgccacctacaagctcatggnnatnggnacngngnatccattaatnaggatcaggtcatcnagctgatgaacgcnatcttcagcaagaanaactttgantcctctccgaagccttcagcgtngcctctgcagctgctgtgctctcgcataatcgctaccacgtgccntttgtggttgtgcctgagggctctgcttccgatactc

SEQ ID NO: 686230 - DNA, 608 bp, Homo sapiens
  misc_feature (3)..(3): n is a, c, g, or t
  misc_feature (16)..(16): n is a, c, g, or t
ccncctggacgtgggnctcgcacgcatggtggtgatccaccgctccaaggcggtgaaggaaccccttctttgactacaaggacaaagttcttggccaaagggaacctctcccggttcctttccgcccgggggcagggggatatcttttttttattgggcccccccgggagggggaccggcgggggtttccctctaacccccccccgaattttggggggggggaacaagcggcttataaccccccctcccaggggggccccccttttttggggaacccccccgaaaaaaaaaagggggcctttttttcccccccccttttttttttgtgcgcccccccccaaaaaaaataaaaacccctcttctttcccccggtttttttctctttaaaaaaaaaaaatttcgcgggcgggtgttttttttttaaaaacaaaaaacccccccccctcgggggggggggagaaaaaaataaaaaaaataatgggggggggaaaaaaaaattttttttgtagggggaaggaaaaaacatctttttttttttccccccccggggggggcaaaacacttttttttttctcctatgagaaagaagaactgggggggtctctcct

SEQ ID NO: 686231 - DNA, 371 bp, Homo sapiens
atatagcacgctgagggcctccaggtcgataaagcagctagccttgggaacccgatatatagggatggaaatgcaggaccaagcatgtcgaatctcccaaaatctatcgaccttcaagagcgagtcgtcgaatacagatactcgatgtcctccgtgttgaaggcagaatatctctcaagatattgaccatattcttgaaactctaagtgccttgggcgttgatcttggcgggacgaacctccgagttgcaatagtcagcatgaagggtgaaatagttaagaagtatactcagttcaatcctaaaacctatgaagagaggattaatttaatcctacagatgtgtgtaggaagctgcagcagaagctgtaaaa

SEQ ID NO: 686232 - DNA, 1505 bp, Homo sapiens
  misc_feature (347)..(347): n is a, c, g, or t
  misc_feature (471)..(471): n is a, c, g, or t
  misc_feature (883)..(883): n is a, c, g, or t
gcctacgccgtggttacgagcgccaccagatgcctgtacctgctcccaagcagggtctgccaggccgacgccagcactggtaagcaaccacgatctctcttgaatagctgctctactcgaggtacggagctgctaggggtcgtgcgtaccagcaaggaagcctcacgcgtggatgaggcataacatgcatcgtatatgtgtggccaacgcaagtgttcccggaagcgcttgcagcgtggcggtagcactcgcccttacgagcaccgcattccatcgccacggtagcggcttcgcgtagcttgctgtgcccttggcatcgtcgtcactctcgtgcacgccaccgtggntacgttgcctcatggttgcagaggctgcaacgtggtatagacccctttgagcgcatctgtctagattcctccaaagggctgcacgtcgcggtgcggaagggtaacgcgtgcctaaggccccatntcccacgactgctgactcacggtctcacttgtgatcttacctatgcgcgatgcccaagcgagggtcgcatccttttcgctcctcaggggttgtcccgtgcgacgctatggtacatccgtacgccgttgggcgcggggccctagggtagtggttcttgcgcctttctccaattgaggcatcctttgaaaggctggagccgcggtgttcccccttcgctcgcgaagtaacctgggcgcgaaggaggttggggaacgaaacatggacctccagaaggtggaatggtttggaaggcgggagcctcggttttccgcgcggggacgccgcgttgcgatcggttgtgagtgggaaacgcccacgggaagggttgcgagaaccctgggggagaaccgggtctgaggatttttcctgggtntagtacataaggaacccgcatgacgcagttataggggttttgacttgtggggcggcaggagggacctgacacccatctccgcgttttgtaccatgggttcctccgaactgggtataacccattaaagccccggcggggagccgtttcccaaccccttgcgcttcgcccattccgtaaggcgttaagaatggggattaacccaaggtcccccaaggggtgtcctttgaagacttgcaacctctcccgcattccgcgggtgtggcaggggaggggggcaactcctttcccccagagggggttccttgtggcccttttgcctgtccgggctgaaggcactgggccgtgccctttccacccgcagtggggcggtggtccccctagggtggggagacgcgtctcctgacagggggcctgcccttcaccttggtggccctcctgggggacagcggcttcggtgtgcccttgaaccgcggtgggagccctttgcggggcccgcctggtctgtgtgcccccagagcggaaccgggtgggggcgcctttccgctctgtgtaaggggcccacgtcccttctcgcgaccactggcccgagagggcgctttggtgtcgcgcaccgcgaatccct

SEQ ID NO: 686233 - DNA, 366 bp, Homo sapiens
gaagactgtggtcagcctttgcattgtgtgacatcgccagtccccgttccccgctcccacttcatattctcccatacttataactctccccacagtcttcgctatcaggcgaagcatgtggctgttctatgaaccagcttcttctttctgcgagcagttcctttcccaccaatgcgcacttgtgcctgcagttaggtgagtttttcctggttcatgattgtttctttcatcttgtcggagcgaataagttgtccgtgctgggggactagggttggtgctcaaggggtctcgggtgggccacctgagattaggcgcacacacgcggtgacgcaagatggcagctaatggcccatagtcttcgcctga

SEQ ID NO: 686234 - DNA, 1109 bp, Homo sapiens
agcggattttctccccaggggctctaggctgtggatgtgagaaggggagcaagggagggagacggcgaaaaggaagagcctccaggcctcgctgggggcaggagtcagaggggatcgctggagaaggggaggagcacggggccgggtcgctggacgccggcctcacgggacactaggtgctggacgacctgccaggctcaaggatggaaggccaggcagaggtgcacaggatcacggcggtcatcgatcagaagctggagactcaccaagatacgtgggatagggttgcgggcataacactggtggagtaagctcggatgggctcgcaactcgttatctttcctctctcgttccacacggtgcggtaaatacgtcgtggacaccggaagagagggaacggatcgcctttggggcagtacaagcacccggtaccagtttgtgaaccttattgaagatgcgcggctcattggaggccttcgcgtaccaaaaccattcagagaagggcccggccctcttcaacatgacgtgcggttgaaaactcgggacttagacacgcaaacaggacaatcagttgggttggggaacattgggagatcattgaccgttgcctatgggaactattcctgtgggatgataactattcgttaccaggcggctcagtccttgtagtacagaatcccttacccacgaggtggaagcgaaggacattgtgccctgggatcttccttgcatgccgtccgaattcgagtaatccgctaagtcaagcaacattctggggggaaagcaatgattcaacgacgggatgattgcgtcccaataggtggtgtgatgagcccattttcaagaggattcccactgagaggacaatatgacaatccagtttgaacggttcacacactagagttaggagagtgtggtgcattggtatcacaaatacctttaaatttttaccattaagcgaggagcatatatgtatacttccaagaaggagattgggtgttagagttgggagaacagtagatggagggaaaaccaggaggaaggatcattatctggaccagcagagttgggtttgggactcaaatattatttacaggaggaggggctag

SEQ ID NO: 686235 - DNA, 314 bp, Homo sapiens
agtcgttgaatggcccggaggcgttgaatggcccggaggtgttgaatggccgaggttatctagagtcaccaaagcctgcggtgcccgccccctgtgcgtgcccgtaaggggctgaccgggttggttttgatctgataaatgcacgcataccccccgcgaagggggtcagcgcccgtcggcttgtattagctctagaattaccacagttatccaagttaggacaggagcgagcgaccaaagtaacccatgggcatttcaacggcctgagggatccttctagaagtcgaccctgcgggccttgcacgccttgccac

SEQ ID NO: 686236 - DNA, 166 bp, Homo sapiens
ggcgcgagcccgcaggcgcggtcgctccccggacagcctgctgatcatgcctggggtcatgccctttgtcgcggaaagcgccgatgaggccaaacgcaagctcgaccggctgcaggcccttgtcgagcccagacaggcgctgcgtctgctgtcgactttcctcggt

SEQ ID NO: 686237 - DNA, 203 bp, Homo sapiens
aagatgatgggcaacgcaccgtgttgggccaacgcaccgtgttgggccaacgcaccgtgtactggtaggagtacctgctgcttgccactcttgtcctcgtagaaccgtgggcacaatcttcagtgatgtagtcgtgggaggccagggggttggaggtgagtctgtctgctcccccgagtagcattgacggtgcgttggcccaa

SEQ ID NO: 686238 - DNA, 779 bp, Homo sapiens
  misc_feature (78)..(78): n is a, c, g, or t
  misc_feature (100)..(101): n is a, c, g, or t
  misc_feature (105)..(105): n is a, c, g, or t
  misc_feature (126)..(126): n is a, c, g, or t
  misc_feature (140)..(140): n is a, c, g, or t
  misc_feature (193)..(193): n is a, c, g, or t
  misc_feature (196)..(196): n is a, c, g, or t
  misc_feature (213)..(213): n is a, c, g, or t
  misc_feature (217)..(217): n is a, c, g, or t
  misc_feature (221)..(221): n is a, c, g, or t
  misc_feature (270)..(270): n is a, c, g, or t
  misc_feature (275)..(275): n is a, c, g, or t
  misc_feature (277)..(278): n is a, c, g, or t
  misc_feature (281)..(281): n is a, c, g, or t
  misc_feature (328)..(328): n is a, c, g, or t
  misc_feature (331)..(331): n is a, c, g, or t
  misc_feature (335)..(335): n is a, c, g, or t
  misc_feature (439)..(439): n is a, c, g, or t
  misc_feature (442)..(442): n is a, c, g, or t
  misc_feature (486)..(486): n is a, c, g, or t
  misc_feature (496)..(497): n is a, c, g, or t
  misc_feature (594)..(594): n is a, c, g, or t
  misc_feature (604)..(604): n is a, c, g, or t
  misc_feature (613)..(613): n is a, c, g, or t
  misc_feature (634)..(634): n is a, c, g, or t
  misc_feature (649)..(649): n is a, c, g, or t
  misc_feature (765)..(765): n is a, c, g, or t
tgaaagggaagaaacattaaaaaaaaaaaaaaaaagaacacaacccccgaaaacaaaaaaagcattaagggccaaaanacacccaacaaacaatgaaacnnggcncacaaaaaaaaaaaaaaaaanacccaagaaaaaantttaaaaaaacccccaaaaggaaaaaacaatttgggcccccccccgccgaaanccncccaaaaacaaaccacnccanccanaccagcatccccctccacggggcccgaacaacaaagaaccgcacaaagngagcnannacnttgaagaacacattgttttggaaaaaaaaggggggtcccgaaagganganccanacaaaaacccagggtcccaatccacaaaaaaaaccaaaggccggaagagcagggacaaccaattcccaaaacccccagtttaaacaaaaggcgcagaaaaaacnacnaaacccagaggtttccacaaaaattcgcaagagggccaaaaacnaagaaaaaannaacgaaaaacccaaagtcggccaaaactagtgtctctaaagatcaaaattcttcactcttttagcatggctgataaatcttttctgcctttgtcacnaatgcttgtnaaaccaaanaactttgcaaaagaatatgcnctgctgaaggaaganagtcccaaaaataccatattgaacttcggtcttaagacacacacagttcctgttggatactggactgtgaaagtttattatcttcagtcttttcatgtcctggagcatggcaagtngtcttccgcttaaa

SEQ ID NO: 686239 - DNA, 373 bp, Homo sapiens
tccccccctccaagtgtttatttttgataccaaacatgaattttcagttccctccctcccagccccccaatttcctgcggggggggacaaaggaccccttcaatgtccctggagttgggagggaggaatgggggacataaagcccgtcctgtttctattttaggcaagaaagagtggggtccaaaaactcttggggttcccctgttagcgctggcccagccccggccttgggacctgggggttggttatttgggggacagtgctaccctcgtttcccctgtttgtttttcttcccccaaatgggccctttttttttttaaaaagtccccgagaatggggaattgttcctgttaatatatttttttcaaagtga

SEQ ID NO: 686240 - DNA, 573 bp, Homo sapiens
ctgaggatcccggaggcagggaaagcctgtataactagtggtttgagctgactgagctctggttccttccaagcatacaatcataagcgatcactgctgcattccggtaccgccaatctgggttcttgatgtgttctttactgaaggggaggacatgtgggacaatgtcgtgactggaacaagtgtggcgaagcatgaggcacacccctgctgctttgcaggggttccagtcatcgtcatcatcattttcgtcctgtttagttagtgtctgtgtgaggattggaaccagatactgtagtgctcccttcgcataaaacttgctggtgtgctcagggggccgtccttgttctgctgcctctgaagcttcaatggccaaatccatttcctcatcacagacattggaccagaattctatcccttgtaaagccacctcatcaatgtcacttttcattgcttcgattgtgattgcaaaaagagcaggacccatatatgtctccatgtacttgataatataaggacattttcttcaccagattctgtaaagcagccactcgtaccctcgtatctggacct

SEQ ID NO: 686241 - DNA, 326 bp, Homo sapiens
ccctttgaaacccccccctttccgggggggggtaaaaatttacccttttttttgtttgtcctgggggcctttaaaacaggccgaacctgggggggcgggttttttttttgggggggaaagcccccccaaggggggggggggttttttctcaggaaaattttttccccaccccagggaagggcccaggtggggcccccatgtttacacaaattccttcaaagccccttaaacatggggccgggccccctttcccccttttttttgtccaattttccaaagggggaaaagtgggtctttttttaaaaaaggaaaacccctttggggga

SEQ ID NO: 686242 - DNA, 259 bp, Homo sapiens
tgcggcgcagacccgccgccacatccagctacttttagtagagatggggtttcaccatgttggcctggctgatctcaaagctcctgacctctaagtgatccacctgcatgatccacctgccttggcctcccaaggtgctgtgctgggattacaggcgtgagccactgctcccagcctcgtcggcctttttttgccttctgcttgtacctcaaccctttggcaaaaagtacgaactacagagggcctgtcattagacttc

SEQ ID NO: 686243 - DNA, 961 bp, Homo sapiens
tggggtgtaacagggttaatggatgatgagtccagggctccgggtgaagccctgggggggaggggcacaaagcgaaagggggcgaaagggaagtgctgtagaaggcgtgcctccggagagtgctcggctcggagcttccaaacataggcgagggcaggggtgaggcctcgggcacacagccggggcccagtcacccggcccaaagtggagggcggccgggcccttgcccgggcacttgtgccaagggtggcctcacacttcacgcacacttcgtacgtgagattcaaggccgtttccacaaattccaaccagtgtgcaaagtgacttaggtgcaaatttaaatctcaaaagggacgggggcaaccagaagctcggggaggctttggaactctcctcagaaaaaagaggaaagaacgaggaaagcctcagaaaacaaagaagaacagcaaggatgacacaagccaaacacagggacgggtgggtggggacgggagatcaatcccgcgtggaggagcctcagcctcggggcactgaatggtggaggccgtgggggctcaaccgatccgccgacaggggcggtgtggccagtgaccaagtggacgctcgcgcggttgaccggggtagaggatagctagcgcgaccgctgcgagaccccaagagggagaccaagatagatcgggctagcatgcaggctcggggccccctaagctaaccaaagcccgatacctgaacccaggtaatacgcacgggtcgacaacggatgccacgcactaatcccacttccccaggcctcacaggagacggggggcacgcggaatctcaaagacgccccagggattagacacggagcgtaaccgcccaattactatacactggatcggggggcacatgggaagcccacagagtgcaagcccaatgaggccgaaccacgggcagaacatacacagacaggaccccgcat

SEQ ID NO: 686244 - DNA, 926 bp, Homo sapiens
gccaccgtccaggagcaggtagctgctgggctccggggaacactttgcgttcgggctgggagcgtgctttccacgacggtgacacgcttccctggattggcagccagactgccttccgggtcactgccatggaggagccgcagtcagatcctatcgtcgagccccctctgtaggtcaggaaacattttcagacctatggaaactacttcctgaaaacgaacgttgctgtgccccttgcgcgtcccaatgctaatggatgatttgatgcgtgtccccggacagatattgatacaatggttcactggagacccaggtcctagatgaagctcccgagaatgcctagtaggcatgcgtccccgcgtgggccctggtacccgagcagcatcctacaccggcggccctgcagcagccccctccgtggccccatgatgcatccttctgtcccttcccagaaaacctaccagggcagctacggtttccgtctgggcttcttgcattctgggacaggcaagtctgtgacttgcacgtactcccctgacctcaacaagatgttttgccaactggcaagaactgccctgtgcagctgtgggttgattccacaccccgccggaccgcgtcgcgccatggccatctacaagcagtcacagcacatgacggaggttgtgaggcgctgcccccaccatgagcgctcctcagatagcgatggtctggcccctcctcagcatcttatccgagtggaaggaaattgcgtgtggaggtcatttggatggccgaacccctttcgacttgtgtgggtggtgcctataaccgctgaagtgggtcttgacgtacccattccttaagtactgttacaaccggtgggggatgaccggaggctctctcatattctggaaacccggaccgggaggaacataaacggttatcag

SEQ ID NO: 686245 - DNA, 771 bp, Homo sapiens
tccgcacggttagggtactgcggccgtaaaacttgtgtcacggggcaggcggtgcctctaatactgggtgatgctaaaggtagatgttttggtgtaaacatggcggggtaaaatttggccagagtcccttataactttttttaaaccttcccttatgacgcatgcctggtgtgggtgtttgacatgtagaaggtgtaataattgacttggtggtgtatagattggtgaagatattggggctggtaaattggtcagtccagtggtttaaatctggaccgcagtgctatatgagcgggaaggaaaaatggtgtttccatggtgtaatcttaatatcttaaacatgttaagtatacttctctaataaggggtaggataaaaattggtgtcccaatggggtgtgtgtgatgtgatgtacacagtaataatgtgattgtgggggatttttaaagcgtaagtgggtgttgttatgagtctttgaaaccgctatctctaaaattgggtggtgctggcttataaaagcgcctaacatcatggtggttgtaaacatttttatcaactcctccttctcacaagggttttttccctatgtggtccaccaagacgtctgtccctctttgtggacttacactagtttaacatctacacagcggggtgcatacaagaggggtcccggggggcgcacatttacgcgttggaactaacaatcatatcttgtggaacaccagctatacaccaggcttcggtagggttggcagccttaacctaataatc

SEQ ID NO: 686246 - DNA, 1053 bp, Homo sapiens
gccctgatcgacgcggcgggagcgagaaatacttgcagacttgaaggaattatcagttcttgcattttcgtattcatcatgtgtcctatgatagttagtggcttccgctcgcctcatccctttgttcatgtcactcatgttcaccaacgccactctgctgaaatgtcgttatttcttcaaggcccggaggcaaatgctcacccacatctccatccagcagggttaccagcagcatgggcagtgagaaggagcagcagtccagcaaccacaacctgcctgaggaagagggcaagggggtaagccttggcagcagtggcatgacatcaacagggttctatggatccccacctggcgcgcgcaaggcagcatgggcaaagagcagcctgtctggatgcaactagcaatgcaaactctatcctacaccaaagcccatggcacgcaaagtcaactgtcacggagcatcgagagcctagggggaacaccatagctcataccaaggcaatgaggcagactgagaagacctaaatatgtgcccaagtgtggcaaaaccttcaataatacctccaaactgagaacacaccagcggatccacactggtgagcagccttccaagtgtacagaatgtggcaagagctactcgcgaagctaccccgcatccggcacgagcggatcactggaaagacacactacaatgaccaagtgcaggagagcaaacggcggcagccagacctaacaaacacaaacagaacacataaggacagaggaaaacagaggacaaaggcgaaacagatacagcaaaaggcacgcaagtgtagcacccggacacctgctcagacacaaaaagcgaaaatataaaaagcagaaaaaaccagaagagagatatacgccccaacagtaacacctagagaacggagggagagacagaaacaaacgacgagaggaccaggtaagtacgacaagaacacaaagaccaacgaaaagaagaaacagaaaacgcccaaagcaaaaagaaaccacgagcaaaccgacaaagaaaaccaaacagaagaacaa

SEQ ID NO: 686247 - DNA, 1297 bp, Homo sapiens
tctgccactcaattttgtgttgaccctcatcctcttgttctcgcatgactgtggttgtccgcccgcctctcaccagattgtgtaccctgtggaaatctctctccacttttccgaaaacgcattttttgggtctcccgtgtggttgacccacccccatggctgcaacacccgggggatgtgtgccgtttttctgctccgaagcccacccattgtgtggggtggcccaccaaccttactgcaaagaggttgccccatttcgaagagttgccgcccactcctagattgtggcccaacgccgcgacgtggccaatatgtgagagagttcccccccagagttccacagggagaattattgttggaaccattattttatccgtgggtgggcaacttgtgggggttccacacttgcaacaagttgcgctttcttctaaaagggcttctggttaggggacaattgcgattctcacaagcagaatttgtcgccccaaaacttttgaaggaaggtagagggaagggtcccctgtggagattttcttgtaatgctggggtgcccccgccgacgatctgttttctttaccccgaaaccacacacttcggcgcgggggagtatacacctcgcacagacacccgggtcccacaaggattctcacacgggctcgcacacgcgcgagaaacaccctctcgagtgcccccctgggaggggatgctctgtgataagtcccctgggtgtgagcttatctgatctagatagaataaggcttactcccctccagtgcaagaatctcttctctcccaaccaccgggtgcactaggatccacgggtcccaccagacgtgtattcacactgagaaagctctattccaagcagccaacaaaaccaccccagcggtttttcggaacacacggccaactctcgaacatgcgcacttgtttcacaaggctctttctgatggaagagacactcaagatacctcgccagggtgtgtacacttccacctccaccattggaagacccaatatggggtgtgtgccccgggcattgtaaacacacacagcacccacctccatcaggagcgcaccccacacaccctacatgccaccgccccacctgaattctatggaacgtctgccaccacgttctccatacatggcatgcctccaccagttgggtccccgcgcccgccctcgccggacttcggcccctcataggctccagcccaacacatgaccacagcccctcggcggggcacacacctttgcttcaaccctcccgatttaagcgtgccccaggtcacca

SEQ ID NO: 686248 - DNA, 842 bp, Homo sapiens
gcaccgcgcgggacgtgagcttgtgctgttgtgtctgtgtgtggttcccgtgcggcgtgtgtgccaatggagtgatgtgatgacacatgtctggatgcatgctcctgtgtgttgcttgacttgtgtgtgctgatgtgcctacagcagctgctgatgcttagagttgctggcctgacgcgctgctgtgctgcacttccccatgctgtggatgtgtgtgacgcagctgtgtgcccctgctgtgctgtcattctgtgctggctgatgtgatgcctgcactgctgcgctctgtgcccataagcatttgtctgtgaacgcttgtggctgatgtgatgcacgccccattgtgatgatctgactgtgtgctgccagcctgatggaatctgtgacattgatgtgcctgtccgcaccctgaaagtgtgccgatggttctgggcctgtgccctgtgtgtgtctttgtgccaacgtgggtggctggctctgctggtgcttgttgttggtgcattgtgatggtgctgctgagctcttggttgtgctagcgaccccctgattgcctggggcaccatccagggacacctgtggctggcaccagatagggggcctggacaccaagtggagttacaagagcctgcgcccaggctatatggacgaccggactgcgcaagggaccatgcctggtgggagaacacagtttggtttccggtttttgagcttgtggcctttggaggggcttggggggacttacttcagcccaagacgccaaagcgcattttacagagacggaaccatcaattctattgagcggtacacgactttgtgcagcacgactgagatctgcaattgga

SEQ ID NO: 686249 - DNA, 1319 bp, Homo sapiens
tatatatatatttttttgggtgtgtgtgtgtggagagaaaaaaaatatatagatgatatttttttttattattgttatataataatcaagccacgcgaagagaagaagaggggatttatataaaaaaaaaaaaagagaggaggggcgcccataataagacaatcaccccgcagggagggcgcacacaacaatatccagcggccgccgcccaccgtattctgtatagagaagaaggagggcgccacacacataggagagagaggcgaactattataagaacagacacaagagaggagcggcgcggtagaaaacaacacagggagcagagagagagagagaaacaacaacggccaactgggcggagacctactaggagagagaagaggacacacctaccaccaggggaggcggggagaacaccaaagtagcggcagcacaaccccacaaaaaacaagaaaaatagacacccctccagagagaggaaacaaacaaaaaaccccacagagcggcgccaaaaaacgcagcgcacaccacaacccaccccgccaccaccaccaccacccccccagcgcaccccgaacacaccccccgcgccacccccccaccaccaccacccacacagagcacaaaactactcaaaaccccacacgggggccgaccagccaacaaccccccccccaccaactcacagagcggaaaaagaggagcacacacagcagaccggacgcaagaaaagcaccacacaacgcacgcacagaacagaaactagacggcacaaccaagagagagcgcgaaggcagctaagacgcgcatccgacacgcaggccgacgagccggcgaagaggagagtacggaagggaagaacagaaaagacaaccggaaagagacacacaacaacaccacaaaacacaccaccataacacgaagcaaacgcaggaacaagaagacaagcaaacaaccagacgacccaaaaaaaagcacaaaacagaacacaccccataagaaacaaaaaacacaaaacacgcaaacgacacaaagaaaaaagcacacgcgagcacacaacacagacaacaagacacacagacacaccagcccacgagagcagaccagcagcacgacgaggcacgcccacaacggcgttcgaaaacacaaaacaaagagcaaccatcagaaagagcgagaccaaagaaagagacgaacaagaaaccaacaaacaacaagaggtaagaacaaaaaagcacgagaacacagaaagcaaccaggcgagcaagaagacgaagaagacaaacagcaacagaggaagaaaaaagcaagacaac

SEQ ID NO: 686250 - DNA, 232 bp, Homo sapiens
ttgtcagtggaggtgaggcggccagtccataactgaaaagagagcggtgttgccaggggctgggtgagaaaatatcctggaattgacagctacacaactccgaatctactgaaaccactgaattggacgcattgaatgggtgaatggtgtggcatgtgaattacctctcaataaagctattaaaaaatactaataatcagcatgaggtcaacctaattggcactgacaacgg

SEQ ID NO: 686251 - DNA, 373 bp, Homo sapiens
  misc_feature (282)..(282): n is a, c, g, or t
tttatggttcgtgatgcttatgtcaatcactgatgctgatggggatcgcagtgactgatggtcgactggcgtatgctaatgctgccgatgccttcgtcggctagataagtaactccaaacccgtgtagcatgaggattcattatgcttaagctgtgaacctgagattcagaagacaatctacctgtggctgggtcactaatcagagcttctcggtctgtcctcaggctggatgttgtccaagtgacaagagagaccctcacttactcagtgtcacaaggaangatgtaggaccctatgagtgtggaatccagaacgaattaatgtgttgaccacatgcgacccagtcatcctgaatgtcctctattgcccaga

SEQ ID NO: 686252 - DNA, 383 bp, Homo sapiens
ttgtcgtgagttaccattacccagcgcctgacgatacgctcttctattgtcttattctggcaggttttgacgtctttcaacattatatattaaagaaattttattccttggaccaaaaggtttggttaaccacccccctcttacttgctttcacattttgagtgtccagaggaaacagaagggaatgagtgtgtgacgttgctgcacgcctgactctgtgcgagcttctttctgtgtatatattttgttttatttttttccgtgtatattttaatccggcagacatcatgtgagattccttaaaatggattaacgattctcagctgaaaaaaaggtttgaaatgtttctgtagtttgtttggtctaacaacaataggtttata

SEQ ID NO: 686253 - DNA, 276 bp, Homo sapiens
tggcagtggccgcatgtgtgtactaaacacgtcaaaatctcacgaacaccagacatggcatgctttacccatcttacttagtgacagagagctgccgttgacattgtttcaaaagtagcaggtacactgactcttgtcacagctgtgttaatttatgaagcaatgtgggtgctgactactagtagtatcaacactatgttcaggatggtttcgctcacctgtctttcatcacatcaacacaaatgtgggggggcagttgcatgcacattccgtgtc

SEQ ID NO: 686254 - DNA, 348 bp, Homo sapiens
  misc_feature (86)..(86): n is a, c, g, or t
  misc_feature (174)..(174): n is a, c, g, or t
aataagaatttattccatatttatttttacaaatgtacaaacacacattcgcaccatcctgggaaagaattggcattagggaagtncttaactcgataccattgcacttaagcagcaaccctttaaagcaaccatcatttgttgtccagtagccacttctggacaccaactttnctttttatttcactttgacattttaagtagactttaaagttttagtttatctaaatctcaactactttaagaaaacctggtcttcatgttgatgtattagtttgctagggctgccttaacaaagtaatacaggatgagtggcttaaacattagatattcactttctcatagttt

SEQ ID NO: 686255 - DNA, 466 bp, Homo sapiens
  misc_feature (60)..(60): n is a, c, g, or t
  misc_feature (131)..(131): n is a, c, g, or t
cctgggggccctgcccttgggtcgccggcccgaggtaacctcgcgagtgcgagcgcgcgnccctggaggagagaacagggatgcagaggcccagcgcctggtccccgacggcgacggtcggaccagccctntaggcggcgcccgcagctcatcccagcgctcccccgtagggccagcaggggtccgatcgccccgccccggctcccctcagatgcaagccagcccgagccctgggatagcacccaaaccgaagacaccacctacggcccccgagcccgcggctgccgtccaggcgccactcccgcgggagcccctggcgttggcgggcaggacggccccagcccagccccgcgctgcctcggcgcctcccacggaccggtccccgcaaagcccctcccagggagcgcgcaggcagcccggggccgcgcccctggggaaggtcttggtggaccccgagagcggccgc

SEQ ID NO: 686256 - DNA, 419 bp, Homo sapiens
  misc_feature (55)..(55): n is a, c, g, or t
caaaccacctctgtggttccaggactaaggccaattgtaatgcagatgattggtntgcggcaacgtaaaaaccaactcacatttctgcaaagactatattgggaaactccaaacacaactaagccggctggtctgcaaaaactcaagtcactgtttgtccctaaaaagaaaaggtggtcgaagtgatgagctaccctgaaaagtcagaaggaaaccacaaaacccacgcccattgctcctcctaagctacagctgctgctgcacacagcagaaatatttatattctgccagagatcccccaggactatcctggatagagtagcttctacagacgttattctggtgggaaatactacgaaaaagtcaagtgctgatcaatctattgggaattttctgccatttaacacctgttaaggaac

SEQ ID NO: 686257 - DNA, 221 bp, Homo sapiens
tactgacctagaggatcccggaatgctagcagagaatggaacaacgaactactttcaatttcatatggaaccaaaaaagagcccacatagccaagacaattctaagcaaaaagcacaaaggtagaggcatcatgctacctgacttcaaactatactacaaggctacagtaacaaaaacagcatggtactggtaccaaaacagatatatagacaaagggaaa

SEQ ID NO: 686258 - DNA, 221 bp, Homo sapiens
ttcctttgtctcggtttgttttttttcgctggttgtttttttgagacaggtcttgctgtgtaacccaggctacagtgcagtggcacgatcactgctcactgtagcctcgacttccaggctcaagcaatcctcccgcctcagcttctgagtagctgggaccataggtacatgctaccacaccccactaatttttgatctttttatagagacaaagggaaaca

SEQ ID NO: 686259 - DNA, 511 bp, Homo sapiens
actaaaggaacgcctgcctgactgaagcttaatgatgtgaggcttctaatgtgataccctaccttgtattaacctgaagtgactcttccttagctaagagagccagacggactccatcgtgactccttcactcgcagccccttacccacccccttcctcaaggacttaacttgtgcaagctgactcccagcacatcaagaatgcaattaactgataagatactgtggcaagctatatccgcagttcccaggaattcgcccggttaatagcacccagagcccctgcgtaagtgtccggttgataacgcccaaagcccggcgtccatcaccttaggatagacttaaagcctctgcacctggaactgtttactttcctgtaaccgtttatccttttaactttttgcctactttacttctgtaagattgtttcaactagactcacactctcccctgtctaaaccaaagtattaaagaaaatctagctccttcttcggggccaaagaatttgacgc

SEQ ID NO: 686260 - DNA, 234 bp, Homo sapiens
ttgcacattttcaagaagttggagtctttgatagggagaacaatttgttgcaccattggctactcctttaaagttaataatttgattgatgatagcgcatctgctatcatgttgttatggcaaaatttgagtttgattattacgattgggttgcatttgaacagttcttagatcaattacctgataaagatgttgctaaattaattgcaaccattcaaatattgcaataatgcc

SEQ ID NO: 686261 - DNA, 288 bp, Homo sapiens
gaacaacagagtctcagggaaagagaaccacaatagaaaaaggcagaaaagttcgggcgcggtggctcatgcctgtaaccccagcactttgggaggccgaggtgggcaaattacgaggtcaggagatccagaccatcctggctaacacggtgaaaccccgtctctactaaaaatacaaaaaaattagccgggtgcggtggcgggcacctgtagtcccagctactcgggaggctgaggcaggagaatggcatgaacctgggaggcggagcttgcagtgagccgagattg

SEQ ID NO: 686262 - DNA, 402 bp, Homo sapiens
acccgcggcgagttcatgcagacatgattgttaaatggaagccgaaagtttctgctaccagtgtccctaccctccacccgtgccacaactgccaatcttattaaccttgtcctgaccagagttgagtcacaggcttactctatcaagtgtcatactggcttagaataattaggattcatctcaggggtgagggagaggccccactttcctagtaatagttattcttactactgcatttgtgagtgctaggactcaatccttgtgcccttttaccctatctatgattctagtaatttcctctagtctcatggtttcaaatatcacctacactcttcccaaatttttctcttttaagagacaggatctctgtcacccaaactgaagtgcagtggtgcaatcttt

SEQ ID NO: 686263 - DNA, 149 bp, Homo sapiens
aaaggttaagcaggacatgcctccttcggggggctatgggcccatcggctacaaacgggacttgtccgcgtcgaggactttcgggctacagcatgctggccataggggttgggagccctggatctacggggactggagcataatgtaag

SEQ ID NO: 686264 - DNA, 1048 bp, Homo sapiens
tggcactggaagttatgtatttaaacagctttacatgtaatattcatatataaaaaacttaaaggtgcttttctccaattaaaaaatctaaaagaattcaaaaataagggcattcaatatttggaaaaaagtacagatttacaaaatggtgtatattctggtcatgaaaactccacaccaacattatataacactgggaaaaaatatacaaacgggtatatattattacaaattttatggcagcaataaacttaagttcacaccaggcaataaaagagtcactattaatcaagatacacaagctttgggtgaggttctctataaacgtgaaggactttttctctttttttctcgtgcagaaatccttaaaaccgtggggccactttaaaatttgtggttaccctttctaagtgagagggtaaatttattacacaacaagtgatgtgaaaaagattaacagaaccaggtgtggtcatattatagtgaaatctcatttccagcctttgtggttcaaccaaagtgggccgaaaaacctctattattcctcaatattttcctcgagtgtggggtttccccgtggaataaagggcgtggtgacgtgcccgtgggcataagtggggcgttggaaaccgtggtaagggaaattgcggggtatccactcccacgacagaagacacgtggacatttggagtggttctacacgaattcaaggaaagaaattacgatccaatagtggttgggagaacttcccaaatgcgaaatctcttgaaaggggaaaaatcctaaaaaccattttattggctggataacccagtttcgaagagcatatattaccaagcgggtggcaaaaaaggcgacacagatttcatcctcttatcaaaattttttggtgttttacaccacacaacttcccgttgcgccgatttattttctttaaaacagcaggttttaactaggaggcgaacaaatttctttttaatacccccaacaaatgcggaaaaattgggtcttgtggggcttttaacaaaacgaggcttttttaaacaat

SEQ ID NO: 686265 - DNA, 229 bp, Homo sapiens
tttactcccaaaccctcttctcccttatctgagctgtttttctccttagcatgtttgcgtgacatgctgacttcagcatcagagaaagtgtcaggccctagcaaggaaactgggcacatgacatagagggacactgtgagaaatggccatgtgtgtgggacccaacgtgtggtacaggtgggagtccaaagccacagagctgcaggtctcatccagggctgtagtcctg

SEQ ID NO: 686266 - DNA, 408 bp, Homo sapiens
tttcccctttcccccccccctccggggttttttcctgggtttgggccaggtgaaagggtcccccccctccctggctttttgggttccaggccccggcaaggggcgcctcccttttttttggggggggggttaattaaggaattttttttcccccccccccctttttttttgggccccccccccccccttttttgcccaggaagtggggggtggggttttggttttccaacaagtgggcgggcgggggggttttttttcaaagggttccctttgccccccctcccccccctttccccccctttttcttccttccttcctttccttgggggcctgggccccctttggggggtttgggggacccccatttttaaagggaaaagggggggggggccgctccttttttgtcca

SEQ ID NO: 686267 - DNA, 487 bp, Homo sapiens
tattgaaaatctcgcctaaggtcatctagatggttagtggcagaacgatggtttaaactcaagtggtctggctccagccctgccctcgcgtatcccccacagccctgtgctttggagggcacctatagctaggtttgcatgtcacatgctagaaatagggtagacgcttctcaaggatgtccggacctctctctcactactgaggaagaagttatttccttctgcttgagggaatggtgggcagagcctacagctgtggtgaccctttgacaggtggggcaggtagagcaggcacaagtgactcaccagggagcattagccctaggatgcagtaggaatgcagctgctgcactgatcttggcagttttgattagtgaacagaataatttatttgtcattcatactctgcttccataaaggatttaagaaagcttacaataagtgactaaatagttactggaataaaactcataagttagaaatgatg

SEQ ID NO: 686268 - DNA, 159 bp, Homo sapiens
ctcgagcgaactctgtctcaaaataaataaataaagtcaaagaaagaaagaacatacacgatcaaagcttctttctctttcttatgtcctagtgtcagtgggagaacttcagagtgatgaaatagaatatttggtggatgaagtcactgaacaaagtgg

SEQ ID NO: 686269 - DNA, 393 bp, Homo sapiens
  misc_feature (244)..(245): n is a, c, g, or t
agtttttcctgacatttccatacaaattaggagacagcaattctcccattccatacagactgtattgcttagtcaaattatatatctcctaagtggagaaaacaatatgcaggtttcacatttgccttaagattagagatgctattaaagtgcatagcagagtgcctagcatatagttgataaccagaagaactctccttgtatgcacctttcgtgagctggacacttctacaagttttacctnnttcgtgcctacagcagcagacttgtatggtaggtattactagatttcatcaagcctaagaccacatttttaatttttttgcatgttgacatttctgacaatctatagaatttttaactaaatgaatatgatactattattcccatggc

SEQ ID NO: 686270 - DNA, 206 bp, Homo sapiens
atcaggcgagtttgtcaggggtgggtgggctgtgagatagatgacagaaaggctggaaggaaagggggtagggtatagaaggccagggccaaggggggtacctacaggtaccgctatactagggaaggggacaagcctatgagcacaactcgccctgggggtaccggaggctacgaatatcggtaatacatagggtacataagcta

SEQ ID NO: 686271 - DNA, 1288 bp, Homo sapiens
aaccgccaaattcactgcacacattcaccaacagcaagcacacatcaatgtatcttgcaacacagtggcagcatcaattggcaatcacttcttcattcactcatcacacatcagcagttcctttattgcacaaaccaaacactcgtgggacccaggtcattcttccactgcaccagttgtaccacaacattttgagggcaataacacagtcatctttcagacaacacagacaggagagagacacacttcatatctatttcgtgcaggtctttcattcacactgcatcagtcaacaatcacaagcatcattcacagacacacaagcaggcaatccatagcacgcaacagtcgctcattgacaccaccagcatgtcaaacaaatctttcacacaatccacaatgcagcaatatgtcacaacacaatcatacaaacattgatgaccacagtgaaggttatcatttcacccccagtaacatgtatggtctggggccaacatttcacaaatcacctgttaaattatctcatttctaaaactgcaccttccaaaatgggttacaggccaacagccaatgacaagacatccaccattcccattcatgcactaagacatttttaaccaaaacatagacatattcagggaatttacaacctgggtaagggtgccattatgggcaaaaaccgacacacagccaacaaacacaccataaacaaacgaaccattatcacacaaccaaaatacagaagatgaaaagggacgacaaaatacgtcccaaggcattaccacacgtaagaccaggcgaaagtgaggaccagagaacatgtgacaggctctacaactaatgcacataaaactacaaccatggtaaaagaggataccacacaaaaagaggatgaaccaaggggtcacaaagacgaatcaacttagacgcaagcctcacgatagaggaggcccacagataacccagcagcgggcacaatatgtagggaaccgacaagtggacgccacagctgagttacacaccagagagggcaccacccctagcacaacgacctcacaaagaacgaagaagaaaagcaaacacaacacacaagagaatgcagccaaacgtagcagcaccgccgacaggcacccacacccacacatgaaccccgcacgttcgaggacatggaagcacacagagagcgacacccacacacaaaaccataacggacaaaaccaacaaaaagtggaccacgcactcacaaacaaaaaggtgaagaataaacaaggcacaccgcacacaccac

SEQ ID NO: 686272 - DNA, 665 bp, Homo sapiens
tcctaagagccagggacagtactgggagaaaccaaggctgaagagtcaggttgaagcacaggcttttgttttttgttgtttttgttttttgagacagagtctcattctgtcacccaggctggagtgcagtggcgcaatcttgcctcactgcaacctccttttccggggggggagcaattctcctgcctcggcctcctttagtagcccggattacaggtgcataccaccacacctttctaatttttgcatttttagtagagatggcgtcaaaccatgttggacaggctggtctcaacctcctgacctcaagtgttctgcccgccccagcctgccaacgctgcctcgctcgttcgcgcttgcgcctccacaccccggccaaatcacagaatcttttaattcctccccccctcccctcagccccaggctcatgacggccaaggagctccctctcctcgtccgcccctttctgcccatgaagccccctttcctgtgtgccacgccgaattgccccccactcctccctctcctttatacttatcactctttattcctttcttcccctttttgtactttgctgggccgtcctcccgagtactccttgcacccgttcccatttctagcttcttattttttcttccctccaccttcttcaacaaccaaattaa

SEQ ID NO: 686273 - DNA, 576 bp, Homo sapiens
gtaacggcatcatattccaggtactgtgggggatgagtatctggtgggtagcttgtcttgcagtgctaagaaagtccctccaagcaggcaacgtctcatgacctgtttattcacggtgtatgtctggttgggattgaatattcgcttcttggtttgaacatgtggatccaggatgggtagatcaaccgagataaggggatagggcagtggctccacctcaggacctcagggcggtaggccaccctagtgagaagtggaaaaggacaggccagagcttgagagaggttgccgagcctctccctggccatcctcaccactgaggccacgacaaagcagagctccagctcggacagaagcctcagggccagtgaggctctgccagagctctcttaccgctcttcgtccccagtctcctccaggcctgcccaaggcaggatgtccagccaggcctcggggtcatcttgtcacgcataacaatattagtcgttaaagtgtaaacaggctaagtgccccgattaaaagacacagactggcacatgggataaggagtcgagacccattcaggctctgggggga

SEQ ID NO: 686274 - DNA, 3373 bp, Homo sapiens
atggccccagaatcccatatattagcttctaacaccatggagacccatatattagcatccaacaccatggactcccaaatgctagcgtccaacaccatggactcccagatgctagcatccaacaccatggactcccagatgttagcgtctagcaccatggactcccagatgttagcaactagctccatggactcccaaatgctagcgtccaacaccatggactcccagatgctagcatccaacaccatggactcccagatgttagcgtctagcaccatggactcccagatgttagcaactagctccatggactcccagatgttagcaactagctccatggactcccagatgttagcaactagcactatggactcccagatgttagcaaccagttccatggactcccagatgttagcaaccagctccatggactcccagatgttagcaaccagctccatggactcccagatgttagcaaccagctccatggactcccagatgttagcaaccagcaccatggattctcagatgttagcaaccagcaccatggactcccagatgttagcaactagctcaatggattcccagatgttagcatctggcactatggactctcaaatgttagcttctggcaccatggatgctcagatgttagcgtctggtaccatggatgcccagatgttagcgtctagtacccaagattctgctatgttgggttcaaaatctcctgatccctataggttagctcaggatccttacaggttagctcaggatccctataggttgggccatgacccctatagattaggtcatgatgcttacaggttaggacaagacccttatagattaggccatgatccctacagactaactcctgatccctataggatgtcacctagaccctacaggatagcacccaggtcctatagaatagcacccaggccatataggttagcacctagacccctgatgttagcatctagacgttctatgatgatgtcctatgctgcagaacgttccatgatgtcatcttacgaacgctctatgatgtcttatgagcggtctatgatgtcccctatggctgaacgctctatgatgtcagcctacgagcgctctatgatgtcagcctacgagcgctctatgatgtcccctatggctgagcgctctatgatgtcagcttatgaacgctccatgatgtcagcttatgaacgctccatgatgtccccaatggctgatcgatctatgatgtccatgggtgctgaccggtctatgatgtcgtcatactctgctgctgaccggtctatgatgtcatcgtactctgcagctgaccgatctatgatgtcatcttatactgctgatcgttcaatgatgtctatggctgctgattcttacaccgattcttacactgacacatatacagaggcatatatggtgccacctttgcctcctgaagagcccccaacaatgccaccgttgccacctgaggagccaccaatgacaccaccattgcctcctgaggaaccaccagagggtccagcattgcccactgagcagtcagcattaacagctgaaaatacttggcctacagaggtgccatcattaccatctgaagagtctgtatcgcagcctgagcctcctgtgagtcaaagtgagatttcggagccttcagcagtgcctactgattattcagtgtcagcatcagatccctcagttttagtatcagaggctgctgtgactgttccagaaccaccaccagagccagaatcttcaattacgttaacacctgtagagtctgcagtagtagcagaagaacatgaagttgttccagagagaccagtgacttgtatggtatctgaaactcccgccatgtcagctgaaccaactgtgttagcatcagagcctcctgttatgtcagagacagcagaaacatttgattccatgagagcctcaggacatgttgcctcagaagtatctacatccttgttggttccagcagtaactactccagtgctggcagagagcattctggagccgccagccatggctgccccagagtcttcagctatggctgtcctggagtcttcggctgtgaccgtcctggagtcttcgactgtgactgtcctggagtcttcgactgtaactgtcctggagccttcggttgtgactgtcccggagcctcctgttgtggctgagccagactctgttaccattcctgtgccagttgtttctgcgctggagccttctgtgcctgttctggaaccagcggtgtcagtccttcaaccttctatgattgtttcagaaccatctgtttctgtccaggaatcgactgtgacagtttcagagcctgctgtcacagtctcagagcagactcaagtaataccaactgaggtggctatagagtccacaccaatgatactggaatctagtatcatgtcatcacatgttatgaaaggaattaatctatcctctggtgatcaaattcttgctccagagattggcatgcaggagattgcattgcattcaggtgaagaaccacatgctgaggaacacctgaaaggtgacttttacgaaagtgaacatggtataaatatagaccttaatataaatagtcatttaattgctaaagagatggaacataatacagtgtgtgctgctggtactagtcctgttggggaaattggtgaagagaaaattttgcccaccagtgagactaaacagcgcacagtattggatacctaccctggtgttagtgaagctgatgcaggagaaactctatcttctactggtccttttgctctggaacctgatgcaacaggaactagtaagggtattgaatttaccacagcatctactctcagtttagttaataaatatgatgttgatttatctttaactactcaagatactgaacatgacatggtaataatttccaccagtcctagtggtggtagtgaagctgacattgaagggcctttgcctgctaaagatattcatcttgatttaccatctaataataaccttgttagtaaggatacagaagaaccattacctgtaaaagagagtgaccagacaatagcagccttgctcagccctaaagaaagtagtggaggagaaaaagaagtacctccccctcctaaagagacactgcctgattcaggattttctgccaatattgaggatattaatgaagcagatttagtgagaccgttacttcctaaggacatggaacgtcttacaagccttagagctggcattgaaggacctttacttgcaagtgatgttggacgtgacagatctgctgccagcccggttgtaagtagtatgccagaaagagcttcagagtcttcttcagaggaaaaagatgattatgaaa

SEQ ID NO: 686275 - DNA, 168 bp, Homo sapiens
  misc_feature (83)..(83): n is a, c, g, or t
  misc_feature (89)..(89): n is a, c, g, or t
  misc_feature (115)..(115): n is a, c, g, or t
  misc_feature (131)..(131): n is a, c, g, or t
gtacatccacccgaccgccaaggtggccccctcggctgtgctgggccccaacgtctccatcgggaagggggtgaccgtgggtnagggtntgcggctccgggagagcatcgtcctncatggagccactttgnaggagcacacgtgtgttctgcatagcatcgtgggctg

SEQ ID NO: 686276 - DNA, 145 bp, Homo sapiens
gggacctggtcaacagatacctgagtagctgggactatggcgcacacctagcacgcccagctcatgtatgtattttttgtagagacaggatctcaccatgttgcccaggctattttttctttaccatagctatattctccttatt

SEQ ID NO: 686277 - DNA, 387 bp, Homo sapiens
agcggctgacatatttgttgctgctgttgctgctgcggtatgtgctgctgatgatgagagagtgctgattggacactaagtatagtctttttgtctctcttcttcagcccatccatgttagctctacggaggtttgaataagccatctgaagcttattcaattccttggagctcacctcttgaaatcccttagaaaggtggcatatgggttttctcactgggtccacagtgctgatctatcttcttcccatcgtaagctcgtaacagacacttgtagtctgcgggctcaaagccctccacagtacctttactttggactgggtatggtacgaccgtcatacttactacaaggcggctatcagacgctgcccgaacgtccgggcactt

SEQ ID NO: 686278 - DNA, 227 bp, Homo sapiens
cgctggtgatctagaggaccattgattcacgtgtacgacctaaagttgcttatctctgtaggaagtaacggtagtcatcatgtatttatttcatttcagaaaaacgtctgatttccctatgtgttggttgcggcaaatcaattcacgatcagtatatactgagggttctcccggatttggaatggcatgcggcatgtttgaaatgtgcggagtgtaatcagtatttg

SEQ ID NO: 686279 - DNA, 861 bp, Homo sapiens
gcgccagtggggtcccaaacaccgcttccccctattcttaggggcgtttccccctccgtggttccccccgctctgagcaagtgttcccctagatgcgtttcctagatcccgtgtagtgcccgtgtttcggacaacatccccgacccgacgtgcatgtatagtgccacttctctccgacccctcctgggatatttgaacccctgtgttgacattttctgcccccccctcctatctttcggtctctttggcccgctccccaactccttgagggatcccctttgctatggaccacgaccgggggtctcacccaggactccctcccccttgtgccacctcggatccgaatttggcgcccccccaatgggggctgtgacaccttccgggtactacccggcttttctctgcggcggcatatatgtttctcaacatctcctgtcaaaatacttctcctcccccatatttgtcacttgagcaccccgggcgggcactcggacatccttgacacgtagacacaatatggagtgagtgactccccggtttgtaacgcccccacttgtatttaaatatattaaccatcacacgaaacagtgttgtgccaaatcaatatggacaggtttctcccacccacataggcgtttaaaacacagaaagcaaattattccccggacggtttttgaacaaccgacacacactgttccaccggaacacaccacccggggggtatataatacaccggcaaaattttaaattttggggccaacaccccgatttaacccctcgtcctagaattatttccccaaaattttttaaatggggcccttttttccccttagcccccccttttcccccttttgggcccca

SEQ ID NO: 686280 - DNA, 190 bp, Homo sapiens
  misc_feature (33)..(33): n is a, c, g, or t
  misc_feature (149)..(150): n is a, c, g, or t
ataatatcttaaggtgtatatttaatttttttnattggcttagttgttttttgttttgttttgtttgagatggagtttcactgttgcccaggctggggtgcaatggtgtgatcttggctcactgcagcctccacctcccgagttcaaannattctcctgcctcagcttcctgagtagctgggattacagg

SEQ ID NO: 686281 - DNA, 802 bp, Homo sapiens
  misc_feature (175)..(175): n is a, c, g, or t
cagtgggagcagctctcctgccaagtcctcaccccctgaaaattgtcgcctgctccaagtttgtctccactccctccttggtcaagagcacctcacagtttgctgagccgtccgctatctgcagtggtgctgaaacgaccggagatactgacagatgagagcctcagcagtttgnagtctcatgtccccttacctcacttgtctctagccgaatcttccaaaccagcgccatttcagggacatcgacacaggcagccaatgttcattggagctggggctgccacatttggggtggcttggtctggggctgggattggaactgtgtttgggagcctcatcatttgttatgccagggaacccttctctgaagcacagtcttctcctacgccattctgggctttgccctcctcggaggccaatggggctcttttgtctgatggtagcctttctcatcctcttgtgccatgtgaggagccgtctccacctcccatagttctcccgcgttctggttggccccggtgtgttcttttcctaatacctccccaagcagccgggggaacggggttgtgctccgtgttttgaccgtaggaacggaccaattaacttctggcaaaaacaagaaacaacaaaaaaagttgtgggccgccggacgccggaaaaatttaacaccattgtttgtgccggccccataataaaaactgccaggtgtcccaggaaccgcgccgagtctgttggctccccaaaaagccgggggcggtctcaccacacggttggcccggttacggcgtcacccccacgcaat

SEQ ID NO: 686282 - DNA, 208 bp, Homo sapiens
agacctctttttcaaaatactaccccaaactgcctttgtgaatggtacaatgggcctggaagggtttgtctcccctaaaagaattgtgggtgctgtaacagtgctggaggtttgtctcccgcccttctcaccctgtcaagtctgtctctccttccccgcaggtgtgtccaacatcatgcctcctcccaagtaacgttcagtgttaaat

SEQ ID NO: 686283 - DNA, 108 bp, Homo sapiens
  misc_feature (57)..(57): n is a, c, g, or t
gaggtcgtgccattgcactcctagccttgggcaaccaagcagtgaaactcttgtctncaaacaaaaacaaaacaaaaaaaatatatgtgaccgcgcgagaagtgtggg

SEQ ID NO: 686284 - DNA, 269 bp, Homo sapiens
tataccctgggaaaagctgacacaagacaagagtgctgtctcccgaccgacgcctattcaacatagtacaggaagtccgggccaggggcagtcaggtaagagagagaaataaagggtattcaaataggaagagggaagtcaaactacgtctctttgcagatgacttaattctatatctaataaacccatagtctcagcccaaaagctccttcagctgataaactgcagcaaagtgtcaggatacacaatcagtatacaaaaatcactat

SEQ ID NO: 686285 - DNA, 599 bp, Homo sapiens
cggctgacttgcctggcctgcgaggaagtcctggcccctggctttggggaagtgcctgccgaggcgcctgcgcactgtgcccctctgtgccccctccccgtactgtctgggccggaccttgtgagcgcgctgggccggcggtgcggcgcgagtggctcgggatgcgcgtgttgacccccaggctgtggtgaggtgtcttgagagctggtaccacggtgagcctgttgtgcaacctcctcctggcccaccacaatgcccaccccagcatgagtggctgagaaagctatgatctacaagtggtcatgattgatgtgctgtgaaccagtggcaaccctatcaattgtcacgagctaaattagaatatccacgagatatgctacaccgaattatgtgatccatcctcaatgaacacaggcaaagacccagttggctttgctcattgattgcattagaattgcgttaggcatagacttggtacgacatgcattctccttgggaaacacaacagatgctgagctgaggacacaggccgtggagcaatgagcgataccagcgaagaaaaagcaaatagaatgcagagcacacctacccacaagctt

SEQ ID NO: 686286 - DNA, 319 bp, Homo sapiens
tcctacttagaaataataaataggggcagctcccatgagtgattacaggccagttccatgcacagtgcactttcaaccaagcaactgcaatatgtgtccttcaacatgctgtccctacagtgcctgggcgggggctgatcgctcatgcactgtagtgttcatcagaggaggggtcccaggttcgaggcctgtccagtgccacagtctgtgagaagtgggtccgaagcggtccatagctgaggtctctggtgtcttttaggctgagatccgcagggttgagggctctgggggctggcttagtcaggttgtccctttcacc

SEQ ID NO: 686287 - DNA, 1133 bp, Homo sapiens
  misc_feature (627)..(627): n is a, c, g, or t
gagaaaaaaaaaaaaaaacacgttggatacttggtacattcagatgcattcttatttaaaaggggatactttggtaaaaggtaaaaccttggttattaaggaacaaaatgtgtttcttaattttaattgggtggagtttacaacttggcatgtgttcccttatacctccgtgttggggctggagtggaccggggtgcattctcacacttagtgaaacagaaagactcgtgctccaagggacacaggcttggttattgaacagggcgtggaatttggggctctccatctcaggataatattttggacattttctcaccaaaaattattaggtttggcacctttttaaatctctaaaggctcattccctttcggaggtggaaattggcctcattaaaggcatttgggaatacttaaggccattatatttggccatttgggggtacctttattacaaaggaaaatttcaggcccttaccctggcattaatttggaaggacacaggcaggaaaggggggctaaggggatggagggccctgggtatttcctgggtataaatagggacgtcatggggcggtaaggtcctggaaggtaaataaccttcccaggcaccggggacaatctcttccnagaagttatcccaactgggctagggtggtggtaataccattaagggggaggataaatctggatgctaacgttattatattatcctcttgggtcctggaataagctaaagttcctttaaataaacaaggtccaaacttttatttaccaccaataacgttgagaggtaatcccttaaagggtccccggtggaaattctccagtgagaaggccacattctcttaaggccttaggggagttccactctttaatggatcttaacagggagggggttattcacactgtgatcttcccattaccctgtgtgacgggatcaagttaataccccccaggcggtctattaaacccttcttcaagggtccaccggggagaaaaggggggaacggagcgggccaagaagggacacaatgggggccggaagggcaaaaggagagggtcaacggagagaatgaacatgtcacaggaataacgtaacatcagagcgcattaattaaaggaataacagagat

SEQ ID NO: 686288 - DNA, 357 bp, Homo sapiens
ggatgtaaagtggagagagatctcttgcagtttggcactagagctgtaaaacagagatttctagtcttctcgatatgtcaatttcagtcctgccaaagggaaatcctcattctaccctcaattccgtcagtagtaaactgaatacatctaaagcacagacctaacaactacaaactggatggactcatacccctattctagtagccattacgaggggtgtgtctagttcctgagcataaaaatattaatttcaatctctatatgttaatgtgtaatatgttaatctcatatgttaatgctatttttcttttatactcaatgttcagcattgaataaataattatgagacttacgaag

SEQ ID NO: 686289 - DNA, 451 bp, Homo sapiens
aagctgcatctagctcactgcaactctgcctcccaggtccagcaattctcctgcctcagcctcccaagtacctgggattacaggcacatgcccccatgcctggctaatttttgtatttttagtagatacaggttttcaccatgttggccaggctggtctcaaactcctgacctcaggtgatccaccagtctcagcctcccaaagtgctgggattacaggcgtgagccactgtgcccggccactttattttttttaacctttgcactgaactttgcatttgacccatttaaactgcatcttagctgggtgcagtggggtatgcctgtactcccagctacttcagaggctgacgtgagaggatcatctgaggccaggagttttaaggctgtagtgtgctatgaatgcacctgtgaatagcagctgtgctccagcatatagagaccctgtctct

SEQ ID NO: 686290 - DNA, 162 bp, Homo sapiens
ctctagaggatgacgggtgctctgtgctgggtgcgttagatcacctcaccgtaatccagcactctgggaggctgagcgcaggtggattacctcaggtcaggagttcgagaccagcctggccaacagtggtgaacacccgtgtctctacataacacatacaaa

SEQ ID NO: 686291 - DNA, 164 bp, Homo sapiens
  misc_feature (74)..(75): n is a, c, g, or t
atccccctcgatcgacggtttctccaaaccagagaggaagtcaaataaatcatgaatgactttttaaaattttnnagacagtgtctttgcctttgtcacagatttactaaacaagaactatcagaagcttctacctaacaattccttgctgggttgattttttt

SEQ ID NO: 686292 - DNA, 324 bp, Homo sapiens
aacgctactacctggccagcatcaggagccccgacattgccggactctggtcatacgcgtttcttatttgaggcctgaaactgatgtcatcaacttcgcagtacgcagaactgcctgtctccacatgctgtcttataacgtctgcagcttcacagccaatggctcccatatgcccagattacttcatgtccaacaaagtaaccgtctcaccatttacaccccaggcctcacagttactcctgagtgtgcttggaccgaagggaaggtaagtagacggatggtgctgaccccacagtactggatcaggataccaggaatgacctc

SEQ ID NO: 686293 - DNA, 106 bp, Homo sapiens
gctcgtgatcacgaacatctccctccccgaacatatacgctaaaacaaaagcagcaattcactgtaaaactggaaagggacgaactggtgttcggttgagcggaga

SEQ ID NO: 686294 - DNA, 922 bp, Homo sapiens
tgtggctgtgggagatgtggctgtggctgtggctgtgctgggaggtatgatggacagtagctgtggcaatggctgcctgggacctgggcgtgagttatggctgggctcagcctccccttctcctgggagctttttctgcctggtgtccatacagtgactattgctgtctgttcacccctgctgcctcatctcctcacccctctgctcctccggacttcctgacgtgcctcctgtgtcttcctaggaagccagagcagtatggcccactgtcgctctgggacatgacacgactgatgaacacactgattgtgtttcgcttcctgcgcatcatccccaacataaagccaatggctgaggtagccaacaccatcctgggcctaatccctaacttgagggcatttggtgggatcctggtggtggcatactatgtgtttgccatgatcgggatcaacctgttccgaggtgtcatcgtgcctcctggaaacagcagcctggttcccgacaacaactcagctgtatgtggaagctttgagcagctaggttactggcccaacaactttgacgactttgctgctgctttgatcacactgtggaacgtgatggtggtgaacaattggcaggtgatcctggaagcctataaggcgctacgcaggccgtggtcaatggtgtatttgtgctatggtggtggtgtcctctggttatctggatccacctggtttctgggttcctcttctggagaacttttccacagatgggaccctcaaggtctaaggagctcctgttgggacaagcgatttcgggggctcctgttcggtatccaaaaaaccaggggaggatgttggaataaaaacccttggttggggcggaacaaaaggcctccggggcagcaaatggcggccctttggagaagtcgacaaaatgg

SEQ ID NO: 686295 - DNA, 210 bp, Homo sapiens
gtccctataaggatccccttttgcaaacgccggtctttctattcctgttggcactgggcaggcagtgggttgttgtggctgagctgaggggtcttggaaggggggggctttttaattttggaggatccttctaccccaaggcctcactgctgccatctgtaagtgaaggaactggaccagatgggactaaacttctgcttcataaaaaaa

SEQ ID NO: 686296 - DNA, 414 bp, Homo sapiens
acctcaccaccggatctacatggctgctggaccacactggctggtagggtgaatagactggtacatgctgggtaggtaggaagatgaatagatgggtgcatggatgagatggatggttgggtgactagatggtagatgatgggtacgtaggtagatggatggctagctggctgcctggatgagatggatgggtgcatagatggtagcatgcatgggtcaggtaggtcagctcacatggatggcatcagcatggcatgcatggatgagatggcatggcatggcatgggtgcacatcagcatggtagatccatgggtaccatcagcatagcatcaatggctggatagcatcatgcatggatgcagcatggctcaggatacagtcagggagcaggggcatcctctcagcagtcgcac

SEQ ID NO: 686297 - DNA, 280 bp, Homo sapiens
accaaggcggacatgagagcactgctcacacacgcacttggtgacacatctcacacatgctcacggtgcccagagcccagatcttgtgacacacatctgccgtgcccacagtgcccagagaccaagtcctgtgacacacctgcgacatgcccacggtgcccatagtgctcttgtgacacagcttcccagagcccaaggtgcccaacacctgtactcctgggaggaccgtcagtcttgctcttgcacagggctgacgtgagccacggaccccgaggtacgc

SEQ ID NO: 686298 - DNA, 416 bp, Homo sapiens
  misc_feature (8)..(8): n is a, c, g, or t
  misc_feature (232)..(232): n is a, c, g, or t
ttcccctnaagccttttcccttgaacaggtgcaagtatttttaactgccttcccctgtcctttcctagtctttccccccttcccaagctccttcacccatactgcccacccagtgaagtttgaaaacaatagttggccggaacgcgggtgtcacgcctgtaatccccagcattttgggaggccgaggcaagcagatcatgaggtcaggagatcgagaccatcctggctaacncggtgaaaccccatctctactaaaaatacaaaaacaaaattagccagtcgtggtggtgggcacctgtagtcccagctactcgggaggctgaggcggaagaatggcgtgaacccaggaggtggagctttcagtgagccgagagcgcgccactgcaccccagcctgggcgacagagtgagactcca

SEQ ID NO: 686299 - DNA, 755 bp, Homo sapiens
  misc_feature (32)..(32): n is a, c, g, or t
cccttcttgtttgaaaggcacaaagcccttcnattaaaaaccagagagccccaggcttaagaagcaaaaggccttagtctattggggagaagagtgccttgcttaaagccagaccagtttcctgcttgggagggtcatcccagcgccggcccctcagttttaatttggacatcaccattgctcaggacattgagggtttgagggaaaagtctagaaagatgatggggcgggtcacacactaattaccattgggaaagctaaggtgagttccaagtttggcttcaccagagaaaactaatttgtgtggcattccagaaagacctgccaaactcgatgagtgaacaggcagcccttcttcattcatgcatgcattcagtttttgaatcaggtgagactttagatctcatgtgaaataagtcttaagtgaaacaaagagaaatttatcttataataagagaaaattggccgggcatggtggctcacaccggcaatcgcagcgctttggaaggccgaggtggatggatcacttgaggtcaggagttcaagactagtctggccaacgtggtgaaaccccgtctctactaaaaatgcaaaaatagcctggcgagctgtcgggcgcctgtagtcccagctactcgggaggctgaggtgggagaatcgcttgaacctggtaggtttaggttgcagtgagctgagattgttgccactgcactccagcctgggcaacaaaacaagtctagctctccatctctttt

SEQ ID NO: 686300 - DNA, 271 bp, Homo sapiens
  misc_feature (97)..(97): n is a, c, g, or t
tcccacccacctcagctgaggtgagacaagtagctgagaccacagacacacaccaccagctaattttttatattttggtagagacagagtctcgccngtgtttcccaggctggtctcgaactcctgggctcgggcaatcttcccgcctctgtcacccaaagtgctggtattataggtgtgagccacccctggatttaaatctgagtctcgactggagctccatcccagagactttcatttctacacttgagcccagaggatcacttgccca

SEQ ID NO: 686301 - DNA, 326 bp, Homo sapiens
cggatgtgctcagcattgagatctgtactcatttcatgcggctgacccttgttctcgttcagcaggttattaaataactcgtaggtcataggctggagttgttagagcagcttactaatggcatattcggacagttcgtgctgtggtgacatagtaatgcgctctgtcgttgatgcatatgcgccgtcactagtaccggtcagtgcgctcgatactaggcgtagttgagggttctcatggatgtccaagtgtgctgacacgggtagcccgtcagtcagagcgaggcctaggtcagcccctgatctttcatattgaatgggtgtgcg

SEQ ID NO: 686302 - DNA, 615 bp, Homo sapiens
  misc_feature (525)..(526): n is a, c, g, or t
  misc_feature (572)..(572): n is a, c, g, or t
ggtccggacttcctgtgtgtgttgagtccctcatatgcttcttacatcacggaaggcatgtgggcctatgtttcattaatcagaaggtttagaatcccaaacttcagtttctttagctaggttgagaaccattcagatctgggcatttcgttttcgagtgagtttgaaagttcgcgtctgtcacggcacatgctcctgtcctccgggttgtcaggtctgttggtgtaaagtccacaatattctctctctctctctctttttttttttgagatggagtcttgctgtgctctgtcgcacgagctagagtgcagtggggcgctctcggctcactgcaaactccaccttcccaggtttcaacgcggtttccctgcctcagcctccagagtagctgggattacaggtggctgccaacacacccagctaattttggtattcttagtagagacggggttttcaccatgttggccaggctggtctcgaactcctgacctcagggtgattccacctgtgccttacaagccttcnnccaaaggtgctgggattaaaggcttgagccaccgggcccagcctanaacagaagactttttgactaattgaaattaaaaccaacaacca

SEQ ID NO: 686303 - DNA, 255 bp, Homo sapiens
cagaagatcccgaggtatctgcagcttctcaccacccgtgacggctgacccaggcagtggcgagctagggtaagggtgcatactcgtcccaggtcctgcattctcttacagctccttccgggcgaaggtcccaggcgggtccaagcttccagcaggatctagcactgtccattggcttgtgcactcccagggctgttccccccttggtgccaggcataaccttcggggtaccggaggctcggaaattcgttaatc

SEQ ID NO: 686304 - DNA, 204 bp, Homo sapiens
actaaacaagatcacaactggctcatcgattctaacaaccagtacacgcaccgggaggaagataagctggggcaagggcagcagcggagtgtcaggagccaagccctcagacgcagcataagaagctggtcgcccagttactaatactatgaatcgtttctcagccctacaaccagcggcacccaaaaaagcatagataaaaga

SEQ ID NO: 686305 - DNA, 734 bp, Homo sapiens
  misc_feature (308)..(308): n is a, c, g, or t
  misc_feature (342)..(342): n is a, c, g, or t
ccacaggtggtagctaccacacccggctaattttttgtatctttagtagagatggggtttcaccatgttagccaggatggtctcgatctcctgatctcgtgatctgcccgcctcagacctcgtgatccacccgcctcggactcccaaagtgctggtattacaggtgtgagccaccgtgcctggccagtattttttttttaaaactaaattatcattaatgttaaaatttaactgaccatgtatataactgtgtaattgctgctttctcacagaactgtctaggattcattcaacagaccacagaaatnaggtctggcatttaacagactaatgatagaaganataaactggtttatacaagaatatcaaaatactgtcatgtggtttagtgtagctcaagttatgaattagtgccaactcttgctgcagtgtctctcacacaattttatcttggaacttggcgatttaaattgactttcttcactgaaaagagttctttcatgatactcttcgtgaatgctcatatagcagcttaatctctttcatttgctgtctcctaacaatgctaacttgttgccacctcttttgttgctcttgaaatattttaattagtttttcttcctctcctcagtcttctacatgtctatgttgtattcttgaagcaaagtcagcaactgtataggatatctataattccatttctgcattctgggttctcaaaataacattcagtt

SEQ ID NO: 686306 - DNA, 156 bp, Homo sapiens
gcgattttgagaatgattgcgccggtaaagcttcaggggttttggatgagaatggctgtgagcaactagggctatgttgtctaattgaagagtatgcaatgagcgattttagttcttgtattgccgttatgccgataagccgttaggccgatctga

SEQ ID NO: 686307 - DNA, 365 bp, Homo sapiens
tttttttttctgagcaatttattattattttttatttattgagacagagtctcactgtcacccaggctggagtgcagtggcgtggtgtcagctcacagcaacctccacctcccaggttcaagtgaatctcgtgcctcagcctacggaacagctgggacaacaggctcccgccaccatgcctggctactttttttttttttgtgccaggatttcattctgtcacccaggctggaatgcagtggcaccatcatagttcactgcagccttgaactgggcttagctcccaagtagctgggactgcaggcgctcaccatcatgcccagccaaaactgaagacttactgggctatgtggtggataagtcac

SEQ ID NO: 686308 - DNA, 1375 bp, Homo sapiens
  misc_feature (469)..(469): n is a, c, g, or t
gctggccgggcctggcctgggcgggacagtgtgcgcgatccggagaggaatggtgctgtgcgcgctccatgccctagttatccgccaaggacatcgacgggcagatggtttgcctgtgacatcgctactcgagggcctctcagtgatgcagtcagtccacctaacagtagagcgctcaccaagatgtaggccagtagcagaagtaaacttacacatctaggtgtcgtctgacactggacgcctcgatccgctgagtgtggtttgcggatcctggcctttcgccgtgtagacgcacgttcggggaatgcgaggagaatcccatggtcatgctaactgataggagattcgaataggagttctgcacgctgggacgtagcgaacgcttggaacttccgaatatgtctcaggtcatgaatctgtgcgtcgaaccggaggaactgacgcctcgacgccggcgtggctgggaaangtcgggactgaaaggacattccagacccccaaatgtgtggcaacggcggctactaccgtaggggcgatacagtgcactagtttcccattgtgtggaaaatctctgcaccaccacaaggttgtaccctgcaactacaggagcgacatgaaagccgcgtcttggctggtagagtttgaataggacggctacccgggaacccgcattggaacgagaacgtccccttggggtgaatcaggaaagaagagggatccctggctcgcacaacttagtgtgtgcttatgccgtgccacaaccatacgatgttggtgtggggccccccaggccccagaagacccccttttggcgcgcaacgggccccttcggggaagattctttcacgaacccctgaggctaatggtccattggaaaccgagcgctagccgccgtggcattattacactttgccggttgagttcgtggggcggcttaggaacccctccgtagataagacttcccaaggggggattggctaacctcccccggaccggagtaggagcaaatgtgttcgccaccaactggtgggtcttgggacatgggggcttttgtggggcttcggagactcccacaccccctcaaactttcgcccatcggaggttgagccctctttgtgtggaggcgcaccttacaaaaccattggaggcaaaaagtttaccgacaaggagcagccttacacaggggactttcaaattttgacttgctcactcgcggacagaatcacggatctcaacaggtgtgcggttccccacaagaaatagcgacagggttgggtcttttgcaccattgtggcaaccacctgttggttgttcggaaacgctgtgtggggttggggccccagggaacctattggtcgttgggttgtgtgcccag

SEQ ID NO: 686309 - DNA, 553 bp, Homo sapiens
aatccctcaacaaactagacatagcaaggacctcaattcaacgtagaggggccacctagtgaaaagccgcacagctagacattataggctaggatgattaataagagaagggtacactgactcgtgtgcgaatttcgtatcgcctaaatagtagtattgcagtatgtagctcaggatagattatggcataggaataaataatacagaaaggacgatccaaatggactcggatgaagcatacttatctgtttggagattacatgattaaatatgtagaaaaccctaaagactccaccaaaaaactgttagaactaataaattcagcaaaggtacagaataaaatatcaatatataaaaattgattatgtttttctacactaacaatgaactatctgtaaatgaaataatctcatttaaaataatctcaagaagaataaaatacttggaaacaaagtaaccaagaagataaaatccttatacactgaaaactttaaaacattgatgaaagaaattaaagaatacacaaatgagtgaaaatacattctgttcatgt

SEQ ID NO: 686310 - DNA, 185 bp, Homo sapiens
  misc_feature (56)..(56): n is a, c, g, or t
  misc_feature (79)..(79): n is a, c, g, or t
aaacggcagtgcacgctgatgctgatggtcgactcttagagtatccacccccttgnaaggcctgacagtgttgaggatnatgtgattttgatcatactgtgtgccccctttaatgtctaaaactaaatttggcttcaacttgctgtaaatcctgccatcggacttcaagctccagaactggctta

SEQ ID NO: 686311 - DNA, 148 bp, Homo sapiens
ggtgtttcctgtgtctggtagaattcacggtggagccatccagtcaagggtatttctgtgtgggaagattttcttggtaatttaatcttcttactagttatacgtttacccatattttctttttcttttttttttttgggaaacaagg

SEQ ID NO: 686312 - DNA, 628 bp, Homo sapiens
ctcttggtgctcgctctttccaggtgtccaacgtggggcagtgccctcctctcatcactctgctgttctcttgtctctcgcgtgaatagcgactgtcagtgatttcggcggtccccaatgcctcttgtgtcacgtggtggttcgggcccatgcgagtgctgtgccaggcctcagccttcttgccagtggagagtatcacctgagatcctccgatgatcagaactagggctattctctgacatccagacagggcgtgtgctcaacaaggtgaacagatgagacctctggctgatctctcacctgtgcacagttccaccctgacggactacatactttggaacaaggaaccatggactctcagatcaagatctgggacttgcaggaacgtactaatgtggccaaattccctggccactcgggccccatcactaagcatcgacttctctgagaatggttactacctggctacagcggctgatgacctcctctgtccaagctctgggatctgcgccagattaagaactttaagacttgcagctggataacaacttagaggtaaagtcacttgatccttgaccagagtggtacctacctagctcttgggggcacagatgtccagatctaatcc

SEQ ID NO: 686313 - DNA, 358 bp, Homo sapiens
  misc_feature (53)..(53): n is a, c, g, or t
  misc_feature (132)..(132): n is a, c, g, or t
tttaaaaaaacctacaacccccaaaaaagatgaagtgaaggcctgttgtaaanttttggaaacatgataaatgggttgttgccaaatatattgaaagttaggggctgtgtgcagtggccttacacctgtaantcccagccttttgggagtcccaggtcaggtggattgcttcagcctcaggagttcaaggtcagcctgaccaatatggtgaaatcctgtttctactaaaactacaaaaactaggtgggcatggtggcacaggtgagaggatcacttgagcctgggaggtcaaggctgcaaggagccaagattgtaccactgtactccagcctgggtgacagagcaatatcttgtctca

SEQ ID NO: 686314 - DNA, 141 bp, Homo sapiens
tactctacgcagccactggcctgaatatacacggaagcaaattgctggcacccccgcttcccaacccttcttgcctgggtaggagaggctaaagatcaccctaaatttactcatctactctagctgctgcctacacatatg

SEQ ID NO: 686315 - DNA, 375 bp, Homo sapiens
  misc_feature (2)..(2): n is a, c, g, or t
  misc_feature (10)..(10): n is a, c, g, or t
  misc_feature (237)..(237): n is a, c, g, or t
  misc_feature (372)..(372): n is a, c, g, or t
cngaggccgnagagagaagtcacttgccctggctctaccttgaagtggttctcagggttggggcgagagtcggggtggggaccgagatgcagctctatcctgtgcccctggtcgcagcaggcagccccagcttcgcgtgttctacttggcctgatcctgccgcctaatgagctcaggtctaggccgagcagagggggcacctggtcggactcggttgggctcggcggccccgccctnctcaccccgccaggcgggcccttctcgacggcgcggggcggctgcgggcgcggggctgaaggcggaaccacgacgggcagagagcacggagccgggaacccctgggcgcccgtcggagggctatggagcagcggncgc

SEQ ID NO: 686316 - DNA, 302 bp, Homo sapiens
gggcgggcttccactccatgaggtatttctccacatccgtgtcccggcccggcagttgagagccccgcttcatcgcagtgggctacgtggacgacacgcagttcgtgcggttcgacaaccacgccgcgagccagaagatgtgagccgcgggcgccgttggatagagacaggagaggccctctagtatttgggaccacggagacacgggaatgtgtaagggcccactcacagagctgtagccccgagaaaccttggggagccctgtcgcggcttactatcaaacagagacgagggccgcttct

SEQ ID NO: 686317 - DNA, 945 bp, Homo sapiens
ggaaggaggagggggtcgggcctccgaggaaggcctacctggctgctgctgccaggaattccaggtcggatggggcggccacctcctgccaggcttcagggccacgtcgtccttgtgcctgtacatgaatgagacagatgcttgaggagagcttgagggatgagcagtgataaggacgaactgtcgcagtcgttctgttcatcgatgtgggcactccgtcacgtgtctgggcaggtctctgtgtctgccgtggttccctgtctcgctctggtctgaggattccccaggggagatggtgcccagcaagaagagtataacgagtcctcacgcatgcatcaggatcgaggccaacccttcagacagagaatcaggcccaaaccgtgggctgagttgcgccttcgagcctatgaccggcggcctggagcgcagcagatccaacatgcatccaactatctgtcttcgtctcccgagatgaggcgatcgcatacatgcctttgcgaattggcgtctcaccatgagggaccataggcatgacactcacagatgatagatcctggcagggcctgaatttcataagcgctcagcggagattccggaggctcagatccatgaaggcttccaggaactcctccgtaccctcaaccaggcagacaggcatgctccatgctgagcaccaggcatatggcctgtgccatcgagactgagggcctgaagctagtggataagtttctggaggatggtggaaaccgttgtacgcactgagaatgcccttcgcgtaggcaggtccgggggacagcgagagatggccgagagacccgagtcaagatattgcgtgggagacggggtgcatccggcccaaggggagagatctgctccccaggagctggaccaggcaggactgaggacgggcagaatggctggggcccgaggggggtgggagagacc

SEQ ID NO: 686318 - DNA, 1123 bp, Homo sapiens
ggcacgaggggcactacctgacagtggaagattctggcagctaggctaggcaatgcagcgagagacaacaagaagggacgggtcacaccccggcacatcctgctggctgtggccaatgatgaagagctgaatcagctgctaaaaggagtcaccatatgccagtgggggtgtgttacccaacatccacccctgatgttgctatgctgaatgaatgctggggatccaaatggaaagttgtgaagcctatcatcacaccacaccccatgccaataaaggccaatgtctccattcccacgaatgaagcctgtatctaataaaatgcatggaggcaatgaaatggtgtgccctggaatatccaatgaatgaatgcatgtggtgaatgtcatgtaagtgcagccagctgcctgacatgctacaacctgagtggcacacctagcctgaccgtgcttacacagtacctactaccatccaaagagcctactatcctatggccacgaaagtatgcaaggtatgtacagggcttgacatatgcctacgatcgacacgtgatgctgtacgtatcaccccagacaaaacactagactatctactatcggtggtagaacgtacagcgaaacacagctggaagaacgaacaggtaggcaagtgagctcatgtagaaaagctagtccatgcgaactcctggcaaacaacaacgcggcccttgcgaagtagctaggagctagctagacagcgcaacagccatggaccctgccttgcccaatcgacaaggatgataccaactgctacctaagataccaaagtcataggagcgatgccagaccaaacttgttgcacgaacctttcatggcaataagaacagttcaaacaaactggctacaggccacctaggcctgaatgaactaaacacaacaggcatgaaaacgttccactcttgggcgcttttcccaattcccaccacggggacagcgggacaccaggaagatgggagaatacccccacaggccacgcagccaggacatgccattagatacagtatttctaaatcaagggcacaaactttcagcgttaacatcacagtagcgtttacatagagggtaactcaagtacgcactgaaaaatg

SEQ ID NO: 686319 - DNA, 167 bp, Homo sapiens
gggggggaaaactttttttttaaacccccccttcctttttttaggcaaacccgggaaaaaaagggaaaatttaaaaattgtttttttaaaaaagccccccccaggaaaacccctttgaaacgggaaaaaggggttttttttttttaaaaaaaaaggatggggcccca

SEQ ID NO: 686320 - DNA, 204 bp, Homo sapiens
tgtttcgcttggtgtctagaggtccggcttacctagaggtcatcagcaatgggcctttgtctcttgggagaggagggcactgggagtcctagtctaggggagcccagcaccccagtctctcgcttgcaaccctggttaacagccctggcatgggtctctctggctttcaccctttctctctccaacctcctcaaggggctgtag

SEQ ID NO: 686321 - DNA, 811 bp, Homo sapiens
cagcagacatggtagaatcctatacaagaatcctctaacctctaaacactgtatgtgctcatgtgagccctgtctactgtggctgctacccttcggcctccctcatgcccagcctccatgtgaacccgcagcccctccttatgattaccatgaatgctgtcagtgttggggacactggccgtcgttttacaagatgtgccactgccactcagctctgtgcagtgcaccgagttatctgccgctctgttctctctatccgcctatgtcagcatcggccgcactgggcagtgggatggggtggctgatacccaattcctcctcctgggcctgctgccttctcagggccacctggaagcacacgacaatgagtcatcctccagcactccagaatcagctttgccaaaacacagaagccccacccatcccagacaccatgattcactagctctggaggttcaagtcacagtgtactctggcaggaaggcactgtgctagcacagcgaacacattgctctgcagagaatctgctctcctccagtcggatggaatccctctgttgcacatcccagggccagtttccagattaaagaattctgaatgtgctctaaattctcactgcagatgggacaatggtacaatccttttgctaaaacaaaatgcaaaagatacatttctaccccctgccaggtcacaacagtaactatcagatccactacacccaagatttctgaagaccatggcatctccacccaagcgcgtgtaaataattccgaaatagaacctgtcatcaccctgaaggaattctaacttc

SEQ ID NO: 686322 - DNA, 209 bp, Homo sapiens
gctgatgctccctcttcaaaaaaatacaaaaattttccgggcatagtggtgcacgcctgtaatctcagaggttgcagtgagccaagatcacaccactgccctccagtctgggcgacagagccagactccatctccaaaaaaaaagaacacaaacaaaagggagaaaggagtttgaaagccgggaaacccttttccctttttgcccttgg

SEQ ID NO: 686323 - DNA, 1145 bp, Homo sapiens
ccgatcccctaacaacccccctcctaatactaactacctgtactcctacccctcacaatcatggcaagccagacgccatcttatccaggtgaatcgcactatcacggaacatacaatacgtctgaccatctcgtattaccgtaagtcgtcgccatagcgcaaagtgctcctgtagagtgtagtaagcatgtcaccacgcgcagcacgaaccttaactcattacttttgatagtcttgcttcggagaccacagttatccccaccttggctatcatcacccgatgaggtcgaagccaggccagaagcgcctgaacgcaggcagcattacttcctattctagcaccctagtaggctcccttacccctactcatcgcacataatttagcactcacatataccctaggctcacttaaacattgctacttacgtcacgtctcactgcccaagaactatcaaactcctgagccaacaacttaatatgactagcttacacaatagcttgaatagtaaagatacctctttacggactccacttatgactccctaaagcccatgtcgaagcccccatcgctgggtcaatagtacttgccgcgagtactcttaagaactaggcggctatggtataatacgcctcacactcattctcaaccccctgacaaaacacatagcctaccccttccttgtactatccctatgaggcataatgataacaagctccatctgcctacgacaaaacagacctagaatcgctcattgcattactcttcgatcagcaacatagccctcgtagtaaacagccatctccatccaaatcccctgaagcttcaccgaggcaggcattctcataatcggccacggttaattcccacattagcagtactgcctagaaaataaactatgaaggcaactcccagtgcgttataaacccttctcaggagttaagcgtatcccctatatatctgagactcataaagcctaacacgcttaccaccataccctgggaacccgggggcacaacatctgagaatattcccatagaaaaaataagcacacctcctataaaaaggccgagctcagcaagacactactgagtctcactagctagtattgcattatattactcttaacaacagactaacacaacat

SEQ ID NO: 686324 - DNA, 225 bp, Homo sapiens
taagcgcagtggcggagcaggtatagtaaacctggtctgattgtatggttgtcatgatcagtgtctggaagtggtgggctgagtgtttgccactgtgcattggcatggcggtgggtaagccggccatgagaggagctggcgcttgcagacttgaactggtatacactttggcgttgtgcagtggcggtgtgtctagaatcaactgtcactcccatgaaagtgaat

SEQ ID NO: 686325 - DNA, 331 bp, Homo sapiens
atcaggagaggcatactgatagtacatagttacttgcgggtcgcaattaccacagaggagatatctaaatggtgataccacgttcacgctgcaggttccagtttatccagacccaggcatactgtgaaggagccctttcccatctcagcagcctccttctcagatttatcaatggttcttgtgtcgatgccaccgcatttatagatcagatggacagtgtggacttgcccgaatctacatgtcccattgacgactatatttatttgagtcttttcctttcccattttggcttttagtgggtaagttttcacgacacctgtgttctttgctg

SEQ ID NO: 686326 - DNA, 179 bp, Homo sapiens
catggataatgtggatggtagaagatttaattaggatacaaagcttagcacgagaggagggccagagaagctgacaggcaagctacaggttacaacacatttgtgaactccgtccacgcacagtggctggcagggcctagctgctacaaagaacacatgttttagacaaatactcctca

SEQ ID NO: 686327 - DNA, 713 bp, Homo sapiens
aggcgtgcggtcactgaggtgtagcagaggatgcgctgtgcgtgctgtgagtgcggcgacaagggcaaatgcagtcgactcctcgctgttgggcaagagactctccgaagactcgagccgccaccagctgtttgcatgaatgtgggctgagcatgtgtgatgctccatgatgcgaatgacgcgtctggtggcctgacatggagagtggcgcagctggaggagtgatggcggctggctgcggaaggagatggcctgctggtgttcctgtgctccggttgcctggctggccgctgggcgactcgctgagctgggtggccagccaggaggacaccaacttgcatcctgcttcgctgtgtatacctgtaatgtgctctgtggataaggaacagaagctatccaaacgtgaaaatggacccatggttgcggtccttgagactttgttgctgcgcggggtgctcactcaatcttggctacgttgtacagatgcacgcccaagaatcttgattacaagagagacttgttttggctcagatgtgaagccatttgaagagtcatgtttagggtcctctgaaaagcaaattgtgtcagaagataaaagagctttttagtcttgaaagcagagtcgaactagaaaagtctctaacacagatggacgatgtcttgaaagcgttacacatgaagctgtgggaggccgaatccaaattgtcctttgc

SEQ ID NO: 686328 - DNA, 1736 bp, Homo sapiens
  misc_feature (35)..(35): n is a, c, g, or t
tttgttttctctcccccgcgcccgccgctgttgtnttttgtgcttctcacacggctggtgtgcgtctgtcttcgcttcctttgttgggctccactggtgtgttgtgcgcttgacttatcgacacatgtttgttgttgtgtgctctccgtctctccttgcacttccgtctcgctctcgttcttgcggtgtgtggctgcgcctccctgtgtctgttggtcctgtgtgtctagcctctccgttgtggtggggggagtgggtagctcgcgctccacgccggtgggtggctggcgttgcgtgcttacttgcgtagccgtttttttgttctccctcgtctggctgactctcgactgttgtgggttcttgcctgtgcttttttcgttatgtatcgattggcgctcttgcttttctttgctcgatttgttctcagtccctcttcttgttgttccatgtgtgttgtacgtgtccgtcttctcctcgtattcgtgctggctctcgatttgtcatttggtctcggctcgtcgtcccccttgtgttttttgttggttgttttggggtgcgttgtctgtagagcgtgtgcctcgtgggcgctcgctgccgctggcagatcatcgttgcgctgtgttttgtacagtgtcttgcgctgtcagccggtaatatcaggtgtatgtttggtgggcggttgctttgccgcttcgctttcttttgtctctggtccctggctgttacttgcctgcgcatgggcgtcctgcttcttgccgcttcttgttccaactccgcctttccctggttgtttttttttcttctctccactctccgctcgcggttgcggtggagtttcgccccccctcatcgtgtcgtttgtgttctctctcacgcgctgcggctctgttttctgtgtttgtgttttgtgttttttcgttgctcgtctacctctcgtcgcggctcttcgcgttcggtcgtcttttttttttcgttttcctctctctcacgctcgctgcgcgcttgtgtggctgattgctgttgtctccctcactcgcttccctcgtgcgtcgtcttttcctctctcttctctctccgctcgacttcacacacacctccctctcttctctctcttttatatttgtacgatacgtctttctgtttttgtctctgcgtctacacgcacatctatcctccacgggcctcgtctctctgtctgctgtgctgtgttgttggtttctgctgctctctcttcctctcctctctctctactctcttcctttgcgcgcgcgtggagtagtgagtgtgtctctctctacactcgctctctcgtctctctctgtctctctctctctcgcgccgcgcgctccactctcatctctcttcttctctctccctacactcctccgcgcgcgcgcgcgcgcgctctctcatcttctgtcttgtcgttgtgctctccccgccgcccgccgcgctccgacattcttttatcttttttttcttctctctctctctccgcgtttctgtcgtctcgctccgcgcgcgcgcaacctatctttcttttctctctcctctctctcggcggggtctcgcctcgcgcgcgcgctcgtgtgtgagtcagatcacgcccgccctcctctctctctctctctctctctctctctctctcctcctcccccccctctctctctctttttcgcccgcccccctcctctctctctctcttctctctctctctctctcctcaataacaaata

SEQ ID NO: 686329 - DNA, 909 bp, Homo sapiens
  misc_feature (27)..(27): n is a, c, g, or t
  misc_feature (142)..(142): n is a, c, g, or t
  misc_feature (187)..(187): n is a, c, g, or t
  misc_feature (189)..(189): n is a, c, g, or t
  misc_feature (248)..(248): n is a, c, g, or t
  misc_feature (275)..(275): n is a, c, g, or t
  misc_feature (283)..(283): n is a, c, g, or t
  misc_feature (295)..(296): n is a, c, g, or t
  misc_feature (300)..(300): n is a, c, g, or t
  misc_feature (304)..(305): n is a, c, g, or t
  misc_feature (314)..(314): n is a, c, g, or t
  misc_feature (432)..(432): n is a, c, g, or t
  misc_feature (449)..(449): n is a, c, g, or t
  misc_feature (511)..(511): n is a, c, g, or t
  misc_feature (519)..(519): n is a, c, g, or t
  misc_feature (556)..(556): n is a, c, g, or t
  misc_feature (583)..(583): n is a, c, g, or t
  misc_feature (585)..(585): n is a, c, g, or t
  misc_feature (601)..(601): n is a, c, g, or t
  misc_feature (607)..(608): n is a, c, g, or t
  misc_feature (611)..(611): n is a, c, g, or t
  misc_feature (628)..(629): n is a, c, g, or t
  misc_feature (639)..(639): n is a, c, g, or t
  misc_feature (646)..(646): n is a, c, g, or t
  misc_feature (649)..(649): n is a, c, g, or t
  misc_feature (651)..(651): n is a, c, g, or t
  misc_feature (655)..(655): n is a, c, g, or t
  misc_feature (665)..(667): n is a, c, g, or t
  misc_feature (696)..(696): n is a, c, g, or t
  misc_feature (698)..(698): n is a, c, g, or t
  misc_feature (708)..(708): n is a, c, g, or t
  misc_feature (722)..(722): n is a, c, g, or t
  misc_feature (728)..(728): n is a, c, g, or t
  misc_feature (757)..(757): n is a, c, g, or t
  misc_feature (779)..(779): n is a, c, g, or t
  misc_feature (790)..(790): n is a, c, g, or t
  misc_feature (814)..(814): n is a, c, g, or t
  misc_feature (827)..(827): n is a, c, g, or t
  misc_feature (844)..(844): n is a, c, g, or t
  misc_feature (871)..(871): n is a, c, g, or t
ggccgcgatttctctcgtccgcaaacnggggcaggacacgctgtgagccaccgagctctgaaagtgacagtgttttccagcggtctgttaccccttgcaaagggaagttcctgcacccctagtccacaggttcctggaaggngttccttctcctgtccactagagtgcgccagagtccacgcccgangngcctgagggctctactagccccatcccagggtgtgcgtcacccacagagggtcccaganccctgcccagggggtgacacgcccggngatggggntcctgagagatnngcanccanncaagttctnaatcccctgattttcttcaccttttcatccaccctggcatcccaaatggcgcgttttgctccttccctttcaaaggagggaaactgagtcaagcaagggcaggagtaccctggggggnggctgtcctggtgagangcagagaagagagcggccagcagcgggccgtccgtcccccgactcccttgcgtgtgggccgnggctgganagatagaccagggacactaggggtccctgcagccacncccacctcccacccgcccgccggtgcngnctgccccaggtggggnctgggnnacngcaggttgatctcgtcnnggtagcgggngagcacngantnccgnacgtccttgnnnaccttgcggatgttctgtgtgtctgtggnanatgtgtagtngctgaagaggcgtnggggtngtgcgcccttcttgctgccctcgggggcngtccacgcacccggtgtacatnctcgtgtacangtacaggatgaacctcttggctgnctcaagattcttntttagggacctgggaantgggggaataggtagcaagtgggaggnggggatttttctatcagatgtcggtttcttgagaagag

SEQ ID NO: 686330 - DNA, 124 bp, Homo sapiens
accttctgctacatatacaccacttccaccacacagatccgataaccaccaacatagggactgtgggagcttctctccaacacaactgaccccttatctgacgcgcgagggggctcctctagag

SEQ ID NO: 686331 - DNA, 369 bp, Homo sapiens
  misc_feature (211)..(211): n is a, c, g, or t
  misc_feature (347)..(347): n is a, c, g, or t
  misc_feature (357)..(357): n is a, c, g, or t
tgcagctgtctcttacttttaaccagtgaaattgacctggcccgatgaagaaggcgggcataacacaggaagacgagaagagcctatggagctttagagtttatgcaagtgcgaaagcagtcatcctcaagcagaacgccgatcaggctccctaatacgtacgcaagagcctcgcatataaacaagtgttccggctatgtggggcggaccntgcggacgcaagaagaccaacccatccgtaggcagatagcatgcctcaagagcttcagccatggtccaatacgcgaaccctagcatagtatcatcaccaattgaatcccaatgtgaaactcggatcacaaacaggnagagcgacangcgtatacactg

SEQ ID NO: 686332 - DNA, 119 bp, Homo sapiens
tctaagacggagcacccaggtgcggtggactcttgctggatgttgtagttagacaggtggcgtccatcttccagctgtttcccagcaaagatcaacctcggcgggttagggatgctggt

SEQ ID NO: 686333 - DNA, 184 bp, Homo sapiens
gagaatactggcaggtataaaggagggattgacccactcctattactggtatacggatcagagaaaatacggtacatgtccccatggaggatattgcttggcctttgaccgattcttaacgtggattctgaataggtatcacatcccagacgtgtccttataccctccgatttgtccacgcgtt

SEQ ID NO: 686334 - DNA, 159 bp, Homo sapiens
  misc_feature (133)..(133): n is a, c, g, or t
taatgtttagcctctgtagtctcaataatcatcccatacacacagtgtccttactgatgtaacttctcaaagcactgggtactttccttcacactgcttaccaatttgttattagacacttacacacatattntcttggttaattctgccctctcccag

SEQ ID NO: 686335 - DNA, 205 bp, Homo sapiens
tgatcccggggtagctatgtgttttgtccaggggttgcacatgcatgtgtcatggtgtgtctctgtggcgggcagggctgtgtgtgattgtgtgcctgtgtgtgtctgtgtgtgtaatggtgtgggtgagtgagcctcctctgtgctgtccacccctctgtggtgtccagtgctgtccacctcctctgtgctgtccacccccctg

SEQ ID NO: 686336 - DNA, 728 bp, Homo sapiens
ggagaggtctctgcaggactcatgattaatgaggccacggatatccaatctaggggatctccttgtcttgaaatccatagtaaccttaattacatctgcaaaatctcttttaccatctaaggttacatacaggttggagattaggacattaacatttaaccatggaacattattcttgcctactacagttcccaccaccccccacccactcctgtgttgatcagatcatcaaaataattatcatcataggtgctcatctcatcacaccaagcatcaactctaccaaacccatctaccatcttgtctgagatcatccccacctctcaacgtcccacgtctcacatcgaaaagaccaaactaccactcacagcccgcgagacgatctcgccacgcgaaccacaagctgcggccccgcgttcacaaccgcaggcacaccgctggcccccacgcccggcgatccgacgacacgacacaccaatgtgccgcctggcccctcacacggacaccacgggctccgcacgtgccactacaccgtttccgtgattccaaaaaaagccagcacacagactggatacaaacgggagcgcattcaggccacaagctcaaaccacagacactcacatagcgacgtcaaacgtaatgttaaatcaacacggaccagggaacaaatcaccaacgttccacgtgcagctcactgcagaagatagatcggcaaagcagaaatacac

SEQ ID NO: 686337 - DNA, 192 bp, Homo sapiens
atggagacggggcctatgtgtgggggcagctgagaccccacaggatgggcagaaggctggacggaggggccaagttcagacaactgaataattttaacaggaagccacatttcagttccatacaaatgtgactccttggtctaaaatttgagttacctgaagaaaggatggttttcccttctgcttgctttt

SEQ ID NO: 686338 - DNA, 296 bp, Homo sapiens
  misc_feature (117)..(117): n is a, c, g, or t
gctcggtaccgtgccgaagatcactcgcagaagatcactccatattatgcaatgaagcaacttggaagaggaaagaaaagaagtcaggaatggccttactcagagtctcacacgtgnccaggctggagtgcagtggcatgatccctggtcattgcaagctccgcctccctgattcaaaggatttttccacctcagcttctcatgtagctgagattacagggacccttgaaatccatggatgggggtatacagttcagctagggggattgtgaacttccggaagatgtgcttgatgt

SEQ ID NO: 686339 - DNA, 1113 bp, Homo sapiens
gccaaggtgagggagttgatggagcgagctctggagctagaggcactgggcgtgggctgaggatgtgcctccccagaggctggactggccattggcataggttgagacctggccatctgactatcactccacgaatcacctcccaggtcccgaggccaaggaccgaggagcatcacgctggacattgggctcacagagtaaagcgggtgctgcgtggtggagcatgtctgggtgcctgaggagctaccagcgcgcctttaatgaatattctggagagaggcaaggcaggttgacgaattacagggtccaactgttattgccaagcatcaactaatcgtgcctgtccgttccggagtgtccatggaagcagaattgtgcgaggtagcccgcaggacgacccatgagacctcctgctgaggaccccgcatgggtgcagctcgaagatgccactggcttgtgatcaagcctgtcatccaggaacccgtgtcatgatggacctggatacgccactgttggcaagaaggttccatcgcactatccgtctggggcggcccctgttggaggaacgcccctggcataaaccaagtcagtacggccacacgtgatacgaagcactgaaggggccttgtccatgaagtttcctccaagaaagcctgcgaagggtgcatggttctccagagaggaggtgatgacttcaacttggtacggggcccgtatgtggaccattggctaggcctggttgacacagggagttgaacgattctactccgcaaaagctgcgagctcaacggggcggcagcccctggggtcccgtccgcaatgaaccgggtctgaaactaggccgaggctacggcaggttgtgcattgtggtgacattcccttgggcccaaattgcttgacaaacccattccatgggattacttggttacccccaaggaacggggctccccccagggagaacctggtgcttgcagggccgtgctactttccgcttaacgcattggccgggaagaatcgagttcggcctggtatggagaccccaaggttgccatcacaggaaattgagggatggccccgtgacatgccaaccgtgtgtttacccctgaagttcag

SEQ ID NO: 686340 - DNA, 262 bp, Homo sapiens
tgactatttgttgctcttccaaaatatcagactattggtgtactgaatagcgctgtgggagtcagatccatgtgaccagtaagttatcattggactaaagatagggactccgggagtcatggcaccctgaggtgaggcaagcccttgagcgtaaggtggcaggctgttgttctgatccatgatgttcactttcttcttggcagaccagaaacccttgcgcttggaactcgtctcactattcaattttttcctagagcatctc

SEQ ID NO: 686341 - DNA, 380 bp, Homo sapiens
caggaggctgtggctgcaattgctctgaaagaggcgggtgcgcaagttggagactgctgagctgtccccttaccttagtccatgaagacaacaggctacagtgaaagtaacagtgaagcctgtaattgcttactatgctggcgtaaccaagaggagaaaacgccactccccttatgttccatttttttccccacaggacagcaccagacgagattttgccatgttgcttgggctggtctcaaactcctgggctcaagcgattctcccacctcagcttctcaagtaccttcaattacagacaggagccatctcatccagcaatttcctttttatgtattcacaatgtatagtagatgataaaagcctatttaagtaagttt

SEQ ID NO: 686342 - DNA, 231 bp, Homo sapiens
gccagggctcgatgccgtcggtattcacggcctggcattatgtcgaccagcccgagaatgctgttcacgactgcgcgatggttgatggaagatcggaatatcatacgccaagctaggccacatgttcgattttgtccatatcgaaggcgttcaagcgccatggtcatctccagtgaacaacagaacgcatgccctccgtcttttagattgtcggaactctaccgcgttttt

SEQ ID NO: 686343 - DNA, 172 bp, Homo sapiens
gcaacctggacgtctacgctctatttctatgaagttcaacattttttttttccttagaattccacatataagtgatatcatgcagtatttgtcttattccatttggtatatttcacttagcataataccctccaggttcatctatgttgctatcgctggcctacagcacatg

SEQ ID NO: 686344 - DNA, 615 bp, Homo sapiens
  misc_feature (81)..(81): n is a, c, g, or t
  misc_feature (317)..(317): n is a, c, g, or t
  misc_feature (381)..(381): n is a, c, g, or t
  misc_feature (397)..(397): n is a, c, g, or t
  misc_feature (505)..(505): n is a, c, g, or t
  misc_feature (509)..(509): n is a, c, g, or t
  misc_feature (517)..(517): n is a, c, g, or t
  misc_feature (528)..(528): n is a, c, g, or t
  misc_feature (571)..(571): n is a, c, g, or t
  misc_feature (612)..(612): n is a, c, g, or t
  misc_feature (615)..(615): n is a, c, g, or t
cacaatagaaagtattcaagagaaatacacagagaaaaaagaaacaaaaatcataaacacaagatgagggccgggcgtggnggctcactcctgtaatctcagaactttgggaggccaaggtgggcggattgcttgaggccaggagttcaagatctgcctggccaacacggtgaaaccccatctctcctaaaatacaaacattagctgggcgtggtggcctgcgcctgtggtcccagctacttgggaggctgaggcaggagaatcgcttgaacccggaaggcagaggttacagtgagccaccgagattgcaacacggnactccagcctgggtgacggggagactctgtctcaaaaagaaaaaagaaaaaagaaaaaaataanaaaaaataaacacagnatcagtttgatgtgggacttcaagaaacaggcggaattggagactctgaaggccagtatcaataacaatgaaggattctttcatgcactgtaatctgaataggggcanacanaaaatgangtggacagaanacatttgaaggagtacagctgaaagtttttgaaattaatactnttaacttacaaggaagttcaatgaacctaagcacatgaacntgn

SEQ ID NO: 686345 - DNA, 1354 bp, Homo sapiens
tgtggggacttaaaccccaaatctttatggaggccctcagcatctatttctctttctcctgacacagtctgggttccccggagacgtccagtccggggggacagcaatgaaacccatcttggcggccagcaggggcatctctgcgaatggtgaaggtgtccttgccaatgtgctggtggttgccacctcacaaaaggatgctccaaaggatcacatggccacaccccggatactcgttggccacgaaagtctcctctttggccattattatttggtggtgtaccgcccgtggccatgcctttccaaagatgggtgtttggtcaacttcgggcaaccttcacaggccaacacacacacaaccaacaaggcatctagtaggagcatagagagaagaataaacccttcttgtgagaggccagaaaagaggaaagtatctcaacacggggagctcatcacagtgggcacctcaaaggggatagcggagagaacaatacaccggggtgagcaataagataccacagtgatatgcccccggagaccacacattgtgccccaagggggaatcccttcccagagagactatttcatgctccgctccccacgtgcacaagcacaaccagagagatgtggtgaattacgcccactcgagggcacaatgtggtgtggccccccacacacgaggggggaaagccacaacaacatgttgtgcccccaaagttgtgttgtagaacgacttgtggtgggcaccaatctacagttgtggccccgaacgaggtattaccccaaccaataaactcggaggacgccccacccatgtctggctgacaacaaatgtcagcgccaatatgcaagaagacggcagccacaacatgagcacaccacacaaggtctcacaccagacacacccggctactccttatgacaaaacccccgcgaacataaccgagggagaacctcacccgcggggaaaaaagaaacacccacgcctcttagtaggagacacaaaacaatagcagtcgacacaccacagcaccgtcgagtgagaaggaccctcgcggagaagtaccacgctagtggggagacagaagacagtctgcgtccccatgatgagacgaagaaacgtaccccccccagtaggcggaagtcggtataaccccgacggaggcagacgcccggggcaacccaagaacaagagaaaaaaataaccacaaaaagggagagcagaccaacacaagagaaccgcaccgcaacaacgacgaccaccatctaaacaaacgacggagggcgaacccatacaccacagcagtatgataacccgaccactgcgggaagaaaacacacaagatagaaaccc

SEQ ID NO: 686346 - DNA, 677 bp, Homo sapiens
  misc_feature (398)..(398): n is a, c, g, or t
  misc_feature (410)..(410): n is a, c, g, or t
ggcgtgaggagctcatgcacagattatgacggaggagctggttggtcacggcagagacaacaggagaaggcaatgcggtcccacatacggcatcagcataactacttccatacgtactgtggcccccggaccatatagcatgagctgtactgggttaagctgaagcttgcagccattatacataggtgcctgtgcctgaggaagcaatgccgaatgcatagtctggaggatatgaccgttacagagatcaagggcccttaatatacagctttgattggagcattgacagagacaccgtatcggctgatgcacttagggagcgtgcacacatagccccacaggctgatggtcccatagccacttgtctactaacatgcacgctcaactgagctgtgtgncactgaactcangattggtcatatgactagaatgagcgaccatcggactagctcatagggcctatagaggactgttgcccacaggctgatgttactatccagacacatgcacacgtatgcagatcgcatgactgccctcgatacaggcgacttcagaccaatcaagacagcggcgcatgatagaccgaggagagaactcgtgttacatatcaccatggcccactgtcgcagcatgccagatgctccatctgatcctttaagagctcatggcatagcggc

SEQ ID NO: 686347 - DNA, 237 bp, Homo sapiens
attcgcggccgcgtcgacggcttggtggtgcacgcctgtaatcccagctgctcaggaggctgagacaggagaatcgcctgaacctgggaggcggaggttgcagtgagtggaggttgcagtgagcctagattgcgccactgcactccaccctgggcaacggataaagactgtctcaaaataaagaaaattatctgggtatggtggtgggctccatgtgattccggcttctcaagaggc

SEQ ID NO: 686348 - DNA, 537 bp, Homo sapiens
atccccccatgcacttagtcaacagtatgagttagaatgagcctgatgctgaagtatcaagaaactagaaaagaaagtggtacagatactatattataaatctgttaggtattttctttaaaagtaggtgtttttgttctttttctttctttttctttttaaatatctggtcatcctgggcactgtttctaaaaaaaaactccattatcccaagcaaaaagcacagaaggtggatttgggcttcaagagatgttacctcaaaatcttaggcctagcagagaatcaccaattttatggagagttaccaggggtttaacaggaaggaagtgcctttagttaggttctcaagccagaggctgaaggcagcagctaatctcagaggacagctctcctcagtgaaattgacccatccggggtggcatgtcaccccaggaattaaccacaatttaaaaacaattgatttcgtaggatagcccagtgacttggtgccctgtgaccctgaggcccctgttgcacacggtgcatggggggtcccga

SEQ ID NO: 686349 - DNA, 870 bp, Homo sapiens
  misc_feature (801)..(801): n is a, c, g, or t
  misc_feature (810)..(810): n is a, c, g, or t
  misc_feature (837)..(837): n is a, c, g, or t
cataaagcaagtccttagagacctacaaagagacttagactcccacacaataataatgggagactttaacaccccactgtcaacattagacagatcaacgagacagaaagttaacaaggatatccaggaattgaactcagctctgcaccaagcatacctaatagacatctacagaactctccaccccaaatcaacagaatatacattcttttcagcaccacatcacacctattccaaaactgaccacatagttggaagtaaagcactcctcagcaaatgtaaaagaacagaaattataacaaactgtctctcagaccacagtgcaatcaaactagaactcaggattaagaaactcactcaaaaccgctcaagtacatggaaactgaacaacttgctcctgaatgactactgggtatataacaaaatgaaggcagaaataaagatgttatttgaaaccaatgagaacaaagacacaacataccagaatctctgggacacattcaaagcagtgtgtagagggaaatttatagcactaaatgcccacaagagaaagcaggaaagatctaaaattgacaccctaacatcacaattaaaagaactagagaagcaagagcaaacacattcaaaagctggcagaaggcaagaaataactaagatcagagcagaactgaaggaaatagagacacaaaaaacccttcaaaaaatcaatgagtccaggagctggttttttgaaaagatcaacaaaattgatagaccactagcaagactaataaaggaagaaaaggagagaagaatcaaatnggacgccantaaaaaaaatggattggaaggggatantcaccaccgatccccacaggaaattccaaactt

SEQ ID NO: 686350 - DNA, 832 bp, Homo sapiens
  misc_feature (591)..(592): n is a, c, g, or t
  misc_feature (596)..(596): n is a, c, g, or t
  misc_feature (599)..(599): n is a, c, g, or t
cgtctcaacagttgtgccaagtgaagtttatttaatagttctttaaataagaataacaaagctgaaagatactgtgcattctaccagttccaataagcaataagcgacagccctcaagcgtcagatccctagtgaagactgcatgcaatcctcggcattttgaactgctttcggctccaatatgaatgatgcacagtgcaggatgaaaaactaagggagattaagatgcaaaatggggcaagtccaaaggcctccatactccgggttggcgatcatcggcagaaaaacagaaataaggatccctccactgggctgcttctttggcggcggaaatgttgctgaagcggatctgggctggcttgtcgcggtcctgataggcgcctttcccgcggccgccggcagccccggcagtcgccccgctccggggtgccacattctcgggcatggcaaactccgctgtgtctgggttggctcgggaaggacggatggacccggattctggccggccgcagtgtaataacggtaagccctcactgccttcacgaaccttccagaaagcggcgccggcgtcgggaggaggcggaggcggannaccntcntgccgcgcggcgctggcgtgacgtaggaggctgtccgctgcgcgccgggcgaggaggatgcgtgcggtgggctccgggctggcgagattgtacgcccggggcgctgtgggtgaagagcgccgggggaacctttacgcgaggcagcaatgacaacgcgcgattttaaaggcgagtggtgaggacatccgcatttcctcactccaccttgcacggctatgaggtccccctcgtgc

SEQ ID NO: 686351 - DNA, 357 bp, Homo sapiens
aatgtctgttttttaattagcacaatatttaattgctttctgatttcagatacattttttttctcttgttcttacaaaaaccctgcagagatgaagaagctgtggtttaaggcagttatgtaacatacccaatttcacacgggcagtaaaataggctattaagcagggccttagtgagtgaaaattgattataattggatcaaaacagccttacttaaagaagttgaactaatgagttctaatttccttttaaacaccaagattctgcatttatgtgtttttcaaaaatcaccctaggaggatgatactctgtaagtctcatgtccaggaaaaatgatccgagtgggtatcctatag

SEQ ID NO: 686352 - DNA, 955 bp, Homo sapiens
  misc_feature (714)..(715): n is a, c, g, or t
  misc_feature (719)..(719): n is a, c, g, or t
  misc_feature (722)..(722): n is a, c, g, or t
cgtctcaacagttgtgccaagtgaagtttatttaatagttctttaaataagaataacaaagctgaaagatactgtgcattctaccagttccaataagcaataagcgacagccctcaagcgtcagatccctagtgaagactgcatgcaatcctcggcattttgaactgctttcggctccaatatgaatgatgcacagtgcaggatgaaaaactaagggagattaagatgcaaaatggggcaagtccaaaggcctccatactccgggttggcgatcatcggcagaaaaacagaaataaggatccctccactgggctgcttctatagggaggacaagagaggatcacccgaagaaatgggaaatgagccaaacccgctcaagcccacgatgagagcgcagagcacaacaccgcggcgccgcgggtcaggccatgagagtgatacctttggcggcggaaatgttgctgaagcggatctgggctggcttgtcgcggtcctgataggcgcctttcccgcggccgccggcagccccggcagtcgccccgctccggggtgccacattctcgggcatggcaaactccgctgtgtctgggttggctcgggaaggacggatggacccggattctggccggccgcagtgtaataacggtaagccctcactgccttcacgaaccttccagaaagcggcgccggcgtcgggaggaggcggaggcggannaccntcntgccgcgcggcgctggcgtgacgtaggaggctgtccgctgcgcgccgggcgaggaggatgcgtgcggtgggctccgggctggcgagattgtacgcccggggcgctgtgggtgaagagcgccgggggaacctttacgcgaggcagcaatgacaacgcgcgattttaaaggcgagtggtgaggacatccgcatttcctcactccaccttgcacggctatgaggtccccctcgtgc

SEQ ID NO: 686353 - DNA, 371 bp, Homo sapiens
  misc_feature (37)..(37): n is a, c, g, or t
aagcacagaaggagcgtgggtcggaaaagaagggatncttcaggcctagaaaaaagtcccaaatcttcaaaaggtggtagtagtagagatacaaaaggatcaaaggataagaattcccggtccgacagaaaaaggtttatatcaaagagtagtcggtcaggcaaaagattttcaagaagtgaaagaggccgaaaatcagccaggaaagccaaaaggggttaatggaaaaagccaggcttttttagccattttttgcagcaaaagattttttgataaaaaaggattccctttccttgtaaaaaggatgctgccttaaaaattgcatgttgtaaaaaatctttttggaaaaaacagactgtttgttttccaga

SEQ ID NO: 686354 - DNA, 1033 bp, Homo sapiens
  misc_feature (202)..(202): n is a, c, g, or t
  misc_feature (205)..(205): n is a, c, g, or t
  misc_feature (212)..(213): n is a, c, g, or t
  misc_feature (217)..(217): n is a, c, g, or t
  misc_feature (219)..(219): n is a, c, g, or t
  misc_feature (251)..(252): n is a, c, g, or t
  misc_feature (254)..(255): n is a, c, g, or t
  misc_feature (266)..(266): n is a, c, g, or t
  misc_feature (268)..(268): n is a, c, g, or t
  misc_feature (288)..(288): n is a, c, g, or t
  misc_feature (291)..(292): n is a, c, g, or t
  misc_feature (299)..(300): n is a, c, g, or t
  misc_feature (307)..(307): n is a, c, g, or t
  misc_feature (312)..(313): n is a, c, g, or t
  misc_feature (402)..(402): n is a, c, g, or t
  misc_feature (792)..(793): n is a, c, g, or t
  misc_feature (797)..(797): n is a, c, g, or t
  misc_feature (800)..(800): n is a, c, g, or t
ggttgacggggtgaaattgtgggatccacgtggtgcgctggggtgggtcgtgcacttgcatcacgcgcatgaacgttcagtggagggaagcagagtgtgaatactgaggaaaccgccgtgggagtgcagtggaagtcggtggcactgagtgtgacgaagtttctctgtcactcagttccacaggtcgagacatgtcagtcanganttcaatnncctntnccagggccttctggaatgactcagaaatgatnntnngatgaatcccntnctgaagaagcttggtacaangannctaaganngagccangcaanngatgactactgatgtggtgccatctcctgcttctatatcttgagccttagacagctccaccagcattctggctgctggatgtaatactngcatttgtttcagaatggtagcaccatcatttgtaatggttacatcaccttttccatcttgaatcattttatccattccttttggtccaaggcttgttctaatagcatcagcaaccgctttggcggcggaaatgttgctgaagcggatctgggctggcttgtcgcggtcctgataggcgcctttcccgcggccgccggcagccccggcagtcgccccgctccggggtgccacattctcgggcatggcaaactccgctgtgtctgggttggctcgggaaggacggatggacccggattctggccggccgcagtgtaataacggtaagccctcactgccttcacgaaccttccagaaagcggcgccggcgtcgggaggaggcggaggcggannaccntcntgccgcgcggcgctggcgtgacgtaggaggctgtccgctgcgcgccgggcgaggaggatgcgtgcggtgggctccgggctggcgagattgtacgcccggggcgctgtgggtgaagagcgccgggggaacctttacgcgaggcagcaatgacaacgcgcgattttaaaggcgagtggtgaggacatccgcatttcctcactccaccttgcacggctatgaggtccccctcgtgc

SEQ ID NO: 686355 - DNA, 979 bp, Homo sapiens
  misc_feature (202)..(202): n is a, c, g, or t
  misc_feature (205)..(205): n is a, c, g, or t
  misc_feature (212)..(213): n is a, c, g, or t
  misc_feature (217)..(217): n is a, c, g, or t
  misc_feature (219)..(219): n is a, c, g, or t
  misc_feature (251)..(252): n is a, c, g, or t
  misc_feature (254)..(255): n is a, c, g, or t
  misc_feature (266)..(266): n is a, c, g, or t
  misc_feature (268)..(268): n is a, c, g, or t
  misc_feature (288)..(288): n is a, c, g, or t
  misc_feature (291)..(292): n is a, c, g, or t
  misc_feature (299)..(300): n is a, c, g, or t
  misc_feature (307)..(307): n is a, c, g, or t
  misc_feature (312)..(313): n is a, c, g, or t
  misc_feature (738)..(739): n is a, c, g, or t
  misc_feature (743)..(743): n is a, c, g, or t
  misc_feature (746)..(746): n is a, c, g, or t
ggttgacggggtgaaattgtgggatccacgtggtgcgctggggtgggtcgtgcacttgcatcacgcgcatgaacgttcagtggagggaagcagagtgtgaatactgaggaaaccgccgtgggagtgcagtggaagtcggtggcactgagtgtgacgaagtttctctgtcactcagttccacaggtcgagacatgtcagtcanganttcaatnncctntnccagggccttctggaatgactcagaaatgatnntnngatgaatcccntnctgaagaagcttggtacaangannctaaganngagccangcaanngatgactactgatgtggtgccatctcctgcttctatatcttgagccttagacagctccaccagcattctggctgctggatgtaatactccatcttgaatcattttatccattccttttggtccaaggcttgttctaatagcatcagcaaccgctttggcggcggaaatgttgctgaagcggatctgggctggcttgtcgcggtcctgataggcgcctttcccgcggccgccggcagccccggcagtcgccccgctccggggtgccacattctcgggcatggcaaactccgctgtgtctgggttggctcgggaaggacggatggacccggattctggccggccgcagtgtaataacggtaagccctcactgccttcacgaaccttccagaaagcggcgccggcgtcgggaggaggcggaggcggannaccntcntgccgcgcggcgctggcgtgacgtaggaggctgtccgctgcgcgccgggcgaggaggatgcgtgcggtgggctccgggctggcgagattgtacgcccggggcgctgtgggtgaagagcgccgggggaacctttacgcgaggcagcaatgacaacgcgcgattttaaaggcgagtggtgaggacatccgcatttcctcactccaccttgcacggctatgaggtccccctcgtgc

SEQ ID NO: 686356 - DNA, 127 bp, Homo sapiens
cactcgcacacgcacacatgcacacaccttctgtctctcactcaaagactaaatccatcatcttttctgattgtgagtttcttgtgctacactgaggggacttggtacaatcagtggacagtgcctt

SEQ ID NO: 686357 - DNA, 360 bp, Homo sapiens
attttgggaaagtgagcatgaagaagggactcagagctgccaggtacccgagtctcaggctctgacatctcttggggcccccttctgccacaacttcttgccacttcacggacttgaattatgtcccgcgcctaaaaaaaagattggcctgcagcacaggcgtgtatcctctccaaaaagctgctgctcatttctggccccatctgctgctatctttgccagtcagccatcacagtttggcatcatcagagtctcagctagagggagcgtgtcatttctgccttagtggtttgcctgcgacctgaccagggcaagaccagctgggatgtcaagtgacattttgggaacttgtcggaagtt

SEQ ID NO: 686358 - DNA, 1282 bp, Homo sapiens
gagcccaccggagtccgagcactgtgaagaagaggtgagaattgagcctcgggacgactcgatagagcccggcgcgccggtggcatcccgcgtccgagccacctacagttcccggcgtgcactgagtcagtccgggcagccgaccgatgagccaaatgaagggacagaggctgacagggggatgctaaggggagcatcaaagacggtggctgaagtgaggcaaccaacagcttgacagcatcctgcggatgttggtcgtgtgtaataggctggcttgcttgcgcgaaatggccaaggaggctccaaggtcctaattcctatatgggccacctgacacacacgaatgggacgacgaacgtgtatcgcccaaaagggtgtacacatcgagtggagatatacggctcgaattggcattgggccaaatgtgcactggggttgacataacacgcctgccgaccagaagaatgggtagggattgactcatttatcacaaggaacactatgagttcacacaacgaagaaatgcattgcaaatccggtagcctcgcgaacgcaatggcccattggtgcattgctgcctcgctggcatctccttcgtggaatagacgttgcttcggtacatatcacttggagtgcacatcgtcctacacagtttgcctgccagtcttatctgtagtatggtctttcaaactccgaggacggtttctcttacttattagacccaaattttcgcctaggaacgatttggtggttcggtgcttggtgacccctatccttgggtgggctttggggaaagggttctttaacaaagggaccatgccgggcgccgccaatgtggcatgaacttaccacggaagggaaagaccatttaggttttttccccaattgcgcaagcggcgtttttgccacccagcggttggttgtcactaatcaatggcgcaacacaatttttggtttgccctattccttttttaaagtccgcgttacacaggggatgatacaccgcttggcgaaccacacgttgaatgcagatggaccggtgttatgttccccaggcgcgttccaacattttggacataacggcttgggttgcggaatttcctcccctacgaattttgggtgcgtttgcaaagtcacatctttcattaccccgggtccgccttaaacttatctccaggggggagaagctggcgccgcgcacaaattgcacactacccgacgatggtgtacttgggaggaacccaccacccaatgtggttcacacacaacgggcgatatgtga

SEQ ID NO: 686359 - DNA, 156 bp, Homo sapiens
gagaggagaactgttcgagttttttatttatgtgtttttaacaaagggagcaaaggcaggggccttaatggggggccaggggcgggtgattacagtcaagggccacactttggatcttgaagtccccgtaagtctggccatgtatgagagatgggc

SEQ ID NO: 686360 - DNA, 1057 bp, Homo sapiens
agccgggagccttctatgggcgatctaactgacgcccatggtaaccgacggatggggagacgcagcgtcacgttaaagcgaaaggagttggctgtaaggcagagaatcacgtctatgtccaggcatcgacggtcctcgccatcatcaagcttcagagtatctcgtgtggtgtagtcataaacggtgaacgacactgatggtggaatgggatggcactgacaataatgattcaacgatttgggtgccaacgtgactctcttggtcgatgtgtctcttggccgtcgatgtaacggcgaggggcagcatgataagtggaactgaccccgtggtgattgacacacatgtagattatggtgagcacgaggaagcgtcaagagacgtcgagtccctgggcatgctgtcaggcacctgcaatagctaactcagagggcgtcgtgctcgtcattgatggtacatgatattggataagcaggaatgcaatgctctctcccgagggggagcagtgagcctattccggggattgccgagctactcagtgtgcacaggtgtctcaccgtggccagtcggtggaagtccatcgtgggaccaatgtacggctagagcagggctggcgtctgtgggaggattgaagcggtggtttggctgcacatccttcgtggtgcaacattcgtttgccttgggagctggtgagacgaaagctatacgattaaggctggctttgggcgccatgattgctgtggtctggatgtaggtgtcctgagtcgttggtcgtgatgggccctgtggcttggagctcaggtctcgcctgatcttgcgatagtggtgcggccgcacctggggtggctgctaggagcttgcaggcctttccgggtcccgtttgggcccttgccggtttgggggccggcaatcaaccgcgagagggcccattggtgtacctccccatcaacaagtttgtgggtggggcacacgcgctatttggcgcgacacacgctgctagcagggcgggcgggggtggtaccaaagcatcttgggggtgccgcctcacgaggggtggctg

SEQ ID NO: 686361 - DNA, 482 bp, Homo sapiens
  misc_feature (474)..(474): n is a, c, g, or t
acaccaaaacacaagtagcagttttttgttttgttttgtcttgtttcaagactctatcacaaaaaaaaaaaagagagagagagagataaagaggtatattgggacaattagtcatctttcctacattttctctttttttcagagcccagaatccttgcatacattttctcattctaaaatcctacctatttagtttgtagaaatgatttatgtagtaatcatagactgctaaaagctagaactccggcctccttttacagacagttactaaggcttagaaacatccttcagcttttcagaggttgcaacatacaactggtctttttccccagcccagttctctttcactgatagggccgttcatcttttcctattccttaaaccccctttcaagtgttaagatttaacctcttgttctagtattctagtatttgaagaacaaatttatttcctgttacacacttcatatttttnttacaaaa

SEQ ID NO: 686362 - DNA, 218 bp, Homo sapiens
taagcgacggttctctccagtgtggatactctgagttgtgcaatggtgtgaaatatgatggaagaccttttccacatacattacatctagtaaggttatctctccagtcatgaatgatcacgatgttagtacaaggtacaggaatttgcgactagaacacctatgccacattttgttacatatcgtacaggttttttgggagatcctactacgagtac

SEQ ID NO: 686363 - DNA, 212 bp, Homo sapiens
gtagcaaaggggcttcgtaacccagccgggccaggttctggaacaacaggctcttttccggggcaggctgcccaccccagcatgcgacgactgcccacagctggcacgcagcacgcgaatggcggctgtgccgctgtaggaagtcgccgagttgaactggtcgaagaccacgttcatgcgcgacagcaacgggttgtcgcgcagccccacgg

SEQ ID NO: 686364 - DNA, 155 bp, Homo sapiens
gggggcccgaaaccccccccctttttttttcggggcaacccccggggcaaggtggttcccaaaaggggttaaccgggccccccggccttaacaaaagggccgcccccaccaaatttttttattgttttaaaacccaaaaaaagttttttttttta

SEQ ID NO: 686365 - DNA, 174 bp, Homo sapiens
aagtccctagcgggatggagagctggactgtgaacttcaacctcccagttgggcagcagggagagctcggacggcagcgagccggatgatgccccccacgagcacagtagcggcgtgtgccagagacggtggagagagagcgccgattggtgctcagcaagagccgaagcaaga

SEQ ID NO: 686366 - DNA, 604 bp, Homo sapiens
ggactgtgagtgccggacttcctcgctgtgatggggatctgccggaacccctggcaagatcaattgctgtcccattccgggcccttcccttatcgtgcgacccccttcaccttggcatcatgttcaggaaatttgatgcaagacagaaaactgtgtccgaaacttgcatccacgtttgagaacacttcagtatattaatgggtattgaagaatcaatgtgtatagatgcaactttccaggtattgaatgcatggtcttaatcaatatctatgcgctacgaaagatcctgtcaaaatagtccgatgccatgaacatatagaaatccttacagtacatggagaattactcttttatagacgaagagagcgggcctttctatccaagcctaagattacttcacaaatatccttttatcctggcacaacagcaggtagataaaggagccatcgaatttgtactcggtggagcagatatcatgtgtccaggcttaacttctcctggagctaagctttacctgctgcagtagataccattgtggctatcatggcagaaggaaaagcagcatgtctagtgtgtggagtcatgaagatgtctgagaagacat

SEQ ID NO: 686367 - DNA, 402 bp, Homo sapiens
  misc_feature (51)..(51): n is a, c, g, or t
  misc_feature (190)..(190): n is a, c, g, or t
aatggttggttaaagggggggcaggtccccaggggggttccccccattttngggtgtttttcctttatcctttttatgttcccgtttacccccaagggaaagggaggttttttttttcccccccccctttcccactttttccccagggggggggtttttatggggccctttatttatcccttttcccccnaagaattttttgaaaaacccccccgagggggaaattttgaaattttttttcccctgggggggggggccttccccctccccctgtggaggggggttttttttaacccccccccggaaaggggggtggggccccccccttttttgggtgccccccccccttcccgccccccctcccgggggtttttccaaaaaaaaaaatttttacggggggga

SEQ ID NO: 686368 - DNA, 201 bp, Homo sapiens
gtccggggtcaacccccagcccccccccccctccctgggcagggtttttaggcaacccctgtgatgctcaaaccctaccttgcctcctaccctttttttttttctgcctactcccccctcctccctggcaaaaaacccccaggggtttggactccttttcccagttgaataaaaaacattttttaaatgaaaaaaaaaaaa

SEQ ID NO: 686369 - DNA, 326 bp, Homo sapiens
  misc_feature (58)..(58): n is a, c, g, or t
  misc_feature (320)..(320): n is a, c, g, or t
ttaatatctgaccaacctctagaagtgatgggcctaaagaaccccttggagctaaaantctttgtcacctgtaatgccagcgctttgggaggccaaggcaggcagattgcttaagcccaggagttcttgaccagcctgggcaacatggcgaaaccccggctctacaaaaaattagccaagcgtggtggtgtgtgcctatagtcccagctatttaggaggctgaggtgggaggatcacctgagtccaggaggtcgaggctgagtgaactgcgatcatgccactgcaatccagcctggatgacagagcaagaccctgtcacntaaata

SEQ ID NO: 686370 - DNA, 894 bp, Homo sapiens
ggcagcaggaggaagacaggcaatccctccggctgtccgaccaagagaggccggccgagccctgatggcttgtggcttttgctttctggcggagggatctgcggcggtttaggaggcggcgctgatcctgggaggaagaggcagctacggcggcggcggcggtggcggctagggcggcggcgaataaaggggccgccgccgggtgatgcggtgaccgctgcggcaggcccaggagctgagtgggccccggccctcagcccgtcccgccggacccgctttcctcaactctccatcttctcctgccgaccgagatcgccgaggcggcctcaggctccctagccccttccccgtcccttcccggcccccgtccccgccccggggggccgccggcacccggcttcccaacatggctctgacagaagaatccacaaggaatcgaattgatctgggcacgggaccctccagcacagtgttcagcaaggtcctgttggagatgatatgtccatgggcaagctacaaataattggggccaaatggacagtccctaatccaggtgggcgtaatgtctttgacaattcatttcccaacagattacccctttcaaaccacctaaggttgcatttacaaacaagacattatcatccaaatattaccagtcagtggcagcattggtctggatatctaacgatcacagtggtctccagcactaactatttcacaagtactctggtccatctgtactctggagtgtgatcccaatccagatgaaaccttagtgctgaagatggctccggttacacaccacgaatggagaaagtacacagaaaagctccggaatgggccaaaggtggaaggttaagaaactgtggttacccctcaatagattgggccctg

SEQ ID NO: 686371 - DNA, 127 bp, Homo sapiens
tcagatcttactgatcaacatcgaggtcgtaaaccctttgtgatatggactctagaataggattgcgctgttatccctagggtaacttgttcctgttggtcaagttattggatcaattggtggtata

SEQ ID NO: 686372 - DNA, 259 bp, Homo sapiens
ttactgccttcttgttttctacctttctaattcctacttgtggttagggtaatttatctatgtgtctgatggtaaaagctgttttttaaaagttgcatactatgtatttttttcttttcatgctcttttgcatgctgacataataataagacagtaactgtattgttatcagaaacatgtcatccaggttcaggcagttttgctgcgtcagcactttgggaggccaaggcaggcagatcacgaagtgcaggaaacaaga

SEQ ID NO: 686373 - DNA, 169 bp, Homo sapiens
ctgctgggttcaagcaattctcctgcctcagtctcccgagtagctgggactacaggcgagtgccaccacaccacggtctaatcttcccgtatattctaggtggaggacagggttttcaccgaggtggaggatggtcctcgatctccatgaccgtcatgtatccagcccg

SEQ ID NO: 686374 - DNA, 195 bp, Homo sapiens
ttccttccacacccttcactcaccatcttttcccacaatcacaactatcagctccctgggtacttccagcttccaactctcagggatctcatgattgctggctggagattcctctcttccagggcctgggaggatcagggctaatccgcaaggggctgctaggctagttagctggacagcactgcaagatgcacg

SEQ ID NO: 686375 - DNA, 1206 bp, Homo sapiens
  misc_feature (3)..(3): n is a, c, g, or t
ctncccctttcagtcgtcgactggtcactgctggatagtcctgccttggtgtcttatgtttgtttccactttttctggtcgggttttcgtgttgcgtgggcgtcttcttttgccctcctggtgggttgttgcgatgtgttcttcttctgcgggttcctccccccgtttcgcagagtttcccttcccccttgggtcccccccggtggtggggcctctcggattgagcagccattttctctggcgtggtctccggcccgggatttgttccggggaccttatgtttcggcattgttgaacttgggatttcctgcgtggccctggtgggttcccaggtttgcccccttttggtttccccctgcgcccggaccgccctccattggggtccctacccgcgggtgttcaaagccaggcgtctgtccccgatggaggtatttgggtggtaccgttctcgcccctgagggtggttctgggtggaaaatgggttccgcctattgcagcttgagccctccgtggtatccccccccgggtattcattgccaatcccagagggtgtcccccatgctttccgtgggttcccccttttgtaggccccccttcggtggaaactggtcagggcccacttccaagggttattgcaataatatcggaagcccctcgcgagtattttctgaaaagaaatgtgcccccttatccacggaacccgtggtgggaacccttttccgaacgttacccaatggtggaaacttgtgcccggtgtgcccacggcccacgccattggggctcggagcacccacggtccgttggcccccaaaagaggtggctgagatttttgctgcaccaatgcttataaaacccccagagagatgttaattgctgagaacttaagggtttaacatgtagatttctctggtcacttgaggcactattcccacgtggacccaagcacccttagatgcgccccccggagcctaccacgagcttcactggtcggagtttacccactaacactgaggctcttccctgccaccacttgagatgatccctatcgggaaaggaaccacgagttgttcctaataccacgaaagaggaaggttggcccacgaagaaaaagatatttcccacgaacgaaaactgagagagaacccacaaaacttaattggcccggggagttaattccagccatttaaattaatgttatttaaagga

SEQ ID NO: 686376 - DNA, 406 bp, Homo sapiens
  misc_feature (25)..(25): n is a, c, g, or t
  misc_feature (249)..(249): n is a, c, g, or t
agttcttttcctattagtgtttttntttttcattcaaatagaaaaactctctttagcatttcttgtaagactggcctggtgctagtgaattctctcagcttttgtttgggaaagtctttatctctccttcgtacctgaaggataactttgctatatagagtattcttgtatggaagtgttttctctttcagcactttgaaaatgtcattgcactccatctagttctgaatggtttctgttgagaatgtnattgacaaatgaattggaactcctttatatattatttgcttcttttctcttgctggtattagaattccctttgtccttgaactttgagagtttgattattgtatgccttagggaaatcttatttgggttaaatctgtttggtgttctctgaccttcc

SEQ ID NO: 686377 - DNA, 340 bp, Homo sapiens
aaggaatataggcagatgtacagaactgaaatcgaatgggaggatggcagaaaagctggcacttctatgtacctgcagaaccaaattggggttgtcatccggatccagaggtatcaatggagtgagcccaaaggttcgaaaggtgttgcagcttcttcgccttcgtcaaatcttcaatggaacctttgtgaagctcaacaagggttcgattaacatgctgaggattgtagaagcatatattgcatgggggtacccaatctgaagtcagtaaatgaactaatctacaagcgtggttatggcaaaatcaataagaagcgaattgctttgacagataacgctt

SEQ ID NO: 686378 - DNA, 321 bp, Homo sapiens
atggcgacgcccatgcaaagcgtaaccccacatgtgggggcacgaacgccaaaacgaaaacacccaatatgccccgcaagacgtacaggagccatataaccacacgtaccagcagcgacacgtacaacgggccaacggcacatggctaaccacgaacgggtccaatcacgaatagcggaccgtacggcacgaaaatagaataagcgtgatgccacacgcaacgtcaatatagagagttgatcactgcgcaaccaccgtggaagacacacaacatactacgcgcactgaccaacacataccagccagcaacgacggtgtgca

SEQ ID NO: 686379 - DNA, 1179 bp, Homo sapiens
ggttactactggatgcgtgccagtcttctccctgcatgccagtccttccgaggtattctcaactgcattgggcccttaaggctcctaatcactcatggctgcgcgcatagcactgtttggcctctctgccctcctttctctgtgggggctaccacaagtttcttcccatggacgaagcccaatttacctccgggtctgtgggtggtatgcatcctattgctgctccttcatcggccatattgttcctggtagtcggtattgtccaagatgccctagccgccgtgcaagatacggggtgtccacctctggcctatgtctccttgtgcccaaaatgccccttttctctggtcattatggcgtctgatagttcttcaaggttcccttgggcccgtcttccttcgactgtcgatacgattgacggaatgtcattccttgctttcacgtagttctacttgggggtcaattaatgctcgtgtttccggggattgtcaaccggaatgatcccggggtcctgttggtagatgatgtgtctctgagacgtgtactagtgctcgctgttctggctcttccatttgcacacgcactattcgacgggtttgaatttctcttccgatgctatctccgggtgcatgaacctcctctactactgtgcagttcctcgtagagtatctgcagcttgtccactaatgtcatcactaatgaggggtatttaatccaagcctgttgagcatatgaattcatcatgaaggacctgtatggaacttggcattcaactctgtaatcccatgtcaatggctattatgggaacctcagcgatgtatagaccctccgaaatcgaattggccaccgtcagggtcggtgttctcgatgatgaatccttgacatgtctcgtcagtgacgttcgcctgatgacgtatcctttgatggggtcaagcaagctgacagtcgtagccctaagtgtcctatctacgctatacgtgtcttcgctggaagcagtcgcaggagatagggcgcaatcccacgatacagctaaggaggcagtatttcattttcatcaacagatgataggctgtggccctttacccgctccgcaatgtctccagataggtacatgcagcaaagcagataattaggcagcctggagtataaaccagagatccagtacaggaagaaaggata

SEQ ID NO: 686380 - DNA, 425 bp, Homo sapiens
ataagcgcgtctgcgtccccacccaatctccgtcgaatgtaatctccagtgtggaggtgggaggtgatgtatcacgggggcgaatttctcatgaatggtttagtgccatcccccttggcactgtcctcgagatagcgagttctcatgagatctggttatttaaaagcgtgtggcacctcccctcattctctctcttgctccagctcctgccacgtaggacgtggctgctccctcttaaccttctgctgtgttcataagtttcctgaggcatccccagaagtcaagcggatgccagcatcatgcttcctgcccagcctgtagatccaattgaaccttgggttttattctttataaattacccagtctcgggtatttcgttatagcagtgcaagaatggcctcattcacattcataaggcccgagtc

SEQ ID NO: 686381 - DNA, 342 bp, Homo sapiens
taaggtgtgtattggattggtgctgtactaacaggtgcaactcaaagattatattattttttttttggagatggagtctcgcttttacacccaagctggagtgcagtggcgcgatctcggctcaccgaaggctccgccccgcggggtacacgccattctcctgcctcagcctcccgagtagctgggaccacaggcgcccgccacctcgccgggccaattccctgtattttaagtagagacggggtttcaccgtgtaagccaggatggtctcgatttcctgacctcgtgatccgcccgcctcggcctcccaaagtgctgggaccacaggaaatctaccggggg

SEQ ID NO: 686382 - DNA, 323 bp, Homo sapiens
cgacctagcaggatcccccacctcatctgcttacatatttagtctatatagtctagtaccactagtatagtaaagtcttagagagcaagaatttttgtttatatgctttctcttcctacctttcctttctatcctcttttacttcgttcactactagtattctcacataataatatatattggcatatagtagtgtgtacaatatgtagacaggaatgaaagaatttatagacttgagttgcaatataaaatgtatatttttttactgtgagttatggcaaaaaaagttttgaaagccgcttctaaataatgcagataaggtg

SEQ ID NO: 686383 - DNA, 574 bp, Homo sapiens
  misc_feature (14)..(14): n is a, c, g, or t
  misc_feature (192)..(192): n is a, c, g, or t
  misc_feature (330)..(330): n is a, c, g, or t
  misc_feature (418)..(418): n is a, c, g, or t
  misc_feature (429)..(429): n is a, c, g, or t
  misc_feature (448)..(448): n is a, c, g, or t
  misc_feature (487)..(487): n is a, c, g, or t
  misc_feature (571)..(571): n is a, c, g, or t
atactttatttaanacacatgaaaattttgtaaaggtagttttgtaattaaattgcaataaattgaactaaatttttctttattcagctgatagggggatggtcaacattactttaattgtggaaataattcctatttaaaatagttttatgaaaaaaagcctttttctgaaacctagttgaaatgttttanaatattctaaatgaaattagttaattgattatccttaatcttcctcatcctgtttaaaaatccggtggctctttaaacaggagaaaaaccactattaacagaaagcctaaggtaagtttacaacacctaaaataaatnaatttcaaatggataaagaaagtaaaaaaacagcaactaaataaaataggtaacccggtactgatttggcttccaagggaaatttctncgctggctatnaagggttgaaatttctttnactgaacgttacaattcaaattaacctgttttaagggtnctcctgttacccatttttctttcatgtggggaatataaactgaattatcatggtcaaatagtttctgggaatagaatactacanaaa

SEQ ID NO: 686384 - DNA, 516 bp, Homo sapiens
cttatgcctttcccatgcgctatggtttgaatgtttgttccctcaactcatgtggaaacttaatccccagtgtggcagttttcagaggcaggacctttaagaggtgttgggtcatgagagctctgccctcatgtatgggttcatccacacatggatcaatggattaatgagttaagtgattagtgggttatcaacaggagtggcactggtggcttcatacgaacagcaagagagacctgaactagcacactcataccgcttgccatgtgatgccctgcaccaccattgggaccctgcaaagggtccccaccagcaagaaggccctcacaatctttctggaaagcaattatcatacaatatatataaacttcttttctttataaattatccagtttcaggtatactgttataagcaatagaaaatggactacgaaaattggtattcagaagtggggctgttgcttaataatgaatacctgaaaacgtgaaagtaagggcagaggccagaagcatttg

SEQ ID NO: 686385 - DNA, 370 bp, Homo sapiens
  misc_feature (1)..(1): n is a, c, g, or t
  misc_feature (30)..(31): n is a, c, g, or t
  misc_feature (38)..(38): n is a, c, g, or t
  misc_feature (40)..(40): n is a, c, g, or t
  misc_feature (50)..(50): n is a, c, g, or t
  misc_feature (75)..(75): n is a, c, g, or t
  misc_feature (85)..(85): n is a, c, g, or t
  misc_feature (127)..(127): n is a, c, g, or t
  misc_feature (182)..(182): n is a, c, g, or t
  misc_feature (232)..(232): n is a, c, g, or t
  misc_feature (275)..(275): n is a, c, g, or t
ncgttcttgtaacttcttcatgatattttnnttctgcnangagctgctcncactgaccagaaaataatgccacanacaacttcancaacatccttactacggcccatgatcccactggaagtgaaancattgtttcctgttgctcaagtagaaatatcttaaggacggtggtttctggaganactaagatgatcttcttgcagactgacaggcatctagatattttcccacnattccaattctttcttcacctgagaagagagagaatccattanttgtcctattgcttttgatatatggtttgaagtctctagccattctgctaaagaagataatttttatgcacttaataaatggaagaaaacatctc

SEQ ID NO: 686386 - DNA, 797 bp, Homo sapiens
ggcttctccatccaggtcctggagttcctggtccctggagctccgcacttggcggacgcagcctgtcgttgaggcacgacgcgagctctggacgactggccgggcatgccttccgcgggctagaggactatgaagtgttagtacaccgattggcacaggctcctatcggccgcttgccagaagatcgcggaggcatgagtgatgcgcaagatattagtttggaaagaacttgcactatggctccagtgactagaagctgacgaaacagatgcttgtttctgcaagtgaattgtgcgtatcgctgaactgagatacatccaaagcatcgttcgttactatgatcggattattgaccggaccaatacaacactgtacattgtaatggaatatcgtgaaaggaggggatctggcgtagtgtagattgacataagggaatcatgggaacaggcaatagcttagatgaagagtgtgtgacttcgagtgatgactcagtttgactctgggcccttgcaagggaatggccacagacgaaagtgatggtggtcataccggcattggcatcggggaatcgtgaaagcccaggcccatgttatacctgggactgggaaggcccatagacggtcagagccttggcgaggaactttggggcttagctaagaattattaaaccgcattgaccccgacgtttaggcaaacacatttggatggcgggccaaccctttagttaccattgtcttcgtggaaaccagtagttgaatccgcatggtcctagcaatggagaacattcaggacatatc

SEQ ID NO: 686387 - DNA, 339 bp, Homo sapiens
ggtcaatagatatttccatgttctagatccctgaggaatcgccacactgacttccataacggtatgaactagtttacagtcccaccaacagtgcaaaagtgtacctatttactaccaaatacctctaccagcgacctgtatgtttccgtgacaaaagagtacccaattctataaactagagccctagaaactatttgggcatctaaacgccactaactatgaacattgtgcagctaatagtaacattacccatgatacaacgttgaatgtgcgcgggacaggttgcggacctatacagtagtatatacacacagtgccagtgcaaaaaccgctatacca

SEQ ID NO: 686388 - DNA, 326 bp, Homo sapiens
tgatcaatggccagcctgggacaaggctccgaggagctattctggtttctgggagagtcacattccctggaggaaggccccctccgcagataacatagatacctctttgataactttgtagaaaagagacgaattataaatgcaactgggcacagtatcccgtagacatcgaaagctacagagaatcgactagtaagtaacacaaagcggaacagatccaaggacggccaactgcgcgataacatctttcacccgccactacgcacaggacaacgctccacaaaacacatgacacgacagacatcaaccaaagcaagccacacccc

SEQ ID NO: 686389 - DNA, 185 bp, Homo sapiens
cagaccatgaggtacctatttccccaggagaacatatttgagacatatatgaaaatcggaggagataatgcactcgcagagaacttctaatcctgttctacaaaagtccaaagaaggagcaaataatgccaacttcacttttcttgttttcacatcaataaagacattgattttagtgtcacact

SEQ ID NO: 686390 - DNA, 287 bp, Homo sapiens
agccaactcaaaaagacaagggaaattgcaaagaagacccccctggcaagctacgaactgatacgcagcccacagtcctcaaccacctcggctgaacagccccaggctagctctctctcaaatccagagaaatacactgatgaacttgccactcagccaaggcgactgcttaacacactgagggaactcaaccctatgtatgaaggatatctacagcatgatgcacaggaagtattacaatgtattttgggaaacattcaagaaacatgccaactcctaaaaaaaaa

SEQ ID NO: 686391 - DNA, 81 bp, Homo sapiens
ctagaagattcagcaaagtacttttgtgctcttgggcttcctacgtactgggggagctcctgggacacccgacagatgttt

SEQ ID NO: 686392 - DNA, 184 bp, Homo sapiens
atctatttttcttggtctcatactcagttttttatgtagtcacttagtaaataacctaatccgcttgttttctccacactaatccgagggtgaattcctaatctagcttttcagatcatgggacgagggaaatgaccgcgtgcgcgaggccctaaggaataacatagaaaacaccgcctctgct

SEQ ID NO: 686393 - DNA, 443 bp, Homo sapiens
  misc_feature (435)..(435): n is a, c, g, or t
atacgtaagttactaaagcccatttgtacaaagaagggattattgtttacttaaggaacagtggttacggtttaattcagctatactaagtcatttcaagtgttcagtagccctgtgtgagcagtgactgtagcgctgatcttactagcactaagaatcagacatctagttccagctttcttatgttttaggagggaagggatatagacataatttgatttatgactaggcagactaatagaatactgttttacattcagaccttgaatttctagggccaggttagcggcataatttggggtttctgaatcctaatttctgtagttgtaaaatcaggtaatgccacctacctcttgttgatcttgtgaaggttgagatgtttgaattgccttccacgttttctgacataggaaatgctccctcataaatgctggnggtcattc

SEQ ID NO: 686394 - DNA, 396 bp, Homo sapiens
  misc_feature (292)..(292): n is a, c, g, or t
gcgaatcattggctctctcccttttgaatctcctgtttgcatttcccatattaccttctttctttgtttatttcctcctttcatggagctttcctttcggtagtttccttagataaggtgaattagaggtaaattttttgagatcctgcaagtgtgaaaatggttttatttggactaaatacttgattgatggggatggaaatcattttctgtcacagttttgaaggcattgctttattgtcttccagtttacagagttgctgttggaaagtctgaagccattctgattttnatacctagcttttccctcaccccctctgaaaaagcttggagaatgacctcttcaaggtgatatgccttgatgtgggtttgttttattcaccgtgctatgtaatt

SEQ ID NO: 686395 - DNA, 561 bp, Homo sapiens
ggaacagttggattcgctactggtattgagtggaggcaggatgctactaagcttcctgtaatgtacagggcagtccccaccacggagaggggttcagcccagaatgctaacactgttgaggctgagaaaccctgcctaaactcattaaatttaaaaaagaagaaaacaagccaggcacagtggctcatgcctgtgcactctggaaggccgcagtaggaggttcactggacgtcaggagttcgggactggccaacacggtgaaaccccgctactataaatacaaaaattagccgggcatggtggcacatgcctgtagtcccagctacttgggaacctgagacaggagagttgcttgaacttgggaggtggaggttcaatgagccgagattgtgccactgcacttgagtctgggtgacagagcgagattctgtcttcaaaaaaagaatgggggctcactgtgttgcctaggctggactcaaactcctgggtgcaagtgatcctccttagcctccaagttgctgggactacaaactcatgcctggtaagaacatgctttataaa

SEQ ID NO: 686396 - DNA, 140 bp, Homo sapiens
atgttctcacccacccccatcgagtaggtatctgaatatacagtaactaagctgaagcacttgcaggtgatattcaggttcagggagtgaccgtagaaatagacagctacaatagaagtatggcatagttaatttagttg

SEQ ID NO: 686397 - DNA, 846 bp, Homo sapiens
  misc_feature (23)..(23): n is a, c, g, or t
  misc_feature (45)..(45): n is a, c, g, or t
attctgatgtcggagccgtggcntgccgggccggcgacatggatnccctgttccagcaaacgcacaagcaggtccacgagatccagtcttgcatggtacgcctggagacggcagacaagcagtctgtgcacataggtagaaaagcgagaatccaagcaagcgagtagaccagatattcagccgtctagaacgtctggaggatttagtccaggcaaggagccccctaatcgagaaaggcaaaaatgccagtacttcgggcttgaccagttaaagtatgatgtccagcacctgcagactgggctcagaaacttccagcatcggcgccatgcaagggagcagcaggagagacagcgagaagagcttctgtctcgagaccttcgagccagctaacgactctgacagccacacatagccagatggacgaatcactgcagtttaactcctccctccagaaagttcacaacggcatggatgagctcattggagatgggcacaatattttagactggactgaggacccagagactgaccttgaaggtggggtccctgctgggggacagagagaaggcctcttgtctaagcctcatccaacagattatagtaactgtgttatatacttgtggatgtacgtgtccgtcaaagtgtgactatctcgatgacaagaccagagcccttgcagatcgggatccttgtctgtcggagttgacgttatcgtgagcctgaaaagtacccagttcgcttggccagttgcttgaaacaaaccatgaacgtggcctctcttaggatccaaggtctttcccatttcactgaccttagtcatgaaagtgagtgctacctacgactggg

SEQ ID NO: 686398 - DNA, 243 bp, Homo sapiens
  misc_feature (26)..(26): n is a, c, g, or t
tatttgttattgtgaaatggtgctgntgatgatgtacaggtgcatgtgtctttatggtagaatgatttatattcctgggggtatatacccagtaatgggattgctgggtctaatggtaattctgctctgagtactttgagaaattgccaaactgctttccacagtggctaaactaatttacatgcccaccagtagtgtgtaagcattctcttttctctgcaaggaacccacgcgggtaccgag

SEQ ID NO: 686399 - DNA, 437 bp, Homo sapiens
gagagagagagagagagagagagagagagagagagagagagagagagagagagagagagagagagagagagccgctccgctcgttcgctccctcccccgcgccgtgcacgtgttggttcggtccgggcataataggctcctcggcccacggctcacttggcgctgatcgcgtgtcctcgcgtgtgatcgtccgtgcgtgtagcctttgcccacgcaggtttcattcatggctctccggttacgcgctcatcccgacgccagcccctgacttgcaggcctcaccggcggttgctggcgccttctttgtggtgtccctgccggactcctgagggcatgtcgtggtcctctttttctgccctctggacttcgcttttgtgtgccctaccgagatcatctcgttcagcatccgtgctgaggacttccgccgctgggctgtg

SEQ ID NO: 686400 - DNA, 179 bp, Homo sapiens
cccccgttttttttggggaagcccctgggggtttttggggggggccggggttttggaaaaacccccgggggggaacccgggggttaatttttaccgggtgtggggttttaaccccccgccccaaaattttttttaagtttcgcctttcaaaagggggcaaaaaaaaggggtttttttta

SEQ ID NO: 686401 - DNA, 122 bp, Homo sapiens
cagcataacaaggcattcaggaaatatcctgttgttgtttatcacaactctccctctctgctcttccatcagacattctgcttcaacaggagcactctcaggctgatgatggcaggctcaca

SEQ ID NO: 686402 - DNA, 155 bp, Homo sapiens
taatcaaactaacctcaaaccaatgataccacacacaccactaaaggacgaccctgatctctcatactagtatcctcaatcattttattgcacacctaacctcctcggactcctgcctcactcattacaccacccaccgacctatctataaacct

SEQ ID NO: 686403 - DNA, 129 bp, Homo sapiens
ggcatgcccggaccccggcggctccggagtccgggaggctctggctgctccagtcgcgggtccgggccccgcctctccactcaagaagagacgcctgcattgttattgtggtggtagcggcgtctggct

SEQ ID NO: 686404 - DNA, 201 bp, Homo sapiens
ctgcctcggtctcctggagtgctgtgactacaggcctgagctactgcgcccaacctcaggatgtaaatcttaaaagttactaggccaggtgtggtggctcatgcggtgaatcccagcactttgggaggccgatgtgggcagatcagcagaggtcaggagcttgagattatcctgaccaacatcatgaaaccctgcctctac

SEQ ID NO: 686405 - DNA, 999 bp, Homo sapiens
  misc_feature (251)..(251): n is a, c, g, or t
ctgccctgaggcactcttccagccttccttcctgggcatggagtcctgtggcagcggaaagcgctacattgccaatgtttattggaacgtgtgcagtgcacctacgcagatcaatctagacgtacacttacgatgtgcagtgctaggtcctgacgacatggacgaagacggtacctttgccagcatccgactcaatgaaagatgtagatctagtaccttcggcaacacgagctagtaatgcacaacatacnagcagcgatgtcgttgcgctgcgctagcaaccgataggttactctggtgattggcatcgacgaggcatcgcaacacatgagcatcacttgtccatgggtatccaaagaagaatagtgagactacatcacacgatcagtgatgttatcgatcccatagatgcggccaacggatatctcactgtggttgcaactcgggacggtgctctctacctaccgggcgcgcatctactggatctcaacgcttttgccatttaacagacctcgttgggactcagaccaaaaagcatgcggtagatatttgaccgccaagcacccagaggacaagattgcaaaacttggtgcgcaactcgtgcatataatgtctttgcttatgtggcgagaacgtattgagcttttaaggtgtagcagatttaatatccctgtttcttgggcactaaaaagatccgataagactttggcagcaagaatagtaacacaggacttgaagaatgttgggcaattggaagtaagaattacttgggagagatctaggaaaataatggtccacccagatagatattggatacaaatgtggttgtccacgaattagtgaggttttgtgaaatttccaagagtatatgtaaagaaactagtttaaaaactagaggaacaacagtgacacaaaatactagacgacgtgatatgttgggtaaaacgatgtaacgatcacaattatagcgaaacaaaagattagagcgaacggaccctg

SEQ ID NO: 686406 - DNA, 170 bp, Homo sapiens
  misc_feature (57)..(57): n is a, c, g, or t
  misc_feature (81)..(81): n is a, c, g, or t
  misc_feature (113)..(113): n is a, c, g, or t
  misc_feature (117)..(117): n is a, c, g, or t
  misc_feature (153)..(153): n is a, c, g, or t
catggggaaggacctcactcccatcacgccgtccagcggcttcacgatcgacctggnctcagccttcacagtggtgatcgnctccaacatcgggcttccagtcagcaccacgnactntaaggtgggctcggtggtggccgtgggctggatccnctcccgcaaggctgtgg

SEQ ID NO: 686407 - DNA, 948 bp, Homo sapiens
  misc_feature (3)..(3): n is a, c, g, or t
  misc_feature (86)..(86): n is a, c, g, or t
  misc_feature (167)..(167): n is a, c, g, or t
  misc_feature (233)..(233): n is a, c, g, or t
  misc_feature (267)..(268): n is a, c, g, or t
  misc_feature (271)..(271): n is a, c, g, or t
  misc_feature (287)..(287): n is a, c, g, or t
  misc_feature (292)..(294): n is a, c, g, or t
  misc_feature (297)..(300): n is a, c, g, or t
  misc_feature (307)..(307): n is a, c, g, or t
  misc_feature (336)..(336): n is a, c, g, or t
  misc_feature (356)..(357): n is a, c, g, or t
  misc_feature (360)..(360): n is a, c, g, or t
  misc_feature (366)..(366): n is a, c, g, or t
  misc_feature (370)..(370): n is a, c, g, or t
  misc_feature (399)..(399): n is a, c, g, or t
  misc_feature (427)..(427): n is a, c, g, or t
  misc_feature (453)..(453): n is a, c, g, or t
  misc_feature (455)..(455): n is a, c, g, or t
  misc_feature (504)..(504): n is a, c, g, or t
  misc_feature (508)..(508): n is a, c, g, or t
  misc_feature (548)..(550): n is a, c, g, or t
  misc_feature (562)..(562): n is a, c, g, or t
  misc_feature (579)..(579): n is a, c, g, or t
  misc_feature (593)..(593): n is a, c, g, or t
  misc_feature (613)..(613): n is a, c, g, or t
  misc_feature (626)..(626): n is a, c, g, or t
  misc_feature (630)..(630): n is a, c, g, or t
  misc_feature (632)..(632): n is a, c, g, or t
  misc_feature (647)..(647): n is a, c, g, or t
  misc_feature (869)..(869): n is a, c, g, or t
  misc_feature (948)..(948): n is a, c, g, or t
gtntagaatgtcgaaaataataataatatcagataatcattagtataaaacaaataaaagagagtacaaattgaagacagcctgantatctattctttataaagaaataatgcatgaccacgttttcatctgtcattagcagttggtacttaatagcgatgatttanaattgtatacttaaaacctaacagaaattataatggcaactcagcatatacttgaaacaatattangtgtagtatattgggacatttagtagctttaganngtntgttattacaccattnttaannnttnnnnttcagantattttacatttatatatcataatataanaccattatatatattatttnnccncatatngggngggggttgctacagattcgcttgaatggnggctacaaacatcacaaagaatgagtcngacttccatgtctatgtgtgagagananattctaacaaccaatttaattttaaaagagattaaaccaaagataaatnaganttatccagcaaacaggaatagtaacaactatcctattttnnngtttcagttagntaaattatgtttcaganatctttacataaangcctctaatactaccactcntaaatcataaaangtgncnggtagtatatttatntttttacccaatcacattttagactcataataaaaatctactacttagagaaaataaatttgacaatttattcaaacattgttacataagaagttttaagaaactgtaaataattcttaatactctcattttgattttccgacttctcaagactattttgtacttctttcaaacacacttcctgatgttgtgctttactgttcattttgcaaacaagttgantttgctcttcatttttctttctaagctcagtttccaggatctaatattttaatttgtaaagcactctctctagatggcn

SEQ ID NO: 686408 - DNA, 984 bp, Homo sapiens
agtgtctgtgacgagagcaagtcggtcagatctgtgctctgttgtgtcatctcctttgtctgttgcgctgttgtcggtctagtgtttgtttttctcctctctctcttcctctgtcgctgctgtctggtagtagctagctcgatcgcaagtggggacgcctggcccctgttgcgaggtgccgccgcgcgagtgttgtttaccccccctattgggcgttgctctcctctctcggtgccgggcgcccgtttctttgtgcagtgccccccgccatatctttggttggacaccaattgtccgggtctcgcgtgcccggtccgcgaaaatttctgcgtggttttgccccttgctcggccgcggggtaatctctcgggtctttttcgcgcccccccttgggtggtcccgccgcaaattgcggctggtttctaaagttagacccggggacgcaaccctggtggcaagagctgccctgcctttgtccgcggctgcggaggtgagtagaatctctacgaggtgttcctcctggccaccctgctcagcgccccacataaatgggcctcctctctttattcctaccgcgcggtttttgcggcgcacacagaggaattatctggccgcctctcctgtctgggagcaaaagttcgcccttgtcaggttctggcgaccgagaacacccctgtggtctaacttggtgaaactgcgcacgcacagtgttctcagagtgacgccccccgagcgcctcctcgggggatgttacgcaagtctcccgattgacgccctttcgtcgagacaatcgagggagagtaacaattagcaaggtataatagaggagaaattttctcccccgtctccttctattccatgttctttcttgattatggctttttagcaataggatgtgtctccgagtagataactttaagggaaaaagggggaaaaaatcccccaaaaaaccgggtttccagggcaagtttttttcaaaaaaaa

SEQ ID NO: 686409 - DNA, 156 bp, Homo sapiens
  misc_feature (17)..(17): n is a, c, g, or t
ccacgcgtcctcccaangcttttgagtcagggacttgaagttgtcgactttgtcgatgaggcctgacgagaggaaaaacctgccaatttggacaaagggggctgttgccgtgaatgactccactgccatggcactggggttattgtggccaatctc

SEQ ID NO: 686410 - DNA, 265 bp, Homo sapiens
gctggtgcctcgcacaggcggccccgcgcttcctcccccaccctgtggaggagagagtgtgtgcccggtttccccgttccacctcccctggtccgacgagcgataggggcaggtgggcgggggcggctggtcgcctggaagggagtcgccgcaacgcaccggccgcccgccgctctccgggccctggcgcggggctgcggcctccgggtatggctccgccagggcgagggacggtgccgggcggagcaggacgcccagggggaga

SEQ ID NO: 686411 - DNA, 651 bp, Homo sapiens
  misc_feature (41)..(41): n is a, c, g, or t
  misc_feature (47)..(47): n is a, c, g, or t
  misc_feature (132)..(132): n is a, c, g, or t
  misc_feature (481)..(481): n is a, c, g, or t
  misc_feature (486)..(486): n is a, c, g, or t
  misc_feature (489)..(489): n is a, c, g, or t
  misc_feature (518)..(519): n is a, c, g, or t
  misc_feature (637)..(637): n is a, c, g, or t
cggggagtcgagagctaacgagcaagattaagcccgactgntagagncgagcgaagcgatgcctaaatcaaaggaacttgtttcttgaagctcttgtggcagggattctgacagtgaggttgacaaaaaggnaaagaggaaaaagcaagttgctccagaaaaacctgtatagattctttttgagtttttggacttcgagagccctaccatcttttaaacagcgcagaagcagcagagatgataacattttttagattggtttaacgaggaacaaaagagttccccatgtgaaaggcatagtgctccgggcaattagaaaatcttcactggactctgatggtctttcgattccagacatgacaaaacaaatgtattcccatgcggcccaacccccccagctgaaaaccccctttttttggatttttggcttagaggggattaggaaaacgcctaacaccaacgtctatccttttcccccgcntttcnacnccttcttctatcttttcttccccttcagnnctttcaccttggtcaacctccttactgcaacattcctctccttttattgtgcttctcctttctttccttctttctttctttttttctttctctcctcctttttttgtcttaattatgnttaaaaaaataaca

SEQ ID NO: 686412 - DNA, 377 bp, Homo sapiens
gacactgaatggacttcagccaccattcagtaattcaaggacagatagaaagagaatctttctcgtcctcttataacagaaagatagacgatggagacggcaacgctttggattgcaaagatcatcagccggtgccccaggtgaacggctttctcatctcctcataggcttcagagcttctcgatttcactagacgaccagggcctcgtgcacttgatccataaatatcttgagcaccctctgctgcttcagccacgtcatcgctacttcctctttgataactagggtcttggtggatcatcagtataatatctacctctatagagagggtgtgcttcggactgcttcagaaccatatcatgttgataatgtgatag

SEQ ID NO: 686413 - DNA, 132 bp, Homo sapiens
cggttcacataaggcttcagttgcccgggtagtgcttcacatagtcatccttgcccgcctcatagtaggtgtagatgagggagatgtattggcagcggagggtcctccacgccgtcatacaccatgtccacc

SEQ ID NO: 686414 - DNA, 675 bp, Homo sapiens
  misc_feature (321)..(321): n is a, c, g, or t
  misc_feature (368)..(368): n is a, c, g, or t
  misc_feature (370)..(370): n is a, c, g, or t
tgaaggcgaagaacgcaaagtgagaacatggagcgtaatatcgccccactcgcgcctgcgacgatttcttccgggtccgatcgctttgccggctgacttcagggactattccaaatgaacaacgcgtagtggagcaacctgtctattaccagaccaactacctgtgtgtggctgccatgatgatttccatgtggggttcttgagtcccttcaacatgatcctgggaggaaatcgtggttgtgctggtgtccacagggtttgtgtgggcagcccacaataaagacgtccttcgccggatgaagaagcgctaccccaggaggntcgtaaatggtggtcatgtgggcgagctatttccttatctccatgtngnagggagtcatggtcttggtggttggcataacttttcctttgctgtggatgtttatccatgcatcgttgagacttccggaaccttcaagaagcaaagtggagaataacattggaagcgaataggtcttgaagagggacaccgagtgggcatggtcctggaatgccttaaaacagcaggaagaaggcatcaagagactcaatgatatatcagcaagtgaaggtataaacataatttacctgagctagggttgcagcacaaattgagttgcagcttgccttgttcagacctatggtctggtgcgtaag

SEQ ID NO: 686415 - DNA, 302 bp, Homo sapiens
  misc_feature (56)..(56): n is a, c, g, or t
atgttaaaagccgtggggctggatcatcgtgggaatcaccgcccatctgaactttnctggcgcgaacgccagcgtgttgcgattgcccgtgcgctggtgaataacccgcgcctggtactggcggatgaactaccggtaacctcgatgcggtaacgccgacagcatcttccagttgcttggggaattgaatcgcttgcaggcaccgccttcctggtggttactcacgacctgcaactggcgaaacctatgaacccccaagtaggaattccgtgatgctcgtctgacggcggaactgagcctga

SEQ ID NO: 686416 - DNA, 318 bp, Homo sapiens
tcgacgtctacaggatccccaaggctcgaaaagggggccgagtaggggcccgagccgtggtcgtgctccagtggagaactgccggttatacttgtggcatggaatgtgctgagccactgtcgtgcatgatcagagcgcttcgtgtctcttcacccccaggatccggtttgactgcaccagtgagatcgggaactgaatgagcttgttgacgactttctgttgctgggcatgcttctgccgaaggctggccacctcccgccacagagcctcattctcatgcttcatggccaggagcttggagtccatgcactcctgctt

SEQ ID NO: 686417 - DNA, 1071 bp, Homo sapiens
  misc_feature (121)..(121): n is a, c, g, or t
gctcgcagacgaggggagagtgcgcgggccgcgtgcaataatgcttccaaatactgatgctccaacacacagttcatcctagttgaacacgcaggaggactgaatagacgtccgcaacggncatccgcgccagcttggtgcatgtaacatcaggtgccttgccacggtgagttgcctcggaggctcgctgacagacactacccctggagtccccgctgcggcagtgggaccaagcttcattgtatgcatggcagagcgtcgaagaggcgaacaatatctagtgatggggccactattctgaatcttcgttgatgttgtccatccatgacagctagatggacttcggctagacacttgccagagtccccaagatgctgaggtgccgtgatcggcaccagcctcaggtgacctatgcatggactgctagaagtttctgaagcacggtgaatacctctatgtggaagcgaagggtcttaggacgcccgccagatcatcgattgctgaggctattccaggtgagaggccatcccatgctggacagttaacgaagagtccgaagacgattgcgtgtgaccagtgaacggaagaggcttgatttccagtcggatgcagcaggcaagctggctggcatccataggtgtcgcccaatgaacccgttcctgcatgctacccgacagggctggcattcgttcccaagcttggcaaagggcgtctactttgtggcttgaacgcattcgggttcgctcgcgattgctcgatggacttgaaatgcttctgaatgaatttgtgcgtggcacagatttttgaaggaaatggacttttgggaagatccaaaggaaacggtaacaagggttggggaaggcccttacggaaggaatttcttcaaagactgggtaagcctggggtgttttcgcatccaaggcgagaaggaactttacactccttaacaggcaaggggtatatggaaaatggagaaccccaagaaaatgtagccagagaagtcccccgaagaattggcccctttctggaaatgttccgaggccaccgaggtgttggaaaggctggagacac

SEQ ID NO: 686418 - DNA, 825 bp, Homo sapiens
  misc_feature (9)..(9): n is a, c, g, or t
  misc_feature (83)..(83): n is a, c, g, or t
  misc_feature (92)..(92): n is a, c, g, or t
  misc_feature (111)..(111): n is a, c, g, or t
  misc_feature (138)..(138): n is a, c, g, or t
  misc_feature (168)..(168): n is a, c, g, or t
  misc_feature (176)..(176): n is a, c, g, or t
  misc_feature (203)..(203): n is a, c, g, or t
  misc_feature (211)..(211): n is a, c, g, or t
  misc_feature (256)..(256): n is a, c, g, or t
  misc_feature (268)..(268): n is a, c, g, or t
  misc_feature (384)..(384): n is a, c, g, or t
  misc_feature (396)..(396): n is a, c, g, or t
  misc_feature (400)..(400): n is a, c, g, or t
  misc_feature (412)..(412): n is a, c, g, or t
  misc_feature (568)..(568): n is a, c, g, or t
  misc_feature (576)..(576): n is a, c, g, or t
  misc_feature (611)..(611): n is a, c, g, or t
  misc_feature (653)..(653): n is a, c, g, or t
  misc_feature (677)..(677): n is a, c, g, or t
  misc_feature (820)..(820): n is a, c, g, or t
aagggcctnccgcagccctcggcgctcaagccgcagccccacccagaccaggcgtgtgtgctgtgctcctggcaggcagggcngagaggggngggagggcggctgggtccnttggagtgggggcgggtcagaggaganacagcaacttcctgcccctccccacggggncgtgggcncaccatagaccacgtcctgcattcccnctgattcnctcacggggagagccctggaccttctggtggtgtcccagcggggngggttcaaggcngcgaccccgcttggggcagcgggcctgcagggaagggccagacggcacctctcagtggagactgaatctcccttccttcaggaggctgcctccagggaagacctggggtccttccngcactcagcgcnggcnggctgtcctgtncatgcagtggaagacattacagaagaattcatacgagaagaacatgaagcctgtggagagggcagccttcagcaagcggggggacaggcccttgaagaagcccagggcgcctcccttttgcagcacctgcttggcacagtccatgaggcccttgtntctccggncctggccaaaggcagcgctggcatgctcaaacccnccaacctgtagccgcttcttgaagaggtccagcggatatgtnagggtcttgctgatgacaccagcnccactgccacatagcaggttttggaggttctcatttttctttccttcggctggtatggcccacttgttcaggtgcttcaaggagctgtagcaagagaactgcagcccggcgtaggggaagatggcgatcaaggtgggagcaanccttt

SEQ ID NO: 686419 - DNA, 1072 bp, Homo sapiens
ggccgcccttttttttggttttttaaaagataaaactttacaacctgcacattaggttatgcataataaatggtgtgttaaaattaagggtttcttgtgcctctctacactacactaatcgtgcctcaaagggtggtgtgtttcatatttataagtgctaattatcatacctacctactttaaattttaggtagaaaaataatctgatattaaatacaaacatatttttctcacattgagttaatatgcataagtgatagttccaaagtgttatttcattactatagtcacaatatccaactaaaaattacgctatctaaaattgtaccaaccaaaatctcgttatttggcagaatctgtgacgggcgtggaccgtgcaagaatgtggcttgaatttaaccatttattacataatctctagatgatacatgcatctagtaatcataagaaaatactatcaaagaggttcggtgcgctcgacacccacgcacgtggtgcagggacaaatacttaaagtatatacacacaaagtgtacaactaactgtgcaagaagtaataaacgccacatgggcaacagaatacagaaaaattagagggaaccctggccaaaaaacagtgcccctcctgctgcatagcaaacccataaaccaacacaacaaaaaaagaaaaggaggatgagccccgaacactctgatgcacgtgaaaggggcaccaccaaataaccaaaaaaagcacagaggcgggaccaaaagacactgggaaccaaacacagcaaacacacggacacgataacggaacacatctcaccctacgaacccatcaaaaccaatcagacgccaaaaagcacaccggcagccgcgcaacaccccaaccaggtcgacgcaaaaacaatgaaatgaacaggatactaaattatcaggagatcgggcagagaccacatcgtagcacacaacaacgagaaagaaacgacaggcataacccacaacaacggtggtcatagcatggcaaccctgcaggagaacaaatagaagcagaaagaaggagacaaaactacaagccacacagacgcga

SEQ ID NO: 686420 - DNA, 908 bp, Homo sapiens
aatagtacggtaaaactggactatttgaaccttccagaaagagtatatgtaactgtcaatcaatgattattcattcttacatgtgtggactactaatgtacctccagaagccaataagatatagcattgactattggcctcttatgatcttaccacgaataatactgctagcaccttgatcccaatagaaatgtccatatcttgactttctatgaccacaggatggcaggtcacctgttattctcttctcccacctgaattcttgaccatctactcctatgtgtcttcaaaggtcatgtccctttctgccttgggagtaactcaccactcctgtcattaattttaatcacctgcaccttgctgattacctctactttcttttctcttactgttctcccgtgctttcacacttatgtaattttatggagaaagttagcagtttgatacatttcaatctatcagaattattccctcatttgaaccaagcactcataggtatctggtacttgtcacgagtttgtgtgattgtggcggggggttgtgcctgagttcattctctctctctctctctctctcagaagaagaagtatacgacacacattaggatacagacagagatttctaagaatggaaggtctgggttactgaatgtagaggctgagtgatattgaggggggcctataatacaccctttaattcctccagaaagatccaaatggagggctttggccaacacaacacactgcggccacggcacggggtcacacattttgagggggcgttctttctccccgggcaagcgtggcaccggtggggcacactagaaaggaaaaccctctctggtctggacagggtggggccaccacggtggagaaagaaaaacccaacacgggcacaagaagagaaca

SEQ ID NO: 686421 - DNA, 896 bp, Homo sapiens
tcctatgtactaggcattattatattgattgacttacgaaactctatcttcaagtcattatcaatctcgggtttttttgtggtgcagtggaaggagaaataggtctagtttctgcctctgattagccgcactagccttgcaacaaatcacatttcatctttgaacttacctctactgttagactaggcgactcacattttgaggacttttctcgggtatctatgagggtatgtagatcctgaacccttaaacagtgcttattaggttacacaggagggcttataatggggggatgaccagtacagacatgccagttaagtttatactagtgggatcccaaatccaaagcagtgtacgtggtgatatggtcagtgactaaccaggcagctaagacagtcttagcgcagcagcccagacatgtatagaggggcagtaagacgggcagaacagggggtggcaacagggagcacagggggcagatagcatcagcacaggcacagacatgcgcctcaagaacaaacgagggcctgcactgggcaggcattgcgcgggcccgctacagtatggcgcaggggtacgaaacgacacgtaaccattgtggaactcggagttgcaggaattgcgctaggttttgtcactttgagatcctgaaactatactgggagtataggatgataaatgatttgaaaaagggcgttagagaatacttcacattgtagaaagtttaattcaaagcgcaaggtacggtttgacactcactttacacatggacaaacattatggtggctcttacacacactggacggttaccaacattttaaaaagggtagcatggatgtagcaagttaacagcaacaaaattcaggcagataatagtactcgcaagaaatggagat

SEQ ID NO: 686422 - DNA, 195 bp, Homo sapiens
ccgcctccacccaccccagccggggactgtcattttctcagtacacaaaggagagaaaggaaaaacaagagcgagaaagacacagggagagaaaaggaagagagaaggaaagaaaaaagaaagacacaggggaaagagtggggtttactcatgagccttagggtgggcatgagttgcggggtgggtggagagcgg

SEQ ID NO: 686423 - DNA, 241 bp, Homo sapiens
ggtgagaaatgagagaaagagtgaaaggccttaaggtggaggtacggtgtcgtggttggtttgtggagatgtttaaagaaagacccatggacccactctcttgccctcatcttgtgcccgtgaaaactgcaggctcagccagcaaaggcaggagaagcagctggacatcagagagaagtgccttacttcagagggacagctcgcacggcgcatcttccacgaagaatcccaggagacaggt

SEQ ID NO: 686424 - DNA, 307 bp, Homo sapiens
  misc_feature (280)..(280): n is a, c, g, or t
ttgccagtttcatgacagagtgaagagaagaaaaaacaaaataacaagcatccaaaaaacacagccaacctgtgcagccccggacagcgcatctccgggaagcagcaggcccagggtcccacgcagcccaaccctccagcatccatctgaagacagaaccacgcccactccaggacgggccatttcctcggcctccctgggaggtctgaaaaaccagcggccactcctgcctgcctccccactgcccgagcctggacgtgaaaactcttaggccccctcncctattaacgaagctgaggcgcggccc

SEQ ID NO: 686425 - DNA, 227 bp, Homo sapiens
gtgcagtgtattgccgcagtaacaagaaatagaccaataaacaagacataatgaataacctggagtatgtactgctgtggtgcaatgccttttgagatcactgggatgcaggttcaatccctggcccggaacagtgaattaaggatctgatgttgccacggcttgcggcttagcgttgaaatttgtggcttggatctagatcctgtcattgcgacatcggtctctca

SEQ ID NO: 686426 - DNA, 256 bp, Homo sapiens
gagacggagttttcgctcttgttgcccagggtggagtccagcgcctcactgtggactcaatgttatgggtttaaatgattttctttctcaaggcccctggagtagctgagactacaggcacacaccaccacgcctggctaatttttcattttattttttagtagagatgagggctggtgctttttgttgttgttgttgttgacagggtcttgctccgtcgcccaggctagagtaagaccctctctcaaaaaaaaaa

SEQ ID NO: 686427 - DNA, 273 bp, Homo sapiens
  misc_feature (28)..(28): n is a, c, g, or t
  misc_feature (105)..(105): n is a, c, g, or t
  misc_feature (219)..(219): n is a, c, g, or t
ccctcaaagtgagacttcatgacgctgnttactgtcgggaaaaatcagtgaaagcccaggagacaccgtacttacgccgctcattttgataccagcgaacataancctgagcactgttgcctgtaacaccatttttcattgcccgtaatggaacgcggtgagagaggcgttccagttgcgaaccaatacgccagttatcattaaaatcataccagccanacaggcgcgcgccgggtttatgctcatgattgaaaacgcgttcagcgtactctg

SEQ ID NO: 686428 - DNA, 1005 bp, Homo sapiens
cgatacgtccacgcgtccgtggagagcctgctgtggggttatccttgcgtcagagtcatctccagggccatgataagtctgtctctagctcctctgtgactcagaaggggaaataccgaaacgcttcgccagatcttcacactgcgcacacaggggatagggagggtgttgacgtaatccgtaaccaatcgaatgcggtatcgactagttcgatgcccatgacgcacttcgggacgatgcgcgactcagctgcgcgatactgcgtattcgggtacaatagaggggaaacctggggtagctggccacgccagagctgcagagtgagtggggcgaccgcacaagacggctgcagtagccatggctctggggctagtggcatggatggccatgtagggcacatctgacgtgccgcactgtccagacttgatgattggcactgacagggagtcctaaagttctgagacgaggcgagcatgctgtccgcaggcatggggctagaggacatcgggaagggggaccttgccctcgctgtacccctcttggttgcagcccacgtgggactcgaggtctttgacctgttcttttgtgccattgctggcgtcccaagagggcgaaggtgtcacaactcgtcgggggaggcagacggggacctagttagtcaagggctgtggcacgtggtagggggccccattggtgcgtccgaactgttgtcgttagggcagctgggaggagaagagcaacttgtgtggcagtccctcctgctagccactttctggggctcctgaagaacttccccggtgaactccacacacaggtacgcgctccttgtccaggggagaggggcctggaggcctagatgggcaggccctcttcttgggggcggggccttgggacctggatgaatgtcccaacctggagaacgcgacacgggaacaggtgtcagggctgttcggagacggccttcggaaagcggaaggggttgctggcgaggcaaaggactctggg

SEQ ID NO: 686429 - DNA, 657 bp, Homo sapiens
  misc_feature (365)..(365): n is a, c, g, or t
  misc_feature (419)..(419): n is a, c, g, or t
  misc_feature (427)..(427): n is a, c, g, or t
  misc_feature (482)..(482): n is a, c, g, or t
  misc_feature (487)..(487): n is a, c, g, or t
  misc_feature (547)..(547): n is a, c, g, or t
  misc_feature (573)..(573): n is a, c, g, or t
  misc_feature (624)..(624): n is a, c, g, or t
ttttctaccattttattttagtgtccctagatttgctttgttttcatatttatattgaggagtttacagagcttcttgaatctgtgggttgaaacatagctgcttttgaaattctcggcctgtatttcatcagacatttttcttctgtctcaatttctctgcaactccacttgcgggtatgtttgacctctgctatgtctttacatctcatacgctcttctataattttctccctatttgtgttccaatctgctctttattaccgacctaatttcccgttcaatgtttctcactggtagtatttacacctgatttttaaatcaatttcaggtatactataatatttgcaatcttttcttctattntcttatatttattaacagaagttattttaaaatctttgatcattacgatgtctngataactngagtaaacttttaaaaatttcttttccaggttcctctctgtttaaggtatgtggntgatntcatggaatgtgtcttattttgtgttgatgccagtaggtatgtgttatgagatctacatngatatatttatttcagagagactaantttgttccatagcaggtgagtaagaaattacttgcatggtcagaactgcgnatttcctgtgcttaatttgctaggaccctttgg

SEQ ID NO: 686430 - DNA, 1077 bp, Homo sapiens
  misc_feature (2)..(2): n is a, c, g, or t
  misc_feature (357)..(357): n is a, c, g, or t
  misc_feature (900)..(900): n is a, c, g, or t
  misc_feature (941)..(941): n is a, c, g, or t
  misc_feature (1009)..(1009): n is a, c, g, or t
  misc_feature (1011)..(1011): n is a, c, g, or t
  misc_feature (1026)..(1026): n is a, c, g, or t
tnctggaaagagacatacttctactctcttccggctgccgtggacaatgggaaagggcctacccttcctccttaggtgctttttccaaaagacatcccctatgattaaatgacatttgtctgcggttatatttttgaaggctagacagcaggcatcctctcttctatacctccaccctgcaggccactttacaggctgtcaagggatagcttcccccgggagtgggagggagagaggacgtggatacctgctctgcttgataatcctgcgccttctcctgcaaggccctcaggcgggcgatctccttctctttctccctccggattttctcctgctcagcttcatactctgcctctngagcctgccgggaagaaaaaggcttcaggataatgcacaccattgcagctctgcacagagaaatgcaatctgtacagggaacgtgctttccagcatcttcccttccacttccttgctagatctaagatgggggtgggactttagcaatgcacaaacaaaaggaaaactagcctttgtagaaggcagccgtggcttacaaaaagctttctcgggccttatcctagagagctcaggcagcatctcatcagacagaagctatggatgcccaaactgttttgaacgcaggaatcctcagccctggcgctcctactccttctgtcacactgaagataatttcaagttgcaaggccacagagccaagtaacaactgtggttccctgccttgccttgtaaaatgcagcaggtagatgttatctcattagtgcctgggaaaactgccaactgtgctttgggcaacccacagtgcttagcagatacctcaagagtaaaccatcaaaatgccgtcccttttaccacctctgggcaagaacaggagtgaataancccaaggcttctcaaccactgcgcctagagcagtcacatgntcacaggcacatgttgggtggcatgccatggtcatcccatgaagactgtcccttatccctcattattntnccttcccagactgcnaagaatccccgggagttgcctattttggggttgtgctccacagagtcaagc

SEQ ID NO: 686431 - DNA, 1174 bp, Homo sapiens
gggagcacggacgatctcgccggctattacgttgcacctcggatgtctagccacgcaccctaccgctatcctctcctaggcgaccgagacccagtggctagaagttcaccatggctctatatctacaatgatccatggccagggacgatcttagactactacgcgggcaatcccgactagtatgaggtatgatctactatcacctacaaacaggtactactatcagcaggctgcctcgtagcctcacgtggctgctatccaacctggctactctactgaccgcgcctctagcacgccatccgcggcaccaactgcactacaccgactcgccttactactaggggacacgcggctgtactcaacacgcgcctgcttgcaggccaccatcacactacacccactactacgccgccctggccccatggccacagccacacgcaaacctgcacacgctcacacgacaccaacgagaacgcatctgcacacacacctgcactgcacatcagacgcactagagacctgggcaacacacgaaaaacactaacactcatacacgacccaagcgctgccgcaaacgccccacacccatgcgcgagagcatgctccccagtagcccaggccacctgcacaaccgccacaggaccgcccagagagcacgaacacgcggagcgagatacccaccccaaggcttacaacacagcccaaccgacatcagccaagaaccatcaggagcactaggcgccacaacccgaacccatggacaacgctcgaggaccgctaggacccaaccgtcacacagcgcggcataccaaactagctccaagtacaaaaaaggccgacccgggccctacacccccgcaccgcggccactgcgcgacacaaatcaacaaaggcaactgcgacacaaaccggccccacggcaaccgccaaccaacgtggccacaccccatacccaccaagtgatacgtgagcatgaccacaacgcaccaacacaaccacacaacagccgcgccaaacacgcccccacaccctgacgcgcgcctcactacagggccatccaaccacgcgaaccgcgaccttgatatcaccacacaaccacacagcccacttgcacaacccaacaccgagatctcgaccaccacaacgagcaccagcaacacacacaccaacgggc

SEQ ID NO: 686432 - DNA, 287 bp, Homo sapiens
ccgcctccaggccctggccccgccccggggcccacccctgagctgttgtagtgagggcagtaaatatccagataatcgttcacattcacctgcaccgtgtagccctctcgccgcaggctgtggggaaaggaagcgggtcagagagaagaagcccaaagccaacccgctttccacctcaccgctccgcagaccttccctggggtcctccgagccttccggcttttcttccgagcggcctctagtctcactccctatctccatcctcggggccctagtgccgccagtcc

SEQ ID NO: 686433 - DNA, 399 bp, Homo sapiens
cccacgtcccccgcaaggacggtggtagattcctcactgaggccctggcgtgggtggtgctggctggtgacactgttgagtgagtacaacctggttggctaccggaggtggtggattcttcaccgacgcctacgcttgtcatgctgcgcaggtgagagtgttgtggttggtgatctggggctgctgctagatggtggtagatgcctctacttgacgcctggtgttctggtacttgccaggtaacgttgttctttcacttcagcctggactgatgcatgaggttgtatattctccacgacctgaggttgtggagtgcgcagatgatggtgttgttccacttgcatctcggctgctgtggcctattgtttcatttctcactgtggtccgaacttgtgcatc

SEQ ID NO: 686434 - DNA, 230 bp, Homo sapiens
ttctagtagcattcaaaatcttcccattgtttttttagtcttcaatttcactataattatcagcaataattttcttttccttatcttttctcttttcttcttctttctttctttctttctctttcttttctatactattttcgaaatatgttcctacatcttgttcacccacagctggaagtgcacattagtgacacatgtttgaatctcttgagagattcctctacagg

SEQ ID NO: 686435 - DNA, 188 bp, Homo sapiens
tgaagccactgcggtgagcgacgatcccttcgagtacgaatgctctattccaggatcgaccatgatgatcctgctcaggaacaacaaggaccctcgaaccggagaggaaattggaggggtaacagacctcaacccctacaaccaacgcttcttccgatgcaaccgaaaacaggtagctctgagccggg

SEQ ID NO: 686436 - DNA, 1481 bp, Homo sapiens
atctcagctgcattgtaaacctgttcctacacatagtgccttaaactatttgaggttgttaatgttattacctatatataaatgctgaggacgtgcagcacttaaaattcagacctactatttagtttccttttgatagcgtaatgtccatttcgtctccgagtggctatgattctcaggtagtagcctgttttgtttccttacttcacagcagggcagcatgtcggctatacgctgaattctgctgctctgattttctcagaatgactctagcttcaagaaaagcaagcacgttacgtacgtgcttaagaacaacattgattcagtatctaactggatacgtcgactacactgtcacagcacagcattttatactcctgttaagtgaaactgcaataacaaatctaacgcccactccccgcacgagctgtctgctgtactacacttcggacttaatcacccatgtttcagagcgtaccagtagggcatgaccttttggggtacgattacataaaacatggcaaaaattgctacatttgatttcattgacatcgtgcgcccacaatccatcaaggctttgggtcacaacccaatggcaagaaacttctcacttcacactaagtacgcagaaacctttttacctacattggaaacgccattggacccaacgcaaccggctgcaagcctaccctcacggacggctggcacaacatagtcaggacatgtaaactggcccatgtgtgaaacgaacagcggcgcacaaccgcccacacccaactacaccagcgcgacaattcaccacacaccactttgtgcccaccacacacctggcgaccacggcccccacgccacggcgccacgacagggcgcggtccacacagcccgacaatacaagataccccgggacaccggccacacagaacaaagtaacacaatggctaacatcagcacaccgcgtaaacaaagaggaagcgaagcggacgcacgagagatgcaccacccaactatcaccgacggaaagagatgcagatacaacgaacatcaaggggcaacggacgaccatgaccgggcataacgcgcgagccacactagcccgacacgaacacaacaccgcgcacacgcatggaccactcacccacgcacacaccacacaaagcacagaacaaagaccaacaacacgactagctgaacacaatatcaaccgggaggcgcaacaaccaatgggtaatagaaacagccgaagcagacaacactgccgagcgggtatccagagccagactaaatcaccggagacagtagacacgactaagtcgcgcaacacgcacacacgacccccaccacaccgagacatgacaccaccaacacagcgcgaaaccagacacagacagcacatggctagtcccaccgtacgccgagcaaacacgactgaccgaacacaggcaccacgcgtcaccgccagtcagcaacagactacagaccaa

SEQ ID NO: 686437 - DNA, 280 bp, Homo sapiens
cacgaggtcttctatagagtctctctctctcttttttttttaatgaagagagtttttgtgtaatgtagtataataaactacacatacttttacaggtacagatttatgattatggcttgctctggttaacacgaaaggtgttgctttggccagaccatattctgtgaaagacccatgattatcacaggtggccaaatgctttgaaagactctgggcataacgttccttttctggtttttattatcaatcttttcacttgtgactgacagctggcagtgtc

SEQ ID NO: 686438 - DNA, 408 bp, Homo sapiens
gacaccacaagataccaacagagcttctgaaacagatacccatagcattggagagaaaaacagctcacagtctgaggaagatgatattgaaagaaggaaagaattgaaagcatcttgaagaaaaactcagattggatatgggattggtcaagtcggccggaaatattcccccaaggagttcctctttaacacccgaagcgcacggccacctcagcatgaggaacacgagcgtcatgaagaaagggggcgtatctctgcagaatttctgaaagtttccttcctctctgctgctttctcatttgctggccatcggattggggattctatattggaagcgttctgacacctccaccagcacttttgatgaagaatggagtctgacttggttcgttagtggatacttctgag

SEQ ID NO: 686439 - DNA, 418 bp, Homo sapiens
aggggatgtcctttccagcctggggatggaatatatgagcccaaccaaaacctgagtgggaggctgcgggcccttttccaaaatcaggaaaattaaaggatgggcctcagtctttaaggaaggcaaagccctgggttgagcctcaaaataaaagatctttttccaagaaatgcaaacagggtgttcccccccatttccaggtgttcccagaccccagcaaagcaatgccctcctggccaagtagatttttttaaaaattagagggccttcctttgaatcaaaaatttttttatttttcaagaaaaaaggactaagattgggcccaaaacccaaaaaagtttcaaaccttctaatccagcgccaatttgaatgggttttgtaggtaaaggaataaaataaaaaactaaatctttttgta

SEQ ID NO: 686440 - DNA, 480 bp, Homo sapiens
ggctgctgagtctgatgttctgcattcccagtttgaacagcaaggagatgtggtcttgcccaaaatgaatcttttgagacagcacaatttattttgcgatgtatcaatttacattaatgacactgagttccacgggcacaaggcgattttggctgcttgctccacttttataagagatcagtttttactcacacagtcaaaacatgtcacaatcaccatcttacagagtgcacaagttggcagaaaattgctactgtcttgctatactggagcacttgaagttaaaaggaaatagcttttgaaatacttgactgctgccagttacctatacatggatcacattgtggaaaatggcacggaaactttgtcaaagtatctggaaatagatctttttatgaaaaacaacacccaactcactgacctgtgtcattcttctgatcctgttgtcaaaaatgaagatgaaaattctgataaagactg

SEQ ID NO: 686441 - DNA, 430 bp, Homo sapiens
  misc_feature (5)..(5): n is a, c, g, or t
  misc_feature (12)..(12): n is a, c, g, or t
  misc_feature (53)..(53): n is a, c, g, or t
  misc_feature (213)..(213): n is a, c, g, or t
  misc_feature (264)..(264): n is a, c, g, or t
  misc_feature (333)..(333): n is a, c, g, or t
tcgtncatactngagcaagcaagacactgacaccttcaggggacttgcagganaccttcagtgggatggatcaggtgaaggtgatgaaaagaattgcagagatgacagacatcaagcccatcctgagaaaactgccccggatcaagaagtatctactaaactgtgacaacatgagatgctcagtgaatgccacccgtcagcagatgcctcagnagaaaaagaggtggaaaacttccttagaaatgttggccgaagcaaaaaggnacggaagcctgtccgcccgcatattcgtcgagaaacccacacccagtggccccagtggagctgcacatntcagtggggtcccagatcgtcagaaaattggtgacagaccccaccttcaaaccctgccagatgaagacacattttgtgctgcccttccctgtgaata

SEQ ID NO: 686442 - DNA, 158 bp, Homo sapiens
agagcattcagtggcgctagtctggtcttatctcaacggatggaaaaagctgaaaacacttgtgatggtcacagcccattggcccagggtccctaaaagattgagatttcatccgtaaggtggatagaattcctccttcacccattcccttcaccacc

SEQ ID NO: 686443 - DNA, 439 bp, Homo sapiens
aattcggccataagggccggggcctttggaggccgggccaaaagggtttccaaaggctgccggatcccggttctttggattcaaaggctttaaggctcttcttcgggccggaattcaaaagccggttgaaccccaagccggccaaggccgggtagaacaatccaaactggaaccatatggaccaaggggtttaaaaccatggcaatgcagaagttgaaattaacatcctaaaggcagaaaagaaccgacttgccaggcaaattttaagaattaatttaaagaacggaaaattggccagaaagcgattagaacggtttggaccggattttcaaattattaggaattccttagggccctgggattatcagttaaggaccatcaaactcattaggaggtccagacctgcttattgggggacctaaagggtccagaccactat

SEQ ID NO: 686444 - DNA, 558 bp, Homo sapiens
gttcgacggaagcaatcaaggaagcgagttatacctgttgattcttagagcgatgagtgggacaggagagtctgtggctgctgtgagggtgaccgaggggcgatggacagtgcgtccttggtttcaaggaggagattgtcccagggaggaggaccaagtcaacgtgagcagctgtgtctttggggtttcgtgaggcaggggtataaggtcagttgtttcgtttgtttttacatagcaacagtaaagaccattcactaggtccccccgtcagtgtgagcatacccagtatgctagagaattgacacgaaacctttaaatcatggcctctttcattaccaaaacaaaacaaaaaaagggaaacaaaatacgatgggagagggaagagatgatgccgaagttgtcatcctgagtgactgtccctgcagtgaccatggtgtcccgtgccttattcattcttcctctctcatttccacgatgtcttgtcacctcctctgtcggaggcatgtctgccatggcagaatttaccccctcggggccgactcattctccatcttctta

SEQ ID NO: 686445 - DNA, 722 bp, Homo sapiens
ctgatctggggctctcttagtaggaaccctgggtcttggtggctgactccggacagtagggaaagagtgtgcagtggacagctgtgggaagaagaaaaaagcaggtccagctacgatttgggaacatgtggctacggatgacatagatgagatcctcgtggcattcatgtgaatctgtgggttgtgggtggtggagccacagcacatcatctggccacggtttgggtgttttgatgtctagcttgaggacagtgtcctctctagactgtgccgtgtagtcaggcaattggatgtctgattattagggtagcagttggtttgggatagctaagtactcccgaggggataataatagttcgatatcttttaagaaaataacgtccagggataataatagttcatatcttgtaaaaaataacgtcttgaatatacggataaagtgtatatgttaagtagtagtaatagcgcaggttaatagtaggtcagtaaatacagagatgagaacattcaggttgggcgcgagagtgctcacacctgtagatcccagcagttgggagttgaggctggtggatcaccgtgaggtcaggaatttgagatgcatggtgggcggaaccgggagaatccgtgtgtactgaaatacggaaattggcagaagtagtgggcatgcacctgtaatgccaggtaaacgggaggtgagggggaggatggttgaaccttgggaa

SEQ ID NO: 686446 - DNA, 338 bp, Homo sapiens
  misc_feature (328)..(328): n is a, c, g, or t
ctgggccccgtagaaacagacaggacagggtctcagcagccccagggtgataccggtggcagggtgctgggcttagaaggatgcgctgggtcctccggctgtccccactgtgcttgtttgtttaaacgtctgaagggcaaacggcagagcatcaacttctggtagctccgaatggtgggtccacgggcatttgtgacggtctcctaggtacagtttatacattggaagcatttttgtaattgttaccagcagtcacatgcaggcggtcacatcactgcagggccaactggactgtgtcccgggcagagactgaacacgtgcacacacntacccagagg

SEQ ID NO: 686447 - DNA, 231 bp, Homo sapiens
cggagggaggaaaaaaaaaggaaggaccctgtgactatgaagcaacacccaaagccactgtcagatgtcatggagatgagacctcacaagaaggccagaaaacaacagactaactccggatatgacaaactctttataaatacttataagtactgttggctacaatagttctaaagccttaacaaatgatgttgaagcaaaatgaataatgattattcctataaaaaaaaa

SEQ ID NO: 686448 - DNA, 425 bp, Homo sapiens
  misc_feature (348)..(348): n is a, c, g, or t
  misc_feature (358)..(358): n is a, c, g, or t
  misc_feature (373)..(373): n is a, c, g, or t
  misc_feature (395)..(395): n is a, c, g, or t
  misc_feature (421)..(421): n is a, c, g, or t
ttcatactactgaacagcataatcaaatcaacaaattcagctaatggccattgtgttgtgggcactgtgcttggccctgcacatccccatgttccctctcccctttgtcaaaaactagctccactggttgttaatgtcaatcactgatttgcggttgtccagaataaaaatggagagcagagcccaaacggagggtggcagtcggccttgtcattacccaaagaactaaaaatggagtaatgcaaaagagtggaactccttcacattaacaaaagcttagttatatacagtataagaccactgaatatttaaacacacaaatttgaaatatggcagaggaaccgggtngaacaggttnaaaacatggtttcantaattctgggtattttataagntatttctggagtccgcttggacaacnttta

SEQ ID NO: 686449 - DNA, 1563 bp, Homo sapiens
  misc_feature (246)..(246): n is a, c, g, or t
aaaaaaaaaaaaaaaaaaaaaggggcgccgttcgcgaatcaaaaaaggcccatcagcgacagttgaccccgctgtgagggctctctcaaaagttcttgagcaagaaccaggcaagaaaaattggagggcaaaggaacttcggcgtggtgtttgaatggagaagaactgtggtgcaagttcacattcttacgcccagaggaaccgacacagaaccgggaactcgcgcacattgttgccaattcctcntgtggccaacaatttttaccaaccaatgtgctctctgtgcaaacttcggcgcgtggttcaccagagggccccaggagaaaccttcaaagtgcctcaaagtgaaagcccaactttgggcgggggaacaaaacttttctccaaggcatgtgacaaagaaacccggcccagagtgtgccgaaaaattccctttgttacaacaccgcgccaccaagggtggtgccaaccttgggggccatttctgtgggtggccctttcccgcccaagaggggcctgttgacacccagaggggcagcgccacaaccaaaaacgcccccttgtctgtggacaccattcccgagtctccgaatgtgtggccgaaatcccaaaaggagaagctcttcggtgggcccacggggggccctgtgtttgtcttgcccccacgcctgtgcctagggagcctgcaacccggggggagccagggaagcatggggtgggacgccgtggtcgcccgttaaggggctcccccttttcacacctttggcacttttcacaccgtgggaggcttggtgtggaaaggttgttgttccctacccgtggggtgtttgtggcccaatgacccccggagggagaaatccctttaatggggccggaccaaattgaagagacgaaaatacccggacagacgcatgtgtatcacggcagataggtttccaccaccccagtgtggtcggtgtggtgaaactaagaaacccctgtctgtggggctccccccgtaattcctgcggggaacattgtggtgcgccggccccccagaggccgaaaaaaatgtgtcagggggacacccgggcacacgtttaacacccgagcgaaaaaacagggggcccaggggggcaccacccccggggaaggaaaaagccccaaccgttaggaaacctcgcaataggcgggacacccccccacgagggatgacacaccacggacacacataagagtacacgacagggcacaaaaaaataggtggtgaccaacagagaagtagtgcatacccatagtagatggcgttcgtctctgtgtgtgctttttccgtgctgcgcgtgtttaagtgttacataaggaaaaaaagaactgaaaagacacaacgacgtaagggaaccacgaaaagcaaagagagaagaacacgagaacaaacagacacacagaggcacgaacgcaagaacaaagccgcagaacgcagaacaaagaccacaggaagacagaaagaacagaggacccaagacggacaacaagccaaggacaagcacgcacgacgtaaaaaccaccgcagaacacaccgaaaaa

SEQ ID NO: 686450 - DNA, 141 bp, Homo sapiens
cgccggtaagtgggacctgctactggcatctagggggaagagactgggcactctgctaaacatcctaaacgacataggtcagcccccacgacagaagaattacctggtccacgatgtcgataatgctgaggcttgagaaaa

SEQ ID NO: 686451 - DNA, 153 bp, Homo sapiens
  misc_feature (1)..(1): n is a, c, g, or t
ntctataacccctacaaaaacaaaaaatgatagtcccacctataggtaagtagatagcccccaggtagcaaatctagtactaaggatacttcctactagatatagctatcccatgactagtcataggcctatgtaaggtatacaatatgctag

SEQ ID NO: 686452 - DNA, 1044 bp, Homo sapiens
  misc_feature (242)..(242): n is a, c, g, or t
ggtgcccgctcttgtcctccgttgctctgttatgtgatgctggttgcgtcagatattgtgttgttgtgcctctcctgtgtgtcccgcgggtgtttttctccttctggtttcccttggagggctttccccctttttccccccgcccttgggccttgggtccccaaacccgcgttgccgcccatgtttgggcccaaatccttggctatccacctgtcccggggatcccgttccaaagcataagnggttttaatagaacccggtttattccaggctcaggccccacattgtccaaggcgcacattagcttttcccagagttggttgttctcatcgccacagaacttgaggaaccacacgaatggggataccagtgtcctactgtccgtggcagagctgtactggcgatcttcctcccctaccatcgcgctgcccatgctcctgcaggctctggccctctcccaggagtaccggttaccgtacttggcctctgaaaccgtgctgaacttggcttttgccccagctcattctttggaatccccagcccaggccttaagtctttctcccacatggcccatcgagccccatcttggctgacggggctatcctggaccaaggtccgtgcccatagttcttagtggcccagtgcccggtggcttcagccagcttcctacgatccagcccgaagaaacgccagaagctttggaggctgcccatcgagaacctccatgaagcccagaactattttgccaaggttgactcccaagagcgcatcacgggacgctcgctttacttccacggccacgactctaccactaccctggggaagaccccggagaggaaccggtgtgcgatgcttttccggcagctgcatcacggagctgccctttcactggggtacccttgataaaccattcttctagagaggacatccctgctgggctgctgtgcagagtataagattttggacttgttcatgtcccctctctccctataaatgatgtactttgtgacaccctatcttgtccaataaacagcattttgatta

SEQ ID NO: 686453 - DNA, 1377 bp, Homo sapiens
ctgcgttgtactttatgtactttttttcttttacttttttcctctcttgctcttcttgtttgcctctctcttctctctccttctgtcgtgccgtttcccctcgtctttctcttcgttgttcttctctgtcttttgctctccttaccatgtgctcattcccgtctcttctgtcgtcttatgtattgtttctcttgttccttcgttgtcggctctctctgttgctccacgctcctgtgttccccttgcttgttgtgcctttgttatctcttccgggctctcttgttccctgtcccttgtctgtcttcgctctctctctcccttctttttcttgtttactcctgttgtttgccctttttcgtgtccctttcccttccgcgacctccctggcgcgtctgtgtggctcgcccttttctctgcgctcgtcccctggtctctcggcctgcattccgctatcctcctgtggttattgccgccccgttccgagggtcctggagccctttttccatctaagtttccttgcccgatgggatcacaccgtgggtctccactctggcttgagaatcttaactgtcagggcctccattcatttctccatctctaaccggatataccccctcgggatcctcactcgactcccttgctctcaggtgccctgcgtacaacgccagcataattcggtcattttcctccatccttctctattgtcgttgccgccagtcgtaactctgtgtgtcccgtcctcggctagccatctatccatggcgcctgtcctccaggctctgtgcatgggtcaccgggagggagggcccctcagtagcaagctctcggattctggcgtcctttcatggagcaagctgttacatgaccctaccacatcaccacccagcgagtccgtcctacactgccggtggcattgcagtcctggcatggaccccctccgccagctctcagccctctagcttggcctctcttgcatgggtgctgggggagaatggggcgaccgggagtgagtgcatggtgctttgtcccagtctcctgcagcccagcaggcccctttcagggctaccttgcactttcccccaccacctagcatcaccgccgtaccctgcttggaatcccagcaccagtcccaccaggcctctcctctgcgtttctggtttctctgccctctgcaagcatctgataagttgcactcaggagcgtttaggggagggcccatgggcaggctggtctcgtgatagtgagtgagtgctcatgggatctggtcgtttagatagcatgtcagcacctcctgcttcacttctgctctgtcatctcctggctccatccaaggccagaaacgtgccttgcttccccttcgcctttctgccgtgattt

SEQ ID NO: 686454 - DNA, 317 bp, Homo sapiens
  misc_feature (177)..(177): n is a, c, g, or t
  misc_feature (281)..(281): n is a, c, g, or t
tcttgtgcatacacctgtgtacacacatgcacacacacatataccccaccgttgatttttatgagggtgaatggtctcaacagcagaaaggcttactacacttgtttttgcaagtatttgcagatctttgtagttcctaatatgttatctcacactgtagcctacagataagaattnggggggaaaagtattaatttatgttattgatgaattctatgagattcccttactctagattcactcatccattcaatacctgtggcaaggctctgggagggatngcaatcatgaacagtcatgggactttgaggtccttt

SEQ ID NO: 686455 - DNA, 289 bp, Homo sapiens
tactgcctctgtactagactgcaagaactcacagtccgacaggggagacagatgtgtcatggtacaaaacaatatggcaagtcctggcacaaaggatgtgcttgtgaaatgtctatgaacaaatacgggaatgagccaagatgctctaagaagtaacacattcgtgtcatgggctttcagtcatctccgggttacatattcggtttttcagaacacaccctttccttaatattgctccaaacttatctatgtctaactgccaggacccggtcccaacaagcattgcccc

SEQ ID NO: 686456 - DNA, 604 bp, Homo sapiens
tgggcagagagggagccaagccctgtcccggccccaagcactaccgattaaatacatgttcttatagtcaagtgctctggggtctggccggaccggcaaaaactaaacccctggcgccccaagaacactatcccaatctggcaagaaggaataacaacaaactcaatatatcatctgtgtccctaaaagaaagggaatgtttccgagaaaaaataaaatagaggggccattttcaattataaaaggcagagcttccttggcaggggttttctcctttcccagtcacctctggggtgcagtccagagcaagtcgaccccgtgctccagcagctacggcttggcttggccggataggctgaaggtgccatccttagggttgggaaagccggagctcggggcggaatggtgccagatgctggaaatatgtctccgggagggggttgcaccaggcgtacacagcggtgaagagcattcctgtgggaggacgaaagagggcaagggtccattgctgttggttgttaatctcagagcagacagaaagctcagtacgggtctggtcacggaggacccgggacacccaatgtggcaggtgcaggggtcatgc

SEQ ID NO: 686457 - DNA, 200 bp, Homo sapiens
gcggtgactctgaggatatcatatttccttccattacggagatttcacgttagttgttcatacgctgcagcagccaggactaaaacaaagtgaagtatactggccgccttgcttaccagggctgcattcagaccctgcttttttttttcttttgtttgtttgtttttttgagacagattcccgctctgttgcccagagag

SEQ ID NO: 686458 - DNA, 125 bp, Homo sapiens
gatgcgtggtgttgtgtgcctgtaatcccgagtagttgccttacaggcgctggcaccatacccatctaatttattatttggtgtcttgtcttgtttccttgagccagacaggtgcagcgtagaat

SEQ ID NO: 686459 - DNA, 251 bp, Homo sapiens
gcccttccccccccccctttcattgggttgttccccccccccgtttccttgacccctttttggtttagggagccttgaggcttccccccttttttggggaataccttcctcctcccttttttaactggggctttttggggccctgcgtgctttttccatggtttccccccgtgttttttcctcccccaagggttggggggggttaaccccccccccgggattttccctaaatttttttttctttcccttga

SEQ ID NO: 686460 - DNA, 132 bp, Homo sapiens
  misc_feature (1)..(1): n is a, c, g, or t
nccgagtgggcctgccatcatgacccttggcgataagtatgatttatctccacactagcagataccaagccgaacccccttcgaccttgccgacaggggacctccagaactagttctcagtgcttcatcatc

SEQ ID NO: 686461 - DNA, 187 bp, Homo sapiens
cagcctgtaccacccactacctaggtatagccattagaagcaccagtctacagcccagagcataggcaatgagagaatagccagctataggaggacgtacctataggacaagcagtaaagctaaaagagactagtattaagagccatagagccgaagctacagagcctacctaagctaccattacat

SEQ ID NO: 686462 - DNA, 466 bp, Homo sapiens
  misc_feature (192)..(192): n is a, c, g, or t
ctcttcctcctgtttttatcaatggtgcactggttggtggctggacacatatagtcgttatgtccttgaatacttctcttgaagaaggccttgcagccctcacaggaccagactccccattagattgggttgaggccccttggaaaaaggcaattaaggctcccattctggcaaaccactgcacgagtagcngagtctccttggcagattccatagccatacttcccttgtcattggtactggccaatctttctctgccaccctggcgtcgattatctgaatttggcctgtagaactgcgggccggcctcgcgcaccgtgtagcgctgggctcgttctccaggtagtagggcacctgctggccgtggggctgcaggaaaggcgacagctgcggcggcgggtgcagtagcatcagcgggctcggagacacgctgttgagtggggaaaccccccaggccgttggagcc

SEQ ID NO: 686463 - DNA, 271 bp, Homo sapiens
tgtctataatgtagagaaaggatagtgtgggagctgaggcaatagataatatctagtgttgattaccgaatatggggatactggcttaaatttagtgctggagatgagtgcttcactcagtttaccctaatctggccctggttgaattaacaaaccttagaatggttagatatgttaagtgagggagaagataagccaaggttaaatgtagtgtgtctgaaccttgaacaactgggtaggtagtggggttattaactgagactagctgcag

SEQ ID NO: 686464 - DNA, 1081 bp, Homo sapiens
gcaatctgtggcctcagcccttgccaactctgcctcttcccccgctgactggggtatcagtttatggtgccctgcaggaagaccctcttgttcctgtgggtgggaaggttctggaatctcagttgccctctctggagttggggagacataggcttttggaggacaagcttgcagagtggttcatggagtgaggtggtgggagatttctgagcctctgcagagatgtgggcagctggtccggatggccacttcgggctcagcacagcaacgcacgcccagactcagactggcggaagcaaacaggggctggacaggccaggagagcctgtcggacagtgatcctgagatgcgggcagcttgctgcagaggcgcgaaggcacacgcgcacgcgctcgtggaacacaaggaagcaacagtgatgctacagaacgaaactcactgccgcacgacgcctcgacgacagggacgggccccagagcgcatcccacgaacgagcacaccaccaaagaaaaatccgaaagagacgcaatccctaggcacacgaagcatacccacgcgccggcaagccgccgaagggactgagacgaggactgcacgccgagcaacaccggccgccatggcgccccgagccacaccgcgccacccccgacgcctacgctcgtccacacacccagccgatctgcctcgccacccgctagcgccctagatgaagcaaccgacaacgagccccccaggtcgagggaggtccgcggcgccccacgccgcaagaccacggaaatgtgagtcagcccccaccacgggacacgacatgcaacgacagagagcgatgacaacgaacgaggacccagaaagcaacggcaccacgacagagcacgcggccacggatgaggggccacgacagcgtcaaccaccgacagcggagggccgagagggaggcaggagtaacgaaggaaggtgaccgcgaggagagaacggaaggggataggaggccgagagagagaagcgcaaaggagcaagaagaaatgaggatgccaggggaagaagtaccgcagcaaggagaacgcagagctgaagagaacca

SEQ ID NO: 686465 - DNA, 338 bp, Homo sapiens
gccgtgctttaaaaaggccttagtgcccgggatgggcccagtgtttttaagggaggtgggagctcttgctttcctggtccctgcagaatgacaaaaaaggtgaagctccatgcatgtgtgcgcgggggtatgtgcgctcagggtctctgtttaagtatcagctaaaaatgtgcttcccccgtgtttgtcataccctgagaccaacaggctccagggtccctgatttttggaaaagcctggaaaagctggggaaatgcggttcccaatgccccggtataggaggctgtgttgagctgccattcaaatggattttttaataataatgaaactggcgggta

SEQ ID NO: 686466 - DNA, 171 bp, Homo sapiens
caaaaacctgttagaaataataaacagattgagtaaatttacaggatacaaaatcaacatgcaaaatctgtagttttttgttttggtttggttttttggttggttggtttttggagacggtagtctcgctctgtcaccaggctggggtccatgggcccatctggcttcact

SEQ ID NO: 686467 - DNA, 100 bp, Homo sapiens
tatcataggtgagataatataggatagttggagaaggggcacgttgtgactggatactcatgaatgtacgtttggtttggggtgaaagcatacgtcttat

SEQ ID NO: 686468 - DNA, 488 bp, Homo sapiens
aggagtttgacatgcaagcgtatccattcttcaagatcccattatatcattcaataatacctcaggttgtgggctgtatggcacatggaatccccacgtttatgtccatttgctgtgcccagtcattgtacctgttgtccagtgaaatgtgttcctaaaagggcacaggtggctccttgggcagcagttatgtctaaggccacttggttttgcaacaccactttttgatctgatcaacctcattcattaacaggaggagggacactcaggtgtaattcagagcctgagcggtgtgctccgcaagagcagtaaattgtgcttctacagttttgacacctgctccagggatagtcattgccaaagggtagaaacaccagggggctcatcacattcgcaaaaactgagagcacagtgcctcccagttatacaggcatctgggcaatgtggggagaacagtagcaggtacataaggccacccccagataaaa

SEQ ID NO: 686469 - DNA, 852 bp, Homo sapiens
  misc_feature (434)..(434): n is a, c, g, or t
taaaaaatagaaatccttttttatttttctgtatcgtgctttaaaaaaaaaaaaaaggtattgttttggcttggcgtgggctccacacaggcagccacaaaagcacaattattttgtaacgctgtacgcgtgttccaccaatattttgagaccaccaagatgatagcgagaaccacccacaataatattaaggagacaagcacctcgcgtgtaataagtacaacgcctctagaagagaaaccttcccaaatatacttctaaagggaggcgctatgtgtgagagacaccccgctctggcttataagatctctctcctctctgttcgcgccggggccctctccttgtggctagtgaagcgggtgcgctcaagttgtgtcagaactcttctctcctcgggggagaaaagattagactgttgtagacgtgcgcacaanagtgctcctctccccgccagcggtcgtttggagatacacaccgtagaaaagccccaggcacagtagaattctcttattcatatatcatatcacccgcacagacactatgtgtggtgagtgtatagaataaagacccgcactagtggtgtgttggtgatcccccccaccaaggagagtatcatttgacgacaccacatattgtggtaattgaggaagagaagaaatactaacgatgaatactcccccccaacagtggtgttgcccccccaagagtaaaatctcacatccacaaagaggcgtcgtcgtagagtagatggaatcagccaattctctccccccccaaaaggaagagtagttgagtagatgaaacatagccacgaaaagtgttggaggcccatgtgtggccccccactattag

SEQ ID NO: 686470 - DNA, 505 bp, Homo sapiens
acaaaacaactagaagcaattaacaaaatggcagtaggaagttcttacattacatgtcggtaattaccttggatataaagggattaaattctccaaagacctggagtgactgaatggattttttaaaaaagagccaactatatgcttcccacaaaagacttgacttgtaaggatacacatagactcaaagtgaagggatggaaaaagacatgacttgtaaggatacacatagactcaaaagtgaagggatggaaaaagacattccaagcaaatagaaacctccagcagattgcatatagtgaaaaaaaaaaaaaatcatctgctttaattgaaaatgctttgttgagagatttgcagtcagaggcaacctgcttatatactggcaagtgtagaaggggacaagatagacaagacatgctcactaatgagtctccctgaaccccatacctcagaaacgtagggcacagtgagaactttggcatttgacttttaaagtgtccagcca

SEQ ID NO: 686471 - DNA, 884 bp, Homo sapiens
  misc_feature (856)..(856): n is a, c, g, or t
  misc_feature (882)..(882): n is a, c, g, or t
gagagggagccgcggaggtgcaggtcgaagaggccgggctacgtcgtgccctgcgcgtgagcagctgcagcggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggtactgcaccatctgaaaatggtgaaactaaaagctgaagaggcacagaaaactgaatctgtagataacgagggagaatgaattgtcatgaaaaatgtggggtgattttatgtatctcttggggacaacttttaaaagctatttttaccaagtatttgtgtaaatgctaatttttgaggactctactagttggcatacgaaaatatataaggatggacatttatcgtctcatagtcatgcttttgggaaatttacatcatcctcaagtaaaataaatatcagttaatattggaagctgtgtgtaagattgattcagcattccatgcacttgctttaaaattagtcctgtgcatactgggtgttttactgtgcatatttgaatttttcatgcagttttctagagcataatcaggtgctttgacctaagttatgtgattctaatgagacatggatagttgtggccatctgcttactatatgtgggttagnatataaggtgtacttggctggatagnac

SEQ ID NO: 686472 - DNA, 1184 bp, Homo sapiens
gccggggtgctccgcatcgccctgcccgcacgccgcccgcaccaccaggaccgcgccgccggcctccgccgctagcaaacccttccgacggcctcgctgcgcaagcctgtggacgcctctcccccctcccgcaccccgccgcggaacgttcagttatgaagaggggggcagcggggaacatggacatgaagcggaggatccacctggcagctgaggaacctggacccggcaagctgtgacgagaccttgtcttggaacaagttgcaaatcaacatgatggaacacacattgagggcttacaccgctgcacctttgtgaacattagagtacctccgtctcactacattgtaggctgtgatctcaggtttccaaatctcacccaagactgcctaacatagaacaaagcttggaactccagtgaacaactacgaaaatcattatgcgagggtcatggaacaatgatcaggcatgacaaagcagttcgcaaaatcttcagcaagcattcatacacctttacagtggcaaccagtaccgcgtggaaaaggaataattccagcaaccgttgagaaacccttttggcacacacggttccgaactggtacgtgcacagcacggcccttgaggcagccctacgctctacaaacgtggatggaagcgattaacacccacacgcgtggaacattgaacattagcgcggagaaagcaagggtggtcctttctccaaagaacctaccgtggcagcccgccagggactataacacttagcgtagagggaacttggggcctaattgaaaccggaaagaagcggagcccagagaacagcgcaacattgaaccctcaagcattggaccggcccagggctgagacaagggagtgatgggaaacttgaacacacacggcagggagagacagacaacgaccagcgacggcacagcacgacggccaaagaaacggcaggcacacaacacaagcaagcgaacatgatgcacaaagccacagcccgagcagagtaggaaaagcaaaaccaaaagcacgcaagaacagccatggaaagcaaagacagacacagctgaaacaacaggaacgaagcaaaaccaacacaacacagcacaacccagcggaacacgcacgaacaaaaacgggcaacgaatacaagaaagcgacaagaagacaccgacacgcag

SEQ ID NO: 686473 - DNA, 847 bp, Homo sapiens
  misc_feature (819)..(819): n is a, c, g, or t
  misc_feature (845)..(845): n is a, c, g, or t
gagagggagccgcggaggtgcaggtcgaagaggccgggctacgtcgtgccctgcgcgtgagcagctgcagcggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggagaggcacagaaaactgaatctgtagataacgagggagaatgaattgtcatgaaaaatgtggggtgattttatgtatctcttggggacaacttttaaaagctatttttaccaagtatttgtgtaaatgctaatttttgaggactctactagttggcatacgaaaatatataaggatggacatttatcgtctcatagtcatgcttttgggaaatttacatcatcctcaagtaaaataaatatcagttaatattggaagctgtgtgtaagattgattcagcattccatgcacttgctttaaaattagtcctgtgcatactgggtgttttactgtgcatatttgaatttttcatgcagttttctagagcataatcaggtgctttgacctaagttatgtgattctaatgagacatggatagttgtggccatctgcttactatatgtgggttagnatataaggtgtacttggctggatagnac

SEQ ID NO: 686474 - DNA, 690 bp, Homo sapiens
  misc_feature (179)..(179): n is a, c, g, or t
ggcagtgcaaatatccaatgaagaggaagtttgtcgctgcatggcatcttcaaagcctgaagctgtacagtgagtttcttactcgggagactggctgaagatggctactctggagttgaggtgcgagttacaccaaccaggcacagaaatcattatcattagctcaccagaactacagnaactgcttcttgcgtgcagaagggcctggcggtattcgggcacactgtacttgctgctagttcagtcacagtcaggtttggctttccagaagggcagttgctagagcctcttatgcctgcaacaagggtggccacttacgaggtctggtgtgccactctgcccagtgcagcaggtctctgcggttgaactcaacgtccttagggagggccttggctgtggcggcacgggccgtgctagtggatgtgcgtgcgcgttctatcagtggtaggagttggggccagaaggctgcgaggcttgtggctggttctgtggaagactccgacggacagcacgggctagactccatgacaggtctggtcggatggcctgatgcatccactagcggaggaccctggttactctactcacggttgacactggctgtgcgccacgtgcttgctcagactgggtgtgctggggctcatggtggactgatcatgctgccctgggacccagctggtacgatcgggc

SEQ ID NO: 686475 - DNA, 993 bp, Homo sapiens
  misc_feature (965)..(965): n is a, c, g, or t
  misc_feature (991)..(991): n is a, c, g, or t
gagagggagccgcggaggtgcaggtcgaagaggccgggctacgtcgtgccctgcgcgtgagcagctgcagcggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggtactgcaccatctgaaaatggtgaaactaaaagctgacagtagatccacatctctcgctcaactgttaatgtctcaagcctccagaggcaccccacccaggcagcactgtcagtaaaggggcagattgaaaccagtgagagtaaagagaggcacagaaaactgaatctgtagataacgagggagaatgaattgtcatgaaaaatgtggggtgattttatgtatctcttggggacaacttttaaaagctatttttaccaagtatttgtgtaaatgctaatttttgaggactctactagttggcatacgaaaatatataaggatggacatttatcgtctcatagtcatgcttttgggaaatttacatcatcctcaagtaaaataaatatcagttaatattggaagctgtgtgtaagattgattcagcattccatgcacttgctttaaaattagtcctgtgcatactgggtgttttactgtgcatatttgaatttttcatgcagttttctagagcataatcaggtgctttgacctaagttatgtgattctaatgagacatggatagttgtggccatctgcttactatatgtgggttagnatataaggtgtacttggctggatagnac

SEQ ID NO: 686476 - DNA, 320 bp, Homo sapiens
  misc_feature (2)..(2): n is a, c, g, or t
  misc_feature (48)..(48): n is a, c, g, or t
  misc_feature (55)..(55): n is a, c, g, or t
  misc_feature (68)..(68): n is a, c, g, or t
  misc_feature (87)..(87): n is a, c, g, or t
  misc_feature (124)..(124): n is a, c, g, or t
  misc_feature (165)..(165): n is a, c, g, or t
  misc_feature (286)..(286): n is a, c, g, or t
  misc_feature (313)..(313): n is a, c, g, or t
gntctcatgaagaattctggtcgtgcagccaggtggtagtctgtaagntttgggntctgggtactggnagattggtccattaggctncctgtagattccagtctcccttccaccaagtcccagntcttgtctacgtggtcacagggtcaaacctgactccctttnggtcctcagtttcccctccccttcatgaaatgaaaagaatactactttttcttgttggtctagcattgctggacacaaagtgtagtcattattgttgtattgggtgatgtgtgcaaaactncagaagctcactgcctataagaggaantaagaga

SEQ ID NO: 686477 - DNA, 1342 bp, Homo sapiens
gagcggggcgtcgcttgactccgtcgacaagagtgagcgagtggacccgcgatggagagcatggcgagctccaggtaaaggacaattatcgagatgaagaggctataagaactatgcttctaaccgccttgaagtaatatgacgtcctgatagatcgcacgagggacgccgggcatttcatgtgtctcgagaagcagtagtgcgacgaggcgaacacacatttagtgatgctggaggcaacagtgatggacgcgtgctgtgctgaaacgaagctgtccgatgttcgggactagtctgtctcaatggacatcgcttattggtgaatgcatcttaccacctagagggaaggacgttggttgatcagcgcagcagcagacatgcgatcggaaggattgctccgataatgcatgaactagactttccttgaccgcttgcattgctatccggccaatccactactacccaccgaagctttaccgagacacagccttgggccattcatccccaatgcaataaacgacgcctaccaataccacttacctgacgactgtctggcacctgtagaacgcttatcatgtgagaaactacctttctcgaaaacggcacgtgtgtggctgcagcacattcgtgcgtatgtcaggctgtggcaatgcttcttcctggacgccgccacagcagtaaacagttgccacgacccctcttggctccccaattcttacacacagtgactactggcaaaacgcgctttgcccttgcatgttgaggtcccttacctaatagacggcaatgacacatatatcttgaccccagtttagattgcgcgatactacgcccgttccccctctaatacagcgagtgtaacgccacacaacatcaccaacatcgtgcgcgtcaccactttatgcgaaaaccagcgccacattgagattgccctgatggcgaactatccccgccacagatagtttgcaaccaactttatcgacacgaagccaccggcgcacttccagtgcattgtcccatgggaaccaaccgatgagaacaacgggacgctgtgttctctcagaggcgacgaaccaccagaggggcagctcgcacatctcttagggacgctcgaaacactatgctgtgacaacaaacagcgaaatcaagcacaatttgcagtctagcaatactatcagtcgcacatccattggaagctcctttgcaccctgaaacactatttttgaccgatcacctcagtgcaacgaccatagggatcatcccaaactcccctagcatacactagtcgccacatgtatggcattccacacacgacgcacctcccgtctagcacagcccaacg

SEQ ID NO: 686478 - DNA, 111 bp, Homo sapiens
ccatttgccaagccgtgctggttaccagggcctggcgggcgctgttggggggcatctggcatggttgactcctcggcgtcacgttcagcctcttcaccggggctgcagcgc

SEQ ID NO: 686479 - DNA, 710 bp, Homo sapiens
  misc_feature (682)..(682): n is a, c, g, or t
  misc_feature (708)..(708): n is a, c, g, or t
gagagggagccgcggaggtgcaggtcgaagaggccgggctacgtcgtgccctgcgcgtgagcagctgcagcggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaaggtgattttatgtatctcttggggacaacttttaaaagctatttttaccaagtatttgtgtaaatgctaatttttgaggactctactagttggcatacgaaaatatataaggatggacatttatcgtctcatagtcatgcttttgggaaatttacatcatcctcaagtaaaataaatatcagttaatattggaagctgtgtgtaagattgattcagcattccatgcacttgctttaaaattagtcctgtgcatactgggtgttttactgtgcatatttgaatttttcatgcagttttctagagcataatcaggtgctttgacctaagttatgtgattctaatgagacatggatagttgtggccatctgcttactatatgtgggttagnatataaggtgtacttggctggatagnac

SEQ ID NO: 686480 - DNA, 669 bp, Homo sapiens
acctacaaatgcctaatccaaggtttcccaatatcagcccgcacatccaaggaagtttggaagaaataggatcaaatcgggggtggggtgtgtgtgcgtgtgtgcgttacttgaggcattgggctgttgagatgtttcccttccgggagaaagtatttaaggggggctctaggaagagaagaaggttgattaaagtaccggtttcctctccgctactaagcgtagagtaagagaactagaaagcgaagtctgtgaacgacttctggagacaggcttcgcgtgaaggaaagtctagaggcgcattaccgaaaacttagaggaattgctagatagattgttaaagatcttggtggggtgggctgagtgttgaatccgttcgttggttgattccgatttctccttagggtagatgggggctgaggaacttctctccgcgatattataccccttcgctcgtttttttttagaagaggaaaaatctctattggcgtctgacctgggatgtgcggctacctaaaaaacgaaattgaaggtctcttcgctgccctaggttcttagttcctaactctgccctaatctatccttttcttttagccgagtctttctcttccctaggcattttcttctttccctaagcgaacgactccttttatatatgttcgagaacgt

SEQ ID NO: 686481 - DNA, 121 bp, Homo sapiens
aaacctccatcgctacatcaccatcatcaaagacctgagcaagccaggagacctgagcaagccaggagacctgagcaagccaggagacctgagcaagccaggagacctgagcaatccaggc

SEQ ID NO: 686482 - DNA, 290 bp, Homo sapiens
  misc_feature (13)..(13): n is a, c, g, or t
ttttttttgcttncaaaataatttatttcgtttataaaaactgacctaatagtgagtgcatatttacattttaaatcattacccaatttagcgagaaacaattcaatgcaaactacaaaatagcttataaaggcagacttatacaggacaccaaaaataataaacagacttactaaaataagtaggaaacaatttaaatagtcactgtattttaagcaggaatccacataagtcttaagacttaaggatttatacaaggtagaaaacactacaagtaaccccaagcttgc

SEQ ID NO: 686483 - DNA, 320 bp, Homo sapiens
  misc_feature (7)..(7): n is a, c, g, or t
ggaggantactatttgcgccagatgtaaaaagatggaatctctgattgctattagcggaacaacgcaaggagcaattgtctgctgcgatttccattgccgttgtccgtaatattgaagcaaccgccacaagggggtattggaatgcgtactacgacgcgctgaacattgatgtctcccgtagagaggcccatatcgtcaattctgctttagatgcctgcagcaccttcatgggccgggatcttattgcgttggattttgtttcacaaactagcaccaacgcacggtgatctgcatcaaggggtaccggcagctcgaattc

SEQ ID NO: 686484 - DNA, 163 bp, Homo sapiens
cctagcaacttccttacaaccttcctacaaaatggtggtctttttcttcattccacctcgtggagaaagacgcttcaggaagaggcacataacttcgctgtggcccttcaaatttgtcttctccacgaggtggaatgaagaaaaagaccacccatttatgtat

SEQ ID NO: 686485 - DNA, 148 bp, Homo sapiens
ccgcctcttagaacctgagagtaagttttcttgtcgtgattctcccaagtcttggtaggcatcgaactggtcctttcactttgagaggcttttcttttgcgcctcttatcacgtcagcacacaccttttccaaggcattttacgttgc

SEQ ID NO: 686486 - DNA, 228 bp, Homo sapiens
  misc_feature (54)..(54): n is a, c, g, or t
  misc_feature (72)..(72): n is a, c, g, or t
  misc_feature (103)..(103): n is a, c, g, or t
  misc_feature (112)..(113): n is a, c, g, or t
  misc_feature (159)..(159): n is a, c, g, or t
ttccgacggcatctacggctcaacattttttgtagccacaggtttcacggcttnacgtcattattggttcanctttcctcactatctgctctcatccgccacnctattattnncactttacatccaaacatacactttggcttgcgaagccgccgcctngatactcggcatttttgtagatgtgggtttgactatttctgtatgtctccatctattgatgagggtctt

SEQ ID NO: 686487 - DNA, 497 bp, Homo sapiens
tgaatcctctaactcagccacccgagtagctgagactacaggtagtgcgccaccgtgccccaccaatttttgtactttttagtagagacaaggtcttgccgtgtttcccaggctggtttttaactcctggggtcccaaagtgctgggattacaggcgcgagccatggcatggcgctcggctcattttttctttttaagggaactgaaatgacagctaaagtgtactactatttttatttttatttatttatttgagtttttgagagagagtctcgctctgtcacccaggctggagtgcagtggcactgtttcagctcactgcaacctctgcctcccaggtttaggtgattctcatgccttagctacctcagtagctgggactacaggcatgcaccaccacgcctgaccaatttttgtatttttagtaccgaagagggggttcaccatcttgaccaggctggttcaaactcctggcctcaagtgatctacgactcaga

SEQ ID NO: 686488 - DNA, 340 bp, Homo sapiens
  misc_feature (55)..(55): n is a, c, g, or t
  misc_feature (93)..(93): n is a, c, g, or t
  misc_feature (97)..(97): n is a, c, g, or t
  misc_feature (111)..(111): n is a, c, g, or t
  misc_feature (171)..(171): n is a, c, g, or t
  misc_feature (254)..(254): n is a, c, g, or t
ctccataatgtgtgcccaggacagggcatggtggggcccatggaatcattacccnagacgggcattttcagggaaacagcttagataaggccnggcntacagtagctcccncctgtaatcccagcatttggggaggctgaggtaggaggactgcttgagcctgggagttcnagaccagcctaggcaacatagaccccatatccacaaaaaatttaaaaaaggagtttgtgttcctgtagtagcatacttgggangttgaggtggcagtatcacttgagcccgggagttcaaggctaaagtgagctgatggagccttgcaccccagcctgagcgacagagg

SEQ ID NO: 686489 - DNA, 202 bp, Homo sapiens
tatactattatttcctattattaattttgcctttatttactgtagttggtaactaaatctctaacatcgaaacatgagatgttctgccaaaaagagattacagaagaaaagacctatgaaaagaaactgggtttgtgcagtgaagattttatttacagggttttgcaatcggtatctttaatctccataacaattgggctat

SEQ ID NO: 686490 - DNA, 854 bp, Homo sapiens
  misc_feature (249)..(249): n is a, c, g, or t
agcggagcggaggctcctgcagtggtggtcggctgttgggtgtggagtatcccagcgcccctcgggatccgacacctttgagcgttctgctccgggcgccagcctacctcgctcctcggcggcccatgaccactaacccatccaccttcaaggtgagtcgatcccaagcagcaggaatagctcccgatgtttcggcggtcgtccagtgtggtagtgatccaattttctcatatagcgttttgatgaacncagacataacaacctgatgaggcaagaactaaaatggcctcgtaatatcttgtgaggacaccttgaaagtaataatctaacgacttctatgaggcccaacgttcaatgtcgatggtagccatagatcgtaggtaggtgtgacaggtgaagacgttgagcagttcgatctaggcactgcatgagagaggaactacctactagaagtgcaagctaccggatgactatcttaagatcttgcaaagggacgaacggtgattattcattgacacacatgtcggacgacagacttgccaggcatggtctggggcagagtgaatgacgaagcctcagtgtcctgctagcagccatgtgctccagacctcaggtgagcaccacggcgcccgagtagccatccgatgaaggaaatccccctaggcggacaagtccagcctcgtcttgggttagctctgactgtcctgaacgctgacggactagtctgtttcctccatgctatgtgaactgcatcaacttgagtcctgactgtacatactcttggatttgtttcattagaaagaagcacgtttatgcaaaaagaatcaaaaaacctgttcacaggggggaaaccg

SEQ ID NO: 686491 - DNA, 339 bp, Homo sapiens
  misc_feature (320)..(320): n is a, c, g, or t
ccccgggctgtacgaatttggcacgagggcgccggaagatgtctgtggccgcggtggcggacacatcagatgatgctcggagtctggctgatcgctctcaccaaggaccgaggggccgtgggaaacgtctgacgcccactctacggaggagcaaatggaggcccaagccgcgattgtgcacggacacaccatataggcgcacagagcccggagtgggacaccttgcagtgtgtgcccagagaccccaacccccaccagtggagagctcctggatcaagtgaacgagcctgtgcataaataaagcaagagtgtttacaccntataaaaaattttttttgt

SEQ ID NO: 686492 - DNA, 804 bp, Homo sapiens
gcatggcgtgtgctcgcccactgatgaatcggtgtactccgacggagggggagtcatctggccaaaaaggtcacttggcctgctcgtatgcaagggctcctattcgagccagatattgtgaacttggtccacaccaagtagcgcaagaatgacagacagccctatgctgtcagatgaattacccaggtcatcaagcactagtgctgaggtctcgggggtactggcagagcctgtggctcgaatgtcccaggagattcgatggtggtgggacttgcacccggatcgtgggcaacaggggtgctataaggcaaacatgtgttcgtggtaggccgaatgtttgcaccagacaaaatctggccgccgattggccctcgtacagatgagacagctaactccaaatatacgcatacgcgcatctgattctgccactggggtgaccttcagccctaacacagatactggctcatgtctaaagggtcattcgatattgaggaaggtgtcctgaacgttcctttggtaggtgaaggatgaggtgtgcaaggctgaccggaagaccccagggaaggcagtgttgtctccttgacgaaaagttaaacgcccatggtaaggattactccatgcacaggtctcaatgacctctccagcgaaatgagagctcgggaaaggcccaaagaatgaagaatacgtgagcctgtataccaggggcagggggccccgttgcattcatctcattaaggggaggattaatgggttatcattccaaggcccttaggaaacattgccttgggattaccccggcaaagc

SEQ ID NO: 686493 - DNA, 381 bp, Homo sapiens
tatgtctaatctgatcagcagagtctcatgagaagttagatcctttctctggtaacattctagctttccactaattgaagtacagaattctctcagtgacacttattgatggcacgaaagaaaaaacaaacatgaattattttttatacaatcatggaaggctaacagaacacaaagaaagaatggccccattcagggtaagacaagctgtctactaaaggcaatgctgtatgtgaaaaaagcaacaaatcctcccacgatctttgaagaaaaccaaagtgttaacattggattctcaaagcaatttcttataaaggagcaataatgcttggtcgttcttcaagttctcaaatgatattttctctcaaaataaccagaagt

SEQ ID NO: 686494 - DNA, 916 bp, Homo sapiens
gtgctcctgtcccccgagaattgggcctcgccctgcttgggcgtgctggacctgttgcaaagcctggtgctgcgctcccgcgcagtggtgccatgaagcgctcggggactctgcgtgctgctactcggacctgagcgccttcggctggtgctgctgggcgctgctccgggagctggtggcctgggggactcagctgtgtacctgagtcctgtggcagtcctggactgtgacgccactttgcttgctccgtgctgaccccctgtggtgctggtagccccacaagttgctaagtctgcgtcgcgaggtgcccggtgcggagctaggagcgggggctggcctgggccgggccaggccctcccccggtggagcgccttcttccttgcctgtgggccagttgcggcctggtgctaggtagctgcgtgtggggagagtggcctggccggagggtgtaggggctgtctgggctgttggggcactaggacttgtgctgtgcctggattgaagaaggcagcggagatgagttgatgttaccgtggacctggagggaaagacctctgcggatatggtgtgccactgttaggctgggcagcatcccggaggggcacacattgattgtaggatgacaaaggacagacgggaatgcgcgcctgggacgccgaatgggaccccgataagggtgatccggcccaagactagtcaggatatatcaaggacccacttctgttgttgattgccggtatccgtaggacctccttgtggagccccaacgcggggggaacgtcttaaggcacgccaagccattggttgccacggaacgatacagtttgcttgtatgagaccagaattgcccgtttgcgcatttccgtgagtgatagcggagtggcccaatacgttagaaggaacaaaagttcctttt

SEQ ID NO: 686495 - DNA, 396 bp, Homo sapiens
ggctggcagacaaatggggatcagcgaagccacgctgttgaacatgctcaacatctcccccttctccttggggctggtcatccagcaggtgtcgacaatggagcatctacaaaccttgaggtgcttgatatcacagaggaaactctgcattctcgcttccggagagggtgtccgcaatgtggccagtgtctgtctgcagatggcctacccaactgtggcatcagtaccccattctatcatcaacgggtacaaacgagtccgggcctggtctgtggagacggattacaccttcccacttgctgaaaaggtcaaggccttctgggctgatccatctgccttggtggctgctgcccctgtggctgctgccaccacagctgctcctgccagctggctcag

SEQ ID NO: 686496 - DNA, 359 bp, Homo sapiens
tatacattgggataattttattcattgaaaaaaccttaggaatcagcttttatatttgcatttctctgcctgcagttgaagggaagagcttgactgtctttcgagggctctcccagccctggaatcccgggcttccttccaaactgggctgggatgtaacaaatctgggatatacatcccaatcatggggacaaggggcaacttgacaggggggccccacacttaaggtgtttggggaagtcaggctgggaaataaggaaaccatttccatgagggatttcaggccccatttcatgagtttattaccctttttttttgccaaatagccctggggaagggagtcatcaaatcgaaaatgg

SEQ ID NO: 686497 - DNA, 81 bp, Homo sapiens
gcggccgcctactactactactgctcgaattcaagcttctaacgatgtacggggacatgaaaaataaaggttccataatgc

SEQ ID NO: 686498 - DNA, 351 bp, Homo sapiens
gtataatagaagtttcaatagcacattgctagccatgagggaactgatgaggaggaactatcatcctgttagagaactccgcttccattcctgcgtctactgtcttgctccactggagatggatggctcacggaggaggccacagtcggatgagagcagcaggttctccctacggcactaagtctacagggggaaggacgctctgtgctggcagcggtggcacacatggcctgtctgcactgtaaccacaggctgggatgtagccaggactatggtctccttggacagacaggtctgatgtttggccaatccagtccttcagaccctgctattgaaaattctaaaactagg

SEQ ID NO: 686499 - DNA, 154 bp, Homo sapiens
  misc_feature (72)..(72): n is a, c, g, or t
tttatttttgggaacccttccccttttggatttataactttactaacccaattacctatcaataaacccttnctataatatttttaaaccacctatgtttatccagcttactctttgaggggcagaatatactaaataaagaatttttttatga

SEQ ID NO: 686500 - DNA, 1267 bp, Homo sapiens
aacttccccgggtgagaactttttttttggacaccatgtgctgcgggcaagtctgcgcccgtgagaccgcatatttacatgtgtgtggaaaccacgtccgtctcctttgtaaaaaatcttttcacacactggtgcttcaccacggttggggtgatccatatccggggatgacactcctaagggaatcttgccgtgccttcttggcaacctcgccttaatttgtttctttcgtgagtggtttttcccaaaacccataagtgctataggccttttgggggctaccaggtccatttcacatatttttaccccagccctgtgggttacacaggggacacaataaagggggtgtaccccccacgattaacttgggggtttcatctcctcctcctatggttaacatccgctttcatttcccacaggcgaaaggggttcccttccaccaaggcctcaaaccattcataggccttccataaaatttcgggggaagaaagcggcatgtggaatgggtaaaaaagcggggtcatgaacactcacgcgataggcccttaaatggcacacacttgggggcacacatctccgccgccacatatacggatggggggcccccccccaaaaacgtggggttattcgacggatcccatcgaagccatgggtcatagagggataccctgatgcgaacaaggatttaagccccgattaatgggggacccttcaccagtgtggctgtttctgaaagcgagcacgatccaattctcggaagtaattcatgcgcattgatggggtaccacgcgaagagtgagaacctacatcccccgcagtgttactacggcaactggttcatatgtcctattgttcaagaccctcatgtagcaggccaatcccccactgcctgtacgaggtacttggagtagctgctaggtcacaacagtaggtttgttccctctttgacggtgtctgtaccgcatgaactagccgctctttccgccacttgaaatttgttcgcacccatggtttaagcgcaaccctattaacgtccgagtgaactgggggagattcacaaaattgagagaacccttttttgaaggtctttagtatgtttagttttgttcttttttgttttttttttttgtaatataaagcgagatatttataagtgggtgctagggtcattgactttatctccgcgtgcacaagcagtgtgttgaactttctaatctcatccctctcctaagtgagacgctgagatagaccgggttccttcgtcccc

SEQ ID NO: 686501 - DNA, 219 bp, Homo sapiens
acgtctagagtgattccattaggcgatggaactgtagattcatatcttctccccagcatggctgcatccgtacgcttgacctcacctgttgtccagcataaatcaagtgaactgattatctgagacaagtcaccccaagagcgctgtgcagattgggcaggaaaagagctaatcacatggatgggttcatatattcgcttcccaaggcacacactgtcc

SEQ ID NO: 686502 - DNA, 142 bp, Homo sapiens
ccacagaatgggatcatgtggacgcccagaggatgcagagtggggcagacacaccagagactcggggattggcatggtgctctgcccgtgttttgccctcctccaatactcgccctgggctttgcgggcccgtgactggggc

SEQ ID NO: 686503 - DNA, 804 bp, Homo sapiens
gccgcggtttcctcggtcagaacctcgttagctccgcccgccgcgtgctccctcctcccactcggaatgcctgtctggggcggtggaaataagtgcggggcctgcgggagaaccgtgtaccacgcggaagaggtgcagtgcgatgggcggagcttccatcgctgctgcttcctgtgcatggttgcaggaaaaatttagacagcacaacagtggcgattcatgatgaagagatctactgcaaatcctgctacggaaagaagtatggaccaaaaggctatggttatggccaggcgctggcacgctcaacatggaccgcggtgagagactgggcatcaagccagagagtgctcaacctcacaggcctacgacaaatccaaacacttctaaatttgcccagaaatatggaggagctgagaagtgttccaggtgtggggattccgtgtatgctgcggagaagatcattggagctgggaagccctggcacaaaaactgtttccggtgtgccaagtgtgggaagagtctggagtctacaactctgactgagaaagaaggcgaaatctactgtaaagggtgtacgcaaagaactttgggcccaagggatttggtatggtcaaggggcaggggccctgttcatgctcagtaatggtgtgaacccagtaagcacgacagagaatctccattaccaaatgagatgggtatatgggctcactactggggaacagcagacttggatgggcatcacgagtgctgttggggctggacgacagggtgatctcggcatataagttaaagttcttaattgac

SEQ ID NO: 686504 - DNA, 367 bp, Homo sapiens
tctattgcctgatgaagaatacttatctcttaagcgaacctaatacagatcatccgctaattctttcctaatgagctatatacagcagaaagccgatttaatcgtaaaagtgccccacagagacactttaccaggaggctgggagagttctccagatatgggagaggcgcagagccagtgtgtgagccgagacctgtctcagcaatccaccatgaggagctagagtatcctcctccctttaccattcagaccgagagaaaaagcccagcttgtgtgcaccctacgtgggagtaaaggcagagctgtacctggttaaaagcctttcagtatttgttatgatgtaaggctctatgattttaggggggaa

SEQ ID NO: 686505 - DNA, 2044 bp, Homo sapiens
ggcgggtggatgacctgaggtcaggagttcaagacagcctagccaacatggtgaaacccccatctctactaaaaatacaaaaattagccaggcgtggtggcacatgcctgtaatcccagctactcaggaggctgaggtgggagaatcgcttgagcccgggaggcaggggttgcagcgagctgagatcgtaccactgcactccagcctgggcaacagagtgagaccctgtctcaagaaagaaacaaaagaaaaagagagaaatcaggaacatcatgaaagatacagcaaaatgttttaccccagcccattgcaccacacctgggattgtgacaattaacttgataaattgttccttttcctgttcggaactgactaggttgtgcgtggatggaccagtgaaaagaaaatcctgtttgggtagggaagagggaagtagaaaacctctttcgtattcttggtgtcaagaaatgggaagagaatgagggagcagagacctgggttgagtgttggctctgcactaaacagctgtgtgatcttggtctagtgccttaacctctctgagcctcagtttgtacatcagtaacattgggataatgacatccacatgcccacttcacagagctgctgtgaggactggatgagaaatgtagagaagtatttcggacaccataaagctcaaatacaaggtgttggttaggaaaagtttcaactgacttgtacccacctgatacccctccatcagcataagcgtgtatgaggatgttaggtacatgtgttgtgagtgaaagctctggaacacccgagtagagctttctgcaaatcagcttctccttcagaggagaccattttgttttgctttccagcagttacttgaagaagccttatctgaagtcacaacagtgacttcaggaatagaagggaccaatggccagcttgctgaaatgtaatgccattcttaaaagccagctaagaatcagaccgtattagttaaggacccataagagtagacatttagaaaaagtgaaaaatggcaagagtggcccaatcttttgagagtttagagaaaatatcatttggaaagggagtagctctccttctattttagccttattattacggtatctataaagcaatgccatattctaaatctgcagaaataaaattctaaggggcgaaagtccaaggcagaagtcaaaagttttgcaaggaaaccgatgaggttgctgacctgagctgggcagggttgaacaggcgagtgccaagatcaaggtctctgattgtctctccttgaaaggtaagcagagaactagggctatcccataaattaagtgggagattggaaaggggtgcggacttctgtattggggagaaggtcttggatgaactggggcagagaactgccagagagagtacctaggaatacgttgttagcaggagaaagaccaagttcagatgcagacttgggaaagtaggtaacttgaccaaaggtagcaaaattagactacccaactggattgtgaatgcagtttatgaaatggatcaggacaggagcaaaaatagattttctagaaactgcagactcctgtgattggagcagtatacaaagtacagcaacatcagactagatctcacctgaggtgctgggtgagaaatcttagggaccagatggaagagggcctgtgtataaagacattaggaaggaggtttgggaaggtttgggagggcagcctgacttgtctccagagaaagttagaactggttgacttagcaaccaagggacactgggtcaaagacgaggaatcaggacgtcggtgcctagtgactgagcgccagcccagcccatttctctacattgccatgggctaaacccagtgtgctgtaaactcttcagttcctttggttatggattttgtatcttttctgtgtttcttaataaagttcttttgaaaaatgggaacctttctcagatgggaattttgtatctttcctctgtttcttaataaagttcttttgaaaaattggaaaaaaaacaacaaaaaaaaag

SEQ ID NO: 686506 - DNA, 1956 bp, Homo sapiens
ggcgggtggatgacctgaggtcaggagttcaagacagcctagccaacatggtgaaacccccatctctactaaaaatacaaaaattagccaggcgtggtggcacatgcctgtaatcccagctactcaggaggctgaggtgggagaatcgcttgagcccgggaggcaggggttgcagcgagctgagatcgtaccactgcactccagcctgggcaacagagtgagaccctgtctcaagaaagaaacaaaagaaaaagagagaaatcaggaacatcatgaaagatacagcaaaatgttttaccccagcccattgcaccacacctgggattgtgacaattaacttgataaattgttccttttcctgttcggaactgactaggttgtgcgtggatggaccagtgaaaagaaaatcctgtttgggtagggaagagggaagtagaaaacctctttcgtattcttggtgtcaagaaatgggaagagaatgagggagcagagacctgggttgagtgttggctctgcactaaacagctgtgtgatcttggtctagtgccttaacctctctgagcctcagtttgtacatcagtaacattgggataatgacatccacatgcccacttcacagagctgctgtgaggactggatgagaaatgtagagaagtatttcggacaccataaagctcaaatacaaggtgttggttaggaaaagtttcaactgacttgtacccacctgatacccctccatcagcataagcgtgtatgaggatgttaggtacatgtgttgtgagtgaaagctctggaacacccgagtagagctttctgcaaatcagcttctccttcagaggagaccattttgttttgctttccagcagttacttgaagaagccttatctgaagtcacaacagtgacttcaggaatagaagggaccaatggccagcttgctgaaatgtaatgccattcttaaaagccagctaagaatcagaccgtattagttaaggacccataagagtagacatttagaaaaagtgaaaaatggcaagagtggcccaatcttttgagagtttagagaaaatatcatttggaaagggagtagctctccttctattttagccttattattacggtatctataaagcaatgccatattctaaatctgcagaaataaaattctaaggggcgaaagtccaaggcagaagtcaaaagttttgcaaggaaaccgatgaggttgctgacctgagctgggcagggttgaacaggcgagtgccaagatcaaggtctctgattgtctctccttgaaaggtaagcagagaactagggctatcccataaattaagtgggagattggaaaggggtgcggacttctgtattggggagaaggtcttggatgaactggggcagagaactgccagagagagtacctaggaatacgttgttagcaggagaaagaccaagttcagatgcagacttgggaaagtaggtaacttgaccaaaggtagcaaaattagactacccaactggattgtgaatgcagtttatgaaatggatcaggacaggagcaaaaatagattttctagaaactgcagactcctgtgattggagcagtatacaaagtacagcaacatcagactagatctcacctgaggtgctgggtgagaaatcttagggaccagatggaagagggcctgtgtataaagacattaggaaggaggtttgggaaggtttgggagggcagcctgacttgtctccagagaaagttagaactggttgacttagcaaccaagggacactgggtcaaagacgaggaatcaggacgtcggtgcctagtgactgagcgccagcccagcccatttctctacattgccatgggctaaacccagtgtgctgtaaactcttcagttcctttggttatggattttgtatcttttctgtgtttcttaataaagttcttttgaaaaatggga

SEQ ID NO: 686507 - DNA, 1521 bp, Homo sapiens
ggcgggtggatgacctgaggtcaggagttcaagacagcctagccaacatggtgaaacccccatctctactaaaaatacaaaaattagccaggcgtggtggcacatgcctgtaatcccagctactcaggaggctgaggtgggagaatcgcttgagcccgggaggcaggggttgcagcgagctgagatcgtaccactgcactccagcctgggcaacagagtgagaccctgtctcaagaaagaaacaaaagaaaaagagagaaatcaggaacatcatgaaagatacagcaaaatgttttaccccagcccattgcaccacacctgggattgtgacaattaacttgataaattgttccttttcctgttcggaactgactaggttgtgcgtggatggaccagtgaaaagaaaatcctgtttgggtagggaagagggaagtagaaaacctctttcgtattcttggtgtcaagaaatgggaagagaatgagggagcagagacctgggttgagtgttggctctgcactaaacagctgtgtgatcttggtctagtgccttaacctctctgagcctcagtttgtacatcagtaacattgggataatgacatccacatgcccacttcacagagctgctgtgaggactggatgagaaatgtagagaagtatttcggacaccataaagctcaaatacaaggtgttggttaggaaaagtttcaactgacttgtacccacctgatacccctccatcagcataagcgtgtatgaggatgttaggtacatgtgttgtgagtgaaagctctggaacacccgagtagagctttctgcaaatcagcttctccttcagaggagaccattttgttttgctttccagcagttacttgaagaagccttatctgaagtcacaacagtgacttcaggaatagaagggaccaatggccagcttgctgaaatgtaatgccattcttaaaagccagctaagaatcagaccgtattagttaaggacccataagagtagacatttagaaaaagtgaaaaatggcaagagtggcccaatcttttgagagtttagagaaaatatcatttggaaagggagtagctctccttctattttagccttattattacggtatctataaagcaatgccatattctaaatctgcagaaataaaattctaaggggcgaaagtccaaggcagaagtcaaaagttttgcaaggaaaccgatgaggttgctgacctgagctgggcagggttgaacaggcgagtgccaatgccaaatccccctctgcgagaaacacccaagaatgatcaataaaaaattaaaaaaaaaaaaaaaaaaagaaaaccaagaagatgggaaaaccatgcagaattgatttgacgaggaaagccttggtctctaatacatgcaatgactagaacagtatttggtcaaagaaccacataagctctgtaccctggaggaaatgtatgcaggcaaggactagtaaaataaaaaataataataattcagagccaccaacacaacag

SEQ ID NO: 686508 - DNA, 581 bp, Homo sapiens
cctaatcggtcaattgatacacttgagaagcacatcatcatgctgacagacaagaatcttggccaagtatccaaataggttgactgtaacccaaatacagaggttgccaaatctgtctagctcgaggtctggtgaaaggggcttacagaactcgaatggaaactccatggtcatatattaatgccagcatgtaggctaatatgtattacaaattaggccctatctcaagtcccacttccagtagcattaggcaccccaattctattgaatgcaacagttgtctctatgaccgtaggaatctttgaaacgcagccgcattttaggacgatacttctccaaatacagaagttgctatgctgggtattttggcacctaatcttcctaaatttcttatgtattgataagattctggcatgggaatagatttaacaagtcataactcaatactgcatgatttggggaaaggtcaatcgatacaaatgacaagcacatctttatatgctgacagcaagaatcttttgccaagtatccaaattggttgactgtaacctcaataccgaggttgcccaatctgtctaagc

SEQ ID NO: 686509 - DNA, 602 bp, Homo sapiens
gtagaaagaagtagacatgggagacttcatttgttctgtactaagaaaaattcttctgccttgggatgctgttaatctaagaccttacccccaaccccgtgctctctgaaatatgtgctgtgtccactcagggttaaatggattaagggcggtgcaagatgtgctttgttaaacagatgcttgaaggcagcatgctccttaagagtcatcaccactccctaatctcaagtacccagggacacaaacactgcggaaggccgcagggtcgtctgcctaggaaaaccagagacctttgttcacttgtttatctgctgaccttccctccactattgtcctatgaccctgccaaatccccctctgcgagaaacacccaagaatgatcaataaaaaattaaaaaaaaaaaaaaaaaaagaaaaccaagaagatgggaaaaccatgcagaattgatttgacgaggaaagccttggtctctaatacatgcaatgactagaacagtatttggtcaaagaaccacataagctctgtaccctggaggaaatgtatgcaggcaaggactagtaaaataaaaaataataataattcagagccaccaacacaacag

SEQ ID NO: 686510 - DNA, 756 bp, Homo sapiens
tgtttaagacaaaatgaaagcaaaaatatagagttccaagtatggtgtagataatctagttgggaatactttgaagtctcaccttccccttataaactaatattgccataattggttccgatatgttctgaagaagcactttaatgttacaaattcaaatgcaatatgggagcatttagattctgagtgtttagacttaggtgggtagcaatggcagtaaacttaaattacgtaagcttcttgcaagccacgaaaccgtgtaaatacgctgtgcgagtaacgaagtgtaggctgttatcagttgaactgtaaatacaaaagtgcttcttccaagttgagtctctatgatgatgaagtttctaaggatttatctgaacaccattcagaaagcttgttgggggaattgatagttatgatgtgcatctgttaaacggagtgacagacgataactcatcattccccagaaaccttttttgattacagtatctaacatttgcttcctcttttggtttgccggttataacggttgggattggacgagggctcactggatcccaattgcttggagctggtcatttggattcacctcatcatgtggctcggatagggcggatgacttaccaggattccgggcagcgggatcagattaccacgacatgggagggtttccttcccaacaagcggatcggggtttttatcaacttatggtatccagattttcttctatcttggatgggccttagatgcgaggatggt

SEQ ID NO: 686511 - DNA, 358 bp, Homo sapiens
  misc_feature (5)..(6): n is a, c, g, or t
  misc_feature (14)..(14): n is a, c, g, or t
attgnngggggggnattccccaaccccctgatatttacaacaactggtgtgtgtgtttttttatctgctgaccttccctccactattgtcctatgaccctgccaaatccccctctgcgagaaacacccaagaatgatcaataaaaaattaaaaaaaaaaaaaaaaaaagaaaaccaagaagatgggaaaaccatgcagaattgatttgacgaggaaagccttggtctctaatacatgcaatgactagaacagtatttggtcaaagaaccacataagctctgtaccctggaggaaatgtatgcaggcaaggactagtaaaataaaaaataataataattcagagccaccaacacaacag

SEQ ID NO: 686512 - DNA, 697 bp, Homo sapiens
  misc_feature (519)..(519): n is a, c, g, or t
aaaaacataaataaatataacgaaaaccattctccacataatgcagcagttgtcagcctgggaaaaacttaaggtggcgcctctatagtactcaattttagagagcttcattatggtgcagttcatacgcaacctggtacttgcagaatccacttatgccatgtgtacacggtgaagaaatagtagactgggtatatcattggttgcgcccgtatgaacattactgccacattttcatgtatagtacatcttacctttcattaattacttcttggcaatgatgttcgtgctcttaggcgactcagttgcagtttccttctctccgttgtttcgttccctgttcattatgcgttcagcttcgtgaggacctatatgagggtagaatcatattatcattcttaatagattcacagaaatttgtataggcaaagcaatttcttgaagagttgagtggccaagattttgaagacatgttgatttttcgagtatctagtttataatcgttgtcgacgaactccnacattaatagaagtttggttatatttcatgtgaaaattttcttccagtagtacgttctggttgtccgatgggttggggggtaactttactacatattagtaagtatggtgcagaatgttcatgcggcatgaggagtgccagctagtgtgataactctaaccattcttgtaatcaaaag

SEQ ID NO: 686513 - DNA, 1840 bp, Homo sapiens
ggcgggtggatgacctgaggtcaggagttcaagacagcctagccaacatggtgaaacccccatctctactaaaaatacaaaaattagccaggcgtggtggcacatgcctgtaatcccagctactcaggaggctgaggtgggagaatcgcttgagcccgggaggcaggggttgcagcgagctgagatcgtaccactgcactccagcctgggcaacagagtgagaccctgtctcaagaaagaaacaaaagaaaaagagagaaatcaggaacatcatgaaagatacagcaaaatgttttaccccagcccattgcaccacacctgggattgtgacaattaacttgataaattgttccttttcctgttcggaactgactaggttgtgcgtggatggaccagtgaaaagaaaatcctgtttgggtagggaagagggaagtagaaaacctctttcgtattcttggtgtcaagaaatgggaagagaatgagggagcagagacctgggttgagtgttggctctgcactaaacagctgtgtgatcttggtctagtgccttaacctctctgagcctcagtttgtacatcagtaacattgggataatgacatccacatgcccacttcacagagctgctgtgaggactggatgagaaatgtagagaagtatttcggacaccataaagctcaaatacaaggtgttggttaggaaaagtttcaactgacttgtacccacctgatacccctccatcagcataagcgtgtatgaggatgttaggtacatgtgttgtgagtgaaagctctggaacacccgagtagagctttctgcaaatcagcttctccttcagaggagaccattttgttttgctttccagcagttacttgaagaagccttatctgaagtcacaacagtgacttcaggaatagaagggaccaatggccagcttgctgaaatgtaatgccattcttaaaagccagctaagaatcagaccgtattagttaaggacccataagagtagacatttagaaaaagtgaaaaatggcaagagtggcccaatcttttgagagtttagagaaaatatcatttggaaagggagtagctctccttctattttagccttattattacggtatctataaagcaatgccatattctaaatctgtctgtattggggagaaggtcttggatgaactggggcagagaactgccagagagagtacctaggaatacgttgttagcaggagaaagaccaagttcagatgcagacttgggaaagtaggtaacttgaccaaaggtagcaaaattagactacccaactggattgtgaatgcagtttatgaaatggatcaggacaggagcaaaaatagattttctagaaactgcagactcctgtgattggagcagtatacaaagtacagcaacatcagactagatctcacctgaggtgctgggtgagaaatcttagggaccagatggaagagggcctgtgtataaagacattaggaaggaggtttgggaaggtttgggagggcagcctgacttgtctccagagaaagttagaactggttgacttagcaaccaagggacactgggtcaaagacgaggaatcaggacgtcggtgcctagtgactgagcgccagcccagcccatttctctacattgccatgggctaaacccagtgtgctgtaaactcttcagttcctttggttatggattttgtatcttttctgtgtttcttaataaagttcttttgaaaaatgggaacctttctcagatgggaattttgtatctttcctctgtttcttaataaagttcttttgaaaaattggaaaaaaaacaacaaaaaaaaag

SEQ ID NO: 686514 - DNA, 733 bp, Homo sapiens
agcgggtcagtccctcctgtagccgccgccggccggcgcccgccgcccctctgccagcacctccggcgccacctcgggccggcgtctccggcgggcgggacgccaggcgctgacgaggcgcgtgtgggggcaggcctgagtcgctcctgctggctgcgactcaggctccggacgtctgcgcgttccccatggggacttggccatgctggcgctctgaggtcgctctgcagatttgtcatcctgcatgttaccaaggggcgagagagcgagacgggattatggaatatcgttgcgagagattggccgtattgatgagaagcgtaggacaatatttctttacaatttgccgatcgtcgttgaggtggatacgcaataatggaaggatcgaacgaaatcgatggaacaacttttggttcatgaaaggagtttcgagcgtgccacttacctcgactgacatggtctttactggcgcaaaggacactgtctggaaccagcaagagttacttgatagctttctatcgttgctgactgactacaggactgcccttactatgctggcagacccatggggagacacttctatacatgaacacaatcatgaggtggcttaatatggctcgtccacatcgatggtacagcgcccatttgtatcgcagcacaagactgttaactgactacgcggaaagcgccagtcgcgcaagatccttgcgtgctaccggcgacaggactttga

SEQ ID NO: 686515 - DNA, 335 bp, Homo sapiens
ccccataacaggtcctcagggctggaataagtcctactatgcacactgtactgatatagctcaatgtgtttgaaagtccaaactcataaggtgccaggaagcaaggactgtgattctcaaggccttgcccagtggctaacacatgcagacctaactgacctgtgttcttctcaaactttaaaacatttattttaaatgtccatttaaatcacttattttcctttatcaaagcacagcaggaatattctttacagagtagcctacgaaagtctcaagaccatcaaccatttacaaccataaactatttgcaatggcaaaataaatacggaaatgta

SEQ ID NO: 686516 - DNA, 113 bp, Homo sapiens
  misc_feature (67)..(67): n is a, c, g, or t
gatctcataagaaatgtaatatgtaaataatatcttgctttatgttgtaaaatatacattgtttgcnctagaatagaaataatttcttttcaataaaaagaaagaaggactct

SEQ ID NO: 686517 - DNA, 242 bp, Homo sapiens
ccacctcagctcctgagtagctaggaccacaggcacgtccaccacgtccagataattttggtatttttagtagagatggggtttggccaggtgggccaggcgggtcttgaactccggagctcaagcgatccacccgcctcagcttcccaaagtgcggggatggcaggtgtgagccaccaggccggggcccaagggctctttaaagagagacatttcccttaattcttcttctacgccctcac

SEQ ID NO: 686518 - DNA, 252 bp, Homo sapiens
ctcacgatcacgaataaaaccgacgagagagaatggtgaacgggaagtgctgggcatgaagcgagacaagagtgagcagccctgccattcagctacgtctcaatagaacctatggttgttgatgttgaagattattacccagtctttcctgtgacatggtggctgagctctggtggagtggcaacgatagactcatcaccagtatgacagattcatctgacggagagatgttcaccgattcgatgccgtaca

SEQ ID NO: 686519 - DNA, 119 bp, Homo sapiens
acagtccaatataaaaatatagaaaagggcttaattcatgaagtggctataggtggctctttctcaaaagtgctcacatgagggtcacaagaagcactatattggtcagaccattggta

SEQ ID NO: 686520 - DNA, 597 bp, Homo sapiens
  misc_feature (14)..(14): n is a, c, g, or t
  misc_feature (67)..(67): n is a, c, g, or t
  misc_feature (87)..(87): n is a, c, g, or t
  misc_feature (98)..(98): n is a, c, g, or t
  misc_feature (100)..(100): n is a, c, g, or t
  misc_feature (106)..(108): n is a, c, g, or t
  misc_feature (123)..(123): n is a, c, g, or t
  misc_feature (126)..(126): n is a, c, g, or t
  misc_feature (138)..(138): n is a, c, g, or t
  misc_feature (171)..(171): n is a, c, g, or t
  misc_feature (174)..(174): n is a, c, g, or t
  misc_feature (211)..(212): n is a, c, g, or t
  misc_feature (222)..(224): n is a, c, g, or t
  misc_feature (266)..(266): n is a, c, g, or t
  misc_feature (278)..(278): n is a, c, g, or t
  misc_feature (298)..(298): n is a, c, g, or t
  misc_feature (313)..(313): n is a, c, g, or t
  misc_feature (385)..(385): n is a, c, g, or t
  misc_feature (412)..(412): n is a, c, g, or t
  misc_feature (419)..(419): n is a, c, g, or t
  misc_feature (426)..(426): n is a, c, g, or t
  misc_feature (436)..(436): n is a, c, g, or t
  misc_feature (444)..(444): n is a, c, g, or t
  misc_feature (486)..(486): n is a, c, g, or t
  misc_feature (496)..(496): n is a, c, g, or t
  misc_feature (522)..(522): n is a, c, g, or t
  misc_feature (563)..(563): n is a, c, g, or t
  misc_feature (585)..(585): n is a, c, g, or t
ataaagtgcaatgntatttccaacccctgtacatatgttccaaattcaagtattgaaaatgcccagnaacttactatagcagcttanctttttttttntnccacannntttgctacggatttnggnccttcaaatgtnttaaatgtgtgggacaatgctacatctacactnggntggcttaatcaacctcttcaatggtgggccctgaggnngcaccaccannnggggggggtccaccaccagggaatcccccaggcattcctccnggcatgcctccngcactctggtacagcttggngatgatgggggggcnaactttctccagctctttctgttgatgttcaaattcttccttctcggcagtctgattcttatcaagccagtngataatttcattacacttgtccagaancttctgngtggccncaccgggaancgggcctngaagtttctcatcttcaacagttgctttcatgttgaaggcanggactcaagngaattcttggatgacaccttgtcccnctgcttctcatcttcagctttgtacttctcagcttcctggnccatacgtgcaatggcttcctngcgcaaacggcc

SEQ ID NO: 686521 - DNA, 365 bp, Homo sapiens
  misc_feature (266)..(266): n is a, c, g, or t
  misc_feature (337)..(337): n is a, c, g, or t
  misc_feature (351)..(351): n is a, c, g, or t
ctggctggacattacccataaagatgaaagctttgtcaaagagcatttccctaccctgtatgcccgtctgcttgaactagggatcgatattaccaaagacatgattccagttgttccggcagcccattatacttgcggtggtgttgtggtcgatgaacatagccagacagatattgccggactctatgcgattggggaaacctcttatactggcctgcatggtgctaaccgtatggccagtaactcacttttagaatgttttgtcnatggaatgagtgcaaccaagcacattcaggaaaatttcaaggccgatcagccaactcctgcagttccaacntgggatgattctcnggtgaccaacccgg

SEQ ID NO: 686522 - DNA, 120 bp, Homo sapiens
tggcagccaagttgttaggagcactttgttgctgtatttgtgatccaaggtttgattttggtaactcaaggctttaaaccagctgattcccttgggccagttgactgactcttccatttg

SEQ ID NO: 686523 - DNA, 631 bp, Homo sapiens
ggtttcgtctttatccgggtccagtcctccctgtttatgccatcagtctttttcccttcatgaggaccttcctggtcgtgccagaccccagttggtcctctacgatccaggattgcccccggtgacccttattcggggtctgggggaccctgtcgccgaggcccttggccgtcgctccgaactggttgtatgtaagtatttgactcacattctcgcgtgggctgtaccccttcgacctagtcaagcacctggcacagaatactctattctcgacagcgctcgtgcccatccaagggcacggatcctcacccctggaggagcccttattatgaaggtggcacttggtcgaggctggtgtcccgtgcaatactggccgagcctggcatcactgtcacccacctggctagtttaccgggtcccacagaagtgggaaccgcgctgagctcctgcagatatttggtatctacaggcgatcccattgcccaactgtgaggggcctctatccccgagcctacgggcggggtatgcacttcgtgcgggggtcatatacattcctgagattctgggtaaggtgctccaagatgtactgagaggacgggcttaatatatgttttgagaaaaaaacataaaa

SEQ ID NO: 686524 - DNA, 735 bp, Homo sapiens
ccaggaggcagaggttgcagtgagccaagatgcgccactgcactccagcctaggtgacagtgcgagactctgtctcaaaaaaaaaaaaaaagaaaaaattctttatcgggatcggttaaaccatatttttatggatcatgggcaagctgaaattttggagaagatggtttctagtattaggtgatgaaaacatttgggtaatatggctgtgggctctcaaagaattttagtgtcttaatcttggctagaagaaagacaattatatatatatttgggcgtaaattacttaaacattttaattacattcagggttctattttaaacattggttttactcactggagggccacttttaaatattcatactcttgggacataagatggctgggtatatccctcatttctttaagtctaagtaagtcagctttaaaaagtacctggcaaccagaaccttccatattctgggactaaatctggcctcggataatactccagtggcagacctgtggtgttggccattttggaagaggagatagtagctattattattttacacgttgtttgatgtgataactcctaaagactttttagtggataaaaggcggcaattggtatttgtgatacccaaaggtggtgtgtggctacctttagaagcctgtggggcaaaatggtaattctaattttcatacctggtttttggattcacaacaacaacattattggggccggctttcc

SEQ ID NO: 686525 - DNA, 372 bp, Homo sapiens
tcgctctcgacacctcgacagctagaggggggctgaaagcctgtggtcccaggagatggagatgccgtttgtggcgatgatctccttgcagccttgctcatctccgggcatcagaccctctccctggcccttgatttcctctacaccatggagcctcacattcgtaggccagttgtgtgcatgctctagacaccacctcggtgtagacgctggaagggctgatgacttcccagggctgactcttcacatcaagctcctctcctcatcttttttgtgtgtgaggccaggtcttgactctaggtctcagctggaaccccaccctttctcctcctccttcctctgagctgaccagcagcaggtctgccgaccacc

SEQ ID NO: 686526 - DNA, 383 bp, Homo sapiens
gtagaagattggaataacagccataggggcgttgaatctttcataagagtagatgatccaacatatctcagcagtgacctagcctcatctctagaagctgggatggactaactattctcgttatatatcttaattactgaaaggtgctatgctctctgttattatgccaagacttggagatagcgcagggcgtagcaaaggctattattatttctcctatataatggatggtgcgtccaattcttcctatgtatatccttaaaaataaagatggttgaatcacttaccattgtgaaaacatacctgtaagatttcccgtgtctgaacgaaagagcatcgatccaatgcttgttcacctgtccctctgtcataactgtttccat

SEQ ID NO: 686527 - DNA, 170 bp, Homo sapiens
catggtgatctagaggatcccgagaggtggggtgcacttgttaattgtggttcagtcttgtgcaggttgtggatggtcagcagtgcccttccacacagtcttgccagtgcttggggagaggggagagatgccacctctgcttgtgttggcccacccgtggtcccacctct

SEQ ID NO: 686528 - DNA, 832 bp, Homo sapiens
cctccccggggttttttccggaggtttccggcgcccctctcattctggtgcccgcccgccgaattgattttttataggccgggcttattgagctcttatagtgtggcgcggtgaacaccccccctgtttcgttggggcccaaaacctttaacctgtggcgcgccccggagaacccccagagttgaggagattttggcccttcgggcgcttctatatatctggcttgtcttcttgttgtgttcgtctctttgggtggtttttttttttttttgggccttgggtgacatcccagagattttaagaacatggggaccggtggaagagtgggaccagccacgtccggtgttggagcggagccatccccccccaagttctcacaccaatagtggcgccgaggacatttggatttgcgaccatatagtgtggttttgtctttaatatagtgccatgtccccaataatagagatagcggtgtgtgtcaccaggaagtcccctgcccactccttaaagccccccccccttctctctataggagaatggccccgtcctctctcccagtccacacaccggggaggtgatagcacttgctttcgtgtaaatttatgtataagccacatttttttaatcttcgcccttaatacttttttaattttgttttattttgagatgaatgaagccctttgtgcccccccttctccccttttttgtccccccaattgagaagtatgaagaagcttttggttttcctgggagtgggtggaggcaacccgggcttacctgtacactgaattgagacccaattggattaaagtgcacccccctttaaaatgga

SEQ ID NO: 686529 - DNA, 346 bp, Homo sapiens
cagtgctggatgtaaagtacccaaaattgaatagaaataatggcttttgaaaattgcacaaagcaggccaggcacggtggctcacgcctgtaatcccagcactttgggaggccgaggcaggcggatcacgaggtcaagagatccagaccatcctggctaacacggtgaaaccccgtctctaataaaaatacaaaaattagctggacatggtggcacgtgcctgtaatcccagctactcaggaggctgaggcaggagaatcgcgtgaacccgggcccggtggaggctgcagtgagacgagatcgcgccactgcactccagcctggcgacagagcgagacaccgtctc

SEQ ID NO: 686530 - DNA, 130 bp, Homo sapiens
gactaaaagagttgaggccagccaggaggtcaggcgtcactagtgcaggctgcattcaacaaacgcattgtcaacagtcaaccaaaagaaacccagcgggcggccccccagcccggcccgccgggttacc

SEQ ID NO: 686531 - DNA, 1173 bp, Homo sapiens
gaacccaggaggcggaggttgcagtgagctaagatcgcgccactgcactccagcctggcgactagagcgagactccgtctcaaaaaaaaaaaacaaggaaaaaaaaaaattttcccgggaaggggcaagggggggggaacaggggggttggaaacggaaatatagggttaggagtaagtaaaaagacaaacgcaataatccaggggtgggactccattctggaattccttaagcttgggataatccctccaaggtaatcaggggctctggagagaccccatttaataactctcttaaccaattgccgttataacctcccagtggacacctctgggctcccgggggggatacctaagcggcaatagtcgaaccaatattttgcagaaagatttcacagggcggtgagaaaagttgtaataccgattacgcgggtgcaaacattggggggtaacgacaagagacaaattttcacctgtggtcaactaatattttaacggcaatttttgttgtgaaaacacattacagtggcgcttaaaaagggctagagcgacatacacaaaaaattgttccgggcggtctcaccaacggcgccacccaattggttcccaaatttgcgggtgtgaagcccttctttaaaggtggcgtggaacgtgtgaaaatccgttggaggggggtgaccaatagggggggaggataacagactccgtgactgcgaacagttgggtggcacaatgggccgccgcgaatgggcttgtcaccgggatatttcttgagaggaggaaaaacacctgtgggcgcgctcacaacacacagtaaacttaggggctacgatgtgggcacaaacaaggggacatatattgataagggcccacgttcagataatcaaccgggtggggcatatatacaacacgtgtggacccacgcggggaaagagttgtcttgacgagattggggtggcacagcgcggcacatgcggcagaggcgctacttacgagaggcccctttcaccaaagcgcgcgcactgttcacaaccccaggtggcagcggagcaagaccacatgagcaaaggcgcccccccgcgcaagcaccacgcaacgccggcccaaacaagcaccaagcgcacctcgggaaccacacggcgcccccggagaaaccgccagcctacctacaacg

SEQ ID NO: 686532 - DNA, 209 bp, Homo sapiens
catccccacgtgtgctccagcctggcaacagagtgagactccatctcaaaaaaaaaaaaaaaaaagaaaaaaaataatttgggccctgggaggcagagtttgtagtgagcccaaaattgtcccattgaacccaagctgggggaaaaaattaaacgcttttttctcaaagaactgaaagagaaagaaaagcgcccagagggttgggattg

SEQ ID NO: 686533 - DNA, 894 bp, Homo sapiens
  misc_feature (1)..(1): n is a, c, g, or t
  misc_feature (74)..(74): n is a, c, g, or t
  misc_feature (100)..(100): n is a, c, g, or t
  misc_feature (103)..(103): n is a, c, g, or t
  misc_feature (107)..(107): n is a, c, g, or t
  misc_feature (110)..(110): n is a, c, g, or t
  misc_feature (114)..(114): n is a, c, g, or t
  misc_feature (171)..(171): n is a, c, g, or t
  misc_feature (191)..(191): n is a, c, g, or t
  misc_feature (194)..(194): n is a, c, g, or t
  misc_feature (204)..(204): n is a, c, g, or t
  misc_feature (209)..(209): n is a, c, g, or t
  misc_feature (218)..(218): n is a, c, g, or t
  misc_feature (233)..(233): n is a, c, g, or t
  misc_feature (327)..(327): n is a, c, g, or t
  misc_feature (439)..(439): n is a, c, g, or t
  misc_feature (525)..(525): n is a, c, g, or t
  misc_feature (618)..(618): n is a, c, g, or t
  misc_feature (672)..(672): n is a, c, g, or t
  misc_feature (750)..(750): n is a, c, g, or t
  misc_feature (786)..(786): n is a, c, g, or t
  misc_feature (794)..(794): n is a, c, g, or t
  misc_feature (797)..(797): n is a, c, g, or t
  misc_feature (802)..(802): n is a, c, g, or t
  misc_feature (817)..(817): n is a, c, g, or t
  misc_feature (887)..(887): n is a, c, g, or t
nggggcaggcgccaggcagggcagagcccaagcgggcgcgagaccggcccggggcccagcgaaaccggcggacnaccacacgcgggagaccacggccagngcncccngcncccngacccccaaacaccccagagaggggggccggagcgggggaaggccagccgggacccngccccagccgaggccgggcngcnggccttcagngccancccaccccngggcaaggcaggcgnagcagcgaagggaggcgggggggcacgaggccaggcagcaggaggcggagacgccgagcggcggggccaagggagggggggggcgcagccggcnggaacggaaaaagcggggggcgcaccggggccagaacggagcccaggggggcccgagggaggggggcacggggggccaggggcagcacggccgcggccagggagcggagcgngagggcagggcgagggccaagggcagaggccagcggcgggaggagggaaaggagcgcaggcggggagagcgggcaggggggcggcncaaaaaccggggcgggggccacaggggcacacacatacagcaccaggttcaggtcagcagctgtcagcgcctgctggaaggcctgattgaggnggccctgctgcagcagctgcaggatatgggcttgctgggcctggcagtcaaggngggcagaggggacaggtgtgccagcagctgagcgcatggcctgcatgatgctggaggtgacggcggcctgctgctccntgagcgccacactcacctcacccttaacgatgcgcngtacctgngcnaaaanggactcctgcaggcngcccacagccacatgcagctggtgcgcacctcagcacgaacactgccggccacggtggctgccatctgcncagtgga

SEQ ID NO: 686534 - DNA, 517 bp, Homo sapiens
  misc_feature (110)..(111): n is a, c, g, or t
  misc_feature (130)..(130): n is a, c, g, or t
  misc_feature (132)..(133): n is a, c, g, or t
  misc_feature (135)..(135): n is a, c, g, or t
  misc_feature (137)..(137): n is a, c, g, or t
  misc_feature (143)..(143): n is a, c, g, or t
  misc_feature (145)..(145): n is a, c, g, or t
  misc_feature (152)..(152): n is a, c, g, or t
  misc_feature (167)..(167): n is a, c, g, or t
  misc_feature (183)..(183): n is a, c, g, or t
  misc_feature (191)..(191): n is a, c, g, or t
  misc_feature (193)..(193): n is a, c, g, or t
  misc_feature (196)..(196): n is a, c, g, or t
  misc_feature (198)..(198): n is a, c, g, or t
  misc_feature (200)..(200): n is a, c, g, or t
  misc_feature (209)..(209): n is a, c, g, or t
tcgatacgacttttttttttttggccctttgactctcttttaatgccacgggaggatctccttgcccagctcccaggaatgtttgcccttctcagtctgttccacttttnngaggcagccaccaggcctnanncntncggccnanaaaacanaaaatttggggacanaacagtcattcgtgcncatcccananctnananagcagcggngggagctttttgtcctgcaaacccagtgcaaacacttgctttgagtggaccctgctcagggtccggaggctcaccagtttcattaacatccgtgggaacatcaatcggtcatggggatggtggatggaaacctaggcatgcagggcttccacatatgtgtgctgcagcctctctacctggagctggtcctgcacattgggccggtctgcaaaaaaaatgctgatagcaatgagcaaggcaaactcggcttcatttagttgcagcttatctatggccctggagaactcaaaaatggggttgagaatttc

SEQ ID NO: 686535 - DNA, 1281 bp, Homo sapiens
aaatataatatttttttataattccgggccctcaaaagcaatcagggtaggttaagaaccaagatttggagctcattaggattagaggccaacttttaaacattctctccaggtgagagtggaattaggaaacgtggctttagaaccccacaacagttactggacaatcacctttaaaacggttaagtctcttctcggacacgcaggaattcaggctagaatcatcccctgcgggcctcgtggtggaggtggcgtggacaccaccgtggcggcgtgcgtggggaaaggcggtgcagtggcgggtggaagcgggctccgggtctcctctccctctctgcagagcgccctgtgtgccctccctgttgcctgtgcgccccacctgtgggcgcaccagacgggggggaaaagcaggagtcacaaaactatgctgcacccacctatgaatgataaattccaacccaaaagtggtgatggacttattcctcaaaacaaccccggggcaacagttggggagaacaattatacacccgccggacaaccagatggtgcagaagggagcatgttaggtgtcgcacgattagcaggaacaaatattgcttccccccaacaattaccccccaggagggtgggaacgaaagaaacaaacaaaaaaccaacacactcattgatggcgacacaaccacggaggtagttcctatccaactcggtttggccgaacaaacaaccaaatcaacgaagtaatgcaaagaaaatcatttccccccacgaaatgagtttggcgagcgccgtgatcaaataacataagtctgggagggggcgggggtagtttagtgttgttccaacatagtatcgtccgcctgggcgacccgcgccaagcgaggagatagtttttgattaccgtccctacatagtcgtgtcaagcatttaaaaggacacacaacaacgcccccgcgtgggggaatacttaaatttatctacaagggatattgattaaaccacaagaatccataccgaaagtttgtggtaaaaaggcgcctccaccgcttgtatttagttataaacacatgaaccactggaaacacaaacatgttgttgtagcgaagactactcccccgccatttgccgcgattaaaaaaatattaccaaagaagatctataaaacacagttagttcataatggtgtggtcgtttggagaaacgaagagctaacagaaacacaagtagggggggccccaatcttgttggtctgtatacaaacaaccaaacaatgtgggggggccc

SEQ ID NO: 686536 - DNA, 740 bp, Homo sapiens
gatggaaaagctaaactgagatcagacgggatgcgtgttgccagatcaaatctcttgctgctactgtaatactagtccatatattctacaagatcagtgtatgtgacgcgacccttggttgtcagttccacgtacatgacctaagtcgtttacacgtcctgttgatccccagcgtgctagttatgtgctcatagatccaagatgctacgtatgaatgtactttcgaagctacaaaaactatacatgggcaacccgttgtcctgggagatacattcctatagttacttcgacggtctccagcatgagtggcgtatcattccaattgtgattacctccagtctcagtcacagccaggattacggaatcttttgccatgaagtatcaatctacatgggtgctacacattactgaaaaaaattaggaacatggtgctagttaattcaagtcttcatgtaaaacttcttctatcatagtggacattaaaaaaaatctctctgcaaagtgcattgaccctacctctagtagatgaatgttgaacaagtagcctatgtaggaagcaagtgactagcatccatgggcatcccacaggttgtagtccagccccgatcttggtggtgggattgatgttgctgccaagtccctccgtttcatgttcagggctctggctatgttcctggtgtctggtacctgatttttcaggatgctgacatttacttcttgcccacaaaacatatacccta

SEQ ID NO: 686537 - DNA, 267 bp, Homo sapiens
ctcccagaagagaacactctcatgtgccagatgcagaatgagctcagcaaaaacagagaagacagagaaaccaggagctcccatggcagacattcaagtactatggtatagacgaaagctgtattttcttcttaatgcagtcacgaggatatgggttccatagacattagtaattatcagagctctcagactcttctccaataggacactgtcatgactagtctccctgctgctgaattggagcaattgcttttactctccagatag

SEQ ID NO: 686538 - DNA, 414 bp, Homo sapiens
gctgatggtctgattctagaggtatccccgtctgatccgcttaaagagacagagcggtagaaggcgctcattgtaggcatgataaaagtggtccaggtggtctgtgatcacctacgggacagtaaggtgatgtagaaggagacgtgagaagaacatttcagaaattgagtatgctgcttttctggcccgggagaaggcaaaggcagatgctgagtgctacactgctatgaaaatagccgaagccaataagctgaagctaacccctgaatatctgcagctgatgaagtacaaggccattgcttccaacagcaagatttactttggcaaagacattcctaacatgttcatggactctgcgggcagtgtgagcaagcagtttgaggggctagctgacaagctaagctttggcttaga

SEQ ID NO: 686539 - DNA, 172 bp, Homo sapiens
taagaggtatatctaggccatgcttcacaaatcgtgtgatacaccagagagcctcagaattacgctcactcaaaaatcctgcttcaaggaatatacctaaaagaattaacattcatccaagccctgtgtctttttgtttttttttttctatttatgttttattatttctttt

SEQ ID NO: 686540 - DNA, 361 bp, Homo sapiens
  misc_feature (11)..(11): n is a, c, g, or t
gacacatagantgacttgcagaggatgggctgtttacttcaagcaccataaaaaaaaaaagagcacaaatgcatgggtttcagggtatatacattaaagttgaacccttgggcacaaggaatcaggccgtatggtcacatagcataaacacatattagacaatggtgtagtgtcaaagggataggacccaccagcatcctatggtggtcgacaaccaatagaatgtgttacatgcagactcgctcaagggcataagttatggtgacggtttatgccaatcactgctcaaaagccctgcaaaatctggaatgatgctgaataataatgcggactaattccaacccagattgagacacaccat

SEQ ID NO: 686541 - DNA, 276 bp, Homo sapiens
gcgacgtcgtactaccaggagattacatgtgtacgggtggcccgtgttctcccgaggtcgtgtcttccgcgagtagccccagagtgtccccgagaagggcccacagagacgcaaactccgtgcttgatctcggataagataccacattctaactgctgaggtcccagcctcaggccaaagttctgggtcagctcggacccggaccgcgttctccctcccagggcagaagaggctgctggctcctcctgcatcatctcctaggatacagtagggaga

SEQ ID NO: 686542 - DNA, 414 bp, Homo sapiens
ttcgccttcctcaccctgggcggcccggcgtcgatgatcggcttcgccatcgcccgcgactacaacccgctgtcccgcgtcggaaccgcgaccggagtggtgaacgtcggcggcttcctggcgaccaccgtgaccgccctgctgatcggcatcctcctccaggcgaccggcggcaacttccggatcgcgctgctggtcgtcgtggccatgctggcactgggcgcttcgcgaatgctcgtgtggtggcgccgggcccgcgcccacgtattcgccgcggaagcccgaggcgaagaggtcccggtccgcatccggcggcaccgctgggaccgcgccccggaagaggccgtggccgccgcctgagccacccgcgccgacccggttcgaccgccccgagcatgcgtccggggcggccgc

SEQ ID NO: 686543 - DNA, 255 bp, Homo sapiens
aggtgattaccctcaggtgtcctgtgatgctggtggtaggagaccaagcacctcatgaagatgcagtggtggaatgtaactcaaaactggaccccaaccatgacctcgatacctacaagatggcatgactccaggaggtcagccccagtatgactcagccaagagcaagctgaccgaggccttcaagtacttcctgcaatgcatgggctacatggcctcaatcactgcaatgactcgcctgtcccggtctcgtaa

SEQ ID NO: 686544 - DNA, 136 bp, Homo sapiens
accagtgcggccaaaggaagagcctggtgttggtgcatgtgcgttatggactagtcgattatatgctatgcgaggtgattattctcacgaggagcatacttgtacacatattttgcacttcaaccagattacgtgt

SEQ ID NO: 686545 - DNA, 832 bp, Homo sapiens
cctatgtaacagtctggtcacttttccgaggagctactgtagtatgctgggggtctactccagtctctagtcaccttggattttccagtacctggagttatcaacagtaaagactatgaaacagcaaagatggtgtcctgcccctccctctgggagctctgtcccagggaggtttcaaaactctgtctgctggagaacactgatgagggtagctggagaacccagttggaaggtcctgcccagtgaagaggaacagggctggaggcttgcttaaaaaaaaagcaggccatgtttgcatataagccactgtgctgtgctgggggcccacttcaggccccagtcacctcagactctccaaagcctgaaggctaaaacggtgaagtcagccaaacagcaaaggtagtggctggcttgtgctgggagctcttttcagggaagtgtaacactgctaccagtggctgaaatggagttccaagccagtgggtcttatcctgtgaggtgccatggaagcaagggccatagactatgtgcttctcaggccactggattctgccccttatctaagtggtgcgtatgggaagcccactgaactccggcttggcaagaggttacagctcctttgacgagggaagccggaaagaccaggtatcataaggccccagggcccctgcatgtgaaggggcgaaattccaaggacgggggatccagggtgggtctgcgggtcaaccgagccggtggacggtacagagagaattacccaccgggggcagacccggccaacatggcccggggcaaatacacaccccgcggaggggcgctggggagaaccacc

SEQ ID NO: 686546 - DNA, 495 bp, Homo sapiens
ttcgacggtgttctgataattctgtggctacaatggaaatggttttgctttcagtgaagcaatgacatatttattctcacacctgtaatcgcagccccttgggaggccgaagtgggcggatcacttgaggtcaagagttcaagatcagcctggccaacatggcgaaatcccgtctctactaaaaatacaaaaattagctgggtatggtgccaggtgcctgtaatcctagctactaggtaggctgaagcagaagaattgcttgaacccaggaggcagaggttgcagtgaactgagattgtgccactgtactccaggctgggtgacacagcgagactctgtctcaaaaaaaaaaaaaaaaaaaagactttcctcgtgtggataaggtcctgtaccttaagggggtgggctcatacagtggtgtgcttccgtcaaaccccttggatttttatccgtaagatttatgcacttcataatttgcagggttaatctcaggga

SEQ ID NO: 686547 - DNA, 81 bp, Homo sapiens
attgactaaaattgggtatagtatggtatttgaaagaataagcatatgctaaagtttattaaaaaaagaaaccttaaaaaa

SEQ ID NO: 686548 - DNA, 1615 bp, Homo sapiens
cactgaccagccttgacactccccttgcaaaccatctcatgtcgaaggccaatgctaagagtggctgcctggggtgcagtgctgggactggtttgcaaggggagtgtcaaggctggtcagctgattactgggcgaacgagtcagggcccatcacgaggacatgaagtggcctaagggctgcctccatgtcctcaataagccacaagctgcacattctgctctgacaagcggacagttctacgcaatcctcaccaggacccaaagatggaacgcccgtcagtgactgcgcagcgcccgacacggccacagcaagcaagccgctccgccccctggtacgccactgggcccttaacacgtcgccatcctcacgaaaactcaccaacggcacctggccccaggcaccgcgagaacgcacacacaagaggaaagaaccccctgagccgacctagcccaccgtgccaccacaagacctgcgagcaaaccaactcacacccaacaaggaccctgccaacacacacacaaccaccggaaaccacacgccccccgcactccccgcacccgaccacaccccagagccaaccgcaacagcaacacaccccaacccacccacccccacagcacaaccggacacacacagaacgcccacccccgccaacagccaccaccccccacgggcccccggccaacacaccaccaccccaccccgaccgcccccacacacccacccaacgccagcgccagccaccgctcacccacacctcaccacccaaacaccgcagcacagcgccaaccccggagcaccacgccactgcaccccacacaccaggccaaccacgaacccagaaccaagccaccccccaccaccgacgcaggaaacccggaccgcaccacgccacacaaaccggcaaccaagaagccccacacacaacagacgcacggcaacctcgcacacgcgcggccccacccgcccagccaatcaccccccacgcgacacgcagagcacacacgacgaagcgaggacagccgcagaggaacaccacgcccacccaccacccgccgcacgagctccacacaacaccgcaacccagagccccccaccacccagccccgccccgtgcgcccaccacccccccgcccccaagcccccaggcggccaaccgccacagacaacccaaccgacaggacagcacccccggcagggagagataaggagcgcactcgagagcgacgagccacccaaccaggcgcagaccaccactccagccgaaaccacgccggctcctccccgtgccgccgggaaagaccacagacacgccaccgcacaaccgcccccacaatacaccacgagcggccgacgggcacagacggccagacgtgcacgcaagacagggacggagcacgcgccgcacactgcggtgcgaggagaaagcaagacgccacagagccggaacacagcagcgcggcagagaggacacgcggagaactgcgcagcagaagcgcagccaccgccaggccgcacaccacgcccaccgcggcagccgcacagccacacagcgcgagacgaggagaaaagacgcaaaagcggcgagcgccggacgagcaggcggaagcaccg

SEQ ID NO: 686549 - DNA, 203 bp, Homo sapiens
ggcgatttaccggtctcaccatggagcggaaagtgcttgcgctcctggcccgattagaataggaccgaggtcccgactctttctccatttcctcaatttcctgcgattcgcttctctaggtaattctgcctggcgcttctgcttcttcttcaatttcttcttcttattctttgacatttggtcagctggtttatgctgcggag

SEQ ID NO: 686550 - DNA, 117 bp, Homo sapiens
cattccgcaaactattctagagatccatattaacaatagggtttacgacctcgatgttagatcaggacattccgatagtgcagccgctattataggttcgtttgttcaacgattaaa

SEQ ID NO: 686551 - DNA, 205 bp, Homo sapiens
gaacgatattagggatgagctgcaggtttctgaagactctgactccattactcaggtctgaaaagtcactactgctgaaacgtctcttcctgctgggtattctgacaagatagatgtactatctatgaagtcatcaggagccttctcaccatgcttgctctctcagatgccccgcatcgaggcttctgcgcggcgcctcctcctg

SEQ ID NO: 686552 - DNA, 443 bp, Homo sapiens
  misc_feature (337)..(337): n is a, c, g, or t
  misc_feature (406)..(406): n is a, c, g, or t
caaacttctggcctcaagtgatcctcctgccttggccttccgaagtgttgagattacaggcatgagcatcagtcttgagcccttcctttctttctgaagtctttccttcctctcctccaagcttttgttaggctatcacaactggccacagaactacagcgtcctatcttcaagtttgtgtccctctcttctttaagttgaaattcaaggtctacctcttccagggcagatgatctcttttttttcctaaagttcctgctctttattacattagaacaattctgatgtgatggggtttcatccaccacatctcacttgggggtgtgtaagtggggtnggagtgggaaaagcaataatgcctgttgtcttgagaaagggatgggttgcaccactacccctttaaggnatcagggtacccttaggggaatggggagtgagttctt

SEQ ID NO: 686553 - DNA, 180 bp, Homo sapiens
tctgtgaggacaggagcggacggggagcaaggagacccaagcccagcagacaccatcaaggccaatcagggccacatccccgccgcacccggcgagacaggaagcgtgatttgctggtgtgatcagtcagttgcacctccccgccctgcaggactcagtgtgtccggcagacagtcctac

SEQ ID NO: 686554 - DNA, 134 bp, Homo sapiens
gttttgaaaacatcagcaaatggcttagaaacataggatgagcatggccaatggaagatgtgggaaggatgttactagggaacaagtgtgatattggcggcacaagggttgtacctaaagggaaaggagaccag

SEQ ID NO: 686555 - DNA, 125 bp, Homo sapiens
  misc_feature (41)..(41): n is a, c, g, or t
  misc_feature (54)..(54): n is a, c, g, or t
  misc_feature (71)..(71): n is a, c, g, or t
tgggctttgtccgggttgccctggtgaccccaacctctgtncacttcctaaccnaaggaccctgcacatcnagaactgcctttggccctacggatggccactggctctggtctaaagtgcctggg

SEQ ID NO: 686556 - DNA, 292 bp, Homo sapiens
aagggcaggattctctgtacgccccagggaaacggcgttatgacaggaaacagagtggctatggtgggccaactaaaccgattttccggaaaaaggcttaaactccaaaaaagattgtgctaaggcttgagtgcgttgagcccccctgcagatttaaaagaatgctggctattaaaaaatgccagcctttttaactgggaggagataaaaaaagaaagggcccagtgatcccgttttaagggtcctctttttttatgaagcccataaaatcttgggtttatgttcccttcca

SEQ ID NO: 686557 - DNA, 324 bp, Homo sapiens
  misc_feature (118)..(118): n is a, c, g, or t
acattaacgccagctgagagtgaggaggctgggtggcatataccgactctatgtccacctggatgggatgacactggggggccacgaatgttcggtgatccgggactcactgctgcangatgggcgattcagcatggttcttactaccaagagcaccggtggggcccccaccttcatgtcactgtcaccaagactgacaagacgctagtcctgctgatggggcaagaaggtgtccacggtggtttgatcaaacagagatggtatgaaaatgccctccaccttcggcgttcccatactgacctcgtctgtcccttcccttcaccg

SEQ ID NO: 686558 - DNA, 141 bp, Homo sapiens
ccgtgggacctcctctgctcctccagtgcctcttgagcgttgaccttgattgctttctctgcctgctccttgtactgctcggcatcttgcgctcgtctcgcactgcagcaagatttccttcagcttcttgtctttctgctt

SEQ ID NO: 686559 - DNA, 181 bp, Homo sapiens
  misc_feature (96)..(96): n is a, c, g, or t
gcaaaaccataactccaagaaagcatcatcaacatcaccaccagcagcagcaccaccagcagcaacagcagcagccgccaccaccgccaatacctncaaattggcaacaggccaccagccaaaattgaggcacttatttaggttgagaaggagccgccgggccaaggtggcccaacattaa

SEQ ID NO: 686560 - DNA, 105 bp, Homo sapiens
ggggttagtgatgattttaaaattaaagcagatgggaatctctcaaaaaaaaactgtaattttgttatatttgattcaatggaatttacctaaaaaataaagact

SEQ ID NO: 686561 - DNA, 891 bp, Homo sapiens
aaaaggggcggtatcacagcccccgaaggactcctctcgggtgtgtgtagaggaaggggtggcgaagctagcgctggtcaacctacgggacagtgacagagtgtatagaacataggagacctggggattctcgaccgaaggtcgagtacctgctcgcttacagattcgctgctgtccagggcaccgactgtgagtggcagatgcatgaagtgccggtgacgcgccagtggttctatgcatctatctgcccaagactggcgagctcgaaggtatgatcacaatctctgctgcagccttgtcctcctaggctcaggtgatcctcctccctcaggcttctgagtagctgggactacaggcatgcaccacaaatgtctggctaattttttgcatttttggtagagacagagttttgctgtgttgctcaggcaggtattgaactctcaggctcgagcaatctgccctcctcagcctctcaaagtgctgggattacaggcatgagccactgcaccttgcccaactggttttcctttgtagaaacctgccaaattcttttccacggtggctgtgccattttgcattctcactagcaatgagaattctagtacttggtattgtcagttattctcattttacatgtgtagtgatatcacctttgattttaattttgcatttccctgatgtctaataatattgaactgttttcctgtgtttatttgcatctgcatattttcttggtgaagtttccatatcgtatcttatagccttctgttcgaaaacgtgagacagggtctagctctgtaacccaggctgaatgcagtggtgtgaccttggactcactggtgcttgaactccagggctcagtgatctccatttaaacttctgagtagtgaa

SEQ ID NO: 686562 - DNA, 612 bp, Homo sapiens
  misc_feature (2)..(2): n is a, c, g, or t
  misc_feature (79)..(79): n is a, c, g, or t
  misc_feature (177)..(177): n is a, c, g, or t
  misc_feature (292)..(292): n is a, c, g, or t
  misc_feature (382)..(382): n is a, c, g, or t
  misc_feature (500)..(500): n is a, c, g, or t
  misc_feature (543)..(543): n is a, c, g, or t
  misc_feature (547)..(547): n is a, c, g, or t
  misc_feature (612)..(612): n is a, c, g, or t
gnggccctggtcacctcgtaggcggccctcatctctgatcatggccacaccgcccatgacatacacgatgagccggggncccgcccggtgcttctacgccagccttgttcttgttgccagtgaccgaagcgtgtgcactgacagcggcctgggagcaggccgtgtgtgtggcggggncggatacgaagggccacaggatcctgttccagccgtgtcctccacggcgtcctccattacatccttgatgaccggtgtgtccaacgggacagctgaaaggtgggctccatgcgtnctctcggctccagccggctggaggtccccgagcccccggggttggttgacagttcctcccagctgctccaggtttacggattaagctgcngtccgcctgttacattggcatgctggattcagcttggccaggttctcctcactcacaccattccgaagagggatgtagagcagcaggacccggatcttgtcgtaggcgggcacgcgcngttccagcagcaccggaacgattcagcttcattggagtccttntatnttctcccccctctggcgtcgggagcccatggcgcaggttcttgctccgacacttacacagctttn

SEQ ID NO: 686563 - DNA, 674 bp, Homo sapiens
ggagattactcactaaggccacactcaagtgcaggggacgctatatcaggtgactgaaagggctgccttccagggttccgccatcactctgccggagcctccacaatagcagggactactggaggcgcgcaaaccactcggataacacgtgataggtctaagagacatgccttcaggccgggtgcacacacacccatgcagagttcactggccaatgatggctccgtggccacatatgacatggggggcatatgaggcgtacaccatgatggcctgccactgcaggagaccattcagcctaccgccgtaataattatgacgtggcgataatgatcaatcacccacaggagtgcggtagaccagaccacgatcactttggtgtctaattaagaggatggagcgatcctgctacctcagatgatggaaagattgcaccattagacggtgcgcacactgccagacaatttttttcttgctagtatagacaggggttccctatcgtgcgcccgtctttgattaaaccaccgggttggagcgaatctcccgctggggaacacaagctcctgacgaaaccacctgcctggtgaaccaagtatatctcttttgggggcacccaacaaaaactcagggttatttgccctaaagtagggggaacaaaaaaaaaacgacatttt

SEQ ID NO: 686564 - DNA, 108 bp, Homo sapiens
tatggctgaggtatctaaggatccccggcaggcgtgaagggaccgctcagtggcgatatgctgaaaggtaagacaagccaggcatctgtctggtctggtcccgcagtt

SEQ ID NO: 686565 - DNA, 174 bp, Homo sapiens
tggactggcagatgggcttcttgcagaagtacgctaccccgctgatcccctcacgaggtgaggtgaacgcggccgacgccttcgacattggctcctttgatgaggaggacacaaaaggaatcaagttactggacagtgatcaggagctctaccggaactttcacgtcaccatct

SEQ ID NO: 686566 - DNA, 184 bp, Homo sapiens
caccaagatgcataccaagaattctgggcttgacatggataacccagggactacaaagtaactaattcctcaaatgaactgactgacagggagtcctccgaaatgattcgggcctcaaagatctgtcctcaggggtcaggacgaaaacatgcagtataagttgatatagctctgccaaggagag

SEQ ID NO: 686567 - DNA, 419 bp, Homo sapiens
caggctgggagcagtggctcacgcctattatcacagcacttcattgggaggccgaggctggcagatcatttgaggtcaggaattcgagaccagcctggccaacacggcaaaaccctatctctactattgtgcatgcctgtagtcccagctactcaggaggctgaggcaggagaattgcctgaacctgggaggcagaggttgcagtgagccgagatcacgccattgcactccagccagggcaacaagaacaagactccatctcaaaaaaaaaagctgaatctctgagtgggtttttcatttttcatttttttttttaaacagatgcctcagaacctgggtaactcagtttatcagaaattcagttttcaagtttggaaggataacacttggggcggtcgtgacacttgtggcgctcgtgc

SEQ ID NO: 686568 - DNA, 156 bp, Homo sapiens
  misc_feature (37)..(37): n is a, c, g, or t
gagcttatcgaatcgacggttctctgctgagtggtanccaggtctcggccccctcggactcctgctcagtccctatgacgggcgcacgtgggcaggcgctggaggtggtgcgctcgcgcgtcgccgacgctgccgcttgagttgcagcaacttcca

SEQ ID NO: 686569 - DNA, 767 bp, Homo sapiens
aaatctagaagcctgttgattcaagaactttctaaagtatttgcggaagacatggctaagtatcgtagcatgcggggggaggatcaccctccttgttaaccagctcaccctccctgtgtgaagatcccctgagactgcgatgcggagtgaggctgggactgcgagtgctgacgccaccttcctgttgaggtgggactggaccctgaacacacccctcagcccctctgtccttattgtatggcctcatgggacctaggggctggaggagaggctgatctgtgccccaaccgttccagcagattgcatggcgtcaactgacattcagagtgctgacacctcatcactggggggatcattctctcggagggcagatgacgcgcaggataatagtctctgaaactgtaaatatgatgggcaaataaaaagttgtacaacattctacctaatcatattccttgtacacacgttttctgtttaattggactaaggagcgcaaaagctaaataacaactagaaacaaattttttaaaaaaaaaatatctgcccgagggggaaagtcttaagtggtgacatattaacattttaatatttgggcatcatactgtccgaacgtaattgataatatggtttgatttcccccccctttgattaagcggatctagctattatgttctaaaaggataattaagaactccaatataaaccccctttcatttttatacactgtgtgtaaggtatatttttcgtgaatggggtttccgtattgg

SEQ ID NO: 686570 - DNA, 825 bp, Homo sapiens
ggtggaccagagagttccctggagtgtggcttcgtacgtgacttttagcagacacagatcctgcttttcaaacatgaccccaggtcggttcaacctcctgcagcatggctgcgctcggtccgagagaacatccaggagggcaggacctgggtgggaggtggtgctgtcggcactcgcgcgcaccttcgcaggatttccagcatccgagccgcacgccctcaaggtgcactcctatcgtggcgcctgccttcatgtgatcactgccggggagattggctcttcggacctagtagtcgccagaggcctcaagtgctgatggctgctgggcgtgaagttaccaacaagcgctgtgccttctagcatccccaacaactgtagtggggcccgtaaacggggcctgtgcttccagcgtctctggccaggtggaccaggtcggtgtgcctcgtgactgctcttccgatggtccctgtcgcctgacagagggttgaagaagtcttgaggccgtagacaccagcgatcttcctgccttcgaccgtccgcctcgtcatcctcttgcctacccttcttctgtcctacatcgtatacgggccgccccattgagctggacagatgctgctctccaaggtcaaggtgccgcacaccttcctcatccacagctatacacgggccaccgtttgccaggcttgcaagaaactcctcaagggcctcttccggcagggcctgcaatggcaaagactgcaagtttaactgtcacaaacgctgcgcacccgggtccctaatgagggtggtgcaatcggtgcgacacacgacgcggaatcaggcacc

SEQ ID NO: 686571 - DNA, 308 bp, Homo sapiens
cggcgctctagagaccccggaggcagtgacgaaacgctttattgcactctagcctgtgcagcaagaacaggactctgtctcaaagaaaaaaacaactatcttaaaatgtaaagttcagagcacacactgttttaatcctattttgatgtaagtgctgaaatcatacgtgtttgatctgaaatgactcacaccaaagttaacagtgtctacctctgagaaggcaaggaaatatgattgggcgggagaaaaacggatagtctcttagactctaagacgcttacggggttgcgtttttacagatagactat

SEQ ID NO: 686572 - DNA, 961 bp, Homo sapiens
tagtgtgttaaaaataaataataaataaaaaaataaacacacaacaacacgcaactttctgtgcaactgattctctacaatggtttttggcccctttatgtgcacccttttgccctgcctacattcagcgtctacattttagctatttcccttgaagccctcatagcgtcgttttatatccaccgttccgcttctacctcgcgtaaattacccaggccttcaaggctgtcttcatgcaagcttccccctagctttcgtcaatttcggtcacactccttataattgtgtgccgccggcaatgtccacccttcgaaggcggggctgcaatatttgtgagctcgttttgctgggaagacggcccccttataatttttggggggaagacggacccctcttttccttgggcgcgccacaagctgttttttcgtcattggaccgcgctggagctactcttctcggcttttcttcgccccgcctgtgccccctggccacttggtgattcccctggggttgtattttgaaatccggggctttgagctactactacgcccctatgaaccccggcagccccccacgttgtctccctctttcggggaaaaatacttaatgggtggtgtacagcccccgtgttctaagacctttattattgtacggatctcatagacacaccctctctgttcaatctgcactatgcaggtgtctctgtccacttccacgagagctccgaaggaacttgactacaagcagtttgcggaggccacatttaaggcatattatttcttttgatagaagccctctttggtcccatgttgagagaaaatcgagtacgccacttctcctttagtggggaggagacaaaagggtcactacgccacaaatcatgtatcataagagtttagataaagaacaactaattaaatcaaccaggtgatcattttctttcccaaacaaacaaatgaca

SEQ ID NO: 686573 - DNA, 1188 bp, Homo sapiens
gttgttggttgctggcgcctgccctcgtgtgtggtgggtgttgtttggcgtcgccgcgcctccgtctgtttgggtgtgtgtgttctggtgttttgggctgcgggcgccccccggcgggggggtggggggtgtggtgtggtgtgggtcgggggggggcgggcgcgcggcgctggctgtgctgtctggtgtgtggtgtggctcgccttcggtgggtctgacggggctggggctgttgtgtgggtggtcttgtcgtggctgtcctgctgcccgcgtcttgtggggggttgtggggcgctgtggttgtggttgggccgtcgtgcggcggtggcgcctccgctcccgcgcggtgggtcggggtgggtggtggtggtgttggggttttgtcctccgccgccgcgcggctgtggttggcgttcgtgagggggggggtgggggctgttgtcgttggttttgtgtgggtggtggtggagggaacgccgctctcctcggtgtggtgtgtgtgtctcgctccgcgcgctggcgttgtggttgttttcctctctctctcttttctttttgtgttattgtatatgtcgaccgctctcgctctgttgtgtctccgcgccctgcgcggcgggggcggtgcgaccacatatgagtggcgccgcacccgcctctctcgctttgtgttgttgtgttatatattgtttttgtctctctccgccgccgcgccgtgtgtgtgtgtgcggtggggggtgtggtgatgagtgtggtggttgttgtctcgtctttatggcgcgcccccgcgcgccgctcgcgcgcgcgcgccgcctctctccctgttgttgtgttccgcgccggggcgggcggggccgccgcgcgcggcgtgcggtggtgtggttgttgttctgttttttttttgtcttcgtgttgtgtagtatatagtatatttgttctcttccgccgctcttctctttgtgttgtgtgtgcgtgctctcctccccgccgcgcgctgccgccgcgcgcgcgcgcgacgagagatgctatatagtaggtagtaacaccgcgccccctccagtctatatagtggtcctcctctcgccccgcagcacctcggggtgggcgtggtgttttttctctccctccctctctctctccctcccccccccccccctgctcgtgtgtgtgtgtgtgtgtgtgtgttgaaga

SEQ ID NO: 686574 - DNA, 535 bp, Homo sapiens
attcaatactcctataaacttacttcctgttcctggtccgaaatttccaccgtctaccacgtgaataccccaagccaaagttgagctcctctaaccactacctaaactctcaacttcctagcatttactatgtactcagactaaagcctaaatatacttactagcgtatatgaccatatgatagtataggtatttctagcaatacgatattataccacaggatcatggtcatacaaaagtaatcacagccaaaagcctctatatctattcgcagactagcctaatacagtaaatttaatcctacaatggtaaaccaatttttaccatatatcctcaaagtaatctactaaggtgatagtatccacagtatctatcttaaataaccgccaacaaacagcttctaacacagtatacatacagcccctaggtatttccagatatcctactacttagctaacagcacgttaaaggctacaactactcttcccatacaattagaatagaggtcttagcagccataagcaagcatcgaccg

SEQ ID NO: 686575 - DNA, 294 bp, Homo sapiens
ccgtccattcgccagccggagctccgacaacgcacggtccagacctaccgccggcacaccgagacgaaggtcgatgttaagctcgagcgcctccgccgccgtgaggagcgtgacctcggctgcacctgcaccgacgaggtatcccttcgacagcggcggcttgtcgtagggcagcacgggctcggagccgatgagcacaacgtctccgcgatacccctctgcccgaagcgcctgcgcggcccgtacccccgcgatcgacgcaccgacaatcgcttgcgtcattcgtcttccacc

SEQ ID NO: 686576 - DNA, 1024 bp, Homo sapiens
ggaaaaaaaaaaaaaaaagtaccgttccagaagcaggagcctaggcagccgagaagggtgcccgaacctgtgagttcttgagtttgcggccactttcaggagctgagaaggagcaggatgtggaacttgcaggatctccaaagaattgaatgtggagcccttccctttcggaattgctggtgggctatacaggcaagaaacgttgaggggctttcctgtgcccagttcgggggctcctgtgcctcctgtgggagccaaggccggtctccagtttcagtggatttctcgagggggaaagacattcggttgggacatgtgttcaggtgtttacaaccttacaggcaaccgcccattcatgtgggccaggcggcacattccgtgggagccgtgagaccatattggccagtggccccaacagcgggggggttcatctcttctattccgtggccccgtggctgccgtgtgtgcaatttgtgcaagcaactctgtgtgtcagactcctataactctcacatctccgaacctctctctgtggctgtgaccctgtgtgtgccgtggcatattgtgcaaggcgcaatctccgggaggccctatatgttagaagcacgctgtggcgaccacgcaggggggcaatttctcggggggccctttgccggggagaaaaagggttaaggtggggtgggcccaacaagctttcaatctcgtgtctctgtgtacaccaaagtggtgtgtgcgggacgcacaagttgtttcccaagtttataccacccgtgtcgtctacaatattcaattcaaaactctcagtgaaagcactatccccccccgctgtgggagatataattccggggacaacgccttttcgtcgttgttttaccaagtggtgaaaacacccagcgaaagagggggggcacccggaggggatatcctagtgggaaacggtgggaaaaaacaccctcccttcaaatacaaatcaaatagggacaagattgcttgtttataatatccagtccgcttggcccccttg

SEQ ID NO: 686577 - DNA, 240 bp, Homo sapiens
tgaaagataagatcgaccttaaatctcatatctaacacatcactacagacacacaaatacacacacaatacacgttccccatgatcatgtacaatcgatctactcatctctcactctcacactgctctccgatgtacgccgctcctattcacttagatttagcagagctatcgctgactgaaatgagacacagctgggaggcacccaccaacacccgcctttttggcccctttatcagag

SEQ ID NO: 686578 - DNA, 420 bp, Homo sapiens
  misc_feature (158)..(158): n is a, c, g, or t
  misc_feature (175)..(175): n is a, c, g, or t
  misc_feature (178)..(178): n is a, c, g, or t
  misc_feature (184)..(184): n is a, c, g, or t
  misc_feature (187)..(187): n is a, c, g, or t
acacgtcacatccagatcttctaagtcatcatctagttatcttgctacagcagcctcccaagtccaggaaacctcatttgtttgtccagcctgggtaacaagagcaaaactccatctcaaaaaaaaaaaaaaataaaaaatttagtggttttttgggnggtgtcccttttggatnccnttcttnttnccttctctatatgtaagggttttttccttagtgggtattcccagtctagtgggctcacactcgaatagtctcagcactttggggaggctgaggggggagaatcaattgaggccagcagttaaaaaccagcctgggcaatatcatggtgagacctgtctctaaaaaaaaaaaataatttcccttggtcttgggtttccaccatttggctggtaaggtgtctggatgggaatctc

SEQ ID NO: 686579 - DNA, 278 bp, Homo sapiens
ttagacaggaggcccaggacttagggaggcatctgggatggaacatgtatattttgaacaatttcagttacccacttcttattgtcctcctcaaaggaatgcccattctgatttagtggtttcctctgcttaccttacaaaacaaactatctaaactaaagttatcacacgtcagagctgagaattccatttgaactagctgcccatggtcaggctgagtacactgcagctcttcaccatctacatgttccctcccagatggactccataagtccctg

SEQ ID NO: 686580 - DNA, 356 bp, Homo sapiens
cactgtgagcatccaggccgagatacaaactgaatcctgacaatcaggcgagcatatctgttgactttgatggtgatgagatcaccatgtggatatggcaaaaaaggagacggactgacggctagaagaatacggacgattagccagactaagaggctcaaggtgcattggccaacatagctgtggacaaagccaaccatggaaatcatgacaaagcgctccaactatactccgatcaccaatgtacctccagaggtaactgtgctcacgaacagcactgtggaactgagagagcccaacgtcctcatctgtttcatcgacaagttcaacccaccagtggtcaatgtcacgtggct

SEQ ID NO: 686581 - DNA, 795 bp, Homo sapiens
  misc_feature (119)..(119): n is a, c, g, or t
  misc_feature (299)..(299): n is a, c, g, or t
  misc_feature (303)..(304): n is a, c, g, or t
  misc_feature (306)..(306): n is a, c, g, or t
  misc_feature (309)..(309): n is a, c, g, or t
  misc_feature (319)..(319): n is a, c, g, or t
  misc_feature (324)..(324): n is a, c, g, or t
  misc_feature (328)..(328): n is a, c, g, or t
  misc_feature (333)..(333): n is a, c, g, or t
  misc_feature (345)..(345): n is a, c, g, or t
  misc_feature (348)..(348): n is a, c, g, or t
  misc_feature (378)..(378): n is a, c, g, or t
  misc_feature (382)..(382): n is a, c, g, or t
  misc_feature (389)..(389): n is a, c, g, or t
  misc_feature (403)..(403): n is a, c, g, or t
  misc_feature (412)..(413): n is a, c, g, or t
  misc_feature (418)..(418): n is a, c, g, or t
  misc_feature (427)..(427): n is a, c, g, or t
  misc_feature (449)..(449): n is a, c, g, or t
  misc_feature (616)..(616): n is a, c, g, or t
  misc_feature (619)..(619): n is a, c, g, or t
  misc_feature (623)..(623): n is a, c, g, or t
  misc_feature (630)..(630): n is a, c, g, or t
  misc_feature (632)..(633): n is a, c, g, or t
  misc_feature (643)..(645): n is a, c, g, or t
  misc_feature (650)..(650): n is a, c, g, or t
  misc_feature (657)..(658): n is a, c, g, or t
  misc_feature (666)..(666): n is a, c, g, or t
  misc_feature (673)..(673): n is a, c, g, or t
  misc_feature (684)..(685): n is a, c, g, or t
  misc_feature (689)..(689): n is a, c, g, or t
  misc_feature (703)..(703): n is a, c, g, or t
cattacctatgaggtttcatttacttctttgtaaatgtactgacttttggagttacttaagaaccacagttcctaaaacattttatttgggagctcaacttctggcttcctacttaccnagaggcagtaagttataacctctggcctttgtctttacattttcaactttctggatccctaacctctggtcccaagttactacgcttgcctatatccactaaccactcactaggtcacaaagttgatggctctggcttgacccagtgaatgagaagtgtcctagatgttttttttttttntttnntncgnaaattttctngggcncagnggccngttaaatttttnttncagcctttcccttagaggagggagccttangttnccttacnagggtggggggtanggaatctanncatanctagtctanaagatttctcacccaggggaantttcccttatctaaaagaggaacctccaggtctcaaccctgccagtcacacccatttaatgtccttcaccaaaattaacccgagcttagtgtcccctttcaattggagttccaggtgagctcaccagcaaaatttactcttgtaaatttctctctcagcaaattccnagnacgnattttcncnngggagtgagnnnttcgnttaaagnnttttcagnttccccngtttgcccacnnttgnccgcaaatttttcncaaaagacaacaccaccactcccgacagaacaacaacaaaccgttgttgggggcccccccttgagcgccctggaaaaaaagttttttaaacc

SEQ ID NO: 686582 - DNA, 365 bp, Homo sapiens
aagcccctaaaggcagatcaggtaaagcgtacatagtaaagggaaaggagagaatggaaataaaactcaatattatgcagatttatgccttatattttagcattaattaaggttgggtctttcaggctggttttggttagtcttagatctggatagtttaattaactggtgatgtagtagtatattaaagctacaataaatcttttttcttgggagagaagtattcctttgcctttctgtaaattgaacaacttacaatcttcagatgtttcgtggaatctattcagagcttcaccatggcaataagtatttcccttaaaacactgcaaacaaatatactaggagtgcgcccttgtaatctttac

SEQ ID NO: 686583 - DNA, 1099 bp, Homo sapiens
gtgcgtgcgtgggccggaggttagtgtgcggggcccgccggtgcggttgaaaagtcctgagacgaatcatggatgtgatggcctgtgtgctgactgtgctgactggctgtgcgaatggaaccctgataatgggcttgcatatgatgcctgtgacctgtgtgcactggtgtgtgagctgatgcctgtgacaccagtcccatctaaaccccaggacaaagtggaagcagctgaggcaacaccagtggccctggacagtgacacctcctggggctgaaaatgcagcatgtgagtgctatgctgcacgctgtagcctgccatgcctgcctgccttgttttgcagccagcagcagggtgaacccgacttgacagagcatgagaaagtggccatcctggcccagctgtaccacgagaagccactggtgttcctggagcgcttccgcacaggcctccgtgaggagcatctggcctgctttggccacgtgcgtggctgaccaccgtgcagacttctactgtgctgagtgtggcccggcagggcactgcccggccccgcaccctgcgtaccctgcctgcgtaaccggcgctatgctgccctgcgagaagctgatccaagggggcgagtacttcagtgatgagcagatgcggtttccgggaccccctgctatatgagcagtacatcgggcagtatctcacccaggaaggagctcagtggcccggagaccaaccaacagccccaaggccgagatccccgcgaaaacctgttggccggacaacaaactatgatgcccagcacacgaaggagcggaagctacagaagcgtctgctccaacagcaagcagatgagcagcgcacatgcaggaaaacaacaacgagaaagaaaaaagtaagaaaagacagagaagatatgaggggaatagagaagaatgaagatgaatggggaccagtagagaatttatagagaagaaagaaagataagagagaggataaagaaggaggagagatactaaggtgtgaggaatatagaagtagagagtagataagccaatgagagatgagatagaggataactaggagagtgagtgtcaggtgtatgatggaaggg

SEQ ID NO: 686584 - DNA, 630 bp, Homo sapiens
gtcgttcggctccctgcattcaagaggaagaccctggtgctgatcggaaccagtggggtgggtcgcagccacattaagaatgccctgcttagccagaatccggagaagtttgtgtaccctgtcccatatacaacacggccgccaaggaagaatgaagaagatgggaaggagtaccactttatcttaacggaggagatgacgaggaacatctttgccaatgagttcttggagtttggcagctaccaaggcaacatgtttggcaccaaatttgaaacagtgcaccagatccataagcagaacaagattggcattcttggaattgaaccccagacccttgaaaatggtccgacaggaaggcctggagcaactggaaagggattttagggcattcgcaagccggacgcttactactttggacttttactggtaataatggtggtgatgaacccttaagaaattccggaagccttgaccaacgtgcctttttcacaagggtgcctgtgctccgggttactaagccttggaatgggggaacccactgtgtgccccctttccatttggaagggtcttccagggttacccggggttgccccttcctgagctttggaatgcgaaatggcaatttgggta

SEQ ID NO: 686585 - DNA, 1010 bp, Homo sapiens
  misc_feature (21)..(21): n is a, c, g, or t
  misc_feature (208)..(208): n is a, c, g, or t
  misc_feature (384)..(384): n is a, c, g, or t
  misc_feature (453)..(453): n is a, c, g, or t
  misc_feature (518)..(518): n is a, c, g, or t
  misc_feature (865)..(865): n is a, c, g, or t
  misc_feature (868)..(868): n is a, c, g, or t
  misc_feature (870)..(870): n is a, c, g, or t
  misc_feature (876)..(876): n is a, c, g, or t
  misc_feature (881)..(881): n is a, c, g, or t
tgactgcttgggacatgcagnacttgtatatgagtatacattgggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggctgtgtggttccaggngctggtgccgtggaagtggcaatggcagaagccctgattaaacataagcccagtgtaaagggcagggcacagcttggagtccaagcatttgctgatgcattgctcattattcccaaggttcttgctcagaactctggttttgaccttcaggaaacattagttaaaactcaagcagnacattcagaatcaggtcggcttgtgggtgtggacctgaacacaggtgagccaatggtggcagcagaagnaggcgtatgggataactattgtgtaaagaaacagcctcttcactcctgcactgtgattgcccccnacattctcttggttgatgaggtcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaaccctggcctctgttgaaatttggaagttttgaaattataggatttttaaaaattgccctgaaggggatacccataaagcaggtcttttatccagtgaacaggatgttttgctttagcagcagtgacataaaattccatgttagataagcatatgttacttcccntgntnttaaanatttnttgaaaagccaattttaatgggttaattttatgggggcggatgtttaattatcccacccccccattgttaagcctttggttttaaaatttttatggtaaaataaaaggtccagtaattttaaatattga

SEQ ID NO: 686586 - DNA, 479 bp, Homo sapiens
aagtctatctctgtgtatctacttctgtgtacatgctcgggttcagttggttggatttggaccttttttttaatgttaactaacaaaagcagtgtctgtgccatgttgcgtctctttctctctttgtctctgtatgcctctgtctctgtgcttgtagctgttccttggagcgcggtgtggtgacttgatgtagtgagctcaagtctgcggctgtggctggggacgtggtggaggctgcatgttctgtcctctccaggaagagctagtggttccctaccctgtgtgtgggtgagcaatgtgcagaggcagagccgctgaagtatggttcctgaggggtggcgaagcaccgccctcattccaggtcacctcatcagccctcgttttggctggggccccagccttgaggctgccaaagttgagaggcatcaaaaccaatgcacagccagccccctgccactagcccctgccagcttgcacag

SEQ ID NO: 686587 - DNA, 304 bp, Homo sapiens
  misc_feature (11)..(11): n is a, c, g, or t
  misc_feature (45)..(45): n is a, c, g, or t
  misc_feature (114)..(114): n is a, c, g, or t
  misc_feature (121)..(121): n is a, c, g, or t
gatacgttgtnaaaaaataactcaggccccaggtacgggactggnacctgtaatcccagcattttggaaggccgaggcaggatgatcttatcagccccaggagtttgagaccancctgggnaacatagcaagaccctatctctacaaaaacataattaactgggcatggtggtgcacacctgtagtcccagctgcttgggaggctaagctgggaggatcacctgaacctgggaggtggagactgcagtgtcctgtgatcgcaccattacagtccagcctggcgacagagagagcgctgtctcag

SEQ ID NO: 686588 - DNA, 1026 bp, Homo sapiens
tatctgttttcatttttttcacgttataaataaaaatactatgctggccgggcgcggtggctcacacctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggaggttgaggcaggagaatcgcttaaacccaggcggcagaggttgcagtgagccaagatcgcgccactgcactccagcctcagcaatagagtgagactgtctcaaaaaaaaaaaaaaaaaaaaaacctgccatttttcaaaattacgggaaaaattttttcgggggccattttaaaagtatagacagggggttttaactcctgtttttgcccaaaatggcaggtctgagggggcaggagtagggggcagcgggggacttcactcacagtgggccataacaagataggctaagtgggattcgggaagagaccgggcatagccgtggggattatcaacctccagtgggtaaggggcaaagacgccttacctttacagggccatgcttttcggaaaaaggggtctaagacctggaaccctggggtaaaaaggaacatgggacaaccacgcgtccaaatggagggtaaacccccgggcgcccaggtgtaagttaccacaagggcggggcaactcagggatcgggagaacggttcccaagtgacccaagcgggagcgaaatgcaaaggcatcagcgattgcccaccattcgggagcgccggaattaaggggtgaccatccgtgacagaccatggggggcaaaacagccttacaaggggggaaagggccagaaaagggtgcccctttacgacagggtgagcgagaccggttagttcgatagaatggagcgcacaaaccagacacatgattgtggcagcgctgtaacactgcagcagagaagaaaaaggaagaaggagggacaacgacacg

SEQ ID NO: 686589 - DNA, 172 bp, Homo sapiens
atgatcggagtatagttcaacagaacactaaagagaagtgaagctgcaagtgtgttaaggcagagcccagtagatccgtgtccacccatgtgccaataagacaatgggcaaagctacaaatggcaagagaaaaatgggactattaatcgcgtgtggaacaaggccttaatag

SEQ ID NO: 686590 - DNA, 1299 bp, Homo sapiens
  misc_feature (259)..(259): n is a, c, g, or t
tactgcaatgcggaagagtacgtcgggattggcagacttccttgatgactgtgcagtctgactatgtgactgtagccactgtagccacttctgtgctccggtttgtcactgagtacatatatgcgtgacagcaccaggagctgtcgtcttggaatcagtgcgttcggcgatgggtgctagcttggaggcgcacgaagtcgtggtctggcgctcctcgctctgcaatacgactgtctgcgtcacactcacttatctaaanacctaggctgccgtcgtccacaagacagtcgagacagacatgggacctgttcctgggtcaataggtagacacgacacgtgaacccctcagaaggccactggtaagcagagctgccagtgtctgaggttttgaaacgcaacgatcaacgtcgtgggaatgcgtactattggtcatgaacgttggtgtgttgggggagaatcgtcggtagtgatgcgtagactttatagtagacacattattgagagacagtcctcggttatagagccacggtgcgtgggtcgcgaacattctgacgccatgactttgcctggtcgttacggcttaatcctgaacttagtcactgatctgtgactgttagtggttcccagtgacgtcgacgcagagggtactggctctgatcctttgaaactcagcccgggggggagggcggggcggtgattactcattgccggcggaggcggccaccaagtttgtgtcgctgcacccttgaggtttcccccttttccgcctcgatggccgcttttggccacatctgcggggtagaggcggtggcttggatgcacacgttgtcccacgggttcccgcgctggttgccggaccatgcgattaaaggccttggccgggcggttaggaacgcattgttcctggttgggccagacacacgcttcaagaatgtggtgtcccggaagtggcacttaaggggaatcgttaataggcgtgttccaacgatgttcccgatgtccaagttcggtgtgctcattgaaccgacagcttgaacctattggaaagggagcaaagtgtcgtttgacaattaaggagatgaaacgcgccaatttctgatgtatacaaaacatgtggcggtgcgccccacatatttctgtgagtatcccctcacacattttctaccacaatttggcacttttgggcgacttcacagaccgagtggtgaatttacacaaaacatggtgggccgcatatttctactaaaaacctcagcgaggggtcgggtacacaccccaacgaaaaacatgactaacgcc

SEQ ID NO: 686591 - DNA, 354 bp, Homo sapiens
aaaaagggccccccgggcttttttgggggtggttagcgcccccccccccaagttggttaggccctttggcccccccttttattttcccccaaattaaaagggccgggttttccggggcccaaaaattttaccatttaaaaaaaaatttccccccctttggttttaaacccccgggcccccccgggaaaaaatttttaaaaaaggttgggaatttaaaaaaaacccgtgggtttttatttggtaaccccccattctggcccagggaaaaaaaaatcccccaagttttttaacaaaccggggggtggttttcccccaaaaaaaaaccccaaaaaaggttgggttttcccattttta

SEQ ID NO: 686592 - DNA, 576 bp, Homo sapiens
gcttccttctctatgcacacttaacctacgtcacgttgccgctgatcggattttaacagacatcctggaagttcggcagaagccatcctgatgacctctgcgcaggctccgcacgcagctaggtcatcaggatgggctagctgcgtgcggagcctgcgcagagcccggccggcccagcctcggagtgctgccaagtgcctacctgtccaccgccaccggggtctgcgatggcacgccagtctggagccgcagccaggcaggcactcgactcccggggccgggccgactccacgaacaccagcccaaactgaagtgcctcttccctccccctgcgaacgctagaatccgaaccaagtgagcccagaacgaaggaacacgggcgctcaggaccccgaggacggacaatgagaagaagcgtcctacaagacagacccacacacagaagagagacgtactaccgacatacagctgcaacccgacctcagcgaacccagccctcaccctggacaccacaacaaacaataatgggccaccaggatcaccaaggcagaaaaacaaacgcgaacgccccccaca

SEQ ID NO: 686593 - DNA, 152 bp, Homo sapiens
aggatccccgatggtttatgctgactggttcaagcgtctgtctggttcagatattaatacccatgttgggtacctagtgtgctagtctccccactaactgaggtgaaaaaggttcccagagtggggtcctctgtcccacatttgccacctac

SEQ ID NO: 686594 - DNA, 107 bp, Homo sapiens
ccggggggcccggacacggtctactggagacacgggcccccttccgccaggttgcccagatggggcctcctatgttctgcattcagcagctatttatcgagtaccta

SEQ ID NO: 686595 - DNA, 408 bp, Homo sapiens
  misc_feature (307)..(307): n is a, c, g, or t
  misc_feature (321)..(321): n is a, c, g, or t
  misc_feature (323)..(323): n is a, c, g, or t
  misc_feature (335)..(335): n is a, c, g, or t
  misc_feature (401)..(401): n is a, c, g, or t
gcttccttctctatgcacacttaacctacgtcacgttgccgctgatcggattttaacagacatcctggaagttcggcagaagccatcctgatgaccttgcgcagagcccggccggcccagcctcggagtgctgccaagtgcctacctgtccaccgccaccggggtctgcgatggcacgccagtctggagccgcagccaggcaggcactcgactcccggggccgggccgactccacgaacaccagcccaaactgaagtgcctcttccctcccctgctggcgctgctccgcctgtgccccccgcccatnggcccccacccatntntggagagccctntgcacccaaagaggactagagatgccgagcggccatgaagagagagcggaaggagcagttgattgnccagagc

SEQ ID NO: 686596 - DNA, 250 bp, Homo sapiens
ctgactacgcggcaaggtgtgcgagctggatgagaacaacacacccatgtgcgtgtgccaggaccccactagctgcccagcccccattggcgagtctgagaaggtgagcaggcaacgacaacaagaccttcgactctgactgccacttctttgccacaaagtgcaccctgaagggcaccaagacggaccacaagctccacctggactacatcgagccttgcaaatacatgcccccttgcctggactctga

SEQ ID NO: 686597 - DNA, 458 bp, Homo sapiens
  misc_feature (371)..(371): n is a, c, g, or t
gcagcttgcgggaagatggaatgacacttgcagacattgctgaggaactggaaacagtgaatgctagaggcaaggtctgctgctgtagtcaggaaaacagtagagcccattgaaggctgggcgatggctgtcagtgtacaacgtcgggatggtgcagtcagagaagatggggtcatggttgtggaagtcactatgggacctgaggtagtgggaactgaggagatggcagttgtggatgtgctgatggtggagtggatggttaaagtgaaggtgggagtactatgagaggtgttctcattagtggttgttaccaagtttctggtagaagtcatggatattcctttggttatgagagaggaagtagtggctgngagagaaatctcagtagacaatgtacctgttatacttgtggagtaggtggtttcggtcgtggagtctgtgacagtgctagtgggaga

SEQ ID NO: 686598 - DNA, 748 bp, Homo sapiens
aacttggtatatagtttgttatcctagtccgcgcctgattgaaacttccacagactgctggttttctcgccgtggccgaggggggtactcatacctaggtgatgttgcgatgtgccgtcatgggttccaccaaccccgcctggtaggttgacgctactgacgccgccataagcgcgggcagaacaacccagagaacagccgcccgcagtcgctaacgcagcccacagaggcaaaacagcaggcacgttgtacggccaggtgctaagtcgcctccgcagggcttggccgtgtcacagatggcaaccaccgttacccgacgtccacctgccgcagtgcgccgcggcccatccagtgtgtcagacttgtttttggtgtaggtgccggggtctggcggtacgcggtttcggcaaggccacgggcgggcaaccggaacaggcctcccaaaaacccacggcgtacgcttgctggcacaacattgaacccgtcgccacaaggcccggttttcaccgggttccctctcagcaaaccacatccctgcctgtgtacgggactgattaggtcgtttcagaacaccctgcacaagcgccgaacccggtaagcacctgagtgtatatactgcaagagatacactaggggcatccagatattagtaatttcatagtaccatttagggtctcacaattaactcttcaattcaatcccccttttccactttaataccctatacttggtcgcttattatttcttc

SEQ ID NO: 686599 - DNA, 137 bp, Homo sapiens
  misc_feature (76)..(76): n is a, c, g, or t
  misc_feature (78)..(78): n is a, c, g, or t
  misc_feature (103)..(103): n is a, c, g, or t
  misc_feature (110)..(110): n is a, c, g, or t
ctgtaatgttttcttagttaaacaattggaaatgtttaggcattttactgtgtgggggcagtgagtaagccactgntncaaattgtattatgatcttgacatngaaattncacaaattcataactcaaaaaaaaaaa

SEQ ID NO: 686600 - DNA, 223 bp, Homo sapiens
tgtctagagcctccctcttaaccgtatagaacaggagtgacatggggttgggcacagtggcttacgcctgtaatcccagcagttagggagactgaggcaggtgtgatcacttgaagtgaggagttcgagaccagcctggccaacatgacgaaaccctgtctctactaaacatacaaaaactagccaggtgtggtggtgcgtgcctgtaatcccagctacttca

SEQ ID NO: 686601 - DNA, 135 bp, Homo sapiens
ccatctgacagcttcacctagcgctcggtccctctataccccttggagcagccggcgtttcgtgttccttcgtttaccggggactcctctacgacgtcgaccctgacggactgtaacgctgggacctgggcgtcg

SEQ ID NO: 686602 - DNA, 777 bp, Homo sapiens
cgcgggctggggcggtcgcttcttccttctccgtggctacgagggtcccagcctgggtaaagatggccccatggtccccgaagggcctagtcccacgctgtgctctggtggcctcagcctcttcctcaacctcccaggacctatctggctccagcccatctccacctccccagtcttctcctcccgcctcagccccatccgtgtcatacctgtccggggactggttgacgagctttaacaagggcctggagagaaccatccgggacaacttcggaggtggaaacactgcctgggaggaagagaatttgtctcaaatacgaaagacagtgagacccgtccgtgggtagaggtgctggagggtgtgtgcagcaagtcagacttcgagtgccaccgcactgctggagctgagtgaggagctggtggagagctggtggtttcacaagcagcaggaggccccggactctacttccagtggcttgtgctcaggattcccatgaagctctgctgcctccagcagtgcaccgttctgggcccatcgctgcgctatccctagtcctagggggaacagagacggccctgacgagtgggctacggcgcagaagtgacaggagcaacgggacacggaggggggcagcgaggtcactgttgactagcacaatgccggctaccgggggagtgaggccatggtggccagtgtggcccttggctactattgaggcagaagcgcaacgccagccatctgcgtatgttcgggattgtgaaggcccctgtgcccga

SEQ ID NO: 686603 - DNA, 456 bp, Homo sapiens
  misc_feature (5)..(5): n is a, c, g, or t
  misc_feature (104)..(106): n is a, c, g, or t
  misc_feature (109)..(109): n is a, c, g, or t
  misc_feature (152)..(152): n is a, c, g, or t
  misc_feature (155)..(155): n is a, c, g, or t
  misc_feature (167)..(167): n is a, c, g, or t
  misc_feature (169)..(169): n is a, c, g, or t
  misc_feature (181)..(181): n is a, c, g, or t
  misc_feature (186)..(186): n is a, c, g, or t
  misc_feature (188)..(188): n is a, c, g, or t
  misc_feature (196)..(196): n is a, c, g, or t
  misc_feature (201)..(201): n is a, c, g, or t
  misc_feature (203)..(203): n is a, c, g, or t
  misc_feature (208)..(208): n is a, c, g, or t
  misc_feature (303)..(304): n is a, c, g, or t
  misc_feature (322)..(322): n is a, c, g, or t
  misc_feature (326)..(326): n is a, c, g, or t
  misc_feature (331)..(331): n is a, c, g, or t
  misc_feature (350)..(350): n is a, c, g, or t
  misc_feature (365)..(368): n is a, c, g, or t
  misc_feature (376)..(376): n is a, c, g, or t
  misc_feature (456)..(456): n is a, c, g, or t
aaacnacatctaagtgagtcacccaaaaattcttaaaaaagtcccaggctggctgcagccccagcgaaccgagtcgccactgacattaaaaactaatataaaannnaanaaaaatcagcttgtcgcagcattcaggtatttgtacaaaaggnggngtctccctacangnctcctgacttgnaacangnacccaggnacctnanctggnatggatgtcctagaagccagaaagggaagaccagacacaaaaatacagtaaagggaattctctactggtcagccccataggggcaccgaccttcnngttttctccctgcttgcnactnaatcngaaaccccagtgccaagancctgtgtctattttnnnnaatgctcnagcccttttagactctccccttggcttctccagtccctgccttggggcactgcccttggaagggaaagatacgggcaggn

SEQ ID NO: 686604 - DNA, 84 bp, Homo sapiens
acggccgtgtattactgtgcgagaggtgccgattactatggttcggggagttatctctactggggccagggaaccctggtcacc

SEQ ID NO: 686605 - DNA, 152 bp, Homo sapiens
gatgagccggtccagagtctcgctcgtacccaggctgcagtcgatgtgcatcacggctcacgccagcttgaccttcacctcagcctcccaagtagctgagactacaggcatgcaccgccatggctggctcttttttaattgtctttttctaa

SEQ ID NO: 686606 - DNA, 246 bp, Homo sapiens
  misc_feature (28)..(29): n is a, c, g, or t
  misc_feature (40)..(40): n is a, c, g, or t
  misc_feature (48)..(48): n is a, c, g, or t
  misc_feature (92)..(92): n is a, c, g, or t
  misc_feature (122)..(122): n is a, c, g, or t
  misc_feature (126)..(126): n is a, c, g, or t
  misc_feature (140)..(140): n is a, c, g, or t
  misc_feature (148)..(148): n is a, c, g, or t
  misc_feature (152)..(152): n is a, c, g, or t
  misc_feature (165)..(165): n is a, c, g, or t
  misc_feature (179)..(179): n is a, c, g, or t
  misc_feature (184)..(185): n is a, c, g, or t
  misc_feature (220)..(220): n is a, c, g, or t
  misc_feature (222)..(222): n is a, c, g, or t
  misc_feature (236)..(236): n is a, c, g, or t
gcccttggggggaaaacaaaaggggggnnacgcccccgcncctcctgngatttgggtgggttggattttgtttttaacccgttcctgccccncctgcccaaaagttatggcctgtgttttgntttnctggtcccagggcnccgtttgntttntgaactcctcccnccaggccctttttnccccnngggggtttgtccccctcgttttgtagggtttgtananaataaaacaatggngtggggccca

SEQ ID NO: 686607 - DNA, 348 bp, Homo sapiens
gccctgtgcacccgtgcactcgatccggtgatgggtgttgtgtacgagcgcgtgtggtgtggtacaagaacaacggtgcacgtcatccagcccaagatcatgcatgatagaggcgagtgccggccagggccacggggagtggaagaggctcctgctggccagaagctctcccgcatcttccatacggaatccacgaggcctacgtgtggccatctcccctgtaccacctaatgactcaggctcgaacaggcgcaaagcaggcgctgcctgccaggtctgaggggactgccggtggccctggagctgtgcccggtaagaggatcccaaattcctctcctctagccagcc

SEQ ID NO: 686608 - DNA, 282 bp, Homo sapiens
gaccttccaaagcggaatgctgggtgtagagatcattacctcgctccatcccgatgatcacctttgagagtagccattatctcctttgttgccttgtcgagatgtagcgcctttctacttagggctcaacattgatcacaggtctgttgagcgaacgtaagatggtgactttgggcacccagcctaccgtattgaggacttttcgttctctttctaccaccaacgtctttgcttgttctgaccgccccactgtcatctatagcagcatctccgctttggaaa

SEQ ID NO: 686609 - DNA, 103 bp, Homo sapiens
gtagtagcgaactctctctgctgactccacgcagcagaggaaggcagacaggtacaacaaggagttaaccaaagagagagacgccctcaggctggagttatac

SEQ ID NO: 686610 - DNA, 132 bp, Homo sapiens
tacctctggctatattgttgacaaaggcctcctctgtaagagtgcatagcacgctcacttgacactctcttgagggactaacggtgtacactcctggtgctaatgcagatatggggctctaggtagacacga

SEQ ID NO: 686611 - DNA, 593 bp, Homo sapiens
tatagtacaaagattaggctttatcactatttttaaaagacaaatggtacttatgttacatgctcgggaggcatgattggtggatgatgcacacctattagctctgtgttcctttcacgcaaagccagtcagaaagcaggttatatattcttcaaaaccatcctacctgattagcatccttgccacctgtggctctgaagaccatgtactacagtgtgaggtcactgttgacgccaaaactggcaatactaaagcattctttagttactgcattgacaaactctgctgttataagagagagcttaccattctgacgaagaggagagaacccccatagtctaagtggctcaaggacatgggagttgtctacgcagaagaacgaaatagctgctcttgggttagaaacttgcgttagtgaagagactttccatatcgcatgctacgttatcagcacctgggaaatgcagttcaatccccaatggcttcaatacattcattgtgcacatttgacatgttccattgttacataaccgagggtccaggcatgaatggtgaaaacattgacgcggttagaaatcagaagatagattttt

SEQ ID NO: 686612 - DNA, 304 bp, Homo sapiens
aatactagatagtatagactagatagatagaggacgacgaccgataaaagatagatgatcgatatgataggcgacagatgatagatagctagatagagatagattagatagatatagataggcagacagatgatagatggatagatatagataggcagacatgatagatatagatagacagatgatagatataggtagatgggcagacagatataggtagataggcaggcagacagatgatagatgagctacatagatgataagatggatagacagataacgatcgagactatcagctcctctg

SEQ ID NO: 686613 - DNA, 531 bp, Homo sapiens
  misc_feature (186)..(186): n is a, c, g, or t
gagagtgatctaagtccgtgaggtacaagcgtgcgggagcatagtggattgaggcttttatcagaagtcaggtgtgagcggatattgtcacatcactctgtgtctgaagcagtgtgtagaaatctagaacatcacacgtgcatgccctgctggtccggtgatgcagctgtgaatgagcaggcttgnggttgctgcacctggtgaggagcagaaggactgtggtcacagccacacgtggacgcggttactagggttctggtgggtgctgtggagggtgcagagggcgtgtgatgggtcatcctgagcgatgcaagctgggcctggaggacgtggagtgttcgcaagggaagagggtgggctggagtgactgcaaggagaaggtctcgggaggtggagctcgggatgtggggaagagctccctgggcctggtggccggtcagcaggggccaggtcggggagtgggtgcagagagccttggagaggccagagaggggtgattcggtggccatctagggcttcctttttggttag

SEQ ID NO: 686614 - DNA, 173 bp, Homo sapiens
ccctggggaaaagcccccccgggttttttgatggccgggggggcctaacgggttactcccgggaagcctcagggcagccagggcttgggggttttttttccccccgggggttttggggacttttttttttaagggttttttttatccctttaaaacgggacccccccccccca

SEQ ID NO: 686615 - DNA, 180 bp, Homo sapiens
acccacggtacttacatcctatgatatggcctgcaaactaaactacaaacgcactcacatcgctataatccttttaaggacttaaactttactccattaagacttttatgacttctaacaacctcgccaacctcctcaccccccactatacctcggagaactttcgcgtaataaccacgt

SEQ ID NO: 686616 - DNA, 947 bp, Homo sapiens
gacgtagccactgacggtgcgagcacatagacttgcgcccggtgcgtgtggtgtgacccggttgccttcgagtgacacatgccgacagactccagaggctatgcctctaatgtgacctcactacatatcaggcactatgtgttataccgtgcaacgcgcacgcttgaagatcttgcctcctggttactgggtaagaagtgctcgctggggtatctagcgtagcttgtctctccttttgccggacgtgctcgctggtgcggtaagcgtggttgaacccttcgttacgcgacatctcattttcgcctcgtgtcctagactattgtgagattccgtgtgttggctcccagattttgtcgtgtcagcgtcctgcttctccggaggggaaggccttcctgtgtggcttgcgcctctttctgtgctgttctctccctgcaacttctatctcatgagtgtgtctcttgtcttagccatacttgtgttggaaaacatggcatttttgctgtatccatccctttagagatgttgattcaccataaatatcctactttttctactgtgcatagaacataagcctgggaccctagaaagacttagacacagagccacaagtccacctgaaggaccccaaagacgagggagaacaccgtgtacaccgtggcgtggccccgataaaaaacttcatattaatggcgggggggggcaccccacatgataatgctccctgactggagatgtgttttgtcattgagcggtttgcgccttcacaccctgagggtttcttgggtagacattagaagtacggggcacgagagcgctggatgtgttataaacacaaatgtgttgataggtaggaggacacaaaagcatactgagagggagtcattagagaaaaggaacaactatattgttagggtgtggagacacacaatttgtagggagcactcatt

SEQ ID NO: 686617 - DNA, 368 bp, Homo sapiens
  misc_feature (81)..(81): n is a, c, g, or t
tgagtttatgttacatttctttttcgaaagtgaatgtacactgtctagcccttaaaaaaaagaaaaaaagcagccgggcgnggtggcacacgcctgtaatcccagcactttgggaggccaaggcgggcattatcacttgaggtcaggagttcaagaccagcttggccaacatggtgaaaccccatctctactaaaaatacaaaaattagtctggcttgatggtacacacctgtaatcccagctactccggagcttgaggcaggagaatcgcttgagcccaggagttgaagaccagcctaggcacagcaagaccccatctcaagagaaagaaagagagagagagagaaagggaggaagggaaaaaaaaa

SEQ ID NO: 686618 - DNA, 113 bp, Homo sapiens
ggcaaaattaccccccaataaaaataattaaacgcctcattcatcgaccgccccaccccatccaacacccccgccagaagaaacttgggcccactccttggggccgtccctaa

SEQ ID NO: 686619 - DNA, 491 bp, Homo sapiens
tatagagagaatccagatcttttaaaaagtgactagtattaataaaaagctggtgaatatgtcagcaaggattcgttacctcaggctgtcatatattcttcagatacaaccataaaaggctaataagccataaagacaaggaagaggacagtattagagaatgtttaatagatggcttcgttccgaattttccggattctacgtggcaaagcgaagctttggcatcttctttttcttgttcagagctgttgcacatgcacgttagcaatcctccctgctaacaaagttattgtcattccctccacagccagtataggtgaaagcatcacaggttctgtatcttggattaaaataatagcgagtcacatgggcagagcacagtccctcatcttatggactgtagcaaaatgatggcattttctttggtgcgcggaagcccatacaagtagcttcatctggaaacctgttctcaatccggttccggtgacacg

SEQ ID NO: 686620 - DNA, 154 bp, Homo sapiens
tcggtaccgtccctagcgagacagtgaagctcggaaagcattctattatggctggctcggactttaaccttgtttcccagaagcatcttttacccttcccttcttacctccacatgaaagcggaggttctccaggcaggatgacagacccagca

SEQ ID NO: 686621 - DNA, 499 bp, Homo sapiens
gcgaaattctcctcctcctagatgggatggcggcgggaagaggcgctcctcacttcctagatgggatggcggcggggagagacgctcctcactttccagactggcagccaggcagaggggctcctcacgtcccagacgatgggcggacaggcagagacgctcctcacttcccagacagggtggcggccgggcagaggctgcaaatctcggcactttgggaggccaaggcaaggcgggtggagaggtggaggttgtagccagccgagatcacgccactgcgctcaagcctgggcaccattgagcactgagtgaaccagactccgtctgcaaatctcagcatgttgggaggctgaggcgtccaatcacttgaagccaggagttcgagaccaggctggccaacatggtgaaactcccgtctctactaaaaataccaaaattagccaggcatggtgacagggacctgtactcctagctactcaggaggaggaggaattcgccc

SEQ ID NO: 686622 - DNA, 933 bp, Homo sapiens
  misc_feature (296)..(296): n is a, c, g, or t
  misc_feature (933)..(933): n is a, c, g, or t
tggcaaaaaacaagacaaccgagttttattttttccacaacagtaaattcccgggggtaaaaagaggcccacaagtattaaaggttgttttcaagaaacaaaagtttaactcttctgtgcataccccaagtctgctgtgattttaatgtgaacacccccttaagacacagaaaaaagagtcctgtgagaacacacccgtgtgaacacaccagcccacccggaagcctcagtgctcgtgctcacaggagccgactcctccttctttacaaggcgaaatctccgcgtggaatatcacncagtgtggacaaaacgcagagtctccagcgtgtgtgtgttgacaaggagccagacagaacccgtggagaggtgtgccgtgtctccaaagagagtctccctcgaggcgacaactctcatgtgtgggccccaagatgtgcaccccagacactctctcaagagtggcgagcccctctttaacagagatgtgagagacacaacagatctcttagttacccgtgagagaaatttctccccagagacaagaaaaagagagacacgtgtgtgcggcttattagtgctcatctctcgtaggaaaatttttgtgcacaatccctctcacgccccaagcccaaagtcttttactatctagagagcgggagcatatattcgcgcggctgatttgtttcaccctgtgcggcctaagttatataatcttccagggggtagtaacgccatatatagagcgctcctgtgtcggcgtcaatactatgtagagacagataatagcggggcgacaaatcatataacatcatctccccaccctgtcttttattcaccaaacacaccattctacaggaggcggttcctccaaaggagaaaatcgtgcggataccaaggggggaagacaccttgtgggtaagacacgggctcccctan

SEQ ID NO: 686623 - DNA, 392 bp, Homo sapiens
  misc_feature (320)..(320): n is a, c, g, or t
tcgcgtcccgggtctgccgcgacggtcgctcaccgcaggggtctccttcctcttctggcagcgagtgcgacctcttttatcctagcaggccaccaccttcgcggcaacaaacatcatttcctatgcagttgcaaagcatgctcccttgcaatcagcgatcaatactggcaaagtggctccaggataggaaaggtcgcacgtgtgttggtaaatggaaaggtttatgaggcgcaggtggtcgtgctccgcggagattgtggtattagcatgtcaaagacaaaacggaaccaaggtatacaggcacagagtctcttcctggngctccgggaaagcttggcacgaccctcttgagccttcagtttaaaatgaaacgctggcgccagatgtggcac

SEQ ID NO: 686624 - DNA, 1215 bp, Homo sapiens
  misc_feature (591)..(591): n is a, c, g, or t
  misc_feature (624)..(624): n is a, c, g, or t
  misc_feature (890)..(890): n is a, c, g, or t
tgtgtcgagctcatagcgtcctgtacaccaggcctgagtcgaacctactgtgtgttgtaagtcgaggaataggtatcaccataatcccttgaggtgaatcttggtggtaccatgacagcttcacccgagtgattggcttgcttgcaccgctaaggtagaacaggtcctagttaatgccaactgctagatgacgttacgggatcgtatacccttttgcgcggagagctgcgactttggacatgtacatccaacggagtcgtcacaccatatatccccaggggctagaagtaagtactgtcataagtccttaggttctctatgtccatggccgggcacgcgccctagttacgagcgtaagtgtacatctgttgtacgaaactacaatagactcttgataagaaaggacactgcgcatgggcatggactcccaagtggtggataatcaccccacggatagctttgacgatatttcgctcaggggaggatactgggtgtctgactctcagcaagtatcttgtcttggacacaggactgtttctctcacaatctatcgtaagtcgcttagctcactctctgtgaggtatgtgtgtnagtacagtctcaaggagataactgacacagagntgagagagacacgagatcgggtcgctgggtagatgccggcaggatcatctaccgaaaagggctatgtctaatcactgtgccagctagggttttatcgattcgcatccgtacattagtctgtggtagacgcgctatctgtataacgtagctcgttaagcatattgtcttgcttagactctcttgtcacctatcaagtcgaatcccgaggagctactacattcgccacgactgtaatgtatgaggtaccttatctcctatgtcagcantgttgggtgatgcacgtaggctatacgagcgccacgtaaattcgatcagtctgaccatgtcaagtgcagctacgtaggaacatcagagggtggtaatcgttgtcctttgcaaaatataattgggccacgatggtcactgcacctaggaaaagaaagtatacttcgcatattatcgccgcaataaatacacctacaacagtatagacatcttctggcactccatgatacagtgtctaacagttatgtagtacccgagttgtgacacagcatcactggtgtgtgcgaacgctaacgacgatcacagccccagggtcttccacactct

SEQ ID NO: 686625 - DNA, 105 bp, Homo sapiens
aagttacttagaaaaaaaagtggtagagataactatattaaaaatctgttaggtatttcctattaaaagctaggtagtttatttatatatttatccattaccttt

SEQ ID NO: 686626 - DNA, 390 bp, Homo sapiens
ctcccaagggagagtttggggtgtacctggtgtttgatggcagcacccgcccttatcaatgcaagatcaaggctcctggttttgcccatctggctggtttggacaaaatgtttaagggacacatgttggcagatgtcgttgccatcataggtacccaaaatattgtatttggaaaagtagatcggtgagcaggggaacaagcgtttgatcccccctgcctatcagctttttttgtggagcctgttcctcactggaaattggcctctgtgtgtgtgtgtgtgtgtgtgtgtgtgtgtgtatgtttgtgtacacttggctgtcaggctttttgggcatgtactaaaaaaggagaaattataataaattacccgtcttgcggccctaggccta

SEQ ID NO: 686627 - DNA, 163 bp, Homo sapiens
cgactctagaggacccgtcactttctacaccaagatgcaaagaaatcttctatattttctcctaaagtctttcttacaattctagattgacagttattttctctcatagtattgaagattttattccatttgtctagctgaataccattttagcttgtggaag

SEQ ID NO: 686628 - DNA, 380 bp, Homo sapiens
cctgtttttgcattgtatataaatagaatcacatattatgtactcttccatgactggcttttattctacattatatttgtgagattcatcagtatagttgtgtgtatttgtagatcttttattctcatttctgcatatattttattatgtgaatgtacaagttatttattctactgttgaatattttgagtagttgccagttttgagcttttataaatagtgctggcatgaatgttgtaaatcactgctgtccagtattgctggtagcagtaaaaatatggaaacaagtcaaatgtctggttctggttaattaaataaaactacatctatatggtgaagtactatgcagtgacatatgcaattgaaaatgtaaaatttgt

SEQ ID NO: 686629 - DNA, 183 bp, Homo sapiens
ctaaaaatacaaaattacccgggcgtggtggtacatgcctgtaatcccagccactcgggaggctgagtttgcagtgagccgagatcccaccactgcactccagcttaggcgacagggccagactgtgtctcaaaaacaggaaagaaaacaaaagaaaattgggactattgccaattacaaata

SEQ ID NO: 686630 - DNA, 1395 bp, Homo sapiens
  misc_feature (1197)..(1197): n is a, c, g, or t
ggcgtgctgcggtccggctgtgccgcaaggcgcagagcttgcgtgatgctgagcccaagactgctgccgtgcgggcctagtacatgcgaacaaagatgacacatgagggcggcgcacggtctggggcgctggcgggcggaatatccctcacgaagatgcccgagcgctgccgtcatacttcacagggtaggtcgacgtgaccagtcgctcgtgcttcgcttgtcgctcggaagacgctactcctagcacgtgtcgtgcgaggacttgcatacggtcccaggaggccgaagtctgccctgggatgcccgtcttagctgggcgctttgttattcacgagccaacgcgggcccctctgtgtctccactgagatcactgccggtgagccagcgagccaggccctgtgtgcgctgacttgcccgggccgtcagtcctcgtggcagtctgggacgcaggtcccttctgtttgacggcgcgcctgcttctttcctgtgcgaacaagctgggccccggcctggagaagacaattgtcagccacgcattattgacatttgaatggcgcaactccgacgtgagaatacgtgatccgtggacacgcgttttaacaagcccccttggtccccaaaagggaagagccacacggcgcggcttgccacacgttcccgaggcttgacctagaaccagtgccagcaaagcccggcttcgttttgcgcgaaaattcggccctaaacgcaaacgcaaagggcgcgctttgcgcataccacgcctttttgaccaacggcactccgcccttgggccatcacccatccgaagtagcaggcagggcgagcacgcttttgcttagattcagcattgacccatttcattcaccagcggccttccaggttagcctccggccgagccacgaccgcttgcaagacgggggccaagctttgggcatcggaagtttgcccctcggcggacagcacccaaccgtaggggagttaacactttgaacgcgcagcaacacaccacaggcccgaacaggttcctccgggcgcgccctcgcaaggacaagggtgcccccttttgcgatttcgccaccccggccttcgaaaggtttagccagcaaattacaaagcggttcagcacttccggtccttgcggcacccctttttggagcctgccgccgcttttttcttttctcttcaacgtaggttntggcaattctacccccacgaacggtccacccggcaggcggcgcatcggcccaggtatccccccggcgacgttccttttaggttcattgcgcaacctttacacctgggggcccgggggtccgtcagagaatgcggcggcgggacgcccgcgcggttgccattccagcaggcccccccggagtgcgccattctacgccct

SEQ ID NO: 686631 - DNA, 1429 bp, Homo sapiens
  misc_feature (454)..(454): n is a, c, g, or t
  misc_feature (661)..(661): n is a, c, g, or t
  misc_feature (739)..(739): n is a, c, g, or t
tcttccccctttggttttggagacaaggcctctctatgtggctcgggtggtcttaaaactctcactataagttagaccagacgaggccttcaaacttcacagaacattctgtgccctcactttgtgccctcgtggaagtgtgtggtgattaaattacgagtgcacgtgcttggcctgtggacagcagtgtggcttttgtgagtctccgaggaaaagtgtgactccttcttccttacttttataccttctcccacagtggaagcgaggcgaaggccttcaagcctcgtgaggaaagaagcctccattcttccgagagaggacaaagaaaaaccaggtctccccaaaagccgggttgtggctccacaaccgtggcgcctttgtggagaattcagcagtgtgattgagtggcttctcagtgtggtggaaggcagaagaagcttgtggaagaggttgnagttgtgaagggccagcattagcacagaggggagaaacagaggtgttctcatataacccccattcctgtagacttctctgtggactctcactctcattctcccagtgtgcgccctgtgggaagaaaacctctgtgacttgtgacagacaagcgtgtgcaaccgaaacgcaccagaagggggcattgtgcacacggggctctcagggnacaatcttctctcgcttatatagggtgggaatgtgacgggtgagaacgcggcgggccctcccagggggggacaattcncagccaagcaaatgtgctgtggtatcaaatcatttctccagtgggcaagaaacacaaggtcttccccctgtggcggagcccccaagggcgccttggccccaaggctattataattaaagctatccacgggttaacccaacacaagacacgggggcaagcaagggcgcccagggaaaagacgcgcacctttcgtggaatattccccgcaagtggggggcattgcataccggtgccacaggaagggatcataattcctccgcgggaaaaattggtagccttcttgggcacaactatgttctcaacattttccaggggcgcctccccacagagcaccccggggtggtggtgctccccccccgaaggggagaagccccaccctgctgtgtataggaccaccaaacaagaaggacgcaaggggggacagcaagtcagggggtcaccacacaaaaggggggccccccacgcccggaggggcccactagtggggcaagagcaagtctcgggcaactccacaaagagaaacctaacaaacagggggtgagggcgaagctaaccaaaagaatcgacccaacccagcggcagcccagggcgaggatggatgtgcaaaaccaaccaactcacagagggggaaaaagaagaagatggtcgaaacagacgcaagacacagaagcacgaagtaatggagagcac

SEQ ID NO: 686632 - DNA, 1039 bp, Homo sapiens
gatcagtaccatatgtgcaaaacgggttggtcagccacatactcgaggtgtcagcgcaaaatataccgcgataaatatgccaaatagggtgacaaggtacatagacttacaatttcataccgttgtcgaacttggagaccacgtagatacgggtcaatattgcacattactggccaatcatagaatcattataaattgatggtagtcttgtagtctaaaagagactactatagaaagaatcttggaataaggaagcgtggggagaggagttgggaaaagagggctcctgatcacagttttatcgcatgtggagttctaggtaaataaccatgtataagctcgaagttcgagcgaaagcaggagttatttgcagtacctattggagtaattcctacactttaggtggagaaatgtatgtgaagactacctagcagctgggtaacatactttgttagctacctcacttcgtttgagacctgtgcccaccatgggacgactcctggtcagcaaccttggctttcacatatacacattgcgttgaactttgcagcggggtgtgcacactcggtacacgcgtcttagattgggtatgccgtggaacccaagatattgtgagtgcaccgtggcgtgcgtgggtttagggctgaagccttttttgaaacgccgtggagttataccgtgcggtaaaggaacagtgtgaggcttgacccttcacaacaaagacttaatgtacctcttctcaacgcggccatgggaatcaacctcttctatgagtgtgtttgtgggtaaaacactgggatgcaaaaaaagtttgggagtacaggagcgggtttacacaaaaaggcgactgggggataatttgcggcatccgttgtaaaggggcgcttatcttcaggtaacaaatttggccatcggaaaataggcaggtcaattatgtggcaggggggagagccatcgaggatgtaaaagcgagtaagaggaaacacaagacacagtgtgtaaaacatagttacaggagagcaacaggcagcgtgggtgc

SEQ ID NO: 686633 - DNA, 107 bp, Homo sapiens
ctgccagtggatagccgggtacgcacatcaagcggatcgccagcggatctagcgaggaagccgcctactccaaccccagcctagctctggtgcaccctccgtcccat

SEQ ID NO: 686634 - DNA, 178 bp, Homo sapiens
cccacgtctcgtgtagggactatcgcgaaaaggcgcgaatacacagcctcccgcgagcacatgctcctatgcgggagatacctgatggatttcttacctcagcggtctcgccccctgcctgagctaatcccggagaaccccagaaaaactcattaaacgtagggggtaccgagctcta

SEQ ID NO: 686635 - DNA, 197 bp, Homo sapiens
actgggaatggaggccatgagcctgagcagcagtggtccagtatgcgtgttggaatcaataggcaggattatgatgttgactgtaacgcacagaggagactgtcaggaggcagccactcatatggtgtgcgacgtcgccggcaatctccccctgcagccgcctaggcaagctcagcaagtcagacgagcatgttgtc

SEQ ID NO: 686636 - DNA, 102 bp, Homo sapiens
gcagacagttttcgcttttattggtcaagaattcttgacagaacccacacacacacatccacacacacacacacatgatgcctgcccttctgtcgtcttctc

SEQ ID NO: 686637 - DNA, 117 bp, Homo sapiens
aaaccccctgggatttggccccctttaaaaattcatctttggattcccctaaaatttggaacagtattgtacatatggtagggacttaataaaggtttgaatgagtgtgttgattga

SEQ ID NO: 686638 - DNA, 400 bp, Homo sapiens
tcagctcggacccctcacggatactcaaatcgtgtaacaaaaaaaaaacccagaattgccatctatattctccaggactggcagtctgccctcaaaagctatcaaacacagattcatgattataagcctgaaaaggagaaacctacaacacccggaaatcggcctacgtccccatataattccctttacacctcagtacgaaactcccccatttatattagaaaattaaataaagggttcccataagttaagctcccagaaaaacacctttttgccgacctcacggatttttaccaaccacttcgcttccctgtggccttggcacacgggcatgcgggtctaggatcctctacgcacaacgcctgctcgcctcctccgtgtggtggaggtaactccgtga

SEQ ID NO: 686639 - DNA, 127 bp, Homo sapiens
gtgcagtagtacaatcacaccattcactactgcttgactttcccaaatgatgctatatgatgtgtttctgaaacaaatcatagcatctgttcttctaaccacctgccaccaattgtacaaacatgca

SEQ ID NO: 686640 - DNA, 630 bp, Homo sapiens
  misc_feature (1)..(1): n is a, c, g, or t
  misc_feature (23)..(23): n is a, c, g, or t
ntccccaagccaggtcattgccnactggaaaggccatggcccccggtgatccatgcttcaatgcccaccccagaaacacacccctcagtgtgtgcctcagtttactttggagatcagtggccgtttttagtgctcctttaggcttactaaaacagttttggaaacaaagctattttgaagtattcaagcagaggaattccctaacactgacccccttgtctttttttaatattcaggctgttttatatgcctaaatttttttcttaagatctaaacgaaaaatagtttcttgtttaaattcacataaggcaatgagatatggaaagatgacaagatacgtataaacattggtttgcattttattaaattattctaatgcaaatcttgtataaagaacccatgatgttttgtaactttctaattaaaatgttcaaaatgaggccgagcatggtggttcattcctgtaatctcaacactttgggaggccaaggtgggaggatcacttgagcccaggagcttgaggctgcagtgtgctatgattgcaccactgtactgtagcctgggtgacagagtgagaccctatctgttaaaataaataaataaataaataaaaaagtcaaaaaaaaaaaa

SEQ ID NO: 686641 - DNA, 242 bp, Homo sapiens
gaccttacatcaaatcgccacatactcgaagaagtaaattatggctgaatcatccgctaccttcaagccaatggcgcctacaatatatcatattatctgcctcttcctacacatcgggcgaggcctatcttacggatcatttctctactcagacaaacctgaacacatcggcattcatcctccatgcttgcaaactcatagcaacagccattcctaggctatgtcctccacgtatacaggcg

SEQ ID NO: 686642 - DNA, 435 bp, Homo sapiens
gcgcacccacccacacatatacacacacaggtacacagtcatgtgcacccatccacatacgtgcagtcatgcacacagccctgcacacagacctacacatacacatgcgtgcacacagacatgcacacacacagtaggggccctaagcaggcgtccttagcctttctgctctgagctctgcagcatcagaacctgctgccataactgagccaagtgaactcctgaagcaggagcatccccgggcgtggcaggggagcgcccaccaccaagattctgctgctgtgctcgggggcagttgtgccttttctgtttttctttctttctatatttccaggaaatcatgacattaaaaatgactttttcttatgacgaatattcattgtaggatatttagtgaaaattcacacaataaaaactgtgattcgtttgtgaaaa

SEQ ID NO: 686643 - DNA, 428 bp, Homo sapiens
agccataccaggcataaaacaagtgacataaagggagggtccctgtgtgtatatgtactgatattcctaggtgcctggctcctagcagcagggctgggcctagagagaaccaaggctcactgcagcgcgctcctaagacccctccctacaggtgctacgttagcagcccagcacataggcttgcctaatggctttcactttcacttttgtttaaaatgactcataggtccctgacatttagttggattatttgctgctacagacctggtacactctgatttaagataaagttaggctaggtgttgtcagcaggcaggctgaggaggccagtgtagtgggcttcctgctgggactgagaaggctcacgaagagcatccgcaatgttggtctcactgagagctgcctcctggtctcttcaccattgtagc

SEQ ID NO: 686644 - DNA, 333 bp, Homo sapiens
cccctttttcccctttgcaaggcaggaggggcggaagggtagcctcagggtccacgggttcaaagagctgggttccccgccggtgccccctttggtcaagggtggggggtcttttgatgagaagatgaaggggttggatgtgaatccgggctcgggggtccaggtccatgaggactgggggttggttggggggctgggccagggaatccgggagaagaaaggcctgaaggtccgggagaaggtaaaccgcctgggttagatggggggggcagggcagagctggtcaggggcgggcaggaccgccctttttcccaataaaggttcccccctgga

SEQ ID NO: 686645 - DNA, 754 bp, Homo sapiens
  misc_feature (1)..(1): n is a, c, g, or t
  misc_feature (93)..(93): n is a, c, g, or t
  misc_feature (123)..(123): n is a, c, g, or t
  misc_feature (137)..(137): n is a, c, g, or t
  misc_feature (139)..(139): n is a, c, g, or t
  misc_feature (260)..(260): n is a, c, g, or t
  misc_feature (307)..(307): n is a, c, g, or t
  misc_feature (348)..(348): n is a, c, g, or t
  misc_feature (584)..(584): n is a, c, g, or t
  misc_feature (626)..(626): n is a, c, g, or t
  misc_feature (628)..(628): n is a, c, g, or t
  misc_feature (643)..(643): n is a, c, g, or t
  misc_feature (651)..(651): n is a, c, g, or t
  misc_feature (653)..(653): n is a, c, g, or t
  misc_feature (727)..(727): n is a, c, g, or t
ntaagagtgggaaccaggggaacccagggatgggattccactgaaaacaaaccgtcctgctgttctgttgagggcccccacccacaggatgtngccatgggacagccacttagggtccaggtngaggggcggcagancngggaggcagggacagggaggggtcgccccagggcagttgcagggctggaactcgtcccttacaaccctgagccccagcaggggccccgtgttagaagcgagaaggccggtgggggtgcgtngacaaggggcagaatgaccctgcccccaaccagtttcgccaggcgcnggcccagtggccccaggccctggcagccggcgtctcccgcngccttccctctgccctgcgcggggacattcagtgcgccggggaggcctcggtgatggccccctccacccgcaggtaccagggctggatgtgcgttttccgcatcagggcaacgaatgcatccagcccctccatcacacgcagcacgccaaaaaccgccaaaacagcgagaatcggcttctggccccccatgaagggccggtccttgcccacagcagccacccactcgtcagcagcntcaaagaggtcctcgcgcacgttgtcctggaggcggtgcctncncttgagttgcttgcngaagaggnanaaggccgccgcacccatgttcttggccacggcaccctccacggctccgaacttgccctcgcggacaatgtagtnaaaggacgccagaacctcggtgggcgt

SEQ ID NO: 686646 - DNA, 140 bp, Homo sapiens
tgtatttatacacgaggaggaagcgcattacctaccctatgaggaatttggagtcacacccctgcgtattccccccggaaaggggaaaaaaaacccccgggggggttttataaatttcccgggaaggggcccaaaaaaaa

SEQ ID NO: 686647 - DNA, 138 bp, Homo sapiens
taaactactttcataaactgtacatcaacatggcacagactgtagcctacttttatttctactgcacaaaagtgaagcttgacacttctgtaactaagaaaacagttgcctacttagcatatataacatgactccaag

SEQ ID NO: 686648 - DNA, 129 bp, Homo sapiens
ctacttgtctcaaaaagtgtcaaggggcgccctgacgaggagtagatagcaatgccctgaatgccaactgcacttctacagaaaagtgcttgagtgccaaggatggtcttcccagtcataagtgaggct

SEQ ID NO: 686649 - DNA, 613 bp, Homo sapiens
  misc_feature (304)..(304): n is a, c, g, or t
  misc_feature (315)..(316): n is a, c, g, or t
  misc_feature (338)..(339): n is a, c, g, or t
tggggtgtggtgtttttccccccaacacccggggggaagttccacccaccctttttgtgtgggtcttcccttccccccccgggggtgtgttgggagagggggaggtgggtgtgtctcacaaaccctcccccccccctttgaaaacttttttttaaaaaagggggggcgcgcgaaacccggtggtgtcccctccccccccccggtgtttttttccacaaaaacggggagggccccccccttgtgggaggaggttttttttcccccccccccccccggtggtggggggggattggggggcgggganaaaaataaaanncccccccccccggggtggggtnnggggggctttttttttttttaaaaaaccccccggggggaaaaaggggggggggccggggggttctttttttttttcccttggggggaggggggtgggccccccccccccccaaaaaaagcctttcccttttttcgggggtaaggggggggggggggggggacccccccccccccggttttttttgtttggcgggggggttttgggggggccccccctttttttttttccgggggccccgggggggtttttacccccccccccccccctggggga

SEQ ID NO: 686650 - DNA, 508 bp, Homo sapiens
  misc_feature (389)..(389): n is a, c, g, or t
  misc_feature (403)..(403): n is a, c, g, or t
aatgataagttaattgctatttatattaggttgccaagaggctttctacagtatggtgggcagcaaatggatgaagtgctaatatctcagtagattttacttgtgttttgggggttaaattcatgttggggtttctgataattgagatgctgcttttgacatttctttaccacctcttagtatttaagagtttttccgttttatgtatactaggtttgtccaatgagtaagtctccatatgtggatcctcataaatcaggacatgaaatctgggaagaattttcgatgagcttcactccagcagtgaaagaagtggtggaatttgcaaagcgtattcctgggttcagagatctctctcagcatgaccaggtcaaccttttaaaggctgngacttttgaggttntaatggtacggttcgcatcattatttgatgcaaaggaacgtactgtcacctttttaagtggaaagaaatatagtgtggatgatttacactcaatgggagcagggg

SEQ ID NO: 686651 - DNA, 346 bp, Homo sapiens
acctttacccatgtatgacccaggtaaccaaatgggagatgagaataagtttctgtttagagctgtattccaatggctgctaacatcacagaaaaacaaccagatcttaggtgccttttgatagaaaagcacaccaggagttttgtttcgttaaaacaaaacaaacaaacaaaaagtggtagctgtcagaaaaaaaaaaaaaaatccagcctgaatttgatcaagcctcttgatctaactcccaaacatacaagaaacactaaggatgaagaaagatattaaactataccacagaaatccaataagcaaaacagactctaaggaaactcagcccagtttcttctat

SEQ ID NO: 686652 - DNA, 81 bp, Homo sapiens
gcggccgcttactactactactactgctcgaattcaagcttctaacgatgtacggggacatgtttgtatgtgtgaagctac

SEQ ID NO: 686653 - DNA, 1062 bp, Homo sapiens
  misc_feature (1050)..(1050): n is a, c, g, or t
aagcttggcacgagggacagacgggcaggcggggctgggcgcgggcggcggcggcccggaggagaacgggcggagggcgcgggccgaccgggcgcaccgaccatggcctccaaatgccccaagtgcgacaagaccgtgtacttcgccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctaggctacagcggctctcatgatgtgggctcacctgcgccccagaccctgcaggggcccccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgtccgaatccccgtgtgaccctgtcccagcattttccgccgacctgcgtgtcccgtgggctgtcgctctcctctctgctgccaccaactncaatttatttat

SEQ ID NO: 686654 - DNA, 974 bp, Homo sapiens
  misc_feature (117)..(117): n is a, c, g, or t
  misc_feature (326)..(326): n is a, c, g, or t
  misc_feature (330)..(330): n is a, c, g, or t
  misc_feature (339)..(339): n is a, c, g, or t
  misc_feature (398)..(399): n is a, c, g, or t
  misc_feature (447)..(447): n is a, c, g, or t
  misc_feature (455)..(455): n is a, c, g, or t
  misc_feature (469)..(469): n is a, c, g, or t
  misc_feature (508)..(508): n is a, c, g, or t
  misc_feature (572)..(572): n is a, c, g, or t
  misc_feature (578)..(578): n is a, c, g, or t
  misc_feature (588)..(588): n is a, c, g, or t
  misc_feature (608)..(608): n is a, c, g, or t
  misc_feature (671)..(671): n is a, c, g, or t
  misc_feature (709)..(709): n is a, c, g, or t
  misc_feature (730)..(730): n is a, c, g, or t
  misc_feature (787)..(787): n is a, c, g, or t
  misc_feature (800)..(800): n is a, c, g, or t
  misc_feature (837)..(837): n is a, c, g, or t
  misc_feature (844)..(844): n is a, c, g, or t
  misc_feature (872)..(872): n is a, c, g, or t
  misc_feature (887)..(887): n is a, c, g, or t
  misc_feature (896)..(896): n is a, c, g, or t
  misc_feature (902)..(902): n is a, c, g, or t
  misc_feature (908)..(908): n is a, c, g, or t
  misc_feature (913)..(913): n is a, c, g, or t
  misc_feature (947)..(947): n is a, c, g, or t
ggcctctgcgcgcctcctggccccggcttcttggctgtcaaacagatgcagcaacgtcggctcctgccgaggagcccaaggggtcccgggatccgccgcacaggctggcactgcttnaagaggaggctactcggagactgcgccgcgcggtggattcattgccctcggaggttcaaccagttatgagtgagggattggccagaagatcggggcgcaggcaagcaggagtgctctattaggataagcaagtttgacaggaagaagctgctcttctccgaattacacagaggtgatgtgttcgtattgcacgtagacgtgtgtataanaggnctctccttncccgcgccccgccaccccgacacacacaggagctgcctaaagtatccttgccttgcagnnttgtgatggcttcctcaaaattttttgtgaatctgaggaatcaagcanaaagtganggtgccataggaangtgttacctgagttttgcaattgcacggagacccttccntggaaattttttcattttgcaaagtccggcttaaaccaaattttttgcatttgaagtccttagngctgcnttgcacatcntgaaatttggggcctattcnagggtaagtgtgcctcaaaagtttgaaacccgcatacaagcacaaactcaaagttttgcatcnagacttgggaaagcgaacttaaagccagcggttgcgtnggcccaggaagtggggaaagngaaatgggatgcctggaagtgggaaggaggtgggtgcagaggggggcaccgcccatngctgccctgcttncaactgctgcgcatagggggcggcaggggcggtgatntctacancttccaccccccgccggggctggctgcnctatcgcttgggcanagggcgacntgtgtnatgtgncctcngcccagcagagcctggcctcatctctgggatcangcgaactgcatgcgagcccggggtgat

SEQ ID NO: 686655 - DNA, 1230 bp, Homo sapiens
aagcttggcacgagggacagacgggcaggcggggctgggcgcgggcggcggcggcccggaggagaacgggcggagggcgcgggccgaccgggcgcaccgaccatggcctccaaatgccccaagtgcgacaagaccgtgtacttcgccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtcatgatgtgggctcacctgcgccccagaccctgcaggggcccccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgtccgaatccccgtgtgaccctgtcccagcattttcccgccgaccctgcgtgtccccgtggcgctgtccgctctccctctcctgctgcccacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgcaaaaaaaaaaaaatttc

SEQ ID NO: 686656 - DNA, 267 bp, Homo sapiens
  misc_feature (9)..(9): n is a, c, g, or t
agcggacantttgccatcgtgccaagagagtcccagccagcacattacgagaagaggaaggatgatgatcctgatgtctactagactttgaatcagatcatgtggcactgaaacagaaacaagagattatcaggcgactataacatgaggatggctgtactcgagggctcagagtgtctcaacgcagtccaaggaccttgcaaagtttcaggcaggcgagcagcagagaagcactggaaaaatcccaattggattaggtggcaaaaa

SEQ ID NO: 686657 - DNA, 410 bp, Homo sapiens
tcccccgaggggtggcagtggccactgtgcacgaggccaggtcagtgagatggctccaggatggcggcaagaactgtgagtgcgaagcatggttcctgtagagccccgtgaagaatattcatgaacagtgtctgggctgcctaagaagcagtgcccctgtgatcatttcaagggcaatgtgaggaaaacaagagaccaaaggcaccacagaaagccaaacaagcattccagagcctgccagcaatttctcaaacaatgtcagctaagaagctttgctctgcctttgtaggagctctgagcgcccactcttccaattaaacattctcagccaagaagacagtgagcacacctaccagacactcttcttctcccacctcactctcccactgtacccaccccgtcgggtggag

SEQ ID NO: 686658 - DNA, 1087 bp, Homo sapiens
aagcttggcacgagggacagacgggcaggcggggctgggcgcgggcggcggcggcccggaggagaacgggcggagggcgcgggccgaccgggcgcaccgaccatggcctccaaatgccccaagtgcgacaagaccgtgtacttcgccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctaggctacagcggctctcatgatgtgggctcacctgcgccccagaccctgcaggggcccccctgcttggctctgctgggagagtgctcagccgcccagtcctgcctgcaagcccagggcgagtattggaggaggggcagccacgggcagagcaccacacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgcaaaaaaaaaaaaatttc

SEQ ID NO: 686659 - DNA, 337 bp, Homo sapiens
cacactactatcgacagggagacacacacacgcattcattaaccaggtacacatttcatcagtccaaagacagatattcctgaattgtaactttattattctataaattcgagtcaatttgtgtacaggtctttcctcccatagtagaaaaatgaaatctagtttatttacaggtaaatgttagtatgttcatgatgtttatttacttaatgacgcaattacaatttaatttcagatagcttcagaatttacttaatgcccttctactccttttcaccaatattaattgccggtatttaaaaaaattattaaacaaatatggccataattaaccggg

SEQ ID NO: 686660 - DNA, 1225 bp, Homo sapiens
  misc_feature (470)..(470): n is a, c, g, or t
  misc_feature (503)..(503): n is a, c, g, or t
gccagatagttgtgaatcgcctgataacatgcatagtactatcgatcagaaaatagtggcaaagacgtcatgctgctacagaggaccctggagaaaacgtctgactcaatccagtagaaaagtcagtataacaacaggatggatcacgctctggtaattgaaactgcgtgatacgtaaccaactttgtcttagtaatccctacacgtgaacttgattgagaagttacttaaggatctagcaggatcatggacagggtaaatatccatcgggactcgagacgtacgcacgaaggatcccatttagtggaagtacacagaagtacctacgagcagtccgattcgtatcaagtactcgaacatgctggaatgcttctcagttcggatgctagatattcgatactgtcctgtaccaggggcatcgctagaattttgaagatgtaggaataagcactagggagggaattattccnacatgtattatttcacgaacagagatttgctgngtatagaactatcccaggatgcgcattgctaagtcggtcacctgtatatctaatacatgctccgcgaaagccataccaataggcaactcaagcctatgtatggacacacaaagatttcctttggatataatgatccaattcttcagggctaggaatatattcccctcttggttcaataaggagaggtttgtgcgcgtatagataaaagctttgctattatcggtcatccgcaagctcttacggccccttgtataattgtaatcactattcgataactatctatgtatcagaagccatagtttactctttaggttgaagccccaatttgcctgcttaacctcttaacgataatcacggaatggcgtttgaacatatatttccttaggagaaaccccttattaaccccaaatgtgaaaaccacagaagcaaaaagcgtaactcccgcattcatgtctagacgtgtacctagggaactttcagtccgaggtgtcccaatacttccctatgtgtgcaggagactgcaagtagtaaggaatatgtattctttgggttcattaacccaggggccgtgtgactggtttgattacacccgtataattgcgcaacctgttcgccaccgaactttgtcaatgtactcccgggatcctaattccgagggatgggaacactgggttgtaagtctcagcacatgtgattccttgttcagtgtgccccagcttccc

SEQ ID NO: 686661 - DNA, 1234 bp, Homo sapiens
  misc_feature (737)..(737): n is a, c, g, or t
aagcttggcacgagggacagacgggcaggcggggctgggcgcgggcggcggcggcccggaggagaacgggcggagggcgcgggccgaccgggcgcaccgaccatggcctccaaatgccccaagtgcgacaagaccgtgtacttcgccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtcggtctcatgatgtgggntcacctgcgccccagacctgcagggcgcccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgtccgaatccccgtgtgaccctgtcccagcattttcccgccgaccctgcgtgtccccgtggcgctgtccgctctccctctcctgctgcccacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgcaaaaaaaaaaaaatttc

SEQ ID NO: 686662 - DNA, 105 bp, Homo sapiens
ggacccatgatagcggtgaggctatagtctgagcttgtcatagagggcactgtctcggtgggcttccagcagtcggaagatctcttcactggtcatcgacatcat

SEQ ID NO: 686663 - DNA, 698 bp, Homo sapiens
ttcggacccaagggtgagtgtagccagggtggtccacgatgtcttccctgccctccccttccctccactgttctcccgacccaccccagcggcctccctccacaggagtgaacaccggtgcggtgggcagctacatctatgaccgggaccccgaaggcaaggtccagccctaggctacagcggctctcatgatgtgggctcacctgcgccccagaccctgcaggggcccccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgtccgaatccccgtgtgaccctgtcccagcattttcccgccgaccctgcgtgtccccgtggcgctgtccgctctccctctcctgctgcccacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgcaaaaaaaaaaaaatttc

SEQ ID NO: 686664 - DNA, 572 bp, Homo sapiens
  misc_feature (372)..(373): n is a, c, g, or t
  misc_feature (430)..(430): n is a, c, g, or t
ggtgcgcgggccggcgccgggggttttggccccaaagggggacctccccccccttttcttctccacctaaaaggggttaagaccccttttttttttttggaccccggggggggcgcagccccaggggggaggtggattctcaaccaatcccccgggttgtgggggggatttttatgggttttttttctcccggccccggcgttaaaaggaattttttttttgaaaaagaaaaggggggggggcccccccccctggttttccctttttggggaaaacaccggggttttcttccccccccccggggggggcccgggggttttttttaaggagggtaattttttttcccccccccccctcccccccccccttttnnttgtttaaaaagaaaattatagggccccctttttttttgggaaccccccgggaaaanggggtttttttgcccccccaaaggggttttgggcccagttttcccccccttggggccccccccttgggtttgcccccttttcccccccctaaaaaaatggggttttttccccccctaaaaaaaacccgggtttggggcccca

SEQ ID NO: 686665 - DNA, 1283 bp, Homo sapiens
  misc_feature (479)..(479): n is a, c, g, or t
  misc_feature (621)..(621): n is a, c, g, or t
  misc_feature (638)..(638): n is a, c, g, or t
  misc_feature (663)..(663): n is a, c, g, or t
  misc_feature (939)..(939): n is a, c, g, or t
  misc_feature (1014)..(1014): n is a, c, g, or t
gggccccggatgttctccagacctctctcccggagggtgttttttgcctcctttgtgggtcctccccgggggggttccggggtgatatcccacacagtgtgttgacccacacccacggggggtacccacggtgttatttgcgccccacctttattggcgcccccttatttttttatagggtgggccaccaccctttgtttgtggggcacccccaagagtgtttggtggacccccgggatattagccccgagagcgttgggggtgacacccgggtttccctccggagaaattttccccccccgggggagaaaattttggtgctgagacacccacaaacaggcgggtcctccgggggggaaccccgcccgacaatgtgtgtcccccacgtgagaattttcttcgccgcgacaaaagtggtggcgcgagagcatcacacaacaaggggggagatatagagagggagagaggcgcgccccccnccgagaagtaatatatggtttctctcttatagcgcccttttgtttatagagaagacccacactgggagagattgtgtgtcccccttgtgggcgcacacaacaaaaatatatgcgcagaattctctatataagagagaaaggngggtagaaatatattgntgagagagacacacctacacagagngagatatgtggggactacactgtgtgtctcacacaaagagagagatatggcccccacacacacaggggggtgtcacacacagctgggccacacaaactcgtgagaaagagttttctacacacacatgtgtgtatacccgacgcgcacatcgcgcgtcgtgtgtgtgcgcacatatgtgtgtgtggtagtaacacacacacacacacgcgtttataagggcgacacacaagatttctttgtcaccacgaagaaaatttataatagtggcgctatatntgagagcaccactctataagggcacactctctataagagagcgccgcgagagatatagtctcttctctcgagaanacgctcgtgagaaggagaaaatgagatacacgagaaaaagagaatgagaaggcccacaagagagagataagaggaacctgggttctacaactaaagcgccacgcctgcgtccacacccacgagagagcacacacctttgttgaggagaaccacacatgtggagaaggagagcctgtaggctgctgggaacctatttctccctattgagaattcactggcacatataatataggtgtttaaaaaaaaaattaaggacctttggggtacca

SEQ ID NO: 686666 - DNA, 642 bp, Homo sapiens
tctagaggatcccgtagaagacgacaggaaggggagaaacggacagaagggagtaacaccggtgcggtgggcagctacatctatgaccgggaccccgaaggcaaggtccagccctaggctacagcggctctcatgatgtgggctcacctgcgccccagaccctgcaggggcccccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgtccgaatccccgtgtgaccctgtcccagcattttcccgccgaccctgcgtgtccccgtggcgctgtccgctctccctctcctgctgcccacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgcaaaaaaaaaaaaatttc

SEQ ID NO: 686667 - DNA, 426 bp, Homo sapiens
gcacgagcagaatccaggctcatatcttgtaaattattaatcctctttgagctgatattatccttagaattttcacttttggtcttgttttctggtagtttcgaatggctgggatcttcttcatcctgatctgtttcaggctcctcaaattcgaatgcatcctggaacaaaccgaataaatttagcatgtttaataattgtaaacatttttccagctctatccataactcacctcggtcgtctgtatttacagcaattccataatgtgccagtaatttatttctttcctcatcagtggggaaactatcggggttggtctcgttaatattccccgtgtcatgatattgctgcaaaatgggcagaaaatgtttcaggaggaaatggccagtctccgagtctctagtgagtgtcaaagggatctcattg

SEQ ID NO: 686668 - DNA, 407 bp, Homo sapiens
gagttttaatgctagcctttcaaaatcctattcgtttataaaagtaaggaaatttactcattccaggtaaaatgtagttaccaaagcagtttgagaggcagacttattaccattcaatctggggtctattgggctctggcacataagaacaagaaaggcaatggtgcaaagaaagcctgggttctcatccagccttcatctttaaaaagctctgagatcttggatagttcacttaatttgtctgttttcagtgatctcatctattaaatggacttactatcattacaaggtaaaatttaatcaatgttaccctttagttgtcatctttatctttctccctaagatagtgtagtatcctgtttctgccttggagccacgctgcctgggtttgtcatttatgagccatt

SEQ ID NO: 686669 - DNA, 960 bp, Homo sapiens
agttgttccggacacatagaaagataacgacgggaagagcggggccgctttggggtccaggcaggtttgggggcctcctgtctggtgggaggaggccgcagacgcagaaccctgtcgtcactttggattggagaccggttttcccggcaatcattgtaccccctggatctttaatgggggggctgggggagaacgagtatctcagctgggaaagggaccggggctcccagaatttgcggtcttccagacagccccgtgggaagtctggaaagcacaatggcacttgaaggaaaacccaaggagttggcagattgtgctggggctaacatgttgggcccgacgggttccccgatgattgtgttcaaggattacttcaccccacgaggccccggtgtgggcgccaggagatcccccacagcaaaggaagcgacacatggtcgcctaaaggaggtggggattaacttagcacatgtgcggccaggcacagtgggagggacctttgtgggacaaagggggcattcacccaaagaactccaaggtggtacattcgtggattcaagacaaaagtggcctttccccttcccaagagctcggagaaacgacaaggccctgtccactcgacgttgtggtgggtcccaacagaagccccccacacagccaaggggtttggacagtcactaccattggatagaaccgtaggaaagcactggggcaccagacggaccctgctggcttcgggacaagacaaagtgggtacatgggccattttgacggcactcgttgttttgaacggacgacacacgggccaaaatccgagttcaggacccctgaccttcccggctgggattttcacacaggttcccattaatcgtggaagatcaatctatcctctcccaggttggaaagattattccagttgagcccagcatgggtcaaattcaccgaacttcagaaaatacc

SEQ ID NO: 686670 - DNA, 1623 bp, Homo sapiens
  misc_feature (1126)..(1126): n is a, c, g, or t
ggctggggaccttggggcaggtggtctccctccagaagagccctgtgttcagccagccctgtcctccagagcaagccccacaggtagcaaagtcagggagggtaatggcttagccccaggctcccaagctgggcagaacagggcagggagctggagagggttggcagtgggcccatgaatccagcctgggcaaggccctgctgtgagggacccctagggacccctgggcctgccagggaggaagggctgcccagaaaaggtactgactgatgcctcctcaccatcttctgccttggctggcacaggtcccaagtgcagagggggagctggtcaggctggtcagtcgggcgggggggcggggggcatgtttctggcctgctgtcaccatggaaatggcagtggctgcagggtgtgtgtgcaagggaggagggtgctgccacagagagcccagccaggaccaccatgaaagccaggagcaccgagggcctctggttggctcacaaacatgcctggtgcaccaggcagagggaacagccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtcggtctcatgatgtgggntcacctgcgccccagacctgcagggcgcccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgtccgaatccccgtgtgaccctgtcccagcattttcccgccgaccctgcgtgtccccgtggcgctgtccgctctccctctcctgctgcccacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgcaaaaaaaaaaaaatttc

SEQ ID NO: 686671 - DNA, 541 bp, Homo sapiens
agtcgtggcggacacgtaggtcggcgggaaaatgatgtgggctcacctgcgccccagaccctgcaggggcccccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgtccgaatccccgtgtgaccctgtcccagcattttcccgccgaccctgcgtgtccccgtggcgctgtccgctctccctctcctgctgcccacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgcaaaaaaaaaaaaatttc

SEQ ID NO: 686672 - DNA, 124 bp, Homo sapiens
tgagtcattagcttgtattcgtccatctgttgtcacatgacatatgggaacagttttccctgaatcagttgacaaatgttatcaacagataatttcattaggggaagtaaaactgtgatcttga

SEQ ID NO: 686673 - DNA, 751 bp, Homo sapiens
ggtgcttctgggagctgcgtgccctctcccccacggcgagccggcctgcacgttctggaagcctccaggtgatgggtcgggggagtctgtggactcctccctcagcacccaccttctgccccagcacgacggccagccctactgccacaagccctgctatggaatcctcttcggacccaagggagtgaacaccggtgcggtgggcagctacatctatgaccgggaccccgaaggcaaggtcatgatgtgggctcacctgcgccccagaccctgcaggggcccccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgtccgaatccccgtgtgaccctgtcccagcattttcccgccgaccctgcgtgtccccgtggcgctgtccgctctccctctcctgctgcccacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgcaaaaaaaaaaaaatttc

SEQ ID NO: 686674 - DNA, 350 bp, Homo sapiens
cccatctggcgaggcagtctcccaaagtgctgggattacaggtgtgattctctgtgcccagcccaacaaactgatattgagcctccactgtgttccatgcactgtacccggttcttgatgatacagctgagatcaaggtagacagatccctggtctcatagaccatctattctaatggggggcattgataatatagttataatgaaatcataggcgttgataagagtgccgcaagaagtaaagagggtgatgaggatgagatgaatcagaggaggctgacttaaaaatggtggtcagcacaggaccgtctgaggaggcacctttcacagagactgcctacacagaggagg

SEQ ID NO: 686675 - DNA, 1017 bp, Homo sapiens
aagcttggcacgagggacagacgggcaggcggggctgggcgcgggcggcggcggcccggaggagaacgggcggagggcgcgggccgaccgggcgcaccgaccatggcctccaaatgccccaagtgcgacaagaccgtgtacttcgccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctaggctacagcggctctcatgatgtgggctcacctgcgccccagaccctgcaggggcccctggttggttttccctttcctggtgcccacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgcaaaaaaaaaaaaatttc

SEQ ID NO: 686676 - DNA, 331 bp, Homo sapiens
ttgaactgggtgtttaaaaatgtgaattcctggtattgtatactgtaattgattacaagggctgggggggtgtcaaaaaacttgacaggttgtgttgatgctcttagtagagtcttgaaaagaaaatattaccccggccaaaaaggcagaagtttcaaaaaattttttgtctttgtttgcattggataactttaacgagtgagtttaaaattatttaatttccttaaaaaaaaagccccctttggaaaaaaaactggggttaagaaaaacgtaaaagccctgtttttatttttattttaaaaaatttaaattgactttccccctgcgccca

SEQ ID NO: 686677 - DNA, 100 bp, Homo sapiens
acaaaaacacccattaccataaacttagtggagacccacgcaaacatatagagctcaactatgagcaaacttgacctcccgagtcgaggtcaggcctgtc

SEQ ID NO: 686678 - DNA, 351 bp, Homo sapiens
cgtaattacgcagttacacgcattcactctggatgcatttcacactgctgcatggaatccagtgcattaaatcacactgcatggaatccactgcattcaatcggtatcaattacaccaagctgcatggaatccacctcattcaattgagatatactgcagcactctgcatagaatccactgcattcaatcgtgcttcatggaattcactgcattcaattgggatcaattgcgccatgctgcatggaagccactgcattcaatcaggatccattgtgctacgctgcatggattccaatgcattcaatcaggatccattgggccaagctgcttgaaatccactccattcactc

SEQ ID NO: 686679 - DNA, 1161 bp, Homo sapiens
atgagcacagggcagacagttatgcaggggtcacagttattgataaaccattatgagcctgcaaggcacattttccagcatcattctatcaccatgcagcaaaccagccttcgaaccaagtcattatgtgcacagtgcactgcagcacatctcagccactatctcccactccgtagcctgccactttcacagtctccagccagcaagcatcacgcatccgtctagccttatctcatcagtgccctcaagaatcacctgcacagcattaatctctcttcgcgtcagcacagccaccagctgttcagcgcctatctctctcttgcgacactcgcagccaagccacgcctcgcaccgtgcacattttttccgatcacacgacacaactcttgggaactttgccagagcacctctcacattccttgtcacgtcctcttaagagaccacaccaaggttgcgcttctccaatcacacaaggcacggttcagttatcctaatacattcaaaaacccctgtggaacattggcaccttcacccagccaatttccttctctaagccgcttgccacagcagacagcggcatcgccacaggtcaaatagagttaggtaggtaacaatatggcttcacacaacaattttcaaacatttatatctccactcccttttctacattctattgccctttaccttcaaaaccacaagagtacccttggtttcatttcaacccccaagcgggcaccaaccgtcggcagcaacacgcttccgtcttctggcacaaacccagcgcacttaattttcaaccgccattcctttcaacgtcttcagcagcctcaatttcaccgcacatacagacttaacgactttgggcaagcaggccgtaaccttaaccccaccgtgggctacgggggcccttcacactagacttacaacaaaacctcaaacacccttcgactgcgacttttacaagcaaattttgggacagagtttacgttatcacgttacaagacttcacatttggctagaccactttacgttaaacacaaataggatatgataggctcccatacttaggtgggcatattctacccgtgtctcgcacgacagtacaatgtcttgccggcacacgacaagcgacctcggttcatggcacgaagcgttatgtgc

SEQ ID NO: 686680 - DNA, 191 bp, Homo sapiens
ttgcctggtgacacccggctcatgagaatgccgccggtagtccatgactggatgagcgccgccggaggccgccgctctgcgaatggaaaggaacggctcagacggatttacccacggccgatccaaaggccttggtgtggatatccgccttgcaaaccattcagaagccaacagtggcgaccactgtgggt

SEQ ID NO: 686681 - DNA, 238 bp, Homo sapiens
tctgctcttcttatggtgttttcaacacaaatctagcaaaagagagatattttgtaaatagaaggaatcaaaagaaaaaatgtgtaatatttatgattctagaatctgactaagacatgtctcttcagtctactaagtgttttcgagttcaggcacatccagataatgcctcttggttacaccagcatctctgcgataaggcttactatgtgcccctgcctgattcagcggggtcggg

SEQ ID NO: 686682 - DNA, 589 bp, Homo sapiens
  misc_feature (21)..(21): n is a, c, g, or t
  misc_feature (89)..(89): n is a, c, g, or t
  misc_feature (96)..(96): n is a, c, g, or t
  misc_feature (135)..(135): n is a, c, g, or t
  misc_feature (143)..(143): n is a, c, g, or t
  misc_feature (148)..(148): n is a, c, g, or t
  misc_feature (155)..(155): n is a, c, g, or t
  misc_feature (209)..(209): n is a, c, g, or t
  misc_feature (297)..(297): n is a, c, g, or t
  misc_feature (316)..(316): n is a, c, g, or t
  misc_feature (540)..(540): n is a, c, g, or t
  misc_feature (571)..(571): n is a, c, g, or t
  misc_feature (573)..(573): n is a, c, g, or t
  misc_feature (576)..(576): n is a, c, g, or t
tttaaacaactgaaccgcccnttacacatgactcttcttggccatttaggttaattcttgaactccaagctttaaattcctcccatgantcagcgntcacctcattcacacattttcatagagctccttggacantgaacttntaaanggaaagntctaccctggagccaggagcatcagggttggcttgggaaccatgagaggttgcncccagggctaagccttggccaggccccggcagcactgcttacttgggaggagccacttcacctttgtattagttattaaaaaatatantttgggctgggcgcatgtngcacgcctgtaatcccagcactttgggagtccgaggcatgcggatcacttgaggtcaggagttcgagaccaccctggccaatatggtgaaaccccatctctactaaaaatacaacaaagttagccgggcgtggtggcaggcgtctgtaatcccagctgcttgggaggctgaggcaggagaatcacttgaaccctggaggtggcggttgcagtgagcacagatcnatgccactgcactccagcctgggcaacaaananacnattcgtctcaaaa

SEQ ID NO: 686683 - DNA, 280 bp, Homo sapiens
accagagaatccggtattgtggacggggtgggtgtggtcgacagagatccttgtcagatatcctatctgcttgatgccgaagcggggggcccaggtacgatccagggcgatgtacattgtcattgtccaggtcacaggtctcgcaaaagcgggtggtgcaatgctccatggggatgaggggagcacgcaggtggagccagctcggtgtgggagaggtacccgtcaatggggtgctggtccatgctggccgaactgccagtgtacagtgaagatgtacatg

SEQ ID NO: 686684 - DNA, 341 bp, Homo sapiens
  misc_feature (68)..(68): n is a, c, g, or t
  misc_feature (81)..(82): n is a, c, g, or t
  misc_feature (102)..(102): n is a, c, g, or t
ttaaattcgcggccgcgtcgacgggagaggatcagaaaaatataactattgggtactaggcttagtancctgggtgacaannaataatctgtacaacaaacntcctgtttcttcttttataggcaaacgtgagtttgcctatataagaaacctgcacatgtacctctgaacctaaaataaaagtttaagaaaaaaaatacaaattaatgagatatcatctcacatccattgcaatggctattattaaaaagtcaaaaaataatagatggtggtgaggctgtggagcaaaaggaactcttatacactgttggtgagaatgtaatttagttcagccgtcgacg

SEQ ID NO: 686685 - DNA, 210 bp, Homo sapiens
atgcatctgatagtgatagcaactagagtagacacacgatataccacctccgctatcataatcatacgctataccccaacggcgtcaaagtatttagcttgactcgccacactccacggaagcaatactgaaatgatctagctagcagcgctctagagccctaaggatacatcttaactcatacaccgtcaaagctggactagacttggg

SEQ ID NO: 686686 - DNA, 373 bp, Homo sapiens
tcctcatcagtgcccatcctgttgagtatggtctcatatggtcaatagaagtaaagtcttcccgttacgcaggctttatgcatgtataaaacactctcatggcttgttctcaataggcttatgatagtacgactcaggttttgtttcagttcagcgtcacccactcatggtgcttgcaagtacacctggtaatcaaatactgggttgtctcagatactctccaaagtgtacttgttggaataagctggtaagaatcgagtataatacctgtggtccgtcatcattctctcggggtataacagagccatgtttcgcactagcatttcaccccagtgatgtacaatgaacggtgcttaagagagacacagtttat

SEQ ID NO: 686687 - DNA, 634 bp, Homo sapiens
  misc_feature (175)..(175): n is a, c, g, or t
ccccccccaccccccctcccttttgtgtgggcaccagagagtgggggcccgagggttttttttcccacaaaggggggtgaggaacccaggggagagggcaccctcttttctctcccctggtgtggggggccggtgtcttcttttattaaccctttgaagcgggcccgctctgtgntttttccccccccccggggggcgtcccggggtgttagggggggccttttttccccccccctggtttttttttctcttcccccggtgttttgggggggtagggggccccacctttttttcccaacccccccagggggagcccctttttcccctttgtggggggccttcccccctttatttgggtggccccccgggccctttccctcccccttggtttttttggggccaagcccccccccccctttttgggggggttgattggggtttagggggggggtcccccccccccttttaagggcccccccattttttgggcccttttccgggtgggggagcctttttggggcccccagggggtcctcccttggaaattttttgggggggggtcccccggggggtgggccccaaaaccctttaataaggggggttctttacttgggtttatttaacgggggttccc

SEQ ID NO: 686688 - DNA, 476 bp, Homo sapiens
ggcgattgggtaaggatgctgtgcaactccacccatgcatgtgagaccagcagttccctcttccttcccccagtgattctctggaagataaatctctacgctaaggtggataggactccatagtattcagtgacgtgctatatttattttttaaatgaatgtttcttggggcgggcacagcagagtgcatgagccctggagttcgagaccagcctaggcaacatggcaagagcccatgtctataaaaaatacaaaaaattagccaggtgtggaagcacatgcctgtattcccagctacttgggaggctgagatgggagaattgcttgaacccgggagacagaggttgtgagctgtgatcgcacctaggcggcagtgagaccctgtctcaaaacaacaaaaaaaacttccttgctttttattaatttttcactgtaggaagtttttaaaagactcaaagtcatataaaaaaaaaaaa

SEQ ID NO: 686689 - DNA, 131 bp, Homo sapiens
aaataggtcattacagatgtaattaggttattttaaaaaattaggaattagggcaattccagatgtaattagttaaaatgaaggtcatactcggatagggtggcccctcatccataatgactggtgtcctc

SEQ ID NO: 686690 - DNA, 206 bp, Homo sapiens
ctagatcatccgctaaccttcacgccaatggcgcctcaatataacttaatctggcctcttcctacacatcgggacgaggcctataataaacggatcatttctactactccagcaacctgtaacacatcaggcattattcctccgtgcttgcaacctatagcaaccagccttcatagagctactgtacctcccgctgacggccaaaa

SEQ ID NO: 686691 - DNA, 145 bp, Homo sapiens
  misc_feature (33)..(33): n is a, c, g, or t
  misc_feature (62)..(62): n is a, c, g, or t
tccttagtctgggaagctagagacccactaaangaagcaaaacagagactcagcaagggggnaaaagatacaaccaggcaccaagtgctgctggatggactggttctccagggtttgtaccagttgctggagccccgaatgattg

SEQ ID NO: 686692 - DNA, 298 bp, Homo sapiens
atctctagacggatcccctgcagcagacacagcatcaaatttttagatgttatcaaaccattctatgctgttctaccagtaattcagaaaccggacagcggaaaatccagtttagagagaaggttctgtggactgctatgacgctcttcattttcttcgtgtgttgtcagatcccactgtttggaatcatgtcatcagattctgcagatcttttctactgtactagatgtttttctggcttccaatagaggaactttaatggaattgtgtttctcctccattgtaacatctggtctga

SEQ ID NO: 686693 - DNA, 100 bp, Homo sapiens
tatccttatcactctttatttgctgctgtttaagttgccacctcccctcccaataaaaattcacttacacctcctgaccatttgtagttcttggtattca

SEQ ID NO: 686694 - DNA, 304 bp, Homo sapiens
  misc_feature (121)..(122): n is a, c, g, or t
aaggcagggggcctgccagagctgggtgtgggtatttaggccctcacgtgccatgcgagcagggccagaccttgaggaaagggagccccatgctggtctttttggatttaaaatgtttcgnntggcctgttgaactcagttccagtccggtcttgtttttagatccctgttcccatagagagtaggagatggggcccaggagacatgtttggggttccgtgatcatcgcatggcccccacccttcaccccttcgttttgtgcggagcccatgacaagaatctttaaatagaatcctgaactcca

SEQ ID NO: 686695 - DNA, 120 bp, Homo sapiens
aatatctgctaccattaattgcgtgtgagccatcatcacaccagtgcagtccagcctgtgtgcaacaaatgtgaaaccctttctcaaaataaaatacaaatgtgatgtgccatgtgcaat

SEQ ID NO: 686696 - DNA, 1017 bp, Homo sapiens
acagagaggctacttccccttatcatagaacgagcttatcacctattcgatgatcacggccgctcagtaatcattgaccttgatcgggcttcctagatccgtgatatgcccttttcctaagcgactcgatcgagacaaaaggtaagctaatagctaagatcttcagagcgctgccaggaacactcacgagaagctcgtctggatagctagtgccgtgtccgcgcgcactcagtgcactgagtcctcagtacgtgcctcccatcaccgtacgcgatccttaacgataacagacgaggtgaacgatcgctcccttaacatcaaatcgaataggccaccaatggtactgaacctgacgagtacaacgacatacggaggactagagtacgttcaactgcgctacagtatcttgcgcccgcattagtgcctagaaccaggcgagctgggacttcctgtgacgttgacgatcgagtagtactcccgacttgaagcccccattcgtataataagtgacgagtcgacaagcacgtcattgcactcatgagctgtgccgcagattaggcttatacaaacagatgcggattcccggcacgtctaaaccaagacacttgtcagcgctatgacgaccgggggtatactacggtcaatgctctgaaatctgtggagcaaacacagtttcatgcccatcgtcctagaattaattcccctagaaatctttgccctacgggcccgtatgtacgcgtatagaacgccatctacccctctagagcggaaaacatcccagaccatgagacaggaaacaggcagcagaagagctgaaacacaaagagggccgacgacccggaaaatcgagagacacggggcctcgcgaacacgacccatctgaggcccaccgcgaggaagacacgaggagaatgtcacaaggcgccagtacaggagacatgtgcacgcaggaaacgggcacccaaggaagacagacggaaaaaagacggaaaacagacactcggcgcgcgcgaacaa

SEQ ID NO: 686697 - DNA, 1010 bp, Homo sapiens
aagcttggcacgagggacagacgggcaggcggggctgggcgcgggcggcggcggcccggaggagaacgggcggagggcgcgggccgaccgggcgcaccgaccatggcctccaaatgccccaagtgcgacaagaccgtgtacttcgccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatccatgatcccttctgtgtctgcgtgtccgaatccccgtgtgaccctgtcccagcattttcccgccgaccctgcgtgtccccgtggcgctgtccgctctccctctcctgctgcccacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgcaaaaaaaaaaaaatttc

SEQ ID NO: 686698 - DNA, 873 bp, Homo sapiens
aagcttggcacgagggacagacgggcaggcggggctgggcgcgggcggcggcggcccggaggagaacgggcggagggcgcgggccgaccgggcgcaccgaccatggcctccaaatgccccaagtgcgacaagaccgtgtacttcgccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgcaaaaaaaaaaaaatttc

SEQ ID NO: 686699 - DNA, 358 bp, Homo sapiens
  misc_feature (171)..(171): n is a, c, g, or t
  misc_feature (188)..(188): n is a, c, g, or t
  misc_feature (264)..(264): n is a, c, g, or t
  misc_feature (301)..(301): n is a, c, g, or t
  misc_feature (355)..(355): n is a, c, g, or t
agaggtgatctagaggatcccgggacgagcatcgttacagaatccacttcagaatcccttctcgcgggtccctcctttttctcacctcccccaaatccaggatttcccggatcttttctatttctcgggcctaggtgtcccggtggcagtcatgaagggcccatggcctcngacactatagtgagacngagggtgggcatgttcttacggtgtattggtaggagaaagctttaaatccttctcttggttaagagtggaccatcngcaagacaaacggtcatctccacgatttggcggtgtnattatgcttaccgagtttccatctctttattttaccagatggttttaatctcanggg

SEQ ID NO: 686700 - DNA, 406 bp, Homo sapiens
gcgcacccataatactacgcacagctcacaccagtgtctccccccaacaggattcacgcgctgacggctactcctctacccgatagcgcactaatctctgcaccatgccacgcaggtgccaccggacgattccacctccacaatctacttccatttcagatactcactccaccgaccccgactctatcaggtcctgtcctcagatcccccccgcaccttactaataccacttccatattccgccctaccaggacgaaagtaccccctaatccatcttcccccggggtaagattaattcccgtatccccggactacactttccttctagattcccggtccactcccgccccctcctacgcctctcacttaaggtaagagctgctatagatgtggctgcgctgctacg

SEQ ID NO: 686701 - DNA, 1565 bp, Homo sapiens
  misc_feature (996)..(996): n is a, c, g, or t
aagcttggcacgagggacagacgggcaggcggggctgggcgcgggcggcggcggcccggaggagaacgggcggagggcgcgggccgaccgggcgcaccgaccatggcctccaaatgccccaagtgcgacaagaccgtgtacttcgccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtcatgatgtgggctcacctgcgccccagaccctgcaggggcccccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgtccgaatccccgtgtgaccctgtcccagcattttaaggcgtgaacatcgggggcgcggnctctacatctacgagaaaggcccctggcggagggggcccggcaaggtccaccgggcccccattcggaggtcccccggcgggcccgagggcagaagggaagccgggaaaaggggcgaaagcggggcccccccggaagggggccccaggccagaaggcccttcccaggtgttcaccaccaacttttcaccggggggaaggccctcaaacaaggtttgccccggggccttggaagcacagaaagcgtggttcacttcccggttgaacacacgggatgaaccgtccctctatgggggccaggggatcttggcggcccgtggtcctggggcattggggcttgttgcgatggcccgccctttgcgcgcggcaaggagacacctgtgagtcccccccggggggcggccctcccccgtgagagcggggccctctcctttccccgccgggtgggttttacacccccggggttgcgtgggtggggcacgtctcacctcttttttatgacccgggggaacccccctatgggcaccggggtctagcccccccttagggtcttaaccgggggggtccccctt

SEQ ID NO: 686702 - DNA, 3081 bp, Homo sapiens
gagcggggggcccggaagtggtccctgtagaaccactgtggcaccgctactccgtgccgcgcccgtcgagcattgcgttgctgcattgcgccccaccgactccactatgttgaagaaattcgacaagaaggatgaggagtcaggtggaggctccaacccattccagcaccttgagaagagtgcggtactccaggaggcccgtgtatttaatgaaactcccatcaaccctcggaaatgtgcccacatcctcaccaagattctttatctcataaaccagggggagcacctggggaccacggaagcgaccgaggccttctttgccatgaccaagctctttcagtccaatgatcccacactccgtcggatgtgctacttgaccatcaaggagatgtcttgcattgcagaggatgtcatcattgtcaccagcagcctaacaaaagacatgactgggaaagaagacaactaccggggcccggccgtgcgagccctctgccagatcactgatagcaccatgctgcaggctattgagcgctacatgaaacaagccattgtggacaaggtgcccagtgtctccagctctgccctcgtgtcttccttgcacctgctgaagtgcagctttgacgtggtcaagcgctgggtgaatgaggctcaggaggcagcatccagtgataacatcatggtccagtaccacgcactagggctcctgtaccatgtgcgtaagaatgaccgcctagccgtcaataagatgatcagcaaggtcacacggcatggccttaagtctccctttgcctactgcatgatgatccgggtggccagcaagcagctggaagaggaggatggcagccgtgacagcccactgtttgacttcatcgagagctgcttgcgcaacaagcacgagatggtggtgtatgaagccgcctcggccatcgtcaatctgccaggctgcagtgccaaagagctggccccggctgtgtcagtgctccagcttttctgcagctcacccaaggctgctctccgctatgctgctgttcgtaccctcaataaggttgccatgaagcatccgtcagctgtgacagcttgtaatctggatctggagaacctggtcacagattcaaaccgcagcattgccacgctggccatcaccaccctccttaagacgggcagcgagagcagcatcgaccgcctcatgaagcagatctcctccttcatgtcagaaatctcggatgaattcaaggtggtggttgtccaggccatcagtgccctgtgtcagaaatatcctcgcaaacacgccgtccttatgaacttcctgttcaccatgctgcgggaagagggtggctttgagtataagcgcgctatcgtggactgcatcatcagcatcattgaagagaactcagagagcaaggagacagggctgtcacatctgtgcgagttcatcgaggactgcgagttcacagtgctggccacccgtattctacatctcctgggccaggaggggcccaagaccaccaatccctcaaagtacatccgcttcatctataaccgagtggtcttggagcatgaggaggtccgggcaggtgctgtgagtgctctggcgaagtttggagcccagaatgaagagatgttacccagtatcttggtgttgctgaagaggtgtgtgatggatgatgacaatgaagtaagggaccgagccaccttctacctaaatgtcctggagcagaagcagaaggcccttaatgcaggctatatcctaaatggtctgactgtgtccatccctggtctggagagggctctgcagcagtacactctagaaccatcagaaaaaccttttgacctcaagtctgtgcccctggccacggcgcccatggcagagcagagaacagaaagtacccccatcacagcagtcaaacagcctgagaaagtggcagctaccaggcaggagatcttccaggagcagttggcagcagtgccagagttccgcggtcttgggcccctcttcaagtcctcgcctgagcccgtggccctcaccgagtcagagacggagtatgtcatccgctgcaccaaacacaccttcaccaaccacatggtttttcagtttgactgcacaaacacactcaatgaccagaccttggagaatgtcacagtgcagatggagcccactgaggcctatgaggtgctctgttacgtgcctgcccggagcctgccctacaaccagcccgggacctgctacacactggtggcactgcccaaagaagaccccacagctgtggcctgcacattcagctgcatgatgaagttcactgtcaaggactgtgatcccaccactggggagactgatgacgaaggctatgaggatgagtatgtgctggaagatctggaagttactgtagctgatcacattcaaaaggtcatgaaactgaacttcgaagcagcctgggatgaggtaggggatgaatttgagaaggaggaaacgttcaccttgtctaccatcaagacacttgaagaggctgtgggtaatattgtgaagttcttgggaatgcacccttgtgagaggtcagacaaagtgccggataacaagaacacccacacgttgctcctggctggtgtgttccggggtggtcatgacatcctggtgcgctcccggctgctgcttttggacacagtgacaatgcaggtgacagccagaagtttggaggagctgccagtagacatcatcttggcatctgtgggataagaggccagcctgcataggacctcatacccttccccaacactacctggaagttgtgccttcctcatgaaactggcagaaaccccttcccaagcttctgtattgaaaaacaattaggaatcattgcagatttttttttattctgctcccacctcccacccgggactacttgctggtgacttttttttttttttttttttaaataggggatgattttagcttgtcctaaatcttgctgtccacccttccaggaaagggacattgtaaatgaataaaacattctcaactcctcttgaatctatcccccaagaaaccatcttatccctgtaataaatcagcatgtatttattgaa

SEQ ID NO: 686703 - DNA, 785 bp, Homo sapiens
aagcttggcacgagggacagacgggcaggcggggctgggcgcgggcggcggcggcccggaggagaacgggcggagggcgcgggccgaccgggcgcaccgaccatggcctccaaatgccccaagtgcgacaagaccgtgtacttcgccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctaggctacagcggctctcatgatgtgggctcagcggttggtgcgggtacgcgagctcga

SEQ ID NO: 686704 - DNA, 759 bp, Homo sapiens
gagcggggggcccggaagtggtccctgtagaaccactgtggcaccgctactccgtgccgcgcccgtcgagcattgcgttgctgcattgcgccccaccgactccactatgttgaagaaattcgacaagaaggatgaggagtcaggtggaggctccaacccattccagcaccttgagaagagtgcggtactccaggaggcccgtgtatttaatgaaactcccatcaaccctcggaaatgtgcccacatcctcaccaagattctttatctcataaaccagggggagcacctggggaccacggaagcgaccgaggccttctttgccatgaccaagctctttcagtccaatgatgtaagtgcctcaacccagctttccttgagaggtggcagctgtaacaaggtggtgggagggccaaagagagccggcccaccagtcagtgtgggctgcctttgtggagacaggaggtatcttctcccaactctggcccttggtgagcccgggctgatagggcttttcccacctatttcccagcccacactccgtcggatgtgctacttgaccatcaaggagatgtcttgcattgcagaggatgtcatcattgtcaccagcaggcagtccatgggggtgtggggtggctccttctgatgggttcccttgacgacccattttcctttgtgtgttccccgcacagtgagacttggttgcttttggcaggtggcacccggggaagtcccggtcaggcccacccgggctccaggtgg

SEQ ID NO: 686705 - DNA, 820 bp, Homo sapiens
aagcttggcacgagggacagacgggcaggcggggctgggcgcgggcggcggcggcccggaggagaacgggcggagggcgcgggccgaccgggcgcaccgaccatggcctccaaatgccccaagtgcgacaagaccgtgtacttcgccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagcacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgcaaaaaaaaaaaaatttc

SEQ ID NO: 686706 - DNA, 237 bp, Homo sapiens
taccattgccgttcaacaagccgtgggtactcccgcccgtatcctgcgaagatccttcttgatgcagatgatcgtcacgattctgccagctcagacgatgtcactggtggttggagttctggctggctgggcgatcaatgccgcgatcggatcgaccgacgcgaagcaatccttcgatcctactattgcggtgctgcccgttgctatgtgggtggtcagtgtgcttgccattatggt

SEQ ID NO: 686707 - DNA, 277 bp, Homo sapiens
ggaggctgaggtggtaggatcacttgagcccaggaggttcaggctgcaatgagccatgatggcaccgggaactccagtctaggtggcaaatcaagaccttatctcaaaaataaaaatttggctgagtgcagtggctcacgcgtgtaatcccagcacttgtgggaggccaaggtgggcagatcacgtgacatcaggagtggggagaacagcctggcgatatggagaaaccccgtgtctactaaatatacacaaattagccgggcatggtggtgcgtgc

SEQ ID NO: 686708 - DNA, 3572 bp, Homo sapiens
gagcggggggcccggaagtggtccctgtagaaccactgtggcaccgctactccgtgccgcgcccgtcgagcattgcgttgctgcattgcgccccaccgactccactatgttgaagaaattcgacaagaaggatgaggagtcaggtggaggctccaacccattccagcaccttgagaagagtgcggtactccaggaggcccgtgtatttaatgaaactcccatcaaccctcggaaatgtgcccacatcctcaccaagattctttatctcataaaccagggggagcacctggggaccacggaagcgaccgaggccttctttgccatgaccaagctctttcagtccaatgatcccacactccgtcggatgtgctacttgaccatcaaggagatgtcttgcattgcagaggatgtcatcattgtcaccagcagcctaacaaaagacatgactgggaaagaagacaactaccggggcccggccgtgcgagccctctgccagatcactgatagcaccatgctgcaggctattgagcgctacatgaaacaagccattgtggacaaggtgcccagtgtctccagctctgccctcgtgtcttccttgcacctgctgaagtgcagctttgacgtggtcaagcgctgggtgaatgaggctcaggaggcagcatccagtgataacatcatggtccagtaccacgcactagggctcctgtaccatgtgcgtaagaatgaccgcctagccgtcaataagatgatcagcaaggtcacacggcatggccttaagtctccctttgcctactgcatgatgatccgggtggccagcaagcagctggaagaggaggatggcagccgtgacagcccactgtttgacttcatcgagagctgcttgcgcaacaagcacgagatggtggtgtatgaagccgcctcggccatcgtcaatctgccaggctgcagtgccaaagagctggccccggctgtgtcagtgctccagcttttctgcagctcacccaaggctgctctccgctatgctgctgttcgtaccctcaataaggttgccatgaagcatccgtcagctgtgacagcttgtaatctggatctggagaacctggtcacagattcaaaccgcagcattgccacgctggccatcaccaccctccttaagacgggcagcgagagcagcatcgaccgcctcatgaagcagatctcctccttcatgtcagaaatctcggatgaattcaaggtggtggttgtccaggccatcagtgccctgtgtcagaaatatcctcgcaaacacgccgtccttatgaacttcctgttcaccatgctgcgggaagagggtggctttgagtataagcgcgctatcgtggactgcatcatcagcatcattgaagagaactcagagagcaaggagacagggctgtcacatctgtgcgagttcatcgaggactgcgagttcacagtgctggccacccgtattctacatctcctgggccaggaggggcccaagaccaccaatccctcaaagtacatccgcttcatctataaccgagtggtcttggagcatgaggaggtccgggcaggtgctgtgagtgctctggcgaagtttggagcccagaatgaagagatgttacccagtatcttggtgttgctgaagaggtgtgtgatggatgatgacaatgaagtaagggaccgagccaccttctacctaaatgtcctggagcagaagcagaaggcccttaatgcaggctatatcctaaatggtctgactgtgtccatccctggtctggagagggctctgcagcagtacactctagaaccatcagaaaaaccttttgacctcaagtctgtgcccctggccacggcgcccatggcagagcagagaacagaaagtacccccatcacagcagtcaaacagcctgagaaagtggcagctaccaggcaggagatcttccaggagcagttggcagcagtgccagagttccgcggtcttgggcccctcttcaagtcctcgcctgagcccgtggccctcaccgagtcagagacggagtatgtcatccgctgcaccaaacacaccttcaccaaccacatggtttttcagtttgactgcacaaacacactcaatgaccagaccttggagaatgtcacagtgcagatggagcccactgaggcctatgaggtgctctgttacgtgcctgcccggagcctgccctacaaccagcccgggacctgctacacactggtggcactgcccaaagaagaccccacagctgtggcctgcacattcagctgcatgatgaagttcactgtcaaggactgtgatcccaccactggggagactgatgacgaaggctatgaggatgagtatgtgctggaagatctggaagttactgtagctgatcacattcaaaaggtcatgaaactgaacttcgaagcagcctgggatgaggtaggggatgaatttgagaaggaggaaacgttcaccttgtctaccatcaagacacttgaagaggctgtgggtaatattgtgaagttcttgggaatgcacccttgtgagaggtcagacaaagtgccggataacaagaacacccacacgttgctcctggctggtgtgttccggggtggtcatgacatcctggtgcgctcccggctgctgcttttggacacagtgacaatgcaggtgacagccagaagtttggaggagctgccagtagacatcatcttggcatctgtgggataagaggccagcctgcataggacctcatacccttccccaacactacctggaagttgtgccttcctcatgaaactggcagaaaccccttcccaagcttctgtattgaaaaacaattaggaatcattgcagatttttttttattctgctcccacctcccacccgggactacttgctggtgacttttttttttttttttttttaaataggggatgattttagcttgtcctaaatcttgctgtccacccttccaggaaagggacattgtaaatgaataaaacattctcaactcctcttgaatctatcccccaagaaaccatcttatccctgtaataaatcagcatgtatttattgaaaaaaaaaaaacaaaaaaacaaaaaaaaaaaaaacaaaaacacacaaaaaaaaaaaacaacaaaagcgatcgcccacacaaaaaaccaccccgcggccaaccaaaatcaaccccccccaggtatatttaaaggaaaaaaggagggcacccaccaacaaggaccaggggaaaacaaaataaagagagatagaaacgggccccgcgtaaacagacacgtggcgtgagcagccggaaaccgatatcaaggacgggtgactctcggaggaagagcacctccaacgccgggggagcacgaaaagcggtccccagccgccacgagagagccaaagtcgccgacgagacacactctacacgtccgcaggatatcggtggacacaccacagcggtctgacgggagcgaccgtgcacatcccgcaacacgggtagataaggacaaatattaacgccggcccaggcgaatcataagagcagccgcggcactcgccccagccg

SEQ ID NO: 686709 - DNA, 642 bp, Homo sapiens
aagcttggcacgagggacagacgggcaggcggggctgggcgcgggcggcggcggcccggaggagaacgggcggagggcgcgggccgaccgggcgcaccgaccatggcctccaaatgccccaagtgcgacaagaccgtgtacttcgccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgccaagcgctcgccaccctcacgtggctcacctgctgttgagccttgtgctgtcaataaacggtttgaggattgcaaaaaaaaaaaaatttc

SEQ ID NO: 686710 - DNA, 486 bp, Homo sapiens
  misc_feature (27)..(27): n is a, c, g, or t
tttaccatgctggacaggcagtaaatngaacaaaatcctttccctaatggagcttacctttatggtagaggtcacaggtttagtttttcccccagatagccatatgactagttcctaattttttcaggtctttactccaaaatcatttttctcttttaggaccttttttgccagcccatctaaagttacaaacagactcttctcctgacctcttattcatcttcctagctttatctttttaccttagtactcatgctgtctattatactaaatgtgtgtctacctgatgcttaacagttactcaaaaatatttgttaaataatgagtgaagtatatatttctagttagtaataactgttctccagacagataaagaaagactttgaatggactccatccatgtagtgtgaaccaaaatttgtgctccaatttttatcagtttcctaggtttcatcctttgatgaaataaaaaatatgtgtattaaa

SEQ ID NO: 686711 - DNA, 3027 bp, Homo sapiens
gagcggggggcccggaagtggtccctgtagaaccactgtggcaccgctactccgtgccgcgcccgtcgagcattgcgttgctgcattgcgccccaccgactccactatgttgaagaaattcgacaagaaggatgaggagtcaggtggaggctccaacccattccagcaccttgagaagagtgcggtactccaggaggcccgtgtatttaatgaaactcccatcaaccctcggaaatgtgcccacatcctcaccaagattctttatctcataaaccagggggagcacctggggaccacggaagcgaccgaggccttctttgccatgaccaagctctttcagtccaatgatcccacactccgtcggatgtgctacttgaccatcaaggagatgtcttgcattgcagaggatgtcatcattgtcaccagcagcctaacaaaagacatgactgggaaagaagacaactaccggggcccggccgtgcgagccctctgccagatcactgatagcaccatgctgcaggctattgagcgctacatgaaacaagccattgtggacaaggtgcccagtgtctccagctctgccctcgtgtcttccttgcacctgctgaagtgcagctttgacgtggtcaagcgctgggtgaatgaggctcaggaggcagcatccagtgataacatcatggtccagtaccacgcactagggctcctgtaccatgtgcgtaagaatgaccgcctagccgtcaataagatgatcagcaaggtcacacggcatggccttaagtctccctttgcctactgcatgatgatccgggtggccagcaagcagctggaagaggaggatggcagccgtgacagcccactgtttgacttcatcgagagctgcttgcgcaacaagcacgagatggtggtgtatgaagccgcctcggccatcgtcaatctgccaggctgcagtgccaaagagctggccccggctgtgtcagtgctccagcttttctgcagctcacccaaggctgctctccgctatgctgctgttcgtaccctcaataaggttgccatgaagcatccgtcagctgtgacagcttgtaatctggatctggagaacctggtcacagattcaaaccgcagcattgccacgctggccatcaccaccctccttaagacgggcagcgagagcagcatcgaccgcctcatgaagcagatctcctccttcatgtcagaaatctcggatgaattcaaggtggtggttgtccaggccatcagtgccctgtgtcagaaatatcctcgcaaacacgccgtccttatgaacttcctgttcaccatgctgcgggaagagggtggctttgagtataagcgcgctatcgtggactgcatcatcagcatcattgaagagaactcagagagcaaggagacagggctgtcacatctgtgcgagttcatcgaggactgcgagttcacagtgctggccacccgtattctacatctcctgggccaggaggggcccaagaccaccaatccctcaaagtacatccgcttcatctataaccgagtggtcttggagcatgaggaggtccgggcaggtgctgtgagtgctctggcgaagtttggagcccagaatgaagagatgttacccagtatcttggtgttgctgaagaggtgtgtgatggatgatgacaatgaagtaagggaccgagccaccttctacctaaatgtcctggagcagaagcagaaggcccttaatgcaggctatatcctaaatggtctgactgtgtccatccctggtctggagagggctctgcagcagtacactctagaaccatcagagagaacagaaagtacccccatcacagcagtcaaacagcctgagaaagtggcagctaccaggcaggagatcttccaggagcagttggcagcagtgccagagttccgcggtcttgggcccctcttcaagtcctcgcctgagcccgtggccctcaccgagtcagagacggagtatgtcatccgctgcaccaaacacaccttcaccaaccacatggtttttcagtttgactgcacaaacacactcaatgaccagaccttggagaatgtcacagtgcagatggagcccactgaggcctatgaggtgctctgttacgtgcctgcccggagcctgccctacaaccagcccgggacctgctacacactggtggcactgcccaaagaagaccccacagctgtggcctgcacattcagctgcatgatgaagttcactgtcaaggactgtgatcccaccactggggagactgatgacgaaggctatgaggatgagtatgtgctggaagatctggaagttactgtagctgatcacattcaaaaggtcatgaaactgaacttcgaagcagcctgggatgaggtaggggatgaatttgagaaggaggaaacgttcaccttgtctaccatcaagacacttgaagaggctgtgggtaatattgtgaagttcttgggaatgcacccttgtgagaggtcagacaaagtgccggataacaagaacacccacacgttgctcctggctggtgtgttccggggtggtcatgacatcctggtgcgctcccggctgctgcttttggacacagtgacaatgcaggtgacagccagaagtttggaggagctgccagtagacatcatcttggcatctgtgggataagaggccagcctgcataggacctcatacccttccccaacactacctggaagttgtgccttcctcatgaaactggcagaaaccccttcccaagcttctgtattgaaaaacaattaggaatcattgcagatttttttttattctgctcccacctcccacccgggactacttgctggtgacttttttttttttttttttttaaataggggatgattttagcttgtcctaaatcttgctgtccacccttccaggaaagggacattgtaaatgaataaaacattctcaactcctcttgaatctatcccccaagaaaccatcttatccctgtaataaatcagcatgtatttattgaa

SEQ ID NO: 686712 - DNA, 438 bp, Homo sapiens
aagcttggcacgagggacagacgggcaggcggggctgggcgcgggcggcggcggcccggaggagaacgggcggagggcgcgggccgaccgggcgcaccgaccatggcctccaaatgccccaagtgcgacaagaccgtgtacttcgccgagaaggtgagctccctggggaaggactggcacaagttctgcctcaagtgcgccgtggcgctgtccgctctccctctcctgctgcccacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgcaaaaaaaaaaaaatttc

SEQ ID NO: 686713 - DNA, 3371 bp, Homo sapiens
gagcggggggcccggaagtggtccctgtagaaccactgtggcaccgctactccgtgccgcgcccgtcgagcattgcgttgctgcattgcgccccaccgactccactatgttgaagaaattcgacaagaaggatgaggagtcaggtggaggctccaacccattccagcaccttgagaagagtgcggtactccaggaggcccgtgtatttaatgaaactcccatcaaccctcggaaatgtgcccacatcctcaccaagattctttatctcataaaccagggggagcacctggggaccacggaagcgaccgaggccttctttgccatgaccaagctctttcagtccaatgatcccacactccgtcggatgtgctacttgaccatcaaggagatgtcttgcattgcagaggatgtcatcattgtcaccagcagcctaacaaaagacatgactgggaaagaagacaactaccggggcccggccgtgcgagccctctgccagatcactgatagcaccatgctgcaggctattgagcgctacatgaaacaagccattgtggacaaggtgcccagtgtctccagctctgccctcgtgtcttccttgcacctgctgaagtgcagctttgacgtggtcaagcgctgggtgaatgaggctcaggaggcagcatccagtgataacatcatggtccagtaccacgcactagggctcctgtaccatgtgcgtaagaatgaccgcctagccgtcaataagatgatcagcaaggtcacacggcatggccttaagtctccctttgcctactgcatgatgatccgggtggccagcaagcagctggaagaggaggatggcagccgtgacagcccactgtttgacttcatcgagagctgcttgcgcaacaagcacgagatggtggtgtatgaagccgcctcggccatcgtcaatctgccaggctgcagtgccaaagagctggccccggctgtgtcagtgctccagcttttctgcagctcacccaaggctgctctccgctatgctgctgttcgtaccctcaataaggttgccatgaagcatccgtcagctgtgacagcttgtaatctggatctggagaacctggtcacagattcaaaccgcagcattgccacgctggccatcaccaccctccttaagacgggcagcgagagcagcatcgaccgcctcatgaagcagatctcctccttcatgtcagaaatctcggatgaattcaaggtggtggttgtccaggccatcagtgccctgtgtcagaaatatcctcgcaaacacgccgtccttatgaacttcctgttcaccatgctgcgggaagagggtggctttgagtataagcgcgctatcgtggactgcatcatcagcatcattgaagagaactcagagagcaaggagacagggctgtcacatctgtgcgagttcatcgaggactgcgagttcacagtgctggccacccgtattctacatctcctgggccaggaggggcccaagaccaccaatccctcaaagtacatccgcttcatctataaccgagtggtcttggagcatgaggaggtccgggcaggtgctgtgagtgctctggcgaagtttggagcccagaatgaagagatgttacccagtatcttggtgttgctgaagaggtgtgtgatggatgatgacaatgaagtaagggaccgagccaccttctacctaaatgtcctggagcagaagcagaaggcccttaatgcaggctatatcctaaatggtctgactgtgtccatccctggtctggagagggctctgcagcagtacactctagaaccatcagaaaaaccttttgacctcaagtctgtgcccctggccacggcgcccatggcagagcagagaacagaaagtacccccatcacagcagtcaaacagcctgagaaagtggcagctaccaggcaggagatcttccaggagcagttggcagcagtgccagagttccgcggtcttgggcccctcttcaagtcctcgcctgagcccgtggccctcaccgagtcagagacggagtatgtcatccgctgcaccaaacacaccttcaccaaccacatggtttttcagtttgactgcacaaacacactcaatgaccagaccttggagaatgtcacagtgcagatggagcccactgaggcctatgaggtgctctgttacgtgcctgcccggagcctgccctacaaccagcccgggacctgctacacactggtggcactgcccaaagaagaccccacagctgtggcctgcacattcagctgcatgatgaagttcactgtcaaggactgtgatcccaccactggggagactgatgacgaaggctatgaggatgagtatgtgctggaagatctggaagttactgtagctgatcacattcaaaaggtcatgaaactgaacttcgaagcagcctgggatgaggtaggggatgaatttgagaaggaggaaacgttcaccttgtctaccatcaagacacttgaagaggctgtgggtaatattgtgaagttcttgggaatgcacccttgtgagaggtcagacaaagtgccggataacaagaacacccacacgttgctcctggctggtgtgttccggggtggtcatgacatcctggtgcgctcccggctgctgcttttggacacagtgacaatgcaggtgacagccagaagtttggaggagctgccagtagacatcatcttggcatctgtgggataagaggccagcctgcataggacctcatacccttccccaacactacctggaagttgtgccttcctcatgaaactggcagaaaccccttcccaagcttctgtattgaaaaacaattaggaatcattgcagatttttttttattctgctcccacctcccacccgggactacttgctggtgacttttttttttttttttttttaaataggggatgattttagcttgtcctaaatcttgctgtccacccttccaggaaagggacattgtaaatgaataaaacattctcaactcctcttgaatctatcccccaagaaaccatcttatccctgtaataaatcagcatgtatttattgaatgattgctacttctgcagactcatgcttcagggctccaccttccccttcaaggcctcccctaaagaggcagaacacctgccctgtcccccttgcacccacagccctttggctgttgtagtcctgtgaggcaggaccctctccccgtcatcgctgtcccagcaccaagcccaggggtgggagcggtagagggtggttgagtgaatcagctaacaggcagagttcacactccctcccgttcgtgcttcttcacaacgcatcctcctttgatagtcgataaatggaggctcca

SEQ ID NO: 686714 - DNA, 662 bp, Homo sapiens
aagcttggcacgagggacagacgggcaggcggggctgggcgcgggcggcggcggcccggaggagaacgggcggagggcgcgggccgaccgggcgcaccgaccatggcctccaaatgccccaagtgcgacaagaccgtgtacttcgccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggtgagctccggctgccctcggcctgccctgggacctgctgggaggggcgtggcgctggcgctggggagggctgggggtcccggccgccgtggatccccgcccagagtccctgccaccctggaaagcctagtgccccccagtccccagcgggccgttttctgagatgcccggtggccgcggctgataacaggaagagtgacacataagacaccataggcaacacggcgtagacgaggacaaagaagacgaaggataacaatccgagaaacactaaatcacagctcccacaccgctgcactgaccgttaacaaaacgatgcaagagcaacaaagaaccgagaaccctagagacgaccaaccacaag

SEQ ID NO: 686715 - DNA, 4194 bp, Homo sapiens
gagcggggggcccggaagtggtccctgtagaaccactgtggcaccgctactccgtgccgcgcccgtcgagcattgcgttgctgcattgcgccccaccgactccactatgttgaagaaattcgacaagaaggatgaggagtcaggtggaggctccaacccattccagcaccttgagaagagtgcggtactccaggaggcccgtgtatttaatgaaactcccatcaaccctcggaaatgtgcccacatcctcaccaagattctttatctcataaaccagggggagcacctggggaccacggaagcgaccgaggccttctttgccatgaccaagctctttcagtccaatgatcccacactccgtcggatgtgctacttgaccatcaaggagatgtcttgcattgcagaggatgtcatcattgtcaccagcagcctaacaaaagacatgactgggaaagaagacaactaccggggcccggccgtgcgagccctctgccagatcactgatagcaccatgctgcaggctattgagcgctacatgaaacaagccattgtggacaaggtgcccagtgtctccagctctgccctcgtgtcttccttgcacctgctgaagtgcagctttgacgtggtcaagcgctgggtgaatgaggctcaggaggcagcatccagtgataacatcatggtccagtaccacgcactagggctcctgtaccatgtgcgtaagaatgaccgcctagccgtcaataagatgatcagcaaggtcacacggcatggccttaagtctccctttgcctactgcatgatgatccgggtggccagcaagcagctggaagaggaggatggcagccgtgacagcccactgtttgacttcatcgagagctgcttgcgcaacaagcacgagatggtggtgtatgaagccgcctcggccatcgtcaatctgccaggctgcagtgccaaagagctggccccggctgtgtcagtgctccagcttttctgcagctcacccaaggctgctctccgctatgctgctgttcgtaccctcaataaggttgccatgaagcatccgtcagctgtgacagcttgtaatctggatctggagaacctggtcacagattcaaaccgcagcattgccacgctggccatcaccaccctccttaagacgggcagcgagagcagcatcgaccgcctcatgaagcagatctcctccttcatgtcagaaatctcggatgaattcaaggtggtggttgtccaggccatcagtgccctgtgtcagaaatatcctcgcaaacacgccgtccttatgaacttcctgttcaccatgctgcgggaagagggtggctttgagtataagcgcgctatcgtggactgcatcatcagcatcattgaagagaactcagagagcaaggagacagggctgtcacatctgtgcgagttcatcgaggactgcgagttcacagtgctggccacccgtattctacatctcctgggccaggaggggcccaagaccaccaatccctcaaagtacatccgcttcatctataaccgagtggtcttggagcatgaggaggtccgggcaggtgctgtgagtgctctggcgaagtttggagcccagaatgaagagatgttacccagtatcttggtgttgctgaagaggtgtgtgatggatgatgacaatgaagtaagggaccgagccaccttctacctaaatgtcctggagcagaagcagaaggcccttaatgcaggctatatcctaaatggtctgactgtgtccatccctggtctggagagggctctgcagcagtacactctagaaccatcagaaaaaccttttgacctcaagtctgtgcccctggccacggcgcccatggcagagcagagaacagaaagtacccccatcacagcagtcaaacagcctgagaaagtggcagctaccaggcaggagatcttccaggagcagttggcagcagtgccagagttccgcggtcttgggcccctcttcaagtcctcgcctgagcccgtggccctcaccgagtcagagacggagtatgtcatccgctgcaccaaacacaccttcaccaaccacatggtttttcagtttgactgcacaaacacactcaatgaccagaccttggagaatgtcacagtgcagatggagcccactgaggcctatgaggtgctctgttacgtgcctgcccggagcctgccctacaaccagcccgggacctgctacacactggtggcactgcccaaagaagaccccacagctgtggcctgcacattcagctgcatgatgaagttcactgtcaaggactgtgatcccaccactggggagactgatgacgaaggctatgaggatgagtatgtgctggaagatctggaagttactgtagctgatcacattcaaaaggtcatgaaactgaacttcgaagcagcctgggatgaggtaggggatgaatttgagaaggaggaaacgttcaccttgtctaccatcaagacacttgaagaggctgtgggtaatattgtgaagttcttgggaatgcacccttgtgagaggtcagacaaagtgccggataacaagaacacccacacgttgctcctggctggtgtgttccggggtggtcatgacatcctggtgcgctcccggctgctgcttttggacacagtgacaatgcaggtgacagccagaagtttggaggagctgccagtagacatcatcttggcatctgtgggataagaggccagcctgcataggacctcatacccttccccaacactacctggaagttgtgccttcctcatgaaactggcagaaaccccttcccaagcttctgtattgaaaaacaattaggaatcattgcagatttttttttattctgctcccacctcccacccgggactacttgctggtgacttttttttttttttttttttaaataggggatgattttagcttgtcctaaatcttgctgtccacccttccaggaaagggacattgtaaatgaataaaacattctcaactcctcttgaaaaaaaaaaaaaaaaaaaaaaaaaaaaaaaaaaaaaaaaaaaaaaaaaaaaaaaaaaaaaaaaaaacagagggccggccggccgtcatacaaacttcactccccccgcgcggcgccacccaactaaccgccgcccaccacatgctagtcttattgagagcagacgggcgcgcccccactagtacgcggaggcctactaccatctaacccagagcacgcgcacgcgtgcgcgccgcgatcttaaaaacagcgttaggcagcgcgacgggcaacaacaccgctcggctgcgccgagagcatcatcctgacgcgaagcgcacccccaaactatcctccgggtgctggaacaaacaacgaggcgcgcacaccgtacactacccgacaagcaattctcagcgccactaaggagcgaccaacaacacacaacccacacacgcgacaccgacccgccggcaacaaccaccacccacccacatatcactggcgccgcgcgcgcaagacacagcctacgcccctaccgcggagagcataattcggaacagacacatatacatatcacccacgccggacagccaccacaagacacaaccgccggcaccgcacacaacaccacaaccaccgacaccacaacacccagacacccaacacgcagcccacgaccacaccacagcactacccacaccacacgcccacgcccgagctgcatcgagagcgagcgctcagcacgtgcaagtacagtcgaaccgcggacagatcgagcgacaagagagcgaggcacgcagactcgcacggcacgagcgcaaagcagagacgcagcgcacaagaccacggcaacgacctgaaccacgacgcagagcacgaaacgcaaaagaacaagccaagccagaagacacaaccataagacggcgagcgaagaagcgaacggccacacagacgacggctggcgcgaccgagatgagagacacgagcagaggacgacacacgcacgagtcgacggcgcaccctcctcgccagagcccagaacacggaaggccgatggtcacgaagctgcaccgcacagcgaccgagcgacgatccgctccagagtgaggatacgtcgaggagacgaccagcaagcgaagacaacgcaggactgaaacgcagggaaagaccacagccagcgatgcgcatc

SEQ ID NO: 686716 - DNA, 204 bp, Homo sapiens
ctgggaatctcctcctcctggctcaagaatccttcactcagtctcctgagtagctggaaccacaagcacgtgcaccagggtgtgtgtgtgtgtgtgtgtgtgtgtgtgtgtgtgtgtgtgtgtccgtgtgtgtatcaggggttgcaatttctaaagtgagtgaacatgagatgtgaagagacctcaggaggaggaggaatgcgg

SEQ ID NO: 686717 - DNA, 2749 bp, Homo sapiens
gagcggggggcccggaagtggtccctgtagaaccactgtggcaccgctactccgtgccgcgcccgtcgagcattgcgttgctgcattgcgccccaccgactccactatgttgaagaaattcgacaagaaggatgaggagtcaggtggaggctccaacccattccagcaccttgagaagagtgcggtactccaggaggcccgtgtatttaatgaaactcccatcaaccctcggaaatgtgcccacatcctcaccaagattctttatctcataaaccagggggagcacctggggaccacggaagcgaccgaggccttctttgccatgaccaagctctttcagtccaatgatcccacactccgtcggatgtgctacttgaccatcaaggagatgtcttgcattgcagaggatgtcatcattgtcaccagcagcctaacaaaagacatgactgggaaagaagacaactaccggggcccggccgtgcgagccctctgccagatcactgatagcaccatgctgcaggctattgagcgctacatgaaacaagccattgtggacaaggtgcccagtgtctccagctctgccctcgtgtcttccttgcacctgctgaagtgcagctttgacgtggtcaagcgctgggtgaatgaggctcaggaggcagcatccagtgataacatcatggtccagtaccacgcactagggctcctgtaccatgtgcgtaagaatgaccgcctagccgtcaataagatgatcagcaaggtcacacggcatggccttaagtctccctttgcctactgcatgatgatccgggtggccagcaagcagctggaagaggaggatggcagccgtgacagcccactgtttgacttcatcgagagctgcttgcgcaacaagcacgagatggtggtgtatgaagccgcctcggccatcgtcaatctgccaggctgcagtgccaaagagctggccccggctgtgtcagtgctccagcttttctgcagctcacccaaggctgctctccgctatgctgctgttcgtaccctcaataaggttgccatgaagcatccgtcagctgtgacagcttgtaatctggatctggagaacctggtcacagattcaaaccgcagcattgccacgctggccatcaccaccctccttaagacgggcagcgagagcagcatcgaccgcctcatgaagcagatctcctccttcatgtcagaaatctcggatgaattcaaggtggtggttgtccaggccatcagtgccctgtgtcagaaatatcctcgcaaacacgccgtccttatgaacttcctgttcaccatgctgcgggaagagggtggctttgagtataagcgcgctatcgtggactgcatcatcagcatcattgaagagaactcagagagcaaggagacagggctgtcacatctgtgcgagttcatcgaggactgcgagttcacagtgctggccacccgtattctacatctcctgggccaggaggggcccaagaccaccaatccctcaaagtacatccgcttcatctataaccgagtggtcttggagcatgaggaggtccgggcaggtgctgtgagtgctctggcgaagtttggagcccagaatgaagagatgttacgcagcagtgccagagttccgcggtcttgggcccctcttcaagtcctcgcctgagcccgtggccctcaccgagtcagagacggagtatgtcatccgctgcaccaaacacaccttcaccaaccacatggtttttcagtttgactgcacaaacacactcaatgaccagaccttggagaatgtcacagtgcagatggagcccactgaggcctatgaggtgctctgttacgtgcctgcccggagcctgccctacaaccagcccgggacctgctacacactggtggcactgcccaaagaagaccccacagctgtggcctgcacattcagctgcatgatgaagttcactgtcaaggactgtgatcccaccactggggagactgatgacgaaggctatgaggatgagtatgtgctggaagatctggaagttactgtagctgatcacattcaaaaggtcatgaaactgaacttcgaagcagcctgggatgaggtaggggatgaatttgagaaggaggaaacgttcaccttgtctaccatcaagacacttgaagaggctgtgggtaatattgtgaagttcttgggaatgcacccttgtgagaggtcagacaaagtgccggataacaagaacacccacacgttgctcctggctggtgtgttccggggtggtcatgacatcctggtgcgctcccggctgctgcttttggacacagtgacaatgcaggtgacagccagaagtttggaggagctgccagtagacatcatcttggcatctgtgggataagaggccagcctgcataggacctcatacccttccccaacactacctggaagttgtgccttcctcatgaaactggcagaaaccccttcccaagcttctgtattgaaaaacaattaggaatcattgcagatttttttttattctgctcccacctcccacccgggactacttgctggtgacttttttttttttttttttttaaataggggatgattttagcttgtcctaaatcttgctgtccacccttccaggaaagggacattgtaaatgaataaaacattctcaactcctcttgaatctatcccccaagaaaccatcttatccctgtaataaatcagcatgtatttattgaa

SEQ ID NO: 686718 - DNA, 638 bp, Homo sapiens
aagcttggcacgagggacagacgggcaggcggggctgggcgcgggcggcggcggcccggaggagaacgggcggagggcgcgggccgaccgggcgcaccgaccatggcctccaaatgccccaagtgcgacaagaccgtgtacttcgccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggtgagctccggctgccctcggcctgccctgggacctgctgggaggggcgtggcgctggcgctggggagggctgggggtcccggccgccgtggatccccgcccagagtccctgccacccccttggaaaggcctaaggtgccccacccaaggtccccaatgcggggccggttattcttgaagaatcgcgccgggtggcacctgcgggccggagaccaagacagggagaacaggcaagaagacgacgtgagagacaagtaacaggaaagggaggaacacaggaagacaaagacacaaagaaagaaaacaaagacaagagaggaagaagacaacagagaaacag

SEQ ID NO: 686719 - DNA, 394 bp, Homo sapiens
ttttttctagatttcactactggtccgtgtagaatttcacataatttaattatatttgtgttttaaccactcctatatctgtggtggtatcccctttctcattcccagtctttcagcccttggctatttcttgtttcccagctgtacctcccaatcacattccattcatgtccgtggtttttataaagaccaatctgggaccacaggcacccaccaccacacacagccaatttcgcgcattttaaccagacacggggcttcatcatcctggacagcctggccccgaactcctgacctcaagtgatccacccctctcagcctcacagagtgctgggaccacaggtacgagccacgagcacacagcccatttctccactctcatactcgcgtgccg

SEQ ID NO: 686720 - DNA, 3154 bp, Homo sapiens
gagcggggggcccggaagtggtccctgtagaaccactgtggcaccgctactccgtgccgcgcccgtcgagcattgcgttgctgcattgcgccccaccgactccactatgttgaagaaattcgacaagaaggatgaggagtcaggtggaggctccaacccattccagcaccttgagaagagtgcggtactccaggaggcccgtgtatttaatgaaactcccatcaaccctcggaaatgtgcccacatcctcaccaagattctttatctcataaaccagggggagcacctggggaccacggaagcgaccgaggccttctttgccatgaccaagctctttcagtccaatgatcccacactccgtcggatgtgctacttgaccatcaaggagatgtcttgcattgcagaggatgtcatcattgtcaccagcagcctaacaaaagacatgactgggaaagaagacaactaccggggcccggccgtgcgagccctctgccagatcactgatagcaccatgctgcaggctattgagcgctacatgaaacaagccattgtggacaaggtgcccagtgtctccagctctgccctcgtgtcttccttgcacctgctgaagtgcagctttgacgtggtcaagcgctgggtgaatgaggctcaggaggcagcatccagtgataacatcatggtccagtaccacgcactagggctcctgtaccatgtgcgtaagaatgaccgcctagccgtcaataagatgatcagcaaggtcacacggcatggccttaagtctccctttgcctactgcatgatgatccgggtggccagcaagcagctggaagaggaggatggcagccgtgacagcccactgtttgacttcatcgagagctgcttgcgcaacaagcacgagatggtggtgtatgaagccgcctcggccatcgtcaatctgccaggctgcagtgccaaagagctggccccggctgtgtcagtgctccagcttttctgcagctcacccaaggctgctctccgctatgctgctgttcgtaccctcaataaggttgccatgaagcatccgtcagctgtgacagcttgtaatctggatctggagaacctggtcacagattcaaaccgcagcattgccacgctggccatcaccaccctccttaagacgggcagcgagagcagcatcgaccgcctcatgaagcagatctcctccttcatgtcagaaatctcggatgaattcaaggtggtggttgtccaggccatcagtgccctgtgtcagaaatatcctcgcaaacacgccgtccttatgaacttcctgttcaccatgctgcgggaagagggtggctttgagtataagcgcgctatcgtggactgcatcatcagcatcattgaagagaactcagagagcaaggagacagggctgtcacatctgtgcgagttcatcgaggactgcgagttcacagtgctggccacccgtattctacatctcctgggccaggaggggcccaagaccaccaatccctcaaagtacatccgcttcatctataaccgagtggtcttggagcatgaggaggtccgggcaggtgctgtgagtgctctggcgaagtttggagcccagaatgaagagatgttacccagtatcttggtgttgctgaagaggtgtgtgatggatgatgacaatgaagtaagggaccgagccaccttctacctaaatgtcctggagcagaagcagaaggcccttaatgcaggctatatcctaaatggtctgactgtgtccatccctggtctggagagggctctgcagcagtacactctagaaccatcagaaaaaccttttgacctcaagtctgtgcccctggccacggcgcccatggcagagcagagaacagaaagtacccccatcacagcagtcaaacagcctgagaaagtggcagctaccaggcaggagatcttccaggagcagttggcagcagtgccagagttccgcggtcttgggcccctcttcaagtcctcgcctgagcccgtggccctcaccgagtcagagacggagtatgtcatccgctgcaccaaacacaccttcaccaaccacatggtttttcagtttgactgcacaaacacactcaatgaccagaccttggagaatgtcacagtgcagatggagcccactgaggcctatgaggtgctctgttacgtgcctgcccggagcctgccctacaaccagcccgggacctgctacacactggtggcactgcccaaagaagaccccacagctgtggcctgcacattcagctgcatgatgaagttcactgtcaaggactgtgatcccaccactggggagactgatgacgaaggctatgaggatgagtatgtgagtcacagttgaggatggacggaccttccttgagctggaaatgaccccgaggcaggagctgctctaagaccaactggaagatctggaagttactgtagctgatcacattcaaaaggtcatgaaactgaacttcgaagcagcctgggatgaggtaggggatgaatttgagaaggaggaaacgttcaccttgtctaccatcaagacacttgaagaggctgtgggtaatattgtgaagttcttgggaatgcacccttgtgagaggtcagacaaagtgccggataacaagaacacccacacgttgctcctggctggtgtgttccggggtggtcatgacatcctggtgcgctcccggctgctgcttttggacacagtgacaatgcaggtgacagccagaagtttggaggagctgccagtagacatcatcttggcatctgtgggataagaggccagcctgcataggacctcatacccttccccaacactacctggaagttgtgccttcctcatgaaactggcagaaaccccttcccaagcttctgtattgaaaaacaattaggaatcattgcagatttttttttattctgctcccacctcccacccgggactacttgctggtgacttttttttttttttttttttaaataggggatgattttagcttgtcctaaatcttgctgtccacccttccaggaaagggacattgtaaatgaataaaacattctcaactcctcttgaatctatcccccaagaaaccatcttatccctgtaataaatcagcatgtatttattgaa

SEQ ID NO: 686721 - DNA, 893 bp, Homo sapiens
  misc_feature (324)..(324): n is a, c, g, or t
aagcttggcacgagggacagacgggcaggcggggctgggcgcgggcggcggcggcccggaggagaacgggcggagggcgcgggccgaccgggcgcaccgaccatggcctccaaatgccccaagtgcgacaagaccgtgtacttcgccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggaaggcgtgaacatcgggggcgcggnctctacatctacgagaaaggcccctggcggagggggcccggcaaggtccaccgggcccccattcggaggtcccccggcgggcccgagggcagaagggaagccgggaaaaggggcgaaagcggggcccccccggaagggggccccaggccagaaggcccttcccaggtgttcaccaccaacttttcaccggggggaaggccctcaaacaaggtttgccccggggccttggaagcacagaaagcgtggttcacttcccggttgaacacacgggatgaaccgtccctctatgggggccaggggatcttggcggcccgtggtcctggggcattggggcttgttgcgatggcccgccctttgcgcgcggcaaggagacacctgtgagtcccccccggggggcggccctcccccgtgagagcggggccctctcctttccccgccgggtgggttttacacccccggggttgcgtgggtggggcacgtctcacctcttttttatgacccgggggaacccccctatgggcaccggggtctagcccccccttagggtcttaaccgggggggtccccctt

SEQ ID NO: 686722 - DNA, 332 bp, Homo sapiens
acgggggaaatgagagtatagggtatgaggtccttggggggtcatcaaaagttctaaaatgattgtggtgatgggtgcacatatctgtgactatactaaaaacactgaactgtttttaaaataaatgaaccccactctcccaaactttcatgtatggcatactgcctagccggagatatgatgacttacaccttagaacaacaaaaaaaaacttccaaataacaaatgctttgtactaaatgacacattacttattgagcacttcgtatgtgcagggtcctatgttggtcatacacaggggttttctcttgtaattctccccacagccctga

SEQ ID NO: 686723 - DNA, 2745 bp, Homo sapiens
gagcggggggcccggaagtggtccctgtagaaccactgtggcaccgctactccgtgccgcgcccgtcgagcattgcgttgctgcattgcgccccaccgactccactatgttgaagaaattcgacaagaaggatgaggagtcaggtggaggctccaacccattccagcaccttgagaagagtgcggtactccaggaggcccgtgtatttaatgaaactcccatcaaccctcggaaatgtgcccacatcctcaccaagattctttatctcataaaccagggggagcacctggggaccacggaagcgaccgaggccttctttgccatgaccaagctctttcagtccaatgatcccacactccgtcggatgtgctacttgaccatcaaggagatgtcttgcattgcagaggatgtcatcattgtcaccagcagcctaacaaaagacatgactgggaaagaagacaactaccggggcccggccgtgcgagccctctgccagatcactgatagcaccatgctgcaggctattgagcgctacatgaaacaagccattgtggacaaggtgcccagtgtctccagctctgccctcgtgtcttccttgcacctgctgaagtgcagctttgacgtggtcaagcgctgggtgaatgaggctcaggaggcagcatccagtgataacatcatggtccagtaccacgcactagggctcctgtaccatgtgcgtaagaatgaccgcctagccgtcaataagatgatcagcaaggtcacacggcatggccttaagtctccctttgcctactgcatgatgatccgggtggccagcaagcagctggaagaggaggatggcagccgtgacagcccactgtttgacttcatcgagagctgcttgcgcaacaagcacgagatggtggtgtatgaagccgcctcggccatcgtcaatctgccaggctgcagtgccaaagagctggccccggctgtgtcagtgctccagcttttctgcagctcacccaaggctgctctccgctatgctgctgttcgtaccctcaataaggttgccatgaagcatccgtcagctgtgacagcttgtaatctggatctggagaacctggtcacagattcaaaccgcagcattgccacgctggccatcaccaccctccttaagacgggcagcgagagcagcatcgaccgcctcatgaagcagatctcctccttcatgtcagaaatctcggatgaattcaaggtggtggttgtccaggccatcagtgccctgtgtcagaaatatcctcgcaaacacgccgtccttatgaacttcctgttcaccatgctgcgggaagagggtggctttgagtataagcgcgctatcgtggactgcatcatcagcatcattgaagagaactcagagagcaaggagacagggctgtcacatctgtgcgagttcatcgaggactgcgagttcacagtgctggccacccgtattctacatctcctgggccaggaggggcccaagaccaccaatccctcaaagtacatccgcttcatctataaccgagtggtcttggagcatgaggaggtccgggcaggtgctgtgagtgctctggcgaagtttggagcccagaatgaagagatgttacccagtatcttggtgttgctgaagaggtgtgtgatggatgatgacaatgaagtaagggaccgagccaccttctacctaaatgtcctggagcagaagcagaaggcccttaatgcaggctatatcctaaatggtctgactgtgtccatccctggtctggagagggctctgcagcagtacactctagaaccatcagaaaaaccttttgacctcaagtctgtgcccctggccacggcgcccatggcagagcagagaacagaaagtacccccatcacagcagtcaaacagcctgagaaagtgacagctgtggcctgcacattcagctgcatgatgaagttcactgtcaaggactgtgatcccaccactggggagactgatgacgaaggctatgaggatgagtatgtgctggaagatctggaagttactgtagctgatcacattcaaaaggtcatgaaactgaacttcgaagcagcctgggatgaggtaggggatgaatttgagaaggaggaaacgttcaccttgtctaccatcaagacacttgaagaggctgtgggtaatattgtgaagttcttgggaatgcacccttgtgagaggtcagacaaagtgccggataacaagaacacccacacgttgctcctggctggtgtgttccggggtggtcatgacatcctggtgcgctcccggctgctgcttttggacacagtgacaatgcaggtgacagccagaagtttggaggagctgccagtagacatcatcttggcatctgtgggataagaggccagcctgcataggacctcatacccttccccaacactacctggaagttgtgccttcctcatgaaactggcagaaaccccttcccaagcttctgtattgaaaaacaattaggaatcattgcagatttttttttattctgctcccacctcccacccgggactacttgctggtgacttttttttttttttttttttaaataggggatgattttagcttgtcctaaatcttgctgtccacccttccaggaaagggacattgtaaatgaataaaacattctcaactcctcttgaatctatcccccaagaaaccatcttatccctgtaataaatcagcatgtatttattgaa

SEQ ID NO: 686724 - DNA, 3121 bp, Homo sapiens
gagcggggggcccggaagtggtccctgtagaaccactgtggcaccgctactccgtgccgcgcccgtcgagcattgcgttgctgcattgcgccccaccgactccactatgttgaagaaattcgacaagaaggatgaggagtcaggtggaggctccaacccattccagcaccttgagaagagtgcggtactccaggaggcccgtgtatttaatgaaactcccatcaaccctcggaaatgtgcccacatcctcaccaagattctttatctcataaaccagggggagcacctggggaccacggaagcgaccgaggccttctttgccatgaccaagctctttcagtccaatgatcccacactccgtcggatgtgctacttgaccatcaaggagatgtcttgcattgcagaggatgtcatcattgtcaccagcagcctaacaaaagacatgactgggaaagaagacaactaccggggcccggccgtgcgagccctctgccagatcactgatagcaccatgctgcaggctattgagcgctacatgaaacaagccattgtggacaaggtgcccagtgtctccagctctgccctcgtgtcttccttgcacctgctgaagtgcagctttgacgtggtcaagcgctgggtgaatgaggctcaggaggcagcatccagtgataacatcatggtccagtaccacgcactagggctcctgtaccatgtgcgtaagaatgaccgcctagccgtcaataagatgatcagcaaggtcacacggcatggccttaagtctccctttgcctactgcatgatgatccgggtggccagcaagcagctggaagaggaggatggcagccgtgacagcccactgtttgacttcatcgagagctgcttgcgcaacaagcacgagatggtggtgtatgaagccgcctcggccatcgtcaatctgccaggctgcagtgccaaagagctggccccggctgtgtcagtgctccagcttttctgcagctcacccaaggctgctctccgctatgctgctgttcgtaccctcaataaggttgccatgaagcatccgtcagctgtgacagcttgtaatctggatctggagaacctggtcacagattcaaaccgcagcattgccacgctggccatcaccaccctccttaagacgggcagcgagagcagcatcgaccgcctcatgaagcagatctcctccttcatgtcagaaatctcggatgaattcaaggtggtggttgtccaggccatcagtgccctgtgtcagaaatatcctcgcaaacacgccgtccttatgaacttcctgttcaccatgctgcgggaagagggtggctttgagtataagcgcgctatcgtggactgcatcatcagcatcattgaagagaactcagagagcaaggagacagggctgtcacatctgtgcgagttcatcgaggactgcgagttcacagtgctggccacccgtattctacatctcctgggccaggaggggcccaagaccaccaatccctcaaagtacatccgcttcatctataaccgagtggtcttggagcatgaggaggtccgggcaggtgctgtgagtgctctggcgaagtttggagcccagaatgaagagatgttacccagtatcttggtgttgctgaagaggtgtgtgatggatgatgacaatgaagtaagggaccgagccaccttctacctaaatgtcctggagcagaagcagaaggcccttaatgcaggctatatcctaaatggtctgactgtgtccatccctggtctggagagggctctgcagcagtacactctagaaccatcagaaaaaccttttgacctcaagtctgtgcccctggccacggcgcccatggcagagcagagaacagaaagtacccccatcacagcagtcaaacagcctgagaaagtggcagctaccaggcaggagatcttccaggagcagttggcagcagtgccagagttccgcggtcttgggcccctcttcaagtcctcgcctgagcccgtggccctcaccgagtcagagacggagtatgtcatccgctgcaccaaacacaccttcaccaaccacatggtttttcagtttgactgcacaaacacactcaatgaccagaccttggagaatgtcacagtgcagatggagcccactgaggcctatgaggtgctctgttacgtgcctgcccggagcctgccctacaaccagcccgggacctgctacacactggtggcactgcccaaagaagaccccacagctgtggcctgcacattcagctgcatgatgaagttcactgtcaaggactgtgatcccaccactggggagactgatgacgaaggctatgaggatgagtatgtgctggaagatctggaagttactgtagctgatcacattcaaaaggtcatgaaactgaacttcgaagcagcctgggatgaggtaggggatgaatttgagaaggaggaaacgttcaccttgtctaccatcaagacacttgaagaggctgtgggtaatattgtgaagttcttgggaatgcacccttgtgagaggtcagacaaagtgccggataacaagaacacccacacgttgctcctggctggtgtgttccggggtggtcatgacatcctggtgcgctcccggctgctgcttttggacacagtgacaatgcaggtgacagccagaagtttggaggagctgccagtagacatcatcttggcatctgtggtgggggggggggaataaataaaaagagaaaaggggggccagataagaggccagcctgcataggacctcatacccttccccaacactacctggaagttgtgccttcctcatgaaactggcagaaaccccttcccaagcttctgtattgaaaaacaattaggaatcattgcagatttttttttattctgctcccacctcccacccgggactacttgctggtgacttttttttttttttttttttaaataggggatgattttagcttgtcctaaatcttgctgtccacccttccaggaaagggacattgtaaatgaataaaacattctcaactcctcttgaatctatcccccaagaaaccatcttatccctgtaataaatcagcatgtatttattgaa

SEQ ID NO: 686725 - DNA, 224 bp, Homo sapiens
ggccctactctcaggatcccgagtcatggctgcggagtcatggctgtacaggacgcatgctggggaggcctcaggagacttgacatcacggcagaaggcgaaggggaagcagtgcacgtttctggccatggtttgagcggagagacaggagaagaggtgaaaggtgggggagggctgcacgcgtttttatacaaaacccaggatcccaaccaagggcgctccca

SEQ ID NO: 686726 - DNA, 433 bp, Homo sapiens
ttttttaaaggtgctcatgttttaatccctagtaccggagagtgtgtttctgatatggcaaaatggacattgctggtgtgattaaagtatggatcttgtggtgggaagattattcccattgaccatggattattcccatgggtcccatgtaaacaagtccaagggaggcaagaaggtcaaagtcagtagaagatggaacgatgaaagcagagcttgaagtgatgcattttgaagacagacgaaggggccaggagctaagaaatgcaggcagcctctaggagctagtaaagacaaggaaatgcatttttccctggagctgtgagaaggaacccagctctgccaacaccttgattttaaccctgtaagtcctattttggacttctgacttccagaaatgtaagagaataaattggtgctatcttaaaaaaaaaaa

SEQ ID NO: 686727 - DNA, 459 bp, Homo sapiens
ttttttaaaggtgctcatgttttaatccctagtaccggagagtgtgtttctgatatggcaaaatggacattgctggtgtgattaaagtatggatcttgtggtgggaagattattcccattgaccatggattattcccatgggtcccatgtaaacaagtccaagggaggcaagaaggtcaaagtcagtagaagatggaacgatgaaagcagagcttgaagtgatgcattttgaagacagacgaaggggccaggagctaagaaatgcaggcagcctctaggagctcacgacagcagaccacaccatcatctccccagcaaagtagcctctggaagggaacggctaacatttccttgagtatttaaaaggagaatcaacaaggtatatgagaattagggagcagaaaggaaggaacattttccatttagggtataactcattttcctccagccacaacaaaa

SEQ ID NO: 686728 - DNA, 197 bp, Homo sapiens
gcccaacatggtgaaaccccatctctgctaaaaatacaaaaattagccaagcatggtggtggacgcctgtaatcccagatgctataggaggctaagacagaaagaatacacttgaagatggagagacagagaatgcagtgagccaagaaatagaaactgcacaccagaaaagagaaaaggcgaagctccaaaacaca

SEQ ID NO: 686729 - DNA, 374 bp, Homo sapiens
ggcgggtggatcacgattgtcaggaagtggagaatggattttagggaggcaagagcaaatgctatagggctaggctgggcgtggtggcttatgcctgtaatcccagcactttgggaggctgagacgggttgatcacttggggccaggagttcaataccagcctgccagctgggcacggtggtaattccagcactttgggaggctgaggtgggtgaatcacctgaggtcaggagttcgagaacagcctggccaacatggcgaaatcctgtctctactaaatacaaaaaattagctgcgcgtggtggcaggtgcctgtaatccaggtacttgaggggctgaggcaggagaattgcttgaacccgggaggcagaggt

SEQ ID NO: 686730 - DNA, 1065 bp, Homo sapiens
cggcacagctcgctttcacagtcagaagtgggtctgttgggatctgtggtccctgtcctccctgtctgtcccttctggtggaggcttctccaccaggtggcagcccgcacaccggtctcccgtggccatatcttggcgtccactctggttcatggccctactcggatcgctcccaataatggatgcaccctctcaagtgactcactctgcgccatgtctccccagactcctggagatgacgttcctgtaaccttccatccgtcgtgaaataaaaggctcactgctcccaggagcggtcttatttattaagaccagatagggatgttcttcagtgctggatctccgagaatcacaggtatactggtctatgaacggggggcatttgctaatctctgagcatgttgcagctttatgtaaataaatgttgattattctcactgtattgaggtaactcttgtctatatgccagtaaatgagttagctacttgacagagcttaaagtaatagtcgccataggttgtagatgggtaaacgatgaaggcacgttctgatcaggatacttgtgatttggtagctggtaaggctgggaggacgcttatatataagagagatttaggaactaaagtagtttaataactatcggatgtgtcatcattaacagaggttaatcagtgtgtattacttttggagttctactaagagatcgggttgagggtatgaaaccacatgaacgggtgatgcatatgaaatccgggtaaagggccaaggttgaaatagtccggactggctggccaaacccaagtacgcggtatggtgtttgcgcccggcaagcatttatttgcgaacggtacgctgcgctgatgaaaccttcagtggaattgccacaggcattgcagcttatggcggaaggcagtgtggtcaccttagaactcttggccagtgccaacaccacagtgacgcgacgttaatactttcttcccccagtcttctttacagggaaacgaagactctacatttcttttgtgcaatgccaggtagggtggagcactagcatggtgctgcatg

SEQ ID NO: 686731 - DNA, 381 bp, Homo sapiens
tgacctgcgacgtttacacagggaaccgtgtatatccttgtgatctgggaaaacccctgtgtcgttctttctcctgagtcaacccctggtcttagttctagctcagagacggcggggccttcttatctgctcctcaggcactggtggttttctagcaccatagactgtctactgacctcatttttcttacggaatggagttagacatggggagcttcaaaaagaacagacctatgcaattcattatgagtaggggggacacaacagtcaaaagcctgttacaggacatgtaagattatgaaataacttgcataatgcaatacttgtattttttaacaaaaatgtaagtatttacaaaataagatccaaggtattttttaaa

SEQ ID NO: 686732 - DNA, 460 bp, Homo sapiens
gaaccggcaggtgaacatcatgccctacgaattgatccgggtgtgactgcagcccaaccgtggcgtggaagggctctgactacatcaatgccagcatcctggataggttatagacagcagaacgcctacatagctaacacaggggcctctaggcgagagcaccgaggacttctggcgcatgctatgggaagcacaaaaccaccataaacgtcacgctaaccaagctacgggaaatgggcagggagaaatgccaccagcacaggccagcaaagcgctctgctcgctaaccagtactattgttgttcacccgatggctgagtacaacatgccccagtatatcctgcgtgagtacaaggtcacggattcccgggatgggcagtcaaggacaatccggcagttccagttcacagactaggccagagcagggcgtgcccaacacaggcgagggattcattgactt

SEQ ID NO: 686733 - DNA, 312 bp, Homo sapiens
tcccctgtcgcgcgctggggctgtttctcgctccttccgagttaccgccgccgtcgccgccgctcctcctctcccggtcctgggtttccttggcgctgcggccgccgctccctctgcgacctgtatgaggaggaggaggaggaggatgtgaagatggcggagctgcagatgctgctggaagaggaaatcccggggggccgccgggcccttcttcgacagctacacaaatctggaacgggtggccgattactgcgagaacaactacatacagtcagcagataagcagagagccctagaagaacccaaagccta

SEQ ID NO: 686734 - DNA, 478 bp, Homo sapiens
cagaggggtgttcccagatagattgggctgagcagcccgtggggcagccactttgatcatgcgatctctttcttagcgccagcactgcccagagggtccatgctgtgagcagtttacagaagtcaagaagcggatcttctcaatggcaatgcgggttgcagcaatccagtgagccacaacctcatgtgcatacaacttcttcttgaaagctatccttggtgtggcccgttctagacatgatctgcaaagcgcgttccgccaaacctacggttctcatcctgaggtggattctgccaggtccaaggcgggcttggtagatttcaaatcccctagcttgacctagtataagattggtggcaggaagtcgcatttgattagagtggatctcaaaatgtcgtccatgaaaatcatcggtgtagccaaaaatggagaaaggccttatgatgtatactccaggtgtgttcaggggaacaagaat

SEQ ID NO: 686735 - DNA, 199 bp, Homo sapiens
  misc_feature (45)..(45): n is a, c, g, or t
cggtcactgcggtcgcggtcgattaggtgctgtacgtgccgcganctcgacagacggacaaacgctagtgctagaagcgcgattaagcaatgtgtgccgcgcgcctgcgttacttgcaaccggtgtatgtctcgtacaacagctgggttcgcgcagacgggcagcgggcaaaagctaaggcttgcaaaaagtacatgcg

SEQ ID NO: 686736 - DNA, 305 bp, Homo sapiens
  misc_feature (7)..(7): n is a, c, g, or t
  misc_feature (22)..(22): n is a, c, g, or t
  misc_feature (78)..(78): n is a, c, g, or t
  misc_feature (97)..(97): n is a, c, g, or t
  misc_feature (158)..(158): n is a, c, g, or t
  misc_feature (185)..(185): n is a, c, g, or t
  misc_feature (196)..(196): n is a, c, g, or t
  misc_feature (219)..(219): n is a, c, g, or t
  misc_feature (223)..(224): n is a, c, g, or t
  misc_feature (227)..(227): n is a, c, g, or t
  misc_feature (254)..(255): n is a, c, g, or t
  misc_feature (257)..(257): n is a, c, g, or t
  misc_feature (262)..(263): n is a, c, g, or t
  misc_feature (276)..(276): n is a, c, g, or t
  misc_feature (281)..(281): n is a, c, g, or t
  misc_feature (292)..(292): n is a, c, g, or t
  misc_feature (301)..(301): n is a, c, g, or t
gccactntggtaccctgagttntccttcggcagaacctgcccatccccttggagaactccgaggtgtgtggggtctancttgtgtgtctgtataganatctatgtgttgccccatgtgtatgtctggaggggagtctataaagaagaagaggaagaancttaaaccagatgtatgtggagctggngtttgctcctntccaccgagtactacgagggttntttnnatntcttagtggaatgtgtgttctaacttnntntctgnnatttagcagatgnaatanaatattatatntttttagtntttc

SEQ ID NO: 686737 - DNA, 325 bp, Homo sapiens
ggccggaacctctttccacagaaaaggatggctctgcttctcctttatcctatttctcctttctgtagctgtttttttcctgctgactctagcttcccattttagcatctgctaatttggtctctgcttctcctttttcctgtgctatctctttactcgctgctgttttcactttagctgtctctgccctacttcccccttctttcagcatctgttcatggcctctgcttctcctttttcctatgtttctcctttctgtagctgtttttttcctgctgactcttgcttccccattttagcatctgctaatttggtctctgcttct

SEQ ID NO: 686738 - DNA, 522 bp, Homo sapiens
  misc_feature (49)..(49): n is a, c, g, or t
  misc_feature (135)..(135): n is a, c, g, or t
tgcaagcaattaggacccccccaaggaagttttcttcaaaaccaccttntacccaccccgcggggacaccgccaggggctgaattctgggtgcttcgcacccggcttcctcctctgcgttccccctgtggcaaanataaggagtccagggcccagggcgggatgacactcattgattctaaagcatctttaatctgccaggcggagggggctttgctggtctttcttggactattccagagagccaaaggaagacttctctgtaggactagcacacccagaggaagagagtgacccaaattggtgctaggagcgaatgaatggggaagtgaactagacctcagccattcccaggagagagatgctgctgcctgggaaaagaaggaatggctttgctttgaggagtcctggagcccattactaagctgcagcatttggtatttgactcacactggccacggtagcgttggactcgcctgactggggagagaaatattaaaagttttctggaggaaaaaaaaaa

SEQ ID NO: 686739 - DNA, 280 bp, Homo sapiens
  misc_feature (81)..(82): n is a, c, g, or t
  misc_feature (86)..(86): n is a, c, g, or t
  misc_feature (145)..(145): n is a, c, g, or t
  misc_feature (149)..(149): n is a, c, g, or t
  misc_feature (227)..(227): n is a, c, g, or t
ctagtccacgctcggagccatccgtccaagggcccgcttgcagtctgtgcagggcttcggacgcaagaagacagcgacagnngtgngcactgcaaacgccgcaatggctcatcaaggtgaacgggcggccctggagatgattgancgcnaccctacaatacaagctgctggagcaagtctgcttctcgcaaagagcgatttgctggtgtagacatccgtgtccgtgnaaggggggtggcacgtggccagattatgctccaacaatgctcccaataaagct

SEQ ID NO: 686740 - DNA, 194 bp, Homo sapiens
  misc_feature (9)..(9): n is a, c, g, or t
  misc_feature (134)..(135): n is a, c, g, or t
gaatgcagnccaactactgtaaggcgcccacattcaacttccgggagtcaggcacttctatatgaggcgagtgggtctcagtctgcttgaatggtgatgagattctgctggatctcagcacgctgcacgtgtcnnaggagagcatgcagtcggacatggtgatccctaattcaggctctaagatgactggtata

SEQ ID NO: 686741 - DNA, 197 bp, Homo sapiens
catatccatccgctcatatgagagccatagctggttcatgagtttcaatacctctggcttctgaaatcgccctgcctgaccactggccgtctctcaaacaagggtttcgatgaccatcgaaaccctaaaccctcatatttcatgtctgcagcagagtcttgtccacttgcaaatttaacagccatagggtttgatga

SEQ ID NO: 686742 - DNA, 404 bp, Homo sapiens
ctttcctgtaacatatttctggtgaccacagaagggactatagtgcagaaacgttgacccaacggctacctttgcgtaagtgttggggtcctgtaacatatttctggcaaaccacagaaaggatgatactgaagaaatccccccaaccccaaagaaatagactgcagcactgattggacgactttgggtaagtgatggggtacccgagtaacaaatgggattgggttagaggcccaacttaggggagttggagtttctcctaagacagagtgagttagaggcccctcttaataaaaggcaaggacacttgactgacctcaggttagaggttactccatcctactctatggagtagctgtcctttcaccactttactttcttaataaacttgtttttgctttgca

SEQ ID NO: 686743 - DNA, 354 bp, Homo sapiens
  misc_feature (172)..(172): n is a, c, g, or t
gcacttcgcctatttgccgaccggattgtatgtatttgcgtataaaaaagatgtttatttgcgggtttgtacattgattattttctttgccgcattggtggcagtgatatcgggtgccagttgcctctatctggtacgcagagtgattaatcgtggtattgtggagaaagangccatcattaataaccattttgaacgcgtactggatggcgggcttttcttttcggctgccgatgtcaaaaaactctacagtatgtataactcggcgttcctggacgacctgaccaaagcaatgggcagaaaatcctttgacgagatttaaaagcgctgccggaaaaaggcggttatttgtgc

SEQ ID NO: 686744 - DNA, 524 bp, Homo sapiens
gggttcccatgccagccatgtctgttacatggcaatctccccagcacttctgagcctcagggaattatcagaaacattggtgtgataataattcacctttcagggcgggagagaggacaacagcagcgttagtcaggaaagctgtggctttggaggccgactctcctttgaatcctggagcttcctccttttggctgtgtgactttgacaagacactcacccagtgcgtcttcatttcctcaagagcaaaatatttgagacaacatcacgtccatgaaacactttgcactgtgtgtgacacacgtaaatgctggtggtaccagtgtggtcatatttacacatggaagaaaggccggaaggaaaattccagatactgtggtggtgttatggcaagtttcacttaattgctttaacaatgatgctcaccataaatgtatacaaactctatttttcaattaaaaaaagatgtgaataaaatttttcccaaattttatataatgaataaatgaatataagtatgtaaa

SEQ ID NO: 686745 - DNA, 173 bp, Homo sapiens
gcagaacacaggtgtcgtgataactaccccttataggccaaattgggataaggtaagactcatatcaacattgtcgtcattggacacgtagattcgggctagtcaccacttctggccatctgatctatagatgcggtggcatcgacaaaaggaccattgagtaatttgagagg

SEQ ID NO: 686746 - DNA, 306 bp, Homo sapiens
  misc_feature (103)..(103): n is a, c, g, or t
  misc_feature (198)..(198): n is a, c, g, or t
  misc_feature (246)..(246): n is a, c, g, or t
  misc_feature (256)..(256): n is a, c, g, or t
cctgcgagccatccagcaggctgtgggaagctccctgcaggggacctgcccaatgataaagatggctctcggtgtcatggccttcgatggcggcgctgccgangtccacggtcagagccccgttcccagggaatcagggggcactgacacggctactgtgttgggacatgggccacggacagcttcctcgcagggctnggtgagtgtcctgggatcccccggatacctgggggtttcccagccgcnggggaccttncggcctgggggaaaagttagggacattgttggagtttgttggctttaagg

SEQ ID NO: 686747 - DNA, 597 bp, Homo sapiens
gcaatatggtgaaaccctgtctctaataaaatacaaaaattagccgggcatggtggtgggcgcctgtagtcccacctacttgggaggctgaggcaggagaatagtttgaacccgggaggcagagtctgcagtgagccgagattgcaccactgcactccagcctaggcgacagagcgagactctgtctcaaaaacagcaacaactacaaacaaacaaaaaacagggttaacaaaagtatggaattcaattctttttatatgctgcagccatgttcctgccctagatttggctgggcatggtggctcacgcctgtaatcccagcactttagggggccgaggtgggcagatcacttgagtccaggagttgaagactagccagggcatcatagcgaaaccccatctctacaaaaaattccaataaagattagtcgggcctggtggtgcgtacctgttatcccagttactggagaggctgaggtgggaggatcgcttgggcccaggagctggacgttgcagtgagccgagatggccccgctgcactcttgttttaacaaagaaaatgaccagacaaaggacacaccgggatcctctagatcg

SEQ ID NO: 686748 - DNA, 236 bp, Homo sapiens
tgtagagtgctggagactgtagccgtgagactggaccagagctggaaaaccgcacctagttactacagggacgtaggcgatctagctggccacgaagatacgaggcctgtaggctgtgctgagagcatagtagttgctgggggctcatggggttcggctggcctggggacccaatctgctgcttcatctgctgttgctgcagaatccgctgctgcagggctatgctaggatagtat

SEQ ID NO: 686749 - DNA, 255 bp, Homo sapiens
atatactctagtaaacctggataccatggcataaccattgggtcatgccttctgatgccgtatctattcactctcacacttgttatgctttactagatctgcttgttcatctatttccgctgctgccgccgtcttggcttattgtgttgttgttggaccctcgtcggttcttcaagctctggtactgattcatcactatcagatccggaatatcttcactatcagatccggaatcactatcagatccgtaatatc

SEQ ID NO: 686750 - DNA, 173 bp, Homo sapiens
cttgggggaattttttttttcccaggccccggtgcccccttttgtccggggcgggttgggacccctgtttttggaaagggccccttttttggggttacctgtttactatgcccgaaattttttacccttttaaccccttttttaccataataattccccccttcggtttttta

SEQ ID NO: 686751 - DNA, 579 bp, Homo sapiens
gcaatatggtgaaaccctgtctctaataaaatacaaaaattagccgggcatggtggtgggcgcctgtagtcccacctacttgggaggctgaggcaggagaatagtttgaacccgggaggcagagtctgcagtgagccgagattgcaccactgcactccagcctaggcgacagagcgagactctgtctcaaaaacagcaacaactacaaacaaacaaaaaacagggttaacaaaagtatggaattcaattctttttatatgctgcagccatgttcctgccctagatttggctgggcatggtggctcacgcctgtaatcccagcactttagggggccgaggtgggcagatcacttgagtccaggagttgaagactagccagggcatcatagcgaaaccccatctctacaaaaaattccaataaagattagtcgggcctggtggtgcgtacctgttatcccagttactggagaggctgaggtgggaggatcgcttgggcccaggagctggacgttgcagtgagccgagatcgtaccattgcactccagcctgggtgacagaatggaatgagactctgtctca

SEQ ID NO: 686752 - DNA, 276 bp, Homo sapiens
ctaaaggggtggacgggttcacagctcagcgctcgggacagggagcagcagccgacacccgacctgaagccgacggccacgcaggtgggcaagagggtgagttcccagctgctggctccagccacgggatgcgcccccagaggcccagggaggctgcaagccgagagcgtgggccgcgctgttctcgtccctgcgatgtggatggtgtgctatccacggggctccaggagaaacatcctgaggctgccgcgcagctttgaaagcacttgctccggc

SEQ ID NO: 686753 - DNA, 392 bp, Homo sapiens
ggcttcctctctgctgagagctgcagagttgatgggatgaccagttgcaaagaggggctgccctttctgctgatagctgaacacttgtcaagatgactttcctagtacagaggagctaccctctctgctaggagctgaacactcatcaaaacaccctggctgtggaaaggagctgctccctgtgggtttcctctgagctgttctatcacttaagaagctcctctttgtcttgctcaccctccacttgtctggatacctcattcttcctggtcgcaggacaagaacctgggacccacagaatttgggaccccagaatggcaaggctaaaagagctataacacaaacagggctgagacatgccccttgctcgccatgttgcaggcaaagagaag

SEQ ID NO: 686754 - DNA, 400 bp, Homo sapiens
tttttccacttttattttagaaattggaaagtacatgtgcaggtttgttatgaagttatattgcgtgatgctgaggtttggagcatgagtgaatctgttacccaggtactgagcatagtacccaataggtagttttctttctaccttgcccccaggagtccccagtatctatttttcccatctttgtgtccatctgtacctaatgtttatctcccacttacaagtgagaaaacgtggtatttggttttctgttcctgcattaatttgcttaggataaaagtttctagctgcatccatgttgctgtgaaggacatggttccattctttttcattgctgtgtagtattccacggtgtctgtggggtttttttaaaggttgtttttgaagaatacttgaaaaa

SEQ ID NO: 686755 - DNA, 235 bp, Homo sapiens
gctcgcccataaatctggtccaacactcgcttcagatattgatggagaaataaacgtgtacgttgtgggtgagaaatgttggcatggacgagaggagaagaaggtatgaaatgaggaaagtgttattagccacaggacatattggattcagttgattcttataaaaactacaggtatcacggtatagccagtacatgaaatgtctaatacaactatcagaggtttagagatttat

SEQ ID NO: 686756 - DNA, 593 bp, Homo sapiens
gtggtggtgggaatatgggccagtgggaatgctatatgaatttgtaaagatgaagcaattttgaaggtggggaagctacaatgatttttggaattcaacaacccgtcttcaaattttggcccatgaagggaggaaattttggaggcagaagctctggcccctatggcggtggaggccaatactttgcaaaccccgaaaccaaggtggctatggcggttccagcagcagcagtagctatggcagtggcagaagattttaattaggaaacaaagcttagcaggagaggagagccagagaagtgccagggaagctccaggttcccccagatttgtgaactcacccaagcccagtggtggcagggcctagctgctacaaagaagacatgttttagacaaatactcatgggtatgggcaaaaaacccgaggccggtatttgtgcctaattgtatacccggttattttagtttctgttctgtggaaagggtaaagccttcccccaaagggttttaatgtagatttttttttgccccccctgctgttgattgctaaatgtaccagtctggtcgggcccctgaataaatgtctttttttta

SEQ ID NO: 686757 - DNA, 353 bp, Homo sapiens
acagagttttccatgcacactttctcaacccctcacgtgggtttccgattcagctggctctacacaagaatctggaccgggcgcgtggctcatgcctgtaatcccagcactttgggaggccaggttggattacctgagctcacgagttcgagaccagcctggccaacatggcaaaaccacatctctactaatatacaaaaaaatcacccaggtgcggtgatgcacgcctgtagtcccagttactcaggaggctgaggcaggagaatcgcttgaacccaggaggcagaggttgcagtgagctgagatctaaccattgcactactgcctgggcaacaagagtgaaactctgtctc

SEQ ID NO: 686758 - DNA, 378 bp, Homo sapiens
  misc_feature (58)..(58): n is a, c, g, or t
aatctttaccttttgggttatcatctcctaccagaaaagaaaaaagagaaaacagcantccttatctttttctacattatcttctgacttttataggattgtaaaatatcctagtagtgttagttaaatcaagttacattttcagagtcaggtgaccctcctggcgggggatgggggggagtgtttattaaaaatgcaatagcatgacattaaaaggtcacatgatcatcttttttgcctagtttctaagttttgggttttttgtttgtttgtttgtttgtttgtttgtttgtttttttgtttaacagaccatgacagaccataatatggggtacaataataggaaaaactaggatgatatcttaaagtcatttaatg

SEQ ID NO: 686759 - DNA, 714 bp, Homo sapiens
  misc_feature (155)..(155): n is a, c, g, or t
  misc_feature (160)..(160): n is a, c, g, or t
  misc_feature (249)..(249): n is a, c, g, or t
  misc_feature (262)..(262): n is a, c, g, or t
  misc_feature (268)..(268): n is a, c, g, or t
  misc_feature (417)..(417): n is a, c, g, or t
  misc_feature (423)..(423): n is a, c, g, or t
  misc_feature (432)..(432): n is a, c, g, or t
  misc_feature (442)..(442): n is a, c, g, or t
  misc_feature (469)..(469): n is a, c, g, or t
  misc_feature (531)..(531): n is a, c, g, or t
  misc_feature (605)..(605): n is a, c, g, or t
  misc_feature (657)..(657): n is a, c, g, or t
  misc_feature (691)..(691): n is a, c, g, or t
cttggtggagagtctaggaatgggttacaaggctcccagaggggagcccactaggctagattaattatgtaagatgaaagaaccagccttaactaaagcgataatgagaggagtgcttcgttcctgagaggttcagtagtggtggcccaccatangccanggtggatggtaggggtgctgtgatggaaccaggttctccagcatctgtggaaatgcttggattctggaatcacaggggccagctggcancacttaaccatcngaagtnggagatgatttttaacagcaggcagcaaggatggaatggcaaacagggggctttgaccccacagagacctgtgggggaaggctaatagaccactgcactcctgaagacaggccagatgggcagccgatgaaggttctgctcaaattctnaaaccnaaaagaccnagaacaggtnttgcaaaacctgctgttcaccactgcnatggaaacttgttggtctctcacctgctctgttaaacctaaaccagaacccattgattgttnggaaaggccaaatttctgttgcaggtgatttccattctccaaccatatccccccaccctacccctgttgttttnccttggccaacttccaaggcctttctttcctcccagggcttcctcttgctcncccaaaatccgctttttttattgtctactccccntgccctggaatttccccgaaatt

SEQ ID NO: 686760 - DNA, 687 bp, Homo sapiens
  misc_feature (650)..(650): n is a, c, g, or t
ataaccgtgtcatcccctatatatccatatagccaagcgtctaccatttaaatcactacaaacaatatactacctctttatcctttttcaacaatcaatttctccattcaattattacctttaaaaaccaccctacccctaataaattctacccctaactcactgtttacgctatccaaaatttatttttatttacgcgcagattcacctccccccccatatctctcacaataccttacatcctcttgaacagtacataccctttagaacagcattctctctaccccctaaaaaaaacaatataatgataacgtcatcaaagggtacgccactttacgaaattttctaaaatcccacctctttccattatacgtttcggccccgttcaacgcaccattaattatttcccaaaaaacaccctttttcccaaattgccttttatacataagcccttctctgcttacttaataaagggccctcctaacacgcttttttttccaaaacaattttttaaaacccccccttttaaaaaaaaccctttctcccagtttccatttaaaaacccccttttcaaaacttggaataaacctaaactcttccaaccttttaatattataccccccccaaaaattacttttaaaaaaggaaanttgacaagcccctttttctcccttttttcttgaaaaa

SEQ ID NO: 686761 - DNA, 318 bp, Homo sapiens
gaaggggagtaagaagggaaggatcataaagaactaaataaaagcagatatgtatatatatatacagacggtgtgtgtattatatatgtatgaactgtgaatatgaggaaattgctctgcaacatactgcattcaaaagttaccagttctagctatagagatgaaggggacattaaccttgtaagaaaattaatccatcacatcatccgccccatagtgaaaattgtgacaagcattttcaagcaactcttttaatttagtaaaatttgggtggtggtgtaattgaacattcactgcctttgaaaactacatctcatg

SEQ ID NO: 686762 - DNA, 758 bp, Homo sapiens
ggaggccccctgggttggttctgacagtctggggcaacggaacgggcacaatgatgatgaacagtatgcttggcgagtatcctgctggaggtaccttcactgctgcgtgctgaccatggtgagcccattggcaggggagtaccaaaagatgatcctccatcttaaagaagatcagacaggagtacctagaagagaggcgggtcataagaagtagtgaattgaagcattctcgaggttcataggctatcccatcagccctttattgtggagaaggaacgaggaggaatggaaggttagtgatgatgaggcagaggaagagcaatgggtgagaaagaagagggaagataatagatgatgaagaaatagcccgaacggtatcgaagatgtgggttcggatgaggaggatgactgcggtaaggatagacgaagaaggaaaactaatgaagatcaggagatgaaatatcattgatcaggacatgaactaaactagagcaagcctattgggaccagaaagaccctgatgacgatcactcgcaagaggagtatggacgaattctacaagatgcctcactagatgactggtgatagatccgacttggacagctccaatggcacctttgctgtcagcaagggtccagtagggaatgtcacgggccagtagcgtatatacttcctcgtcgggctccctgttgaccgtttaagaggaacagagcgagcaagaacgacatcaaactctatgtccgccgtgtgtcatcggg

SEQ ID NO: 686763 - DNA, 293 bp, Homo sapiens
  misc_feature (142)..(142): n is a, c, g, or t
  misc_feature (157)..(157): n is a, c, g, or t
  misc_feature (194)..(194): n is a, c, g, or t
  misc_feature (203)..(203): n is a, c, g, or t
  misc_feature (209)..(209): n is a, c, g, or t
  misc_feature (243)..(243): n is a, c, g, or t
  misc_feature (274)..(274): n is a, c, g, or t
  misc_feature (285)..(285): n is a, c, g, or t
cttttgcgcaggcgtcgcgccctggggccggggccgggcggcaaccgcggtgcgcaaacgcaaaaccgtcggtgggtcggggaatcggtcgcctgaagaaggtaatcaacctcttctgggctcaagaaatggacaacaaagnagcgcgctggcctangccatcatccagttcctagcatgaccagctccggcangggggcctntcgtcngtgctcaggagagttggaagtcgcctccagtgcntggagatgcgtttggggtgacggtagaaganagtgaacttgncgatacct

SEQ ID NO: 686764 - DNA, 588 bp, Homo sapiens
tgatgtgatctagaggatcccagcggggaacaatcacttctggtagactgaattggggattttttataaagagggcatggatgtaatggaatcctggaaggaggaagggagcttacggctgtgggaggagaggagatctgtgtagattatgagaactgtggacggtggtattctggctgaaagttagtttcctgctttctagagctaagcgggctaccacttctagtgctttaaagcaggctggctacccttggactgtgttatctagtggtttagagaggtaagctacaggggcaaaggaaggaggatttcctttctgtggtcctaagacacggagggctattcctcagctttcagcagtatagagagtgaaaggtggggagatatcaggtaaggacggagctgacgcagtgacaagagcagttgtggagtttgttggaagctggggagtatgtaatgtgaggggttaaggggttcattgggagggcctttggccacttcatagaggggatgagctaggagggcaaagttggaaatccatattctaaagaagcctgctagccctgggaaggaaatggattcgctttt

SEQ ID NO: 686765 - DNA, 815 bp, Homo sapiens
ggaggttccgggttgccgcacccaccgcctggcccagttcccgggcctgtccttccgcgggaggcggactccgggcgggtgggggaggcgcagcgggaaggagaggcgcctcccgggcccttggaccggcctgacggcccccttcggcccaggggtcccgggacgcgcagcctggacaccctgctcattgtccctggacacggcagtcttccctccgcccgcagcagcccccgcccgcgtgcaagtgggcgcgccattggccgcgccgggcggggtcggcggcggcggtgacctcattgcagtgccccggggacgcttggcaggcgcggagtcccaggtccccctgactggggctccccctgatagggcgcgggccgcccaggggcctggtgcaggtcccggggactgggggaggaacagacaactatttctggaaggccctttcccaggggtccagagggaccaggcattcctgggaagaggggtcactcctcagcgggtcgcctgtgtcctcgcggtggaggacgcatctgtgcccagaaccagcttctccagaaagcctgggaccttacagccaggccaggggcaggtccttgaggggctcacacatccccccatcggtggcagacacacaagcccccctcggtggcagacaccacatcccccccattcgagtggacagacgggcacagccgcgaccccataaaggaaggcgagctcgcacaacacaccccggaagagtaacaaaacactagccacagcacgcggcacggataagccacggacaaccacccagggagaaacaaaaacccacg

SEQ ID NO: 686766 - DNA, 164 bp, Homo sapiens
tggggcggggcagagggggcgggcttgttgtgagcggggtgcgcccccactccagtaagacttgcttgccttgcttgcgcctgtccccaaggaaggccgtgatccttggctgtggatgtcccggcagcccgggtttgggggcgcgcactagccgcggccatggg

SEQ ID NO: 686767 - DNA, 1304 bp, Homo sapiens
gagagcgggtactgcgaactgccgggcgatgctgtcgctgccgccgtgatacggagagcaacagttccccagcaacaccccttccccgacacaggcacacaccccccgtacaggcacgcacagcccgaccccacagtgcccggctcggctgcgccatcctcgtattggcccaggaagcccatccagacccctgaccacgcagtagcccagataggaaagaagagcctcatgcctgagctcgaggaggcaggcaccatggatctgacaaataactgggcattgatccagcatgcatgaagccctagccagatgccacggggacatacctgtgcaaaggcccaaccagacttgcggctgcggccagggcactattgaagcgactgctggtcattccatgtgtggatcaaggaccagagaaggtttccaagcgagacccaactggtgaccggtagcctatgggccattgaaaggcgaagcaagaaatcgtttgaggaattccctacataccacacccgacaaacgtagattccaagcaaacttagtaagcgtatattgagaccatatcacgtcatcggccaacaatgacacctttaagcaggacaaggacgtttacgatgccacagcttacttgcagtacttatcccatgcacaaccgcctttgtaaaagaggcacaaacacgtcaggcacgagacccgtgcgacattgaacccattgccctgggttattgtcggtggatcaccggaatgaaatccacgtgggcacaggaaatccgcgcggcgatagcgcatgggcgacgcgcaacaaccaagtgccagttgcacaccgcaactgacgttggagacggaaacctacatacaccgagtggggccacttcagagagaatcggatcgacgaattggaagccgacgtgagaagggcccgaacgcagatgggacgacgggaaatatgccgccggacgggacgccgcataggaaaacgcgacaagtaacggggagacgccagggaaacccggcggactgtccacgggagctacactcatttccagcagcggaaaacaatgaagtcattccacaatccattccgcagataaggagaccaagcgtattcactaagcgcgcctaacaggcgaaagcaacgtgagaggacggcacattacgcacaacagtatgcattaggacggactgagggagcaagcgggaaagcgcgattcacccatttcgggtccgccgcaatatcggtgttatgagcacgcaaggatactgacgcgtatgcacagtaagacccgagcacattgcaggctgag

SEQ ID NO: 686768 - DNA, 153 bp, Homo sapiens
  misc_feature (7)..(7): n is a, c, g, or t
agccttntactggaactgcgtctcctactgctaattcggagagtcagcggagcggcgcggaggctctgctcggatcgaggtctgcagcgcagcttcggttagcatgagttctgcagtgactgcagggaagctggcacgggcaccggccgaccc

SEQ ID NO: 686769 - DNA, 953 bp, Homo sapiens
tggtaaaaatggggtcttgttatgttcccggggctggtaattgaactccgggcctcaagcaatctcaatctccttcttgccctcagctttcccagaagggcgtgggatttacgggcctgtgggccacccaaacccaaagcagaggtttaaagagctttgggaaaaaccagcctctcgtcctccagtcttcttgtgtggtaagtggtgtgtggtttgtgaaaacagtgaagtctcttgtgcctcgtgtgtgtgcccagaggcgtggagagtgtgcaagggcgcatagtgactctctcgaggtgtccacgtgcaacctctctgtgcctctctctcggtgtgttcaaacacaatttctgtgtgtggcctacagccctccgggagttagcgcgtgggatttaccgaggtggtacattgcccacccagtggcgcgtgggtataattttgtgggtgtttttatagtgataaaagaagtgggggtttctcactcaacattgtggccccgaggggcgtggtctcttctaaaacttctcgtgagaccctcaagtggaatcccacgctgtggccttgcggccttcccaaaaagtgctatgaggatttacgaggggttggagcccaattggcaaccttgggcgcgtgtctccataacaagtcctttaatatttcaacaaccaggtttttggtgcccaagccatagagagagcctataaatcgtggtaacaaaatacttggaagggccagaggacaaatagcgattagcaccgagataaagggggacattaatggggggctattcattgcgaaagccagaaagatagccctccgtggctacctaagagccagccttgaaggcgcccaacaaggcagaaggaacaccatttgcgcgttttgaacctaaccatccgtacctacgaaaccattactgaccagactgcgggataaataccccttggaaa

SEQ ID NO: 686770 - DNA, 237 bp, Homo sapiens
cggggtccagttataacgagtatttggagggcagcacggtgctcacagtgtcgacggaacttgtacaggcaggcatgcaccgcagtggtgaatacacgtcgacctggctccatgtttgcgatattgggaggtgagcacggtgctcatgtatcgaaggaacttgtctagaggaggtatgcaccgcagtggtgaatacaccgtcgagctggaggcatgcatgcgtgctcgggtactgga

SEQ ID NO: 686771 - DNA, 95 bp, Homo sapiens
  misc_feature (82)..(82): n is a, c, g, or t
agcgttgagtcccctgtaaagccaaaccccctaaaggtctccacacgtgcgtgtttaacggcacacttgacaatggcttcanagcacgcttgaca

SEQ ID NO: 686772 - DNA, 448 bp, Homo sapiens
aagtgattacttaacctgtgtcctgcggaggacccttctggcgggcagctggaagcctgtgcacccgtcttcaaataatggcttttaatagcagactggaacgtttcggattacaaagcaaaccggaccctttcaaacctggttatctttgtgaagtagcattccacttaaaattgggagccctttaataacagagagaaatcatgtctatgaaactagagaagctgctcagataactgcaaaccagccatccttactggttttacgagtagtagtgttataaagaaagttgtccagttttatgagtcttgtaggtttgtttttttgtttttcaaatacagtagtgtacaaaaaggaagcagaatgtggttgctgtctcaatgtaatgcctcgctgggcctgagaatttgaaaataaaaaagtttttttctttccccaaaaaaaaaaa

SEQ ID NO: 686773 - DNA, 1575 bp, Homo sapiens
  misc_feature (324)..(325): n is a, c, g, or t
  misc_feature (334)..(334): n is a, c, g, or t
  misc_feature (336)..(336): n is a, c, g, or t
  misc_feature (338)..(338): n is a, c, g, or t
  misc_feature (341)..(341): n is a, c, g, or t
  misc_feature (779)..(780): n is a, c, g, or t
  misc_feature (792)..(792): n is a, c, g, or t
ctggaggggcctggcttactgtcagtcccaggcctcagtcacagcctttacacaccctgcctgtggggcaggtccctcctttccctctgcctccattagaacccagggcttttgccaagagaggccgggtgttctggcggcattttgtggcaggactttgctctcagccccaaccggagcagctgtccacagtgccctcccccttgtgccaagttcctggtcagggcccaggaggccatccaggaacgccaataaccatccatccctgctacagcacagccaggagtggggtggggtccacgttccctctgactatccaagaanntagagcctnanantanagccgtgttctgtgtacagtgttcctccctggacctcgcaagagtctgcccggacaacccagagtgaccttgagctgattcccaactctggcattggtgtgtcctggctggccggctcctggttatgtcgggctggtggcagcccctcctgccagcaaggtacagagcccagtgctggccggagcctgaccaacctgatctcctaatctaggttggggacacaggagcatgacaatcacaagtcaaaattaggtgtggaacctcagggcggagctggtgtcctgccagagatgcctgggggccggcgggaggacttggaggaggagaggctgcagagggcagggacacagagtagggggccacacaaagggtggctcagagtggaggaggggcataaaggaagagccatacataatcagcagcttgaggggtgtggannctgcagccacanaggacttcccagggagggaatggggcatagtgtggaagtggtgccctcattttcagaggctgcagacacttcgctggaaggcacacttgccacggggcaggcagtgtggcagtcagaaatgtgtgggatggaatgggcgcggtggctcacgcctgtaatcccagcactttgggaggccgaggcgggcggatcatgatgtcaagagattgagaccatcctggccaacttgacgaaaccccgtctctactaaaaatacaaaaattagctgggcatggtggaacgcacctgtagtcccagctactcgggaggctgaggcaggagaatcgcttgaacctgggaggcggaggttacagtgagcagagatcatgccactgcactccagcctggcaacagagcgagactctttcaaaaaagaaatgcgtgggacagaatggcgggtccatcctggacgggatggggcccctgacccctgtgtgcctgcgctctgccagctcctgcgcagagcaggtactcgggggagggaggatggtatgctccaaactcaaggtcccaacttggtgtctgacttggccgcaagaatccttggggtccgtggttacttcatacaatgcaatattgcgggggtaggggcttgggggtcacttactagctgagtctcaacttctgtcccccagcctggtaaatgggcctgaacctattcacctcttgaagggtctctgagggaatcaactttaggaactctgtccgttggtgttgatgtcacaaagtgctggaaaactggta

SEQ ID NO: 686774 - DNA, 184 bp, Homo sapiens
agttacaacattcgaggcgggcgtactgttgattctattaatatgaatatccaaataggcaaatccatatagacagacagtggattagtgattgtcagggctgggaaaatgggagattggggagtgacagcttaatgggtattggatgccctgccctttttgagttgatggtagtgatgatatt

SEQ ID NO: 686775 - DNA, 786 bp, Homo sapiens
  misc_feature (738)..(738): n is a, c, g, or t
  misc_feature (741)..(741): n is a, c, g, or t
  misc_feature (745)..(746): n is a, c, g, or t
  misc_feature (755)..(755): n is a, c, g, or t
cccttctactctctccttcgtctcctttcctcttttctctcctctcttccgtcttcctttcctctttctttcttgttttctcctctccttccctttttcctcttcctcgcgtctttccttctttcgttcttctcccttcttctttcttttcctctctgctccttcctcgtctctctctcccctctctttctctcctttctttcttcccttctcttttcctctcttcttttcccttcttcccttttttctcctccttttctttcccgttcttccgtctctcctcttttctctcctcctccttttcctttctttccttcctctttcgttcctcttctttttgtttttcctctcccctctccttcccttcttctttcttcccctttttcttttcctcccttccctctctctcctctcttctttcctttcttttctctctttttcccgctttctcctttttcttgctccttcctcctctctccttccgttttcctcctgctcctttcttttcttccttttcccttcccctctatctgtcttcgtccctctccctctccgtctccctcttctgttctctcctttccctctgcgtcttccccctcttttctcctttttctgcgcctgtggttttctctcttcttttcctcctaacttctcctcctccctcccgccccctgtctatattctcctcgtacctcttcccgatttcctccggcccttcgatgcgctcatggcgcgacnccncgcnnctcgatggnctcatgcggggtccccggcctagtcttcttc

SEQ ID NO: 686776 - DNA, 770 bp, Homo sapiens
  misc_feature (203)..(203): n is a, c, g, or t
  misc_feature (218)..(218): n is a, c, g, or t
  misc_feature (225)..(225): n is a, c, g, or t
  misc_feature (258)..(260): n is a, c, g, or t
  misc_feature (297)..(297): n is a, c, g, or t
  misc_feature (319)..(319): n is a, c, g, or t
  misc_feature (352)..(352): n is a, c, g, or t
  misc_feature (385)..(385): n is a, c, g, or t
  misc_feature (395)..(395): n is a, c, g, or t
  misc_feature (403)..(403): n is a, c, g, or t
  misc_feature (457)..(457): n is a, c, g, or t
  misc_feature (466)..(467): n is a, c, g, or t
  misc_feature (470)..(470): n is a, c, g, or t
  misc_feature (511)..(511): n is a, c, g, or t
  misc_feature (518)..(518): n is a, c, g, or t
  misc_feature (758)..(758): n is a, c, g, or t
acacatatacgccacacatgcacacacacaacatacacgcacacaaaggttatattctgaacaccaaagtgatagaaaaaagctttgaatgcgctaaatcaaataaaaccctttattataataaactgtggcatactgtggctatcatgaaaaatattgtaactattttaaaagccaaaggaaaaatactggcagtttgaaantagcagcaaaaagcngataaanatagaatggaagataacataagactaatatcannnttctaatgttgatactgtgtaggattgccctgaagtnattttaaattggttcttaaggnactcttaaaaagtcccttaaaaatattaaattnttgccccttacaaacagtggaaaagaaaaaaanagtatttggnatgttacncgcacccaccgaggaaatgtattaggtgctatcatcaattatggtctttgtttntgaccttcnnccngctttatccagcccccctttccgtgcccctgtcgtgaccgnccgttcncccttcctcccgccgcccgtctgaagtgcatttaccaggtctaagaatatatttaaaggttgggggcaaggcatgattgatgcacatttaagaagaaaaatatggaacccataaggtaggtcaagttctttggagagtgttgagaatgaagatgtattaaactctggctatcttggaggagattccaaagtacatggagttctccagctctttatcagttgaaatctgtttcatcgtggncaatagataatt

SEQ ID NO: 686777 - DNA, 301 bp, Homo sapiens
  misc_feature (9)..(9): n is a, c, g, or t
  misc_feature (19)..(19): n is a, c, g, or t
  misc_feature (51)..(51): n is a, c, g, or t
  misc_feature (71)..(71): n is a, c, g, or t
  misc_feature (98)..(100): n is a, c, g, or t
  misc_feature (104)..(104): n is a, c, g, or t
  misc_feature (106)..(107): n is a, c, g, or t
  misc_feature (134)..(134): n is a, c, g, or t
  misc_feature (152)..(152): n is a, c, g, or t
  misc_feature (156)..(156): n is a, c, g, or t
  misc_feature (166)..(166): n is a, c, g, or t
  misc_feature (171)..(171): n is a, c, g, or t
  misc_feature (179)..(179): n is a, c, g, or t
  misc_feature (199)..(199): n is a, c, g, or t
  misc_feature (219)..(219): n is a, c, g, or t
  misc_feature (244)..(244): n is a, c, g, or t
  misc_feature (264)..(264): n is a, c, g, or t
  misc_feature (268)..(268): n is a, c, g, or t
  misc_feature (280)..(280): n is a, c, g, or t
  misc_feature (282)..(283): n is a, c, g, or t
  misc_feature (292)..(295): n is a, c, g, or t
agcacaaantgggcttggnaaaacgtgtattttgtgtatagaaggaatttnaggagaggtattacttattntcatatgtattttaactgtttctctgnnnaaangnntttacttcctcctcctgttcctccccncctccctccttttccagntcantatttggagntcaanactgtctntcaatcagatcatcttgatntttttctttatctcccttcnccttcctaagtcccatttcttggtnataaatattgcattattcanactntcaaactgtgtntnncttacaatnnnnaatgat

SEQ ID NO: 686778 - DNA, 859 bp, Homo sapiens
gcagtgactccggggcgagcgccgcgagatcgcagtagttcgggccatggaggctggagcctgcgctctacccgatggcgggggctgcggtggccgcagggtcgacgatggacctgctcggggtcccggatcgggccctgaggccccgttggacgaagctgtgtgtggctgctgtaccccaacgtacaacgaggaggaggaggagcgccgctagctaccgctcgtaagcgcctgggcttgctcaatgaacgtgctgagttgccagcgccgggggcatgctcacctacgtgcgtctacctggtgcctcctgcagattcagctgatcctgcactacgacgtagacctaccgcgaggtgaagtatggcaacatggggctgcccgacatcgacatgcaaaatgctgatgggtatcgaacgtgactcccgatcgccgccctgctctacacacctgtgctcatcaggttttttggaacgaagtgtgcatgatgttcctcgctgtgggcatctacgccctctttgtctccaccaactactgggagctgctactacatcgcttgctgccctcggcttgtggcccttgggcatggccatcgtgcctctttgggcttccatgggcaactacatcaccaggatggcgcagaatgtaccatgagttactccctattacaaggagcagtgatgggcaggggatgaagcagcgtgctccgcggggctcccacgcgccctatcttcctggtcttccaagccatcttctacagcttcttccatctgagcttcgactgcgcccagttgcccatgatttatttccttgaaccactacctgtatgaccttgaaccacacgctgtacaatgttgcagag

SEQ ID NO: 686779 - DNA, 891 bp, Homo sapiens
gtgttcagctacagcttccttaatggtccttcgaattccgcctagaaatggaagctcttccatctgatatcagcgattgatgaaggcaaagttctaacagtagcctgtgcttttctacgggtgatcctaccccagaagtaacgatggtccgtgttggtggaagaaaaatccactggtcaagaacaggggatggtggccacattgaaaactagagatgatctgactaccctgatcatcatggaggtacagagacaagatggtggactttatacccgtgagtttagggaatgaagtttggatctgatctctgccacatgtgaatatacatattcgatccatttaggagggcctgtgcccttatgactctaccattcattcttaacttttcgcaaaggtttcacacggacataatcgttgtctgaacgtgtacctattcaatatgaacaaggagtaggtttgtatctagcctgaaatgagtcagagttcaaagatattcatttgaatcgttttcatagttgttgacctaatgaatataactagatttgtctagtggcatgtacatatctgtatatgagccggattaacggtccataagagtttgtagccagacatattctatgacgtgtcacaatgtgaagttttgcaactaactgtggtagggaggaaagtttctttgtgggatcgattacctgtgtcgaaattaatcaatctttgtggctcaaggctacgggaaggtcaggactgcgtcccagggtggagacaattcgcttgggaggctgtcgctcaaagaggggggggggcttcatggagggggggcaaacactgggaaggggggggggagggggttcccccgaggaaaaaaggtaccggaggagaaattgattcaacagg

SEQ ID NO: 686780 - DNA, 228 bp, Homo sapiens
ttccgggttgtgcatcagacctcctcattccttacgggcatgtagaaattccccttgacagtccggtagccggtcctgcagcctcgggctcccccaacccacctctaccctctccgcccgggacacatcatcgcatctccgggagccctcagaaccccctcattcactcaacaaatctccggctatgcccacggacccaccatttctctgggatgcccaaacccggaa

SEQ ID NO: 686781 - DNA, 104 bp, Homo sapiens
cagtcgtagacgtcgtagagtagtagtttctgcaccagtcccgcacaggccaccagggaaatggattattccatctatttccttgggcacatcttcttcctgag

SEQ ID NO: 686782 - DNA, 132 bp, Homo sapiens
ttggcttcagagagaatgaagcagagaccatcttcacatcgacgatcgccatgttggaggcagagcggctccctgtgtaactgacacttagggagatatggaagctggtgtgggctttgggttcatcacaag

SEQ ID NO: 686783 - DNA, 229 bp, Homo sapiens
acgtgttattatttcgaaaataatgttgtacttcatgccaggtactgacaaaagacttgagaccaggatggttactcttgtcagctaaggtcaccttgtgccttttggacccttttcttcctggacctacttgaaatcaagcttatcggattacagtgactactttctatacggcgacttgaaagggcaatacgttaaagtaatgacgcctgatgacgacgtttctgtt

SEQ ID NO: 686784 - DNA, 150 bp, Homo sapiens
  misc_feature (133)..(133): n is a, c, g, or t
ggcactgggataagatattgttagtcactcacagtaggaagaaactagcaatagacgattacaatatgatgtagaaaatgctacgcagagattagaagtgtcctattgcgtcttctgtcacttgttttcacantcctaccctcacaggcc

SEQ ID NO: 686785 - DNA, 416 bp, Homo sapiens
cttctcttctgaaagaataaaaatatgatgctacccagacaaggaaagaatcccaaattttgacgttaagacacccagaaccatgacctctgtgtccctcctgacagtccacctccctgtgcctggtctgtccctcactcctgcaaaagacgaggaggaaattaaattcaactcacatgggccagtcgatcaaatctggcaaagagctcgttgagcatcctgaccagctcctgagcagacaaggtcgtggagagccattttgccaccagggaaggaatatggaacaccacctatgattctctgcatggaccgtggctctgccttcacttctgctgacccctttgctcagaattcatgtatttgtgtttttcacttggctgacttcgtctcaaataaagccaagaagaatcaaaaaa

SEQ ID NO: 686786 - DNA, 191 bp, Homo sapiens
atctagaaatattgtaaaactttatatgtagtagtcgtatagtaagggtgtctgaatagttgatttatcataagcttgtgatttatagagtttctctttcatgtgaatatttcatttgtatatcaatgaatcatgtttttttaataatattttatttatatttattttatattatattattaaattattta

SEQ ID NO: 686787 - DNA, 326 bp, Homo sapiens
  misc_feature (35)..(35): n is a, c, g, or t
ttgggggggggggttttgggggggggaataaaatnttttttggggcccccccctttgggtttcccggggcccctttttttaaaaaaaaggtttttttttacccccttttggggttttcccccccgggggcccagggggtttttttttttaaggggaccctttttttcccctttttccctgggggggggggggtcccccccccccaattttttccgggggggggggggcccgggggtttttttttttttccccccccccgggcccgggggggggggggggggccggggttttcccaaaaaaaaacaaaaaaatttttttttttttta

SEQ ID NO: 686788 - DNA, 468 bp, Homo sapiens
ggcggaccggtcccatgcacagttcaaacattcaagtatccaacttcagtggtttagtatattcagagttgtgccaccattaccacaatcaactttacaacgtttacatcaccccaaaaaagaaaccccatactaattagcagtcacccctttgtcctccccaacccttcagcctaagcaaccactaatctgccttctctctatatatattcgcctgttctggacatttcatataaatgaaatcatataatatgtggcctttcatgtctggcattcttcacttgatatgttttcaaggtttttccatgttgtggtgcatatcagtacttcatctctttttttattgctgaataatattccttgtatggatatgccacgttttgtttattcacttgttagttgatagaaattagggctgtttcaattttgggctattataaataatgctgcaaagaacatctgtgcaca

SEQ ID NO: 686789 - DNA, 599 bp, Homo sapiens
  misc_feature (49)..(49): n is a, c, g, or t
  misc_feature (466)..(466): n is a, c, g, or t
  misc_feature (570)..(570): n is a, c, g, or t
cacctcgaaactagtcagggctccgttgtccagcagcttcccgcggtanatcttgtcctccaccacgtcggtccagtagagggcgctctggctgaggtggaagtccagggcgatggtgttgcgcaggccgggcaccaggacgctgtagtctcctttgtgaagatcgatgcgccggatttcatggcggttggagaaaatgatgaacggcttgaaggggtccaggctgcggcagctctcgccgtcaggttccaggacccagccctcgtagcaggagcacttcacgctgaacttgttctggtcgcacttttggctgcatttgagatgcttggcacagtagctctggatctggcaggtgtggttgtcgggccccagctccatgcccagagggcaggaacacacaatgccttcgccaggtgccactgagcagttgtggctgcagccaccgttattcagagagcactggtcncagagctcgccctcatctgagccgtcgccacagtcgtcgttgccatcacacagcttgtcagggggcaggcagactgaggtgttgttggcacaagggtgcgaggngtgctgcaggcccgggactcgcagttctc

SEQ ID NO: 686790 - DNA, 642 bp, Homo sapiens
  misc_feature (35)..(35): n is a, c, g, or t
  misc_feature (47)..(48): n is a, c, g, or t
  misc_feature (416)..(416): n is a, c, g, or t
gaagacccccgaacgggtgatgcggttgacgacgnggggaccgctcnnatgagtctgcttcgtgtgcctatcccacctgcttccccctgactcagtttacctgcaacaatggcagatgtatcaacatcaactggagatgcgacaatgacaatgactgtggggacaacagtgacgaagccggctgcagccactcctgttctagcacccagttcaagtgcaacagcgggcgttgcatccccgagcactggacctgcgatggggacaatgactgcggagactacagtgatgagacacacgccaactgcaccaaccaggccacgaggccccctggtggctgccacactgatgagttccagtgccggctggatggactatgcatccccctgcggtggcgctgcgatggggacactgactgnatggactccagcgatgagaagagctgtgagggagtgacccacgtctgcgatcccagtgtcaagtttggctgcaaggactcagctcggtgcatcagcaaagcgtgggtgtgtgatggcgacaatgactgtgaggataactcggacgaggagaactgcgagtccctggcctgcaggccaccctcgcacccttgtgccaacaacacctcagtctgcctgccccctgaca

SEQ ID NO: 686791 - DNA, 187 bp, Homo sapiens
ctcttgctgatatttagtttccttatcctgttcatgccttgtatcgccttttaccttgctatatcttctcgtttcttctttcctgctttctgcttaggtacgggctagcgaggcggtggctctgagctctactttcgggctatgtctttattcttatttaacgtcgtgaattctccttaaggacctt

SEQ ID NO: 686792 - DNA, 1506 bp, Homo sapiens
  misc_feature (49)..(49): n is a, c, g, or t
  misc_feature (466)..(466): n is a, c, g, or t
cacctcgaaactagtcagggctccgttgtccagcagcttcccgcggtanatcttgtcctccaccacgtcggtccagtagagggcgctctggctgaggtggaagtccagggcgatggtgttgcgcaggccgggcaccaggacgctgtagtctcctttgtgaagatcgatgcgccggatttcatggcggttggagaaaatgatgaacggcttgaaggggtccaggctgcggcagctctcgccgtcaggttccaggacccagccctcgtagcaggagcacttcacgctgaacttgttctggtcgcacttttggctgcatttgagatgcttggcacagtagctctggatctggcaggtgtggttgtcgggccccagctccatgcccagagggcaggaacacacaatgccttcgccaggtgccactgagcagttgtggctgcagccaccgttattcagagagcactggtcncagagctcgccctcatctgagccgtcgccacagtcgtcgtgtgcctatcccacctgcttccccctgactcagtttacctgcaacaatggcagatgtatcaacatcaactggagatgcgacaatgacaatgactgtggggacaacagtgacgaagccggctgcagccactcctgttctagcacccagttcaagtgcaacagcgggcgttgcatccccgagcactggacctgcgatggggacaatgactgcggagactacagtgatgagacacacgccaactgcaccaaccagggtgggcaccaggggcccgttggggtggggatgagatcgagccccctgcatcagacacccagcctatccatctgtctttcagacccacggtgtgtcggccaccatctgggagccagaggtagcctaggcatggctcttgtccttcaggagctcccggtcctgtgggagagggaggttgccgaaaaatcattgccacacgctgttaatatcatgcgctttgcagttggtggccttgggtttgagctccagctctgcagcttattatctgggtggccttgagcaagttacttaatctccatgggcctctgtgagtttcgtctgcaaagtggggtaataatagcaccaacatcacagcgctgatgtgggagtttagtgagatcacgcacgaaaagtgctcagcacacggctgtgtctggtaaatagtagcttgagaaaaggatgctgcaggcagggcatgaactgagcctgaagagacagaggagagagggcctggctccacaatgctcccagtgcctggcctctggggcccagcctcggagcgcggtggggacctaagtttctggagggatgggccctctcacggacatgctggcttccttagctctggaagcattgtgccagactttttattgtgaacaactaaccaaatttttaacactaccgtattagtttctcctcgtctcaccgttcctgcaggctggacgtcccaaacccaaatgttggcggttgggttcctcttagccgtgtga

SEQ ID NO: 686793 - DNA, 164 bp, Homo sapiens
tagcagtgcggggggaggcagaagccacggattctgcggcccgtgcgcacccgcgagcttagcacgtagttggggtccaggtcgtcgccgccctgcaggttgtcggggtagaggtcggtcttgtgctcatcactgggcttgtcggggctgtcgggctatcgggg

SEQ ID NO: 686794 - DNA, 1085 bp, Homo sapiens
  misc_feature (49)..(49): n is a, c, g, or t
  misc_feature (466)..(466): n is a, c, g, or t
  misc_feature (859)..(859): n is a, c, g, or t
cacctcgaaactagtcagggctccgttgtccagcagcttcccgcggtanatcttgtcctccaccacgtcggtccagtagagggcgctctggctgaggtggaagtccagggcgatggtgttgcgcaggccgggcaccaggacgctgtagtctcctttgtgaagatcgatgcgccggatttcatggcggttggagaaaatgatgaacggcttgaaggggtccaggctgcggcagctctcgccgtcaggttccaggacccagccctcgtagcaggagcacttcacgctgaacttgttctggtcgcacttttggctgcatttgagatgcttggcacagtagctctggatctggcaggtgtggttgtcgggccccagctccatgcccagagggcaggaacacacaatgccttcgccaggtgccactgagcagttgtggctgcagccaccgttattcagagagcactggtcncagagctcgccctcatctgagccgtcgccacagtcgtcgtgtgcctatcccacctgcttccccctgactcagtttacctgcaacaatggcagatgtatcaacatcaactggagatgcgacaatgacaatgactgtggggacaacagtgacgaagccggctgcagccactcctgttctagcacccagttcaagtgcaacagcgggcgttgcatccccgagcactggacctgcgatggggacaatgactgcggagactacagtgatgagacacacgccaactgcaccaaccaggccacgaggccccctggtggctgccacactgatgagttccagtgccggctggatggactatgcatccccctgcggtggcgctgcgatggggacactgactgnatggactccagcgatgagaagagctgtgagggagtgacccacgtctgcgatcccagtgtcaagtttggctgcaaggactcagctcggtgcatcagcaaagcgtgggtgtgtgatggcgacaatgactgtgaggataactcggacgaggagaactgcgagtccctggcctgcaggccaccctcgcacccttgtgccaacaacacctcagtctgcctgccccctgaca

SEQ ID NO: 686795 - DNA, 258 bp, Homo sapiens
gcctggacaacaagagcaaaactccgtctgcaaaaaacaaaacaaaagaaaacaaagaaaagaacttagtgacacagacagtcccaggacacatagcactccccagtaccagaatcacaggcacacacagggctgcccaggcacatgcaatctccgtgaagtatgcagagtcccttgaacacacaagtttaccctgacacacacagtctctgtgtcctacaatccatacagtgagactcatcccacaagcaattggtc

SEQ ID NO: 686796 - DNA, 1138 bp, Homo sapiens
  misc_feature (82)..(82): n is a, c, g, or t
tagatgagtcaatgccacttgttcagcccgcacctgcccccccaaccagtgctcctgtgccagtggccgctgcatcccattnctggacgtgtgatctggatgacgactgtggggaccgctctgatgagtctgcttcgtgtgcctatcccacctgcttccccctgactcagtttacctgcaacaatggcagatgtatcaacatcaactggagatgcgacaatgacaatgactgtggggacaacagtgacgaagccggctgcagccactcctgttctagcacccagttcaagtgcaacagcgggcgttgcatccccgagcactggacctgcgatggggacaatgactgcggagactacagtgatgagacacacgccaactgcaccaaccagggtgggcaccaggggcccgttggggtggggatgagatcgagccccctgcatcagacacccagcctatccatctgtctttcagacccacggtgtgtcggccaccatctgggagccagaggtagcctaggcatggctcttgtccttcaggagctcccggtcctgtgggagagggaggttgccgaaaaatcattgccacacgctgttaatatcatgcgctttgcagttggtggccttgggtttgagctccagctctgcagcttattatctgggtggccttgagcaagttacttaatctccatgggcctctgtgagtttcgtctgcaaagtggggtaataatagcaccaacatcacagcgctgatgtgggagtttagtgagatcacgcacgaaaagtgctcagcacacggctgtgtctggtaaatagtagcttgagaaaaggatgctgcaggcagggcatgaactgagcctgaagagacagaggagagagggcctggctccacaatgctcccagtgcctggcctctggggcccagcctcggagcgcggtggggacctaagtttctggagggatgggccctctcacggacatgctggcttccttagctctggaagcattgtgccagactttttattgtgaacaactaaccaaatttttaacactaccgtattagtttctcctcgtctcaccgttcctgcaggctggacgtcccaaacccaaatgttggcggttgggttcctcttagccgtgtga

SEQ ID NO: 686797 - DNA, 355 bp, Homo sapiens
tccgagggcttcattcaaatgacaatcaaatgagacaaagacgtttttgaaaggcaagaacttaaagctcaacacgcatgcatcccatattaaaaacagtaactattccaagtttttaaaaaatacaagaaaaatgacaatttaaagtataagaaacaacagcagttgagtaagacctaaaaggagcatagaaagctggaaagaaattgaaagaggattcactagatcttgatgattgggccattctctttgaagcagtttggtaataaaatactatgtttgcttttcccagtattcaacagcacctctagattccaaagtaaataatatttacttaataatattgcaaaaactg

SEQ ID NO: 686798 - DNA, 523 bp, Homo sapiens
  misc_feature (106)..(107): n is a, c, g, or t
  misc_feature (336)..(336): n is a, c, g, or t
  misc_feature (360)..(361): n is a, c, g, or t
  misc_feature (364)..(365): n is a, c, g, or t
  misc_feature (367)..(368): n is a, c, g, or t
  misc_feature (370)..(370): n is a, c, g, or t
  misc_feature (372)..(373): n is a, c, g, or t
  misc_feature (380)..(380): n is a, c, g, or t
ttcctggggtgttggaaacgtgctgtaccctcactggggtggcggttccacgggtgaatacatttgccgaaactcatgaagtgtacgctgaaaatctgtgcgtttnnctttaggcaaacctaagttttgttttgttttgtttttttaagtattacacagtgactgtggtggtggctggaagcagaagtcaggagtgtattcttttttttttttttttttaaaccggcagtgggggcgggaaagggggatgccaagtactttcctaagtgttgaatacaagtggaggcaaacttggaaacgttccacatttcacagggcgagggcagggtgccctgncagcggctagcaaagaacggcccnnctnnanngngnncggcccnactcggaccccaagtctccctagaggtcctatcgctcccagcggtttccgcagccacctccaccacctccgcagcaaaacgctagccggactggcgggccctcgccggcgtcgtgctgacgtaacgcgcgtgctgacgtcgcc

SEQ ID NO: 686799 - DNA, 186 bp, Homo sapiens
ggatcccgacgctctctgtggggcaaggtgaacgtggatacaagttggtggtgacgccctgggcagtgctgctaggtggtactacccttaggacccagaggttctatatgagctcctattggaggatcttgtccactacctgcatgctagttcatagagcaaccccctaagtgttgaagtgctcac

SEQ ID NO: 686800 - DNA, 294 bp, Homo sapiens
  misc_feature (51)..(52): n is a, c, g, or t
  misc_feature (59)..(59): n is a, c, g, or t
  misc_feature (66)..(66): n is a, c, g, or t
  misc_feature (118)..(118): n is a, c, g, or t
  misc_feature (154)..(154): n is a, c, g, or t
agtagccagggctctgctagtaaccaggacagtgctagcaaccagggctgnnctagtanccagganagtgctagtagccagggctgtgctagtaaccaggacagtgctagtaaccagngctgtgctagtagccaggatagtgctagtaaccagngctgtgctagtaaccaggatagtgctagtagccagggctctgctagtaaccagggctgtgctcgtaaccagggctgtgctagtaaccagggctctgctagtagccagggctctgctagtagccagcactgagctcgtgcc

SEQ ID NO: 686801 - DNA, 543 bp, Homo sapiens
  misc_feature (30)..(30): n is a, c, g, or t
  misc_feature (126)..(126): n is a, c, g, or t
aagcctgtctgtggtgacgatggccaaacntacaacaatccttgcatgctctgtcatgaaaacctgatacgccaaacaaatacacacatccgcagtacagggaagtgtgagaagagcagcaccccnggaaccaccgcagccagcatgcccccgtctgacgaatgacaggaagattgttgaaagccatgagggaaaaaataaaccccagttctgaatcacctaccttcaccatctgtatatacaaagaattcttcggagcttgtcttatttgctatagaaaacaatacagagcttttgggaatggactcactgattttcagtcttttccatctctttcctcctagactctgtgatctgagggtataaagacatctccaccaagtctgagccctcaaaatgtcctgattacaatgctgtctgtccaactgcctgttcaataaaagtaaactcagcagaacaccctttctgggatttctttgtcactatctggataatagatatttgcttttaaagaaactgaataaactctacccttttgtctta

SEQ ID NO: 686802 - DNA, 362 bp, Homo sapiens
cgtatcgctcacttctccaccaactacctggtccctgggctctgtacaggcagcccagctacaggcgcccggacggtcagcagcgcggacagagtatatacaggcgctgggggctctggttcccggatctccgtgtaccgctcaaccagcttcacggggcggcatggggtccgggcgcctggccaccgggatagccgggggtctggcaggaatgggaggcatcagaacgagacggagaccatgcaaagcctgaacgaccgcctggcctcttacctggaccgagtgaggagcctggagaccgagaaccggaggctggagagcaaaatccgggagcacttggagaacaagggaccccaggtcac

SEQ ID NO: 686803 - DNA, 565 bp, Homo sapiens
tatgggatgcatggctcatgcctgtaatacagcactttgggaggcgaggtgggggggatcacttgaggtcaggagttgttgaccagcctgccaacatagtgaaaccctgtctctactaaaaaaaaacaacacaaaaattagccgcgcgtggtggtgcgcacttgtaatcccagctactcgagaggctgaggcaggagaatcacttgaaactcaggaggtggagttgcagtgagccaatatcaagcccattgcactccggccagggcaacagagcaacactctgtctcaaagaaacagacaagaaaagaaaagaaaatggcatatctcatcccctaggcctcccctgcaaaggacagagaaccttcaagaggcagataacacagcctcactctaaatcaaagcagacaagagccctgctcaagattatcccagagaatggcttgacaaaacttctaaaacaacagccatgatttttggcagctctctcaaaacataatcagttcatatttgcgagtttcatatagagggcgaagctgtatcattacatagcaatgtatttcacaaa

SEQ ID NO: 686804 - DNA, 135 bp, Homo sapiens
cgtgatgtgtgcctgtgctttctgagtgctagcaagcccacctctgcctgtcacacacgttgcagtgttgcctctcaggttgttgcttgtcttggccttttcatgatgctttttcttatatcggcaatcaagctt

SEQ ID NO: 686805 - DNA, 654 bp, Homo sapiens
gtggctctggctctggagagccccgtggatggaggctggatgccctcggccctgcctgggatgaatcccagttgcgcagttatatgcttcccgactagtgcccattcctgcgtctgagtcagagctgacccccgggcagaggagcttattgagaatgagtgatgcctagtggttggctgacctgacagcaagatctttgtgtaatcctttgccctgcaaattgggaagccttgaataccttgcaaggagcaatattggcaatggagacttctctgtgtacagtgccatgcacccacaagttcttgtactatgatgcagaagaatgatggccaatttccatgaactttaagccgaggtccaacatggggaagacatgaaatttcatgagttcgttgagaaactgcagtgatatacagcagcgaggaggggacgagaggttgtatctgcatgcaaactgctcaatgacactgtgggctggaagatttgtcatggacttcttaggttttaacttggaactggattaataagcaacagggaaagcgtggctgggggcagcttacctctaacctgctgctcattggcattggaggacattggacacctgctcactattatgagcagcagaactatttgtcaaataaactgtacaactga

SEQ ID NO: 686806 - DNA, 284 bp, Homo sapiens
  misc_feature (58)..(58): n is a, c, g, or t
  misc_feature (135)..(135): n is a, c, g, or t
  misc_feature (211)..(211): n is a, c, g, or t
  misc_feature (228)..(228): n is a, c, g, or t
cactctacttttaatttatcttcagaaaatgtgaaaaaaaatcttaaataggcttttncttgaaagactgatgaccttaagtgtaattaaataactaaaagttaaaaatggttcttaatggtcattctgtttggngtcataaatgcattccacaaacaacccagtaacaattataattattgtataatctagttctataacaatacttagnttacaatttatattttnataaatgcttgttagctgaaaaaagatgtgttggtcaacccaaagttatctaggct

SEQ ID NO: 686807 - DNA, 94 bp, Homo sapiens
agaggcccctttttttttcccccggggttttgccccggggcccccccccccccccaggtggtttaaaggggccccgggggggtttgttttttta

SEQ ID NO: 686808 - DNA, 214 bp, Homo sapiens
atgtccctagctgggcaaagccaagaccaccaagaagcggcacagcgggacacatccaatgccttcgcaatgtttgaccagtcccagatccaggagtttaaggtgaggctttcaacatgattgaccagaaccgtgatggcttcatttgacgaaggaggacctgcatgacatgctaggcctcgcttggggacagaaccccacatgacgaataccg

SEQ ID NO: 686809 - DNA, 106 bp, Homo sapiens
acagctcaggaaaccgtgggctgtacagacattttcaaagtggccagtgttactttaatgggactgccttcgtaatttatttgctattgaaacttctaaaactagg

SEQ ID NO: 686810 - DNA, 164 bp, Homo sapiens
aaccgcctgcaactacgggccatccagtgggactccaaattgacagctacctacaccccgagaagccaagaaatagggcgcgagataatatcgctgtaatcacaaataatcaacccggcagcgcactagctgccgggcttcaagcggcatcacactcagcctct

SEQ ID NO: 686811 - DNA, 635 bp, Homo sapiens
  misc_feature (367)..(367): n is a, c, g, or t
ggccttacgataggcggcaaaaagggagccaagaagaaagtggttgatccattttctaatgaaaacgatgggtatgatgtgaaagcacctgctatgtgcaatataagaaatattggaaaagacgctcgctcatcaggacccaacggtaaccaaaattgcatctgatggtctcaagggtcgtgtgtttagaagtgagtctgtgctagattcgcagaatgatgaagttgcgattgtagcaagaattcaggctgatctactgtaagatgtgcagggtcaactagactgcactgactaatttccatggcatggatcttacccagtcgacaaaaatagtagttccatgggatcaatatacacaattgcgcangacgaaaatggagtttgcgacatggcgttcaagcgggtttcgaaatagttcgaaaggaacgtgacccgggactaggctctacctatgtctgtcctgtctggattctggtgatgagggtgtgttacatagacaaacgtcggaacaatcagcatacggtaagatgcatcttagtgctctagacaccgaacgaggtgcctgcataagtccgcgaagagagatgatcggaaatcatgaccctgagaggtgccagacaaatgacttgaaagaa

SEQ ID NO: 686812 - DNA, 205 bp, Homo sapiens
gagtggcatgggtacctcatctgtcacgtcgatgattctatatggatacctaaacaaaaatagaaggcgggactcttcccttcgcttgaatatcatccctgtatatggcatgaatgagagattacccatatttccatcagagtaatacaactactaccttgcttacttccttaccgcataacgtacaccatgactatacaacacc

SEQ ID NO: 686813 - DNA, 580 bp, Homo sapiens
  misc_feature (494)..(494): n is a, c, g, or t
  misc_feature (522)..(522): n is a, c, g, or t
gcgagacggttcaaggcgtctcactctgaaacacatccacgggcttctggtgccggagcatctcacatacgatgcgggatgttgcagaacgtgccactgcggcctcccccgttcaagcagtgcacaacggtgcggccttccccgccattgtattcctcttgccacttgtccacctggcgaatgagcttcaagaaggagcgcttagacactggtgtgtccctgtacatcggccagcccaggaactggaattgctgcaccatccgatatccatcttggggactggcggcattgtaaatgcggaatatcctgctgatgatgtcctcttccaggtcagcagagacaaattccacctggatggggccgtgtctgtgtactccgttttctggccagtactgtggacacaactgggcaggatccacatcatttagcataactacggatgtgcagtgataatccaggaccagtctccaaaagtctttcactgtgtttggcanaggatgctgcgtgactataaaagctganggctgtttatagctggccatgagggcagcattgatgtagttgctgctctccccatcga

SEQ ID NO: 686814 - DNA, 297 bp, Homo sapiens
ctgggaggtgcagtgcaccatcaccctcaaagcctggggttgccgcccatggcgcgggaagggttatcaaggcccccttgcgcaggtccaacggctcatagttgcgcaagttgaacgagcccattttcaaaaccctgcgctcttcgttctgttgaaccagccactggcccaggcgtttgccaattagggtgcgttcgtagttgtctaaaccaaggttgcagatataacgactggcctgggcgatgtcgatcacgatctcttgcttcatgctgatcgggtctaaccgcagttcgaatt

SEQ ID NO: 686815 - DNA, 311 bp, Homo sapiens
  misc_feature (26)..(26): n is a, c, g, or t
  misc_feature (33)..(33): n is a, c, g, or t
  misc_feature (67)..(67): n is a, c, g, or t
  misc_feature (189)..(189): n is a, c, g, or t
  misc_feature (228)..(228): n is a, c, g, or t
  misc_feature (261)..(261): n is a, c, g, or t
cgaaatatcattgcagatggcatctnagatctnatggagatgtacaaagaggttaatgttgtttttnatgcctgctaacacaacgtccgttcgacagcctatccatcaaagagtaatttcagatgctattatttaggaaatatattcttggccgggtgtggtggctcacgcctgtaatcccacactttnggagaccgagacaggcagatcacgcaatcaggagatcangatccatcctgggccacgtggtgaaaccccgtnttctactaaaaatacaaaattttagctggggtgggggcaatggcatgcct

SEQ ID NO: 686816 - DNA, 417 bp, Homo sapiens
gagatgccagcaggagatacgaagtctcccagccaaggaagaagcccaggacctaatggcttcactgctgaatttcaccaaagatttcaagaactaataccattcctactcaaattattctgaaaaacagtgaacagaatacttccaaacttattctgtaaggccagtatgaacctgttaccaaaaccagacaaagacacatcaaagaaagaaaattgtccaggcgcagtggctcacacctgtaattccagcactttgggaggccaaggcgggcagatcacctgaggtcaggagttctagaccagcctggccaacatggtgaaatcctgtctctaccaatactacctaacaaatttagccgggcgtgctggtgtgcgcctgtagtccccagttactcgcgaggctgaggcaagaacc

SEQ ID NO: 686817 - DNA, 115 bp, Homo sapiens
ccctctccaccaaaagctctagcccctttagccttccactgttccagcacaggtcatctgtgcaagcatcattgtctttgcatgcatccattcttcttaaataggtgtagaacag

SEQ ID NO: 686818 - DNA, 853 bp, Homo sapiens
  misc_feature (9)..(9): n is a, c, g, or t
  misc_feature (194)..(194): n is a, c, g, or t
  misc_feature (197)..(197): n is a, c, g, or t
  misc_feature (216)..(216): n is a, c, g, or t
  misc_feature (220)..(221): n is a, c, g, or t
  misc_feature (306)..(306): n is a, c, g, or t
  misc_feature (342)..(342): n is a, c, g, or t
  misc_feature (349)..(349): n is a, c, g, or t
  misc_feature (374)..(374): n is a, c, g, or t
  misc_feature (383)..(383): n is a, c, g, or t
  misc_feature (386)..(386): n is a, c, g, or t
  misc_feature (397)..(398): n is a, c, g, or t
  misc_feature (445)..(445): n is a, c, g, or t
  misc_feature (507)..(508): n is a, c, g, or t
  misc_feature (510)..(510): n is a, c, g, or t
  misc_feature (512)..(512): n is a, c, g, or t
  misc_feature (588)..(588): n is a, c, g, or t
  misc_feature (592)..(592): n is a, c, g, or t
  misc_feature (594)..(594): n is a, c, g, or t
  misc_feature (599)..(599): n is a, c, g, or t
  misc_feature (608)..(608): n is a, c, g, or t
  misc_feature (611)..(611): n is a, c, g, or t
  misc_feature (709)..(709): n is a, c, g, or t
  misc_feature (712)..(712): n is a, c, g, or t
  misc_feature (721)..(721): n is a, c, g, or t
  misc_feature (731)..(731): n is a, c, g, or t
  misc_feature (733)..(733): n is a, c, g, or t
  misc_feature (737)..(737): n is a, c, g, or t
  misc_feature (740)..(740): n is a, c, g, or t
  misc_feature (770)..(770): n is a, c, g, or t
agcgtagtnatcccacacttgttttaattacaatagaataagttaaccaagaaacaagttggaaaatggaaggcccctcccaggtttgcacccagaggcagggagaggtagaccctcaccagaaagacctccagtaataacacagatagccacctactatttggttttttttttttttttttttggaaatgganttncgtcttgtcgcccagggtngganntgaaatggcgcgatctcggctcactgcaacctccgcctcccaggttcaagcgattatcctggcctcagcctccctagtaatgggngattacagggcgcccaccatcacacccagctaattnattttangtaagagatggggtttcaccacgtnggccaggcnggntctcaaactcnntgacctcaggtgatccacccgtttgggtctcccaaagtgcggggatnacgggcgtgagccattgacccagccaccaccccattatttctaagggacttatatgtgtgannancngtagtaagcttggcatattttacctcgttaaatttcatctcaactctttgaagcacatttagccactcttcataantgananagggnggctctganaanttaggtgaccgcccagggccacacagctaaggggaggagctattaaccattatcactatggtcccccaggccttgagattctggataacctagaaaanttnagatgttcnaagtttaccnanaacntcntgaaaatggcgcggaaggtaggccatgtangaggtttcccggtcattgtgcaaaagatttatttacattggggaacggtggtactacagaaaaattcttagcgtgaatgtgtg

SEQ ID NO: 686819 - DNA, 531 bp, Homo sapiens
  misc_feature (106)..(106): n is a, c, g, or t
  misc_feature (109)..(109): n is a, c, g, or t
  misc_feature (111)..(112): n is a, c, g, or t
  misc_feature (115)..(116): n is a, c, g, or t
  misc_feature (118)..(118): n is a, c, g, or t
  misc_feature (120)..(120): n is a, c, g, or t
  misc_feature (122)..(123): n is a, c, g, or t
  misc_feature (130)..(130): n is a, c, g, or t
  misc_feature (165)..(165): n is a, c, g, or t
  misc_feature (198)..(199): n is a, c, g, or t
  misc_feature (228)..(228): n is a, c, g, or t
  misc_feature (248)..(248): n is a, c, g, or t
  misc_feature (257)..(257): n is a, c, g, or t
  misc_feature (352)..(352): n is a, c, g, or t
  misc_feature (424)..(424): n is a, c, g, or t
  misc_feature (458)..(458): n is a, c, g, or t
atcatagtgtccaagtgtgcactcaggtacctcatcatagtgtcccagtgtgcactcacccggcctcctcatagtgttccagtgtgcgctcactcagcctcgtcanagngnnccnntncncnntcacctngcctcatcatagtgtcccagtgtgcactcacctgncctcactcatagtgtcccagtgtgcactcaccnngcctcatcatagtgtcccagtgtgcgctnacctagcctcatcatagtgncccagtgtncactcacctagcctcatcatagtgccccagtgtgcactcacctagcctcatcatagtgcaccagtgtgcactcacctggcctcatcatagtgtcncagtgtgcactcacctggcctcatcatagtgtcccagtgtgcgctcacctaccctcatcatagtgtcccagngtgaactcacctagcctcatcatagtgccccagngtgaactcaactagcctcatcatagtgccccagtgtgcgctcacctggcctcatcatagtgccccagtgtgca

SEQ ID NO: 686820 - DNA, 424 bp, Homo sapiens
gtcgaatcacagaactcagaggaaaaaaaaaataaaatttaagctttcgggaaagcagcccctcttgggcaccatcaaacatttcttggttccccttaaattgggaactcttcaaatatcaggggtggtgcgggttgggccatacttttatctggggtccttgtgagtgacagaaatgggtgcggccgggaaaagatctccctccttaacatttcctcttctccctcctcctctttatactaaacccggtgcctcaccagacggggcagggcgctctggaaggagagatcccgggcccaggacaggagatgccaattctaatttatctcacggagggccttggaaaaaaacgcttcggggccaggctcaggggctcaggcttatataatcccagtatttggaaaagctgaggcatgaaaatagt

SEQ ID NO: 686821 - DNA, 363 bp, Homo sapiens
caaaaaaaaatcttcggttaaatcatcaagtcatggactggcttagtagccctgaaagctttcatgaatttagaaatccatggcccggcacggtggctcacacctgtaatcccagcactttgggaggccgaggcgggcggatcacgaggtcaggagatcgagaccatcccggctaaaacggtgaaaccctgtctctactaaaaatacaataaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagaatccgtctca

SEQ ID NO: 686822 - DNA, 215 bp, Homo sapiens
ctttgtaaacagattaccagtttttcacttgtgggtgtgactcttcaaaatatttctttattcataattaaaattaggtttaaattttcataatatgagactattctataggcagtgcttgcttgaaaagtcttatttttaaatctcccttgcatgaggtgcctacttccccttttcaaatctatcatatatcatactttgcttctaaaaaaaaa

SEQ ID NO: 686823 - DNA, 527 bp, Homo sapiens
cagaatatacgcacagacaagccatgcttgtatctgcagcacagcatcctaactcaaaccaatggcctataggtaacgatgggattggaccacgacatggtatagggctctaaccatgtggcaccatttcctatacaataaatatgacaaagtactaggttctcttataatctgacccttgtaaaagtgactccatcaatttcagaggtacccaatgtaaaccagaagggcagaatatctgcgtgttcaagttaggttttatcagatatatagtggaaactaacagaggaaaaaacacttaacatacaaattttgtacatatatttgatttacaagagagacccgaaacattcatcatagcagggctatatagggtcccagaaacatgttggatggtacaaaagagtacagggtacttcgacgtgtgacattacactaagggactatattatgtcgggtaattgaactgacctaacaaatgtgctgtatcttatatagcacagatacgtatatgagtccccgactgg

SEQ ID NO: 686824 - DNA, 334 bp, Homo sapiens
gagacggagtctcgctcttttcgcccaggccggagtgcagtggtgctatctcggctcactgcaagctccgcctcctgggttcacgccattctcccgcctcagcttcccgagtagctgagactataggcgcccgccacagcgcctggctaattttttgtatttttagtagagacggggtttcaccgtgttagccaggatgttctcgatgtcccgacctcgtgatctgcccgcctcggcctcccaaagtgctggcattacaggcgtgagccaccgcgcccggcctttttttccttcttgttcagtttattaatgatgccccttctgtcgtcttctc

SEQ ID NO: 686825 - DNA, 170 bp, Homo sapiens
ggcacatgggctctgggcaaggagtgggagcgtgggtcgctcacctccctctccttaccttgaggctctatggaggaccccttggttctgccccactcccatttaaagatgaggaaactgaggctgtgttgtggcagggagggctaagggctcgcgtggaaccggagctc

SEQ ID NO: 686826 - DNA, 376 bp, Homo sapiens
  misc_feature (38)..(38): n is a, c, g, or t
  misc_feature (186)..(186): n is a, c, g, or t
  misc_feature (316)..(316): n is a, c, g, or t
  misc_feature (322)..(322): n is a, c, g, or t
tacaggtgcatgccactgcacccagctcattgcctttngttttgtatgttaaagcagatttagcccatgaacttggagacagttttgctgagcagaacttcatctcttggctttgctgtttgtttgccttgttttttttgttggttttacttagttttgtttttggagctaacatccataactttngctatgtatgatataatcccctgtatgaccctgggcaagtaacttaacccattcagggtccaggttcctcttatgggaaaggggatgcttgataagacactgttcatggttccttgcagttttactattnatgganaggatattcggatggacctaaaaatttaaacccagtttccctttttccaaattt

SEQ ID NO: 686827 - DNA, 312 bp, Homo sapiens
  misc_feature (18)..(18): n is a, c, g, or t
caggcaaaaacgtccccnaagccagcagttgtagagactgtttcaacagccaagccccagcagatccaagcgttgatggatgaagtgccaaaacaaggaaccattgtccgagaactgaaagcccaaaaggcagccaagaacgaggttgctgcggagggggcgaaacttttggatttaaaaaaacagttggctgtagctgaggggaaaccccctgaagcccctaaaggcaaaaaaaaaaagtaaaagcccttgggtcataaaaagtccctttaatagatagggccagtaataaataaatgtccaatttttata

SEQ ID NO: 686828 - DNA, 899 bp, Homo sapiens
aaagactgtaatttcatgttcgttttgaggaatctaagccagtttaggggaacacaatctgcttctggggaaggaggtgcaatttgcccaggtgtgagtaaactttccccataataagtaggatggaggcttcacagtctgctctgtgtggccaagctctctaacatactgtggctccatttcagctcctccaggttcctcaagggcatcttctcttagaaggagccaaacacatggcttggtagagatgctcatatgtaagtcatcagctaggatgacaattacagtgcttccatctaagcagtagtatgtcctcttttctttctgagatctaacagtgaatgttatagaccaggtccagtgggctctcattgcatgccttcttattccagttcctgtgagaggtgagacaagccactcaggatttttttttttaaacctttcttggctgtgagatattaacaacatttccttgtttcatattcttggtaacaaaaaacaaaaagggtcgggggggatacctaattggccaccaagtactgggatatattaaagcctgcgtcactgatgattcacctaagaaaaaaacacaagaaacgaacaagaacacatagtttgagcacacgatgagggcaccatagagagatgttttgaaaaacgaaagtgctgagggcgcgggacacaaatgataagagatgaaaaagggggagaaaagagagtgatacataaagaagaacccgggggacaacaaaacagtggtgtagaagtctccacagaatagaaaaagcgcccggggcgaacacgcaaaaagtcgttcagaaaaacacagaaagggagatcatgaggggcaaaaacgggagtactaaacaagagaagacgagaggcgccataacaaatac

SEQ ID NO: 686829 - DNA, 296 bp, Homo sapiens
tagcatgttgtacagccatttaccaagattgttgtaggttaagaagggcagatttattagagaaattgtgaaacatatgttgcagtgggcagctcagcatagaaggggctacctgcaaggaggctaggttctggaggaaagtttatagggtcctgcgttaagggtgctatgtgtgaaatgaggtcattgtgcccgcaggttgtttgtgattagctgtctctaacaattgttcatacaataattgttcattattgttctcaacttggggctctccccaacctggggacccttcctta

SEQ ID NO: 686830 - DNA, 789 bp, Homo sapiens
aagcagaataaaatatttaatatgtaatttacaatgtatttcaccagctcagcgatacaggatgtatacagattatatcaaagtagtagacagttacgggcctgtgcaaaccctgcaacaaatagtacttcagatatctgcgtaattaatagaacaaacacacagcttatgctgttgtagaatgtgatacaatttcaactaccacaaaaatacaaagggctgcaaaaatgtgaccattccaacaacatatataagttattaaagtaagagattcgattctgaaagaatataaagtgaagacgtttaagtaggtctttgtctacatgcatattattcctcattagaagaaacaatatatgtaaaaaggccatggggtaattgctttgttaacatttgtatgcgccggagcatcggtggtctcacgcctgtaatcccagcactttgggaggccgaggtcgggcggatcacaaggtcaggagatcgagaccatcctggctaacctggtgaaaccccgtctctactaaaaatactaaaaattagccgggcgtcgtggtgggcgcctatatgtcccagctactcgggaggctgaggcaaggagaatggcgtgaacctgggagggtggagcttgcagtgagccgacgatcatgccagtgcactccagcctgggtgacaagagcgaggactccgttcaaaaaaaaacgaaaaatactcagacgccgcacacctttgtcgaaaaaggccattctctggcaaaaatcaattatctaagcctttaaggctccgaggcca

SEQ ID NO: 686831 - DNA, 118 bp, Homo sapiens
  misc_feature (3)..(3): n is a, c, g, or t
gcncgcggacgtggtgggcgtggcgctttggtgcttgccttgttttacggtactacgcttttctacgtcacggttacggtctacggacggcgtcgcgggcactgctttggcctctgga

SEQ ID NO: 686832 - DNA, 442 bp, Homo sapiens
gcgcctgtcttggtctcgcaaaaggcgagattgagctctgatcggcctgcacccgtctgggaagtgaggagcgtctctgcctggttgcccatcgtctgggatgtgaggagcccctctgcctggctgcccagtctggaaagtgaggagcgtctctgttcggccgccatcccatctaggaagtgaggagcgcctcttcccggccgccatcccatcaaggaagtgaggaggcgcctcttcccggccgccatcccatctaggaagtgaggagcgtctctgcccggctgcccatcgtctgagatgtggggagcgcctctgaccgccggccccgtctgggatgtgaggagcgcctctgcccggtcgtgaccccgtctgggaggtgaggagcgtctctgcccgggcgccccgtctgagaagtgaggagagcctctgcaatgaacccacg

SEQ ID NO: 686833 - DNA, 1050 bp, Homo sapiens
cactccaccttactaccagacaaccttagctaaaccatttacccaacactaaagctataggcgatagaacatgaaacctggcgcaatagatatagtaccgcaagggaaagatgcacacattatcaacccaagcatactatcagcaaggcactaacccctataccattctgccataactgaattcaagctcagcaacatcaactctcgcaaggcagagccaaagcctaagacccccgcaaaccagcacgagctacctaagcaacagctcacacacgcagcaccacccgctcctatgctagcaaacatcagctggcgcaagatctcctcacggtcagaggcgcacacaaccataccgcaggcccagggactgaaatagacctggcacgctaccaacgcactcagacaatctcgagccgccaaaactagaaaacaaggggcccaacagaacaacccaatcatacaactacccacatggcgaaaactgaaaacatgataagatccaccacagacggccgcaagcgtctgccgggcccccacaacgcggacaaaaacaccccaggtaaacagaagccgatcacacaaactcccacccaacaccccaaaagcacaggcccctcccaccgcacccacaacaccacaatccacagcaccacgacgatcacccaggaccacccacccgcaacccaacatacccgcgcaacaaccacactcgcacaacacaagcataaataccactggacacacagcagtgcacaaacccaccaaaaataggcccccacagactcaaacaaacgacagaacgcgcacaacaaacgacaaaaggagccagaaacatacaggacaacaccatgacaaacaccaaacctcacctaaccgcgatcaccaccaccgccacgccaaagccacccacacaatagaaccaggacacaccgcgaacaagagcccccagacaactaaagcaaccccaaccaacacaaagacacatagataccccctcaagatggaacacccacaaaccagagccgggtcaacacgcaaacgggacaaaag

SEQ ID NO: 686834 - DNA, 302 bp, Homo sapiens
ggtcgactacgcaggaggctgaggcaggagagtaggcgtgaacccggaaggcggaccttgcggtgagcagagatcgtgccactgcactccagcctagctgggactaaaggtgcccgccaccatgcccggctaatttttgtatttttagtagagacggggtttcgccatgttagccaggatggtctcgatctcctgaccttgtgatccacccgcctcggcctcccaaagtgctgggattacaggcgtgacagccgcgcccggccggttgcctttacttttcaatctgttgaaccaagtcgacg

SEQ ID NO: 686835 - DNA, 346 bp, Homo sapiens
gacccccacccttggaccccgctgtccttttctagttgtttactgggtgggggcagccagtctgaccttgtctgggggtctggacggtccctaaggtgtgtaactttcagtattatctggtgacagatggttcggtggtgaaaaaggtttattatatcccttatggcggccttgtacaaaatccgttagaaacgctaaggtaagatatcagatttctaacaagacaaaaacagcatcatggagtcaaaagattttcacagagggggtctggatttgggaggtgagcgggttttcagctctcaagggtggtcacttaaataaaaaccttcttggcctttaaaaaaaa

SEQ ID NO: 686836 - DNA, 444 bp, Homo sapiens
  misc_feature (1)..(1): n is a, c, g, or t
  misc_feature (301)..(301): n is a, c, g, or t
  misc_feature (432)..(432): n is a, c, g, or t
naggaaaagtgggcgcaggggacccgcgtcagcatacggaggacccgcgccggcaccagcctctgagttccctcagtatttatcgatcattatcgggcatttctgggagagcgggatgtggcaggacaatagggtaatagtggggagagggtctgcaggaaaacatgtgaacaaatgtctctgcatcataaacaagttagagaaaaaagtgctgtgcttttgatgtgcatatacataaacatctcaatgccttaaagagcagtattgctgcccgcatgtcccacctccagccctaaggcgnttttcccctgtctcagtagatggaatattacaatcgggttttacaccgaggacattccattggcccggggacgaggcagggacacagatgccttcctcttatcttcaactgccaaagagggcttccttccnttttactaattt

SEQ ID NO: 686837 - DNA, 452 bp, Homo sapiens
  misc_feature (216)..(216): n is a, c, g, or t
  misc_feature (392)..(392): n is a, c, g, or t
gagtggttggtacatgggctgctgctgctcctccatgtctcattagcctcctctgtccctgagccccgctccacctcggggtacacgaccacacacatcttctggctcaccagtgttagcagctcaatgaagtcactgaaacacttgggcttgtgttgccagtaaacacccaggaaatagacaggcactcctgtcagcagtgatggccatggccanatgccactactaccagccggctctgtaccacatggctgacagaccacgcaggcaaggcccagtaacagcacagtagcatgatggggaacacgcaggttgactcttgactggcggcgggggactatcacggcttcttccacgcgaaggactatctcgtccagcataccgtgaccccnatagaaagaggtagttgatgaagcccacatagttgatgagtgtgtacatgtcgctggtga

SEQ ID NO: 686838 - DNA, 250 bp, Homo sapiens
  misc_feature (185)..(185): n is a, c, g, or t
ctatcacattatcaaagagcacatatgtacaatgcattttacaagagaacagaacattaccaatatcagctggcagtaagggcaagctgaagaataaatagactgatgttgcctgggcaatgtctagtcctcaaacgacatccaaacgtgcgttcaggcgagctgaacacagacttcttgcccangtgacaaggcatatgtggctcagtaatacaatacgatggatacattgtgactagccgggctaccg

SEQ ID NO: 686839 - DNA, 127 bp, Homo sapiens
aaggttgtgtgtctccaacagcttgtttatgttgggcctctggttctccggccactcgcatccgcccgcacacactctaaccgctcctcccagcgtagaagcacagggtctcggcaaatgttccctg

SEQ ID NO: 686840 - DNA, 152 bp, Homo sapiens
caattctattttcagagttgactgtactcttttcctctgaagatacacgtataaacgcgaccaacgaggtctctcgtcctaataacaggttcaggcatgaatcaccgtctaacagctatttaaacaccgcctcttcatagaagtaacgccga

SEQ ID NO: 686841 - DNA, 986 bp, Homo sapiens
  misc_feature (18)..(18): n is a, c, g, or t
  misc_feature (115)..(115): n is a, c, g, or t
  misc_feature (166)..(166): n is a, c, g, or t
  misc_feature (187)..(187): n is a, c, g, or t
  misc_feature (352)..(352): n is a, c, g, or t
  misc_feature (583)..(583): n is a, c, g, or t
  misc_feature (610)..(610): n is a, c, g, or t
  misc_feature (678)..(679): n is a, c, g, or t
  misc_feature (720)..(720): n is a, c, g, or t
  misc_feature (736)..(736): n is a, c, g, or t
  misc_feature (752)..(752): n is a, c, g, or t
  misc_feature (802)..(802): n is a, c, g, or t
gggaaagggaagaagggnggaagagaagaaaggaaggggaaagaggaagggagaaaggaatagaaaagaaaatttatgaaataacaaagaagaaaaattttaaagacaaaagccnagtgaagtgtgagttagtcttataatataataagatgaagaggaaaagatnaagtaagaggaagaaaagggnacatggagtatcatagctaagtttaattaagacaaaacacaaacaacaacaacaagagaaggacgacaatgtctgagggcgtcacgaacccagagggatggatcgcatgtagtaacagatatgtaggtccaacggggctgaatgccaagacatgttcgggatagnaagagatcacgaaagacacacgccgagtcagtaggaaaggtatggaagaggtttgtagctagagcaaccggcatgtttattaagcacagaggccccatcatactaaccgaatagagatagatgtagctcccgcgcatgaagcgatataagaaaagaatgagtggagcgctgaggagaccgacccaatttatagtaatgtcatataaaatagtatgatactattaaaaagtnctagagcaaatatggaaatagagaatnaacaagaacctagtgtgaggtatttcagactacgcggcccgcgacttctgcggcgcatgggagaattnnttaggtactgggtccgaagtaatgcctattttattaagtgntagaggaaaagagtgncaaaaaaaatgatgtnaccctgagtgcttaagagtacttcagaagccctctcttaggtctagtcanccacccacaacatcaaacagatccaagagcagcgttccccctttctcccagaaattgaactaagaccacagaagactagttgcctcaccaagacaggacactacctcaaacgagacataaccgaaagaaaactaattataccaaaatcccaaaaatagaagcacaagtgaagactatagcgagt

SEQ ID NO: 686842 - DNA, 1919 bp, Homo sapiens
  misc_feature (89)..(89): n is a, c, g, or t
ttcttgtacttctgtggttttttcatatggtttttgtgttttcgtgggatcctctcctcgtgtctggccgttgtgtactatctcttgcntgctccgttttcgtcgtgtgcttgttctgtctgttgtctgttacagagttagttgtagttctatcgctggtctactacttggtgcttagtttttccttctatgtgttggcgtcgtgtccttctgcggtgggtgttctgttatgcctgcttcctgttctttgggccccttatacaaggggctaatttctccgttgttttgatgggtccccctggtgtggtttcccttgtgttccttccggggtggcgctcgttgtgactcctcctcattgggtggatgtttattgtgctttctcggccgttcaatcgtcgtctgtgtttctttggactacagatagtcttttccctggtgtgtccttgcggtgttgtgctccctctgttaatgccggctactcgcgcatgtttggtggtgaacgtcccctcttgctgttcgtcccatattgcgtttgctgtgtcttgctcttgtggtggggttatttcctcccgtcggtcctctcgtcctccctgctgtttttgtgagtgatgtctactattcggatgttattcctccacatagtggccacccacacccccccggggtggtttgaatataggagagtgttctttattatgcctcacatattgtactcaagctgttgtttggtagagttcttagtatgactctgtgtcgtcgtgtagttaaactacggggcgtcctaccacagagtctttgtgaagaagaagttgttctttgtatagaggggggtagcaactcctcgctgagatattgattcttcgtgccgcaccagtccgtcacaatatttgtggcgcccgacaaataggagttgtatattagattataaccctagaggcccctcccctagatgaatctcttcttgggcctccgctctctccgcgttgattacgccccagggtatagtataaggagcccgtgtgtcacatcagttgaattttgtatttctctatgtgtctccagcactccacctgggtgtagataagaggcctcccaggatctccgccacaattgtgcgtttgggtcccggtataaggacgcccctcataagtggtcttttttaaatgcccttgttgaagaccctttatgatcctcgggtatcacgcttggggctgctgtcttagcactgtttctgggaacacacgcacacacatataaatggtggagagaatagtccagcacacacgccagtgtctcaactgtggtagcactgtttgtgtccccgcgagcaccagcgtgtattgtgttcttagatcccgcgtttgtgtctcccccacatacagtgtgctccccctagaaggacattcctcccacacacactttatctctttatggtgcgctcgtctccatacctctgtgcggtatagttctcacaccagaccatgggtgtgcttctcagagccctatgggggtgtaatatatagtggagcgccctcttacgcctgatagctccccacgatgtcccaagagggacactccagaaatccactctgtcccagatgggagccagccagagaatagtcccagggttccagaatagccaagattttgatagaggaacattgtatcggagtccaagaatgagatttaatggagactgggcttggcccgggtaatctggggacaaaggaagccagatatttcctgattttggctttagcttcccctcccagattttggtttttggtttgtttatttgaacctttagagtcggtgtaataaactcacccgtggccaacctaaaaaaatatgaaataaatattacttcgagcagtatatgctcgggctgagaagagtagatagtccttggtgtttctcgt

SEQ ID NO: 686843 - DNA, 159 bp, Homo sapiens
  misc_feature (93)..(93): n is a, c, g, or t
cacttgtgaaaccacccggcagcccctctccgcccctcgtcgtaatgccttcccgcatttcataggaattcattggaccagacctgtcaacgncgatttctcgctaaattttttgtcatttttgaatcttcgtccagagaatgtagaactccttcagcc

SEQ ID NO: 686844 - DNA, 166 bp, Homo sapiens
gtcgtgatatcacgctggggcgcaggacggccaagaggtggacaacagcaggctaggccccaggtattgccctccacggaaccctaagtcccacccttggctggggtctccctgccttgaatgagcgtctgaggaggggctgccaagcagggtttgtaggagcact

SEQ ID NO: 686845 - DNA, 957 bp, Homo sapiens
cgctttgtgcccatttacaatatctgtcaaatgcagtaccctctcaaaatacactcttcccccccataggcccctttataacaaaatacggggtctcacaacattcggttttccccttgaaaattccccagttgcacagaaccccctctcggtaattttaacccacattgtcgaattggtgaaatgacgcctaaattcgaaacattgtaataatttgttggcgcactttctttaaaaatttgccaccttgtcgcaaaactccaaattgtttcaaacaacatgcccccccccccacttagttcttttgggtcacgcaaatatccaatacgccaaggattcttccgggaaacctaacttgtgcgccaacaaaatcatcctttcccgctccaatagaatctctcatcgcctccgatacactaaacctttgcaacaaaaaaaatactattctggtagcaaaagtctctccgcctttaacatgcgagtcccccaaaatacggcggtattattttttttgcccccccactaatatcaaatcgcgcaaatggagacatttgaagtaatttccccaataccctccacagacagctcaacaaagaatttttcattctatgtacgtcccccacttgtttctatataaaactcccctgtgataaagacaataggggatgaacacttaccactcacaaaaagatggcagctgcccccgtaaaagagtgttatgtctccgttgacgggaagaaaccatgtctttcccgcgggcaacacccaactggtgagaagtttataaaaattctcatgttggcccgagcggcgcggtggagctccccacgcccggtaagtccccacccccgccattggaggagtggctaagagggggtgaggaggacacaaccacacattccacagaaggttaaacccagtcgcccacggggaacccccttttcgccccacaaaaca

SEQ ID NO: 686846 - DNA, 747 bp, Homo sapiens
agaattgtgggcagatttaaacactctgtggcattgtgaagcggctcgtacatataaagaaagatagacacaagcacacatatttaattagcactgcttgatggagactgttcaaaatctccttgggtgtaaagcatttgttttgagcattttaaataaggagtgcttctggaaaaataagggttacttatttaggccctttgaggttgaaaatggatttttctttccaggacttgattccttccgagtgcaaataacaacggcatcacttgtacttcgataagaggtctgcttgtgtggcttccagaaagagcagcaggagatgtgaataattttacagtgaggaagttgcaactgcagattagcctttgtgacagcttcaacctgtggccccagataaccagtgattaattgcctgccctgggtcccttccttttttcagactccaggtttcccttgagcctgtattgagacggtgaatttcgttctgagggttctgcgtgggccggcgtgttgtgtggagccgcgtggcgcggggagcgcagcacggtcacgcagaccgaagctttcactgcacggccggactcgttagtgcgaatgagcctgtgtcccgcgtgcaccgagggagccgagcagcgcaggcggccctctagccccgcacggccagcgcgccgtgggggatgcgtccctttgcctccgccacgctcacctctacccgaccgctgcctctgtgctccgggcggccgc

SEQ ID NO: 686847 - DNA, 480 bp, Homo sapiens
  misc_feature (1)..(1): n is a, c, g, or t
  misc_feature (108)..(108): n is a, c, g, or t
  misc_feature (111)..(111): n is a, c, g, or t
  misc_feature (201)..(201): n is a, c, g, or t
  misc_feature (220)..(220): n is a, c, g, or t
  misc_feature (296)..(296): n is a, c, g, or t
  misc_feature (309)..(309): n is a, c, g, or t
  misc_feature (321)..(321): n is a, c, g, or t
  misc_feature (366)..(366): n is a, c, g, or t
  misc_feature (387)..(387): n is a, c, g, or t
  misc_feature (390)..(390): n is a, c, g, or t
  misc_feature (407)..(407): n is a, c, g, or t
  misc_feature (435)..(435): n is a, c, g, or t
  misc_feature (472)..(472): n is a, c, g, or t
ngccgcagctgttggttttcggaatcaccacttcaaagccctgcgcttcatactgtttacggatgttgttcacttccgattcgaagctaatcagaacatcgcccaggncgngctcggaaaaagtggtggtcgcgccacgaccgccagtatcgaacacttcaacgtttttcaggaactgggtcataaactgttcggttttgnctttgtcaccaccgtcagntttatccgctgcgccccatgccgtcagataggtataacgcgcgttacccgacgttttcgggttcgggaaaatcagnttcacgtcggagngcaccaggtcgntccaatcgtggatattcttcgggttacccttacgcaccaggaagnccatggtggagtaggaacggngancttttattcgggaaggngggactgccagtcgggccgggatcaagnttggcttttatcggggaaggattttggtccgtcgggncaacctgg

SEQ ID NO: 686848 - DNA, 609 bp, Homo sapiens
  misc_feature (381)..(381): n is a, c, g, or t
  misc_feature (386)..(386): n is a, c, g, or t
gggacaagacagaaatttgagatgaataattccaccaccaccactagtagcagcaactccaaggattgtggaggtccggcctccagtggggctggtgtaccgcagccttagctgatggcctaaaatttgcttctgttcaggcctctgctccccaggggaattcacacaaagagaccagcaaatcaaaagtgaaaaggagtaaaacttctaaggatgctaataaatctctgccttctgctgccttgtatgggattcccgagatcagcagcactggcaagaggcaggaagtccaagggcgccctggagaggcaactggcatgaattcagcgctgggtcaaagtgtgagcagcggcggcagcggcaacccaaacagcaatagtnccagnaccagcacctctgccgccaccgcgggggcaggctcctgtgggaaaagcaaagaggagaagccaggtaaaagccagagcagccgaggcggcgtgcaccgagggagccgagcagcgcaggcggccctctagccccgcacggccagcgcgccgtgggggatgcgtccctttgcctccgccacgctcacctctacccgaccgctgcctctgtgctccgggcggccgc

SEQ ID NO: 686849 - DNA, 546 bp, Homo sapiens
gagtccgagtggactgagcgatgctgagtggttgtgtgagtcgcgtctcggaaaaccggtagcggttgcatgtatggatgatctaagtgtacatgattagtagtcgagattgcgagaatgtcgacacagaagctgtgttcacatgattatgacgaaagcatggttgatggcacacttataatgaaggaaaggaaatgggggaagcatgtaatggagtatgctccttggggggccatggtatagtcccgcgacgagtgaaagttaagagatttactagcggacattgcattaaatggacagctagagtgctgtagtgtttgaatgagctctcaatttgacttcccatgtacacttctcttgacatagtgatggctgagaaaagtggatagacacatgactagtgatagaagaaagttagagaatgcattccgggtgtttgatagggatgggcagggctatatcagggctgcagaacttcgccatgtgatgataaaccgtgggtgagaagttgacagatggagaagttgatggagttgatcagggaag

SEQ ID NO: 686850 - DNA, 1358 bp, Homo sapiens
  misc_feature (381)..(381): n is a, c, g, or t
  misc_feature (386)..(386): n is a, c, g, or t
  misc_feature (847)..(847): n is a, c, g, or t
  misc_feature (860)..(860): n is a, c, g, or t
  misc_feature (876)..(876): n is a, c, g, or t
  misc_feature (1269)..(1269): n is a, c, g, or t
  misc_feature (1326)..(1327): n is a, c, g, or t
gggacaagacagaaatttgagatgaataattccaccaccaccactagtagcagcaactccaaggattgtggaggtccggcctccagtggggctggtgtaccgcagccttagctgatggcctaaaatttgcttctgttcaggcctctgctccccaggggaattcacacaaagagaccagcaaatcaaaagtgaaaaggagtaaaacttctaaggatgctaataaatctctgccttctgctgccttgtatgggattcccgagatcagcagcactggcaagaggcaggaagtccaagggcgccctggagaggcaactggcatgaattcagcgctgggtcaaagtgtgagcagcggcggcagcggcaacccaaacagcaatagtnccagnaccagcacctctgccgccaccgcgggggcaggctcctgtgggaaaagcaaagaggagaagccaggtaaaagccagagcagccgaggcgccaagcgggataaggatgcggggaaatccaggaaggacaagcacgacctgcttcagggccaccagaatggcagtggcagccaggccccttccggggggcacctctatggctttggggccaagagcaatggaggtggcgcgagccccttccactgcgggggcactgggagtggcagcgtcgccgctgcaggggaagttagcaaaagtgccccggattcagggctcatgggaaactctatgttggtaaagaaggaagaggaggaggaggagagccacaggcgaatcaagaaactgaaaactgagaaggttgaccccctgtttacagtgccagcgccaccaccgccgatttccagcagtctcacgcctcagattcnaccctcctacttntccccatcttcatccnatattgcagcaccggttgaacagcttttggttcggactcgttctgtgggtgtcaatacatgtgaagttggagtagtgacagagccagagtgtcttgggccctgtgaacctgggaccagtgtgaatttggaagggatcgtgtggcatgaaacagaagaaggtgtcctagtggtcaatgtcacgtggaggaacaaaacgtacgtgggaaccctactggactgcaccaagcacgactgggcccctcccaggttttgtgagtcaccgacaagtgacctggagatgagagggggccggggcagagggaagagagcaaggtctgctgctgctgccccgggctccgaggccagcttcacagagtccagagggctgcagaataagaacagagggggggccnatgggaaaggaaggcgggcagcctcatgcagcggacgaagaccccccaattgtgctnntgagatatcaaagtcagctcctcctcagtac

SEQ ID NO: 686851 - DNA, 89 bp, Homo sapiens
ccgcagctcttttcgtattcttgctgaacttatattcgcgtcctatcgagcattaggccaagagctttgatcagatgaatcaggcagga

SEQ ID NO: 686852 - DNA, 1342 bp, Homo sapiens
  misc_feature (381)..(381): n is a, c, g, or t
  misc_feature (386)..(386): n is a, c, g, or t
  misc_feature (847)..(847): n is a, c, g, or t
  misc_feature (860)..(860): n is a, c, g, or t
  misc_feature (876)..(876): n is a, c, g, or t
gggacaagacagaaatttgagatgaataattccaccaccaccactagtagcagcaactccaaggattgtggaggtccggcctccagtggggctggtgtaccgcagccttagctgatggcctaaaatttgcttctgttcaggcctctgctccccaggggaattcacacaaagagaccagcaaatcaaaagtgaaaaggagtaaaacttctaaggatgctaataaatctctgccttctgctgccttgtatgggattcccgagatcagcagcactggcaagaggcaggaagtccaagggcgccctggagaggcaactggcatgaattcagcgctgggtcaaagtgtgagcagcggcggcagcggcaacccaaacagcaatagtnccagnaccagcacctctgccgccaccgcgggggcaggctcctgtgggaaaagcaaagaggagaagccaggtaaaagccagagcagccgaggcgccaagcgggataaggatgcggggaaatccaggaaggacaagcacgacctgcttcagggccaccagaatggcagtggcagccaggccccttccggggggcacctctatggctttggggccaagagcaatggaggtggcgcgagccccttccactgcgggggcactgggagtggcagcgtcgccgctgcaggggaagttagcaaaagtgccccggattcagggctcatgggaaactctatgttggtaaagaaggaagaggaggaggaggagagccacaggcgaatcaagaaactgaaaactgagaaggttgaccccctgtttacagtgccagcgccaccaccgccgatttccagcagtctcacgcctcagattcnaccctcctacttntccccatcttcatccnatattgcagcaccggttgaacagcttttggttcggactcgttctgtgggtgtcaatacatgtgaagttggagtagtgacagagccagagtgtcttgggccctgtgaacctgggaccagtgtgaatttggaagggatcgtgtggcatgaaacagaagaagagactccaggtttcccttgagcctgtattgagacggtgaatttcgttctgagggttctgcgtgggccggcgtgttgtgtggagccgcgtggcgcggggagcgcagcacggtcacgcagaccgaagctttcactgcacggccggactcgttagtgcgaatgagcctgtgtcccgcgtgcaccgagggagccgagcagcgcaggcggccctctagccccgcacggccagcgcgccgtgggggatgcgtccctttgcctccgccacgctcacctctacccgaccgctgcctctgtgctccgggcggccgc

SEQ ID NO: 686853 - DNA, 1541 bp, Homo sapiens
  misc_feature (381)..(381): n is a, c, g, or t
  misc_feature (386)..(386): n is a, c, g, or t
  misc_feature (847)..(847): n is a, c, g, or t
  misc_feature (860)..(860): n is a, c, g, or t
  misc_feature (876)..(876): n is a, c, g, or t
  misc_feature (1326)..(1326): n is a, c, g, or t
  misc_feature (1398)..(1398): n is a, c, g, or t
  misc_feature (1504)..(1504): n is a, c, g, or t
gggacaagacagaaatttgagatgaataattccaccaccaccactagtagcagcaactccaaggattgtggaggtccggcctccagtggggctggtgtaccgcagccttagctgatggcctaaaatttgcttctgttcaggcctctgctccccaggggaattcacacaaagagaccagcaaatcaaaagtgaaaaggagtaaaacttctaaggatgctaataaatctctgccttctgctgccttgtatgggattcccgagatcagcagcactggcaagaggcaggaagtccaagggcgccctggagaggcaactggcatgaattcagcgctgggtcaaagtgtgagcagcggcggcagcggcaacccaaacagcaatagtnccagnaccagcacctctgccgccaccgcgggggcaggctcctgtgggaaaagcaaagaggagaagccaggtaaaagccagagcagccgaggcgccaagcgggataaggatgcggggaaatccaggaaggacaagcacgacctgcttcagggccaccagaatggcagtggcagccaggccccttccggggggcacctctatggctttggggccaagagcaatggaggtggcgcgagccccttccactgcgggggcactgggagtggcagcgtcgccgctgcaggggaagttagcaaaagtgccccggattcagggctcatgggaaactctatgttggtaaagaaggaagaggaggaggaggagagccacaggcgaatcaagaaactgaaaactgagaaggttgaccccctgtttacagtgccagcgccaccaccgccgatttccagcagtctcacgcctcagattcnaccctcctacttntccccatcttcatccnatattgcagcaccggttgaacagcttttggttcggactcgttctgtgggtgtcaatacatgtgaagttggagtagtgacagagccagagtgtcttgggccctgtgaacctgggaccagtgtgaatttggaagggatcgtgtggcatgaaacagaagaagtatttcagctagtacaagggaagtgcctattagaagcaatgggccgcttgaggacatggattgcatccagtagtggcgcattcaccaaaaggcagatgaaaataatctgtaccaacaaggatcacaacaggaaacatcatgtgaattttccactattgacaatcttgactatctagcctgggatttgcattgccaagcaacacgttaaataattttgtatctctttgaaatcaatttctggtgatcacacatgcagattgaaaactatggctttaagatttacgttcagtnaataaaatttacgttccctgaaaggcaaagaaggctgtcatttcatgcctcctaaccttcattgtctatttncctttggtacacacaagcaacctagtacgcacaaacgtacatgcccattatggagagatagctttctgctctgtcaactttgttttataaaagctctgttttcttnattgcctttatcctattacatctgtaaattttatttt

SEQ ID NO: 686854 - DNA, 401 bp, Homo sapiens
  misc_feature (44)..(44): n is a, c, g, or t
  misc_feature (280)..(280): n is a, c, g, or t
  misc_feature (317)..(317): n is a, c, g, or t
ttattctaggctgatagtttgatactgcttatataatggaaatngcccaccgagctttctcgagatggccctactctctattccgtggcgcactatgtagcaccggatgagaataagggctaatacggcagctattctggcttcttacccccaatctaggctaaggctttgacgagcagagtcttcttactgatgaccatcttagctgcgctcttgggcttgaaaagggccgtagaatccggatccctatgtcgccttacacccgcggtcttacggatanatggacgattttaaatgcctctcccaaggtaagctcnagagctaaattaatagggattaaattctctatgcttaatgagctaaggcaggcgacggcggcttatttctcttgcagggcgtgg

SEQ ID NO: 686855 - DNA, 304 bp, Homo sapiens
tgcatccgtgggaggagcttcacgtcggcgtctcacgtcccgcgtgtgtattgccgggactcggagttcctgtggtgagcgacgggctcctggccatgagggctcaggcgctgtttgagcatcctcacagcatggtggccacttcctaattgtcctccttactgaactgtaagctccacaaagaaacagtaggtgttcctatacagtctgtggttggctgaatacacagctgagcttgaggggaaggcatcacaagtgcaaacagtaaccgatgcttttcctccagcagaggctggaacatact

SEQ ID NO: 686856 - DNA, 226 bp, Homo sapiens
gggtgatctagcaggatccttaagacagacactcggggaaagaaggaagtttatgtcccaaggggaacaaggattgctgcttgaccttccacacagacttctccaacgaggagaatgggaccatcatgtctacaagggcttccttggcctactaccaatgctgtggaccttgatgaattgtgcttcccggaatcaaattagtgggatggaggatccccatgcccca

SEQ ID NO: 686857 - DNA, 311 bp, Homo sapiens
  misc_feature (5)..(5): n is a, c, g, or t
  misc_feature (31)..(31): n is a, c, g, or t
  misc_feature (78)..(78): n is a, c, g, or t
  misc_feature (123)..(123): n is a, c, g, or t
aagcnttgcaaaaagtttgagcctatgaacnatcaagaatggaagtctattaattcttaactacactgaagttaaagncttttttagaactaagccaccatacagacagagtgcagccttccncctagacccctgcccctctcttcactagcaggcccatggctcataatcagaacagtaccccaccatggttgagcatcccactgttagtgacacagagttccctgggaagaggtcccaaaggacacagagaaaagaagaccaatgaagacaccagtaattcaaataccagagtgtcacatgcattaaat

SEQ ID NO: 686858 - DNA, 402 bp, Homo sapiens
tccactcttggcagacgggaaaggggaagctggcatcccatggcaagaggaaggaagcaagagagaagggaggagataccaggctttttccaacaagcaggtttcatgggaactaacaaggcgagaactcactcatgacccaaggacagcaccgagatgttcacgagggatctgcactcaggacccaaacaccttccacgaggctccatctccaacactggggatcacatttcaacgtgagattgggaggggacaaaaatcccaactgtatcaccccatgcccaggtgggggaccgtacttatgaagagggggggtggccttgtcagaaacaggccatcactgtctgaacgacagggctcatgcctgaaagcctatcactgctggcaggcagaggcgcgtcg

SEQ ID NO: 686859 - DNA, 1097 bp, Homo sapiens
  misc_feature (622)..(622): n is a, c, g, or t
ggaacccggccgacagaagatggcggatgatgcagcgtgcagggttttctcccgtgtggctcacatctctcgttactgtgctgggcggttgcttcctctccgtgctgccctgtggggagtcagactccaggttcttcagccttgtggcccctggggctctcgggcctgtggaggactggactaggagcacacggtgggcctctcgtggttgtgggggccttgggacgtggcgggagccctgcagcttctgtgcggcctgtcctgggggccgtccgcgttgaaaacgccagccaagttccccaaggtaagctccctggcagacgacgccgtggatagcctgttgggatcccgcacctttctgcgggaatattacaagtagcaattcttctaactcacacagcagcagaacggagcatacgggcagagactgaagcagttccactccaaagaacatttctcattcctacgggatcaccgagttccccctggggattacagggcagtggttgaccgacactggtggtgacaccactcaggaaagacgcgggagaaattcacgtgggacccttttcaagattcatgtggaagaacttcaaggaggttccatgtggttgttggggcnagaggtttatttataacagcggagatgtaaaaataaaggggagaagagacacatgggttaagcgcaaaggtctgtcagaaacgcaatgaacaagcattaatatgtgggacgcagagcggtacaatgccgaaacaaagagcctggtagcaacacgggtggtaatgggccccccacgggtttttgaaacacaacggcctttggagaaaacacaaattgtggcgcgcagcatccacgataagagcaagagaggagcacacacccaggcggaaaccaaccaagagtcagaaacgagggatgcgagtggatgatacaccgacgaagagcaagacatcacatcatactaacaacgaacatatgagacaaacagctacagcatcacacgtaacacgatagcgaaaaaccatcaaaaccgctgtttctgttttcctcttttttatttttcattttttttttttatgggagacaccaagcgagg

SEQ ID NO: 686860 - DNA, 306 bp, Homo sapiens
tttctgtctggtcatcatggaactgaaaatcctcaaatgccttcactcttttacctaactcctagtctttttgggaagtagttaagatatgcctgctatctttaactttggaggtagtatcaaaattttacttctttggttgtttagtgaattaatgttgaatattttctactgtcatctatacatattcccatgaagtattataaggaaccttagcacattatttatacacaagatacccaaatatttaccttttcatcgagatagcttatatatggatgatattttttacacctctcacctgga

SEQ ID NO: 686861 - DNA, 268 bp, Homo sapiens
  misc_feature (135)..(135): n is a, c, g, or t
tgaggtgtcactgtcaaaatcagggggagggggacgccatagtttgatgtaggccttgtcagtcattttctctaagggcttgggaggcaaccatcttcgggcatatggctgttaatgtgtgtttacactaactgncaaaatgtggctgttgtaagtttggttaaaacttttatcttagtattggaaatatataggcagttttaagtcattactgggttacttgttaccccttaccgaattaagaaaaatagccacaggtggaactcaa

SEQ ID NO: 686862 - DNA, 388 bp, Homo sapiens
aaagtttgggggtccccccctttttaccccacccgggaggaacgcccagggccccgggcttgtttttccttttgttttccttttgggcagtttgatcaccgatcgagtaaggaatgccctttaaattggcgcgccttcggttttttttttttttttttttttaacccaagaaggatttccccggcttccttctcctcaccattttcccagagggagttcaaaggccacttttcaagcagcttttggccccttcagcctcagagtggaattttttaaagacaggacccctatgtccaggaaaggggaaaaggaactttgccaatgatagtgaccccagcaaaagcaaataataataatattaataataataaagagaaataaaataata

SEQ ID NO: 686863 - DNA, 379 bp, Homo sapiens
cgagaaagatgatcactgatatcacagtttattaaaatgactttatggcaatcagaaagaagggagaaaaacggaataaaggagagaactgtccaaataagtgtctgacactgtggaaggttgtttgaggatggcgattgctgaaaagtttccataaaatgattctctagagggaactatgccaataccatatctgttaacatcttagacccacagggtcatatcgtaacctttgctagagtctgagatggaaaaacattaactcgaatagtaaacgtcaagaccgcaaaattaatctgctaatcagaattttgtcttttgtgttgattcttacacttactccctggggatcttggatttaactgatcagttgacactc

SEQ ID NO: 686864 - DNA, 292 bp, Homo sapiens
  misc_feature (190)..(193): n is a, c, g, or t
  misc_feature (195)..(195): n is a, c, g, or t
  misc_feature (198)..(198): n is a, c, g, or t
  misc_feature (205)..(205): n is a, c, g, or t
  misc_feature (216)..(217): n is a, c, g, or t
tagggaataaattcgtataactggacatacggcggagacaagatcatgaaccgagaccagtgcccttgcagcacaccagccatactcgtctctactcttgtacatctcgtctctgcgggggatcctctacagtgctatctgaccatgctttgccagctaggcagtgggcgattcgcactacaaagtcgtnnnntnggnaccaggntgcgagtagannacaaccagaaatttagacaggatctcttacctttggaaaataggggttaggcatgaaggtggttgtgactatcgg

SEQ ID NO: 686865 - DNA, 1463 bp, Homo sapiens
ggccgcagacgcggggacgctggctcgctccctcactacctccctccgatgcgatcaaatgatgccgagaggtaaaaatttcctcacgacagtttgtgtggtgtaaagaaacctcctcagtgcgtcactgtgacgtccaagatacttctggggctggttgaattgcagctgatcaaataaggtgagatggatagatccgcatcaaggaaatgtatgcgacccgtgagcaggggtcggggactccagacggtgtgttggctgcagcgtgatgggggccattggttggcgcatatcagtgcgttcaaggaaaaggcgtggcatcaaagggtacttgatagatcccacgcgtatcccagatgatggaccccatcgttgtggagcccaaattgagcaatagcactatcacgtggcggcactacagtaggcgtcacagcctgcatttcctattgcgtaatcgaatggacggccactaaggggatttctcgcaatccaacagtgggcataatacactcgaagagtcgagtgtggtgcgatctagagactagtagtgcctttgccctggggaaggatgagactgccagtagacaatacacgtaataatactacctatgtgttgcccaatgccacctatatgacacgtaacaggctacctgtcctttacgttcctgggtacacatgagaagagtgtagctgaattggcaaggatagatagataaactgggtggtcttgatcttcacagtcttaacacagtgactcgatcaccgagaggactgggttggatgttccgacaaagaggagttctaacccttcaacttatggattactagagtacagttcgcgtaccgaagtccactaactgggattgcccatggatccaatggagcattttgtgaccgaaaggtcggagcagacagtggcggtgcactcacttgtgggaacagcgtactcctattcgccagaaaccgtaggtttccatgaaaaatggtccacctcaacgtcggaggaagtccgagaaactagagtcgcaaacgatctaagggccatgcggacacctgaagagtgtcgcagagaccccgagtcagcgggatcaggtgcaggtggcctttgtcaaggacctaaggcgccttttagagaacgacccacaacgcagggctcagaattccacatgcgcggccaagggaggtcacacagacaaacacatggggtccaaacactgggaggacacacgccggatcatgctggctagagaagcccaaaaattcgggtggaacgctggatgcacgcacgacctgataatccccgggcaaccacgtgaaaggctgcgcgcgggagaaagccacgtgacttgggacgcaggaagtcgcacaggcaccccgagaaacggggcaacgtgacacagcgcggggggagacgaaggcgcgactggctcaagcacaaaaagaacaagcacaccagcgcatag

SEQ ID NO: 686866 - DNA, 773 bp, Homo sapiens
atttgctattttctatttactatagttcatttttgaaaaatcgtgttggcaatccactaggtttgattttacaagcttcagtgggtctcagctttcagtttaaaaaagcaatagaaccaagcacagtggttcatcgcctgtagttctagcactttgggaggccaaggcgggtggatcagcctgaggacaggcgttcagagaccagcctggccaacatggtgaaatcctgtctccactaaaaacacaaaaattagctcaggcgtggtacgtgggtgcctgtaatcccagctactcgggacggctaaggcaggagaatcacttgaacctgggagggggaggttgcagtgagccaagatcgctcagtggccctccagccgtgggtgacaagaagcaaaactccaatctcaagaacaaagaaaaacagcacaaaaaaacaagaaacaagatggagggggagacgaagagacaccgaaagaaagagaagggcgaaagcacacgcatcggagcgagaggcgcagcacggagaccacagataagaaagaagcgtagacgacatagggcaacagaaagaataccgcgcagcaaagagaactacccggggaccaacaacacaaagggtacaggaaagatgatcgcaaaacacggtgaaaaaaaacgcacgccgggaaacacccagggatgtactgaggcaacacccacgaacagaggggaaacgagagacttaaaacgggggagacagaaaaaaagggaggtcacgcacggagcacgcacaa

SEQ ID NO: 686867 - DNA, 242 bp, Homo sapiens
actgaagacgactcacctccaccaagagagtgatctttgtggccatccttctcccttcgtttcttgcgcagacatttctccttgcttgttatgaagccgctctaactcgtgtcctaagatagtacatcttcttctgtgcgggcttccctgtgtcattctttacgtttaacccatctacttcaatacaccctatttgcttcttgggaagacaccggattctctctcactcagaagactcgttc

SEQ ID NO: 686868 - DNA, 709 bp, Homo sapiens
ggtcgtgtctcttgcttgccaacagtgttaggtacaggacacagatccaggggcgcactctcttgcagctctcctggaacgccctccggtattgtcctctcgcgtcttgtacatcgctccgggatcttgcttctcggtcactcgtccgtgcttctagtgaccttggcagcaccggttctcgtaggttatgccttccttcttgtctaatccattagccatgagctcgccgagattcgtctgaatgtgttccaccgttggtggaggcagtcgaacgatcagctctggtcaaatatgtatctgtcagagcctcgctagcacctatgctctacattcatgggcctcttactagtttctgaccgtcgcatggtatctgggcctctgcgaagtgccgttgttatctagttcttccgacgataattggccgaggagaagcgcgagggcataagagacgatctccttgaagatgctgaaccagcggtggtggaccggattctctttccaggtagtatcagtgaagccatgctgtatgatgtagtggggtaggatcccaatggacgccatgaaaggctgccatggctcctgtgctgacaaaagcttgaactcgaggcctttatggatcttcatgccctggggtaactgcgcgaagggaacctagctgtgatgatttcttggagagtcaataacctaatgaggagtagaagcttatcga

SEQ ID NO: 686869 - DNA, 177 bp, Homo sapiens
agtagctatctgttagacgcttattcatttccctacgaaaataaatgtcgaacgtgataattaccacattataatacttttaaaaaaaagatggccaaggagagatgacacataaaatagaaaatccatgaaaagttgaactctgctgcaaaatatgaatgtcattcacaaaccttg

SEQ ID NO: 686870 - DNA, 121 bp, Homo sapiens
tacgaggtggatacacagcatctcatctttcccgtcaaaaatggttggtaagatgttgacttcaaaccgttcgttgagacatgctggcaactgtgcactgggaaatccgcggtgatttagg

SEQ ID NO: 686871 - DNA, 416 bp, Homo sapiens
  misc_feature (13)..(13): n is a, c, g, or t
  misc_feature (16)..(16): n is a, c, g, or t
  misc_feature (28)..(28): n is a, c, g, or t
  misc_feature (46)..(46): n is a, c, g, or t
  misc_feature (54)..(54): n is a, c, g, or t
  misc_feature (65)..(66): n is a, c, g, or t
  misc_feature (72)..(72): n is a, c, g, or t
  misc_feature (74)..(74): n is a, c, g, or t
  misc_feature (78)..(78): n is a, c, g, or t
  misc_feature (97)..(97): n is a, c, g, or t
  misc_feature (104)..(104): n is a, c, g, or t
  misc_feature (114)..(114): n is a, c, g, or t
  misc_feature (118)..(118): n is a, c, g, or t
  misc_feature (120)..(120): n is a, c, g, or t
  misc_feature (123)..(123): n is a, c, g, or t
  misc_feature (134)..(134): n is a, c, g, or t
  misc_feature (136)..(136): n is a, c, g, or t
  misc_feature (139)..(139): n is a, c, g, or t
  misc_feature (147)..(147): n is a, c, g, or t
  misc_feature (157)..(157): n is a, c, g, or t
  misc_feature (161)..(161): n is a, c, g, or t
  misc_feature (171)..(171): n is a, c, g, or t
  misc_feature (174)..(174): n is a, c, g, or t
  misc_feature (177)..(177): n is a, c, g, or t
  misc_feature (180)..(181): n is a, c, g, or t
  misc_feature (192)..(193): n is a, c, g, or t
  misc_feature (218)..(218): n is a, c, g, or t
  misc_feature (240)..(240): n is a, c, g, or t
  misc_feature (249)..(249): n is a, c, g, or t
  misc_feature (260)..(260): n is a, c, g, or t
  misc_feature (263)..(263): n is a, c, g, or t
  misc_feature (270)..(270): n is a, c, g, or t
  misc_feature (284)..(284): n is a, c, g, or t
  misc_feature (297)..(297): n is a, c, g, or t
  misc_feature (300)..(300): n is a, c, g, or t
  misc_feature (302)..(303): n is a, c, g, or t
  misc_feature (320)..(320): n is a, c, g, or t
  misc_feature (325)..(325): n is a, c, g, or t
  misc_feature (328)..(328): n is a, c, g, or t
  misc_feature (330)..(330): n is a, c, g, or t
  misc_feature (400)..(400): n is a, c, g, or t
taaaatcaagggnggnttttattgaggngcccccagagccacccanaatttggnagggatgaggnngtaaananagtnatcatcaccaaagcaaatnaaaaaanaaagtttatntgcnanggntttgcagtganangangccttcanaaattaaggnaacnggccacccgncanagnggnncacttcagggnnttcacgaaatcttcccccttcttgngggggggcttcagcccgggggngggatccgngaacatcttcnccncaaaagnggggactttgccgnggcccaggttccnctngnngccctttttcccaagcngcggnggngnggggaagtggggacattccgtttcctgtgacttaacgaaggaacattccacaacaccttcctttccattnattgcatccacaaggg

SEQ ID NO: 686872 - DNA, 237 bp, Homo sapiens
gacctcgccggtgacaccgagaccctcatggttgacaaatcccgcaaccgtgggcaggtcgccgacccgttcgcgggccccggcggcgatcgccttggcgatcggatgctccgaagcatcctccaacgccccggccacctgcagcacctgcgcctcggacaccccggcggcggtgtgcacgccgatcaggctcatcttgccggtggtgactgtgccggtcttgtccagcacgaccgt

SEQ ID NO: 686873 - DNA, 266 bp, Homo sapiens
gctccagggactgtacacggcaggggtaagctatgtgtatgtcaggggttgagcatgagtgtgcggcgtattataccatagccgcctagttataagagtactgcggcaagtactattgacccagacgatgggggcttcgacatgggcttaagggcgtcataagtggagtccgtcaacagcaggtctctttacatcatcaacagctcattgtgtcagcggcagtcatcttcaagttgtaggctcaggagatttgatagtactagggc

SEQ ID NO: 686874 - DNA, 161 bp, Homo sapiens
gcttccacgagggtttcagcttgttctcttacttttaacccagttgaaattgacctgcccgttaaagaggccgggacatgacacagcaggacggggaggaccctatggagctttaatttattaatgcaaccattccctaacaaacccacaggtcctaaatt

SEQ ID NO: 686875 - DNA, 1513 bp, Homo sapiens
  misc_feature (587)..(587): n is a, c, g, or t
ttgccttccccctgagcagcaggccctgctaggaaggtggcggaagccgtaccaatgtggctgaagccctccagtcagatgaacaacggccgaggagaacctgctatgtggtcctggcctacagatgagatgcgacctgtgtcatcttgacgtggggcgtgtctaggtctaatggtacactgccggcccctgccctggtgacggttccagagacggctttccatggtaggaggtggatgctgcaggctttgggaacttgttcgatgcgaccgaggaaagcaattgagcccatgcatgatccgatgaacagtcaaagagccatatggccttggatggtagggacgcgtcgctggcccccatgtcgatgcgatggcatgtgttggcctggtcgggctactgctgttgctagggagcaagtgcctgagaccctccgcaccccctgtgcctccttgcctttgtcccattggtattgcatccacactgtacaggggtacttggccccggtacctccgcagttgcactgcccctgggcatgggatcgctttaggcgcagaccccaacgaggcgaatttctccttgatcatccnattcttgggtaggggcttcggtcgctttagtgcccagaagggagcgcagtggtggctcgtagtggcccctgctcaacacgcacgtgggctccgcgattcgcttttgggtaatttggagccccaatgccctcttttggcccttacttggtaaccaggtgcggccccctaatggacgccgatgacttgatagtcggatctcactcccttcactttccttcacgaggtccgatgcgttccttattaacagcgggggagatgtgcggtgtagagctatgcacataggggtctccttgtgggccttagggacggatgtgaggttccccttgggggctacgtaacctcgtttggtggtcagccgctacttcgttgggccactccgagcttggggtcccagtatgttggtccttgactctggtctgaacgttaagggcgtgagggaaccgtccgtccaagtccccctaggtggccgtccgtttccggcgtcgtttggagacgcggtctccggggcgcggggcttggcatgcggcgagcattttgtgtgtggcatctgcggcatgcataacgaaatccccgtcaccaggttaagtaagggtatcaccccccacccccccagggtgactatcgccggggggttcccaaggggggcgcattggtgccgtctcaaggggggcccctccaattggggtgctggtcttcacactccaggttgggcctgtacctatcgacgggacacggggggcttcaacgtgtggtttatcccgtgcaccgttcgccacagagtggtttttatcgtgtgcagcagtgctgacatttactgttgtccccgctggagccttgggacatctcaggcacgtgactggcgcctgtcagccacatcgatctagcgggctttgtgggctacagtagttggtgtgtgggcagcactg

SEQ ID NO: 686876 - DNA, 880 bp, Homo sapiens
gctgccagacacaggtgcagccttcctctcagaacatcttctgtatcctgaaagcctccaggtgggttcatccttcaatgttaatggacaggaaaactaagaccagtgaggaatcccaacgctcatcctgccaggatagaaaggaaagcccagaggcattgcaaagagtgctgaagagcagggattgtgctgtatggggacaagctcttgctttgtgtttcaggacaggtaacccaggagtgcaaacctcagtcaggtgcagtccagagtcctgtcttgagcataatggctgctctgctctgctccccgagcctcaccacctccagcggggttcatcatcccagtttatggacagaaaaactaagactagagggggagggcttagctcctgctcggaggagaccttcaactccttcacctgcctggacttggcaccctcccaagagactgcaaccaaggttatgaaaatagcatctactcaccatccttcctcagtgacacccccaatcaatccatccctcaggtcccaccccctgtcgtcaaggagactgagccccgagaagcggcaagctcctgggagctcctcaatcgtcggcagctgccttccgtggtctatctgcaatgtgctcaagtccttttccctcctcctcatccaagagatccaagaccgtgtctcacctcacccctgctccaggaagccccccttcagtggtctggggtttcactccctgtcattgacgtccggcctcaccaggaaagcaccaagccttgcaaatgctctctagtagttaattgccgtggcacagagaaggggtgaggggaagcattcgtttcgtggctattccctgttcatctcgcaggctggccctgccttcccagg

SEQ ID NO: 686877 - DNA, 346 bp, Homo sapiens
tagcattagacattgtaaagatctacataaaatatactctataattgcctctagatacggggtatgacaatctagataagtagcagactatggagaaaaatgagttacctggagggtcaggtaacttgcgaaactaaaaagtatgttagttgaggcaaagtcctaagcaaggttgtgctatcaaggctcagacataccttcgtgggccatggatatacacaacactggaaatgcctgccaactaatcttggatagatactttaaggcatccacttagctgccagttgagacaatcaccacagttattacccaaatactatgaacatatttttgtaaaccagtcatt

SEQ ID NO: 686878 - DNA, 205 bp, Homo sapiens
ttaatgaggacgggtatgaagactcggggctggagcgctcagtgcttatggaggaacagcccttacacaagatagcacggtgtgctactgagagggaatgcaggttcgtggagtccccaagtcaagatcaaagacttcaggcacagcggcttcgaaaccctgatgtgcgaggttcactacagacgccccagttcagacccggcct

SEQ ID NO: 686879 - DNA, 975 bp, Homo sapiens
ctattttgcctagttgttgtggggcacacccattccgcggcattcactccccccgggtgccccccttgggcccctttcataagttgggcccgttttttttgggccccttttcaacccatgcggcaatttgctcctttcccgagggtcttttaatctcgttggtgtcgccgcacatataggtgtgttgttctctgtcacttttctcatctggagagcgtgttagcctcatagtgagctcacttgggcgctccaccgagtgtgggttcatcgcctctcgcgccgcacacacattgttgggggcgctccacagaagggtggcacactcggtgttgctcctctgtgagattgtggtccgcttctcgttggtcaccacagggaggtgcgttctcaccgccacatattggcgcgccctatttggtatccgccacctttgaggggagcttttacctttttttgtgtgttttttgagaagtgtttctgagagggttaccaccgcgaagaatctctggccgatatgtagtttgtaactctcgctgtatggtgaccacaaaatgctgcctgtggtgcttcttctatggtgaggcccccgtagattttgctttcctctctgacaccaggttaccctcaccctcatattttttgccttctttccaggaaatgagaattctttggcccacctcgggagaaccccctgtgtcagtatttttctattctgtttatatattccactgccgctataatttttgagccacaattacaatagtgggagagatatactgtctaacttggagaggccagagaagaccccatagtgtccatctgtttactagggtcctgtccactggtatttggggctataagtcactcccaccccccctttggaccaaagaacctggggttaaatttgggttgggcatcccccatcccgattataaagacttttttaaacatgaattaaacacctgttttttttta

SEQ ID NO: 686880 - DNA, 556 bp, Homo sapiens
tatgggccgtagtgtacgagttcatatggaatgtgaagatcgacagcgttgcacatacagtacgtgagccattggaggcattgatagcaataacgcactgcgtagcagggcaaggcgcagaactaacagccctcgaatattgatcgtagaaaggaagccgactaaagagctaggcataagcatacaagctgagtccctgggctgactattgtatgcgttccaatatctgcatgcattcaacaattgacatgcagcgaatggcaacttttgtaggcaatgcgcgaatagattcgcatgaagcgtgatgacaatgaatccaaaggagcggacatagagcccatgacatctggagaaagtcgtcttctgccgaataggccgaaaccgcgagtaatacttcgtcaaacggctctgtcggaagcatcccttgcatctttggaggcggtagaagacgaatggcagtggaagctttggcatactgttccgggagtcaacacatcggtggcaacaatatcttttagttctaacccaaagacacaaatagtacttgaatctaaat

SEQ ID NO: 686881 - DNA, 897 bp, Homo sapiens
  misc_feature (218)..(218): n is a, c, g, or t
  misc_feature (897)..(897): n is a, c, g, or t
caggaaagctaacggctactcaaagccacttagaaaacaggatagcgagcagatgcagcaggaacagtggtatctggaggtccttaaatccagagcgatggcagaggagctgcgacggaagtcataatcatgtgcctaacatagcacagggatgttccaatagaccacacccagtcttccccgaaggtcatccaaagtcaacgcgattacagtccagnacgttacacgtatctaagaagtaacagctgattaaataagaactggagcaagtactcttaagtgctacattaacctggttagaaaggctggtggattccagattgctattgtaaaatctccatcatgatgtgtaggagtgaaggattagatggttaatatccaagcagtcctactagatatttggtaaccagcttcccttaactagctttttctttaaatactcgttaataagctattccacaaacctccagttaacctaacacatgaccctaacctagccatttaccatacatcaaactagctaaaggaaaccaacctaaggaagtgaacacagttgtgatttatttcatctagctaacttgtctctctatatagagaaagtacctttaaggctagcattccaaatagactagaatagcgttctgccagtttatcctcataccttatgaccaacttagcagacaaacgcagttaaacaagctctttggagacgtaagtgccagtgacccggtagctcattctaaaaaacctcaatgagttgaaaagccttcgagtaaagcagtccagtaagagccggccgggtgtcctttctccggagcaagaccctaaagttgcagcgtagaaagactcgaggccatgtagagccacgcacctggaaacgtttcctagaaaccggtn

SEQ ID NO: 686882 - DNA, 184 bp, Homo sapiens
ccgatatgcggcgcgcacttatcagagagcagctcacagtggaactcagaaagtattcgaactgcaaagacaatgacaaataccttaacattatcgccttacgtctacatacttgagataaaggaaggcttaaattcatgaggcaagcacccaatacgagcagtttgcgatggcacatagcaaa

SEQ ID NO: 686883 - DNA, 100 bp, Homo sapiens
ctctgtctgttccggtgtcacgtactagactatattataatcccatgtatgtatgtatgcatgtatgtaatgtatgtatttattttgagacggagtattg

SEQ ID NO: 686884 - DNA, 381 bp, Homo sapiens
  misc_feature (163)..(163): n is a, c, g, or t
  misc_feature (172)..(172): n is a, c, g, or t
  misc_feature (354)..(354): n is a, c, g, or t
cccagctaactccaatcattttcaatgtggtattacttctgcacttggataataactaattttcccccaggatatcctgtctactaatagataacatacaaagccctcttttaagaaataggccagacgtggtggctcacacctgtaattccagcactttggnaagccaagncgggtggatcacctgatgtcaggatttaagaccagcttggtcaacatgctgaaaccctgtctctactaaaaatacaaaaatttagctgggcgtggtggtgggcgcctgtaatcccagctactcgggaggctgaggcaggagaatcgcttgaacccgagaggcggaggttgcagtgagctgantcacgccactgccgtctgactggtgac

SEQ ID NO: 686885 - DNA, 141 bp, Homo sapiens
cagtgtgccccctttccaatcatattcctctctctcaccctaataggtaaccactaccctgacttttgtaatgatttccttgctcccaaaatgtagtcctaggactgacctgaaagacacatgcctcgtaatacccagcca

SEQ ID NO: 686886 - DNA, 118 bp, Homo sapiens
gcactataacagtaacttaaaggaataattttctttagagggactctctccaaaaaggaaggggatagtgggaaaactggtccttttattcttcagatcccctagcagaaatagactg

SEQ ID NO: 686887 - DNA, 416 bp, Homo sapiens
ttccgtctgtgatagctttctcatgcatggggaccagacagagatcacacatctggtgaagcacatcaggaaagactctgattaggcaaagggcaagaagggacaaaagggaagcctctccacgggcggaaatactcttttttctatacttgctgttgtgttaaaccactgtgacctcaatggcatgaataccatcctatataggcatccttcctaaactctcctagactaggcacataatagggacagcaggagagtggcagtggctaagcaggaagactttagcaattatgcaaaataggtttgaatttggctctgccaccacttagtgcaacgtggggtaggtaagtcactccctaagccccagttacctcatctttaacgcagagatagtggcatcgataaacaccgggtac

SEQ ID NO: 686888 - DNA, 193 bp, Homo sapiens
cctttttaaaaaggggggttttttttttttgaaaggtagcccccccaaagcaggggccatgttttttggatggttttttgggcctagggccccgttaatgccccattaattttttttatggggggccgtgggttttttttattaggggggggaacttgaattccccaccccgttttgttggttgttttttttt

SEQ ID NO: 686889 - DNA, 94 bp, Homo sapiens
  misc_feature (36)..(36): n is a, c, g, or t
cccaaatcttttggggacttttctttttttacccancctccgcccctgcgaggagttgaggggccagttcggccccgcgcgcgtcttcccgttc

SEQ ID NO: 686890 - DNA, 387 bp, Homo sapiens
  misc_feature (2)..(2): n is a, c, g, or t
tntgtcagtcatgagtattgactgacatcctaaatgagcatgtgcttactgtatgggactggcagaggtaaagcaaaaggagcagaaataaagacaacaaatgaagttgttttggctgtggagtttcacccaacagatgcaaataccataattacatgcggtaaatctcatattttcttctggacctggagcggcaattcactaacaagaaaacagggaatttttgggaaatatgaaaagccaaaatttgtgcagtgtttagcattcttggggaatggagatgttcttaccggagactcaggtggagtcatgcttatatggggcaaaactactgtagagcccacacctgggaaaggacctaaaggtgtatatcaaatcagcaaacaa

SEQ ID NO: 686891 - DNA, 340 bp, Homo sapiens
ctagaggatccccattattggtggacgaatatatggacaaatattacaatggagcaactgctgtagcattggacgtatgaaaaacctttctaatgactcaaaccccaaatagttcacaaataaaaactatgataaataaatttatataaaaagtcaaaaggcaagacgacaaatacagaaaaaaagaactcatcagaaaaaggattcatctttctttatataaagaggcctaaaaattgatcaaataaagaccaatgacttaacagaaaattggcaaaggacatgggctattcagagaaaaaatgcaaatgatccttaaatatatgaaaagatctcatcc

SEQ ID NO: 686892 - DNA, 268 bp, Homo sapiens
acagattgaagtcacatttgagatagatgtgaatggtattcttcgatgtgacatgctgaagacaatgggtactgggaacaaaaataatgatcacaatcaccaatgaccagaatctgcctgacacctgaagaaatcgaaaggatggttaaatgagggccgagtagatgcaggcgagctcgtgagccagaggccaatggcgcgggcgagtagtagggctggcgcttgccggaacgccgggtcgttagtccgccggaatgaacggtgaggg

SEQ ID NO: 686893 - DNA, 185 bp, Homo sapiens
agcatttccaattctggttttgcggacagcaggtcttagcttgtccggcgagggttggagttggtcccggcggagattcagttggaagagcccgcggcttcccggggcaacttccccacttggaagggattctgaaagaaaatgaagtcagccttagaaattaagtgtgatctgccctctcgcct

SEQ ID NO: 686894 - DNA, 541 bp, Homo sapiens
  misc_feature (453)..(453): n is a, c, g, or t
  misc_feature (466)..(466): n is a, c, g, or t
  misc_feature (473)..(473): n is a, c, g, or t
  misc_feature (476)..(476): n is a, c, g, or t
  misc_feature (486)..(486): n is a, c, g, or t
  misc_feature (527)..(527): n is a, c, g, or t
gggcgctctttttcctggtgactactattcacgctgaactctgccatccagatgcagaaaatgcctttaaagtaagacttagcatcagagcagctcttggagataaagcatatgtctgggacacggatcaagaatacctcttcagagcaatggtggcattctccatgagaaaagttcccaacagagaagcaacagaaatttcccatgtcctgctttgcaacataacccagaggtgtccgttctggtttgtggtcacggacccttccaacaattatactcttcctgcagctgaagtacagtcggccataagaaagaataggaaccggatcaacagtgcattttttctggatgaccatactctggaatttttaaaaattccttctactcttgctcccccgatggagccatctgtgcccgtctggattattgtattcggtgtgatatttgcattgntacagttgcaatngcctacnggntctatctggnatcggcaaagcagaaaggaacaacaaaggaccactggagtngaagatgcagaaga

SEQ ID NO: 686895 - DNA, 593 bp, Homo sapiens
  misc_feature (472)..(472): n is a, c, g, or t
  misc_feature (535)..(535): n is a, c, g, or t
agcgggccgttgccactcccgggagcatgaaggaccgaacccaggagctccgcacggcaaggacagcgatgatgatgatgatgtcgctgtcaccgtggaccgagaccgcttcatggatgagttctttgagcaggtggaggagattcgaggcttcattgacaagatcgcagagaatgtggaggaggtgaagcgggaagcacaggtgccatcctgggcatcccccaaccccggatgagaagacgaaggaggagctggaagaactcatgtccggacataaagaagacagcaaacaaagttcgttccaaggttaaagagcatcggagcaggtccatcggaggcaaggagggaaggggctggaaccggctccttccggctggaacctggagggatccgggaagacacaggcactccacggctggtccagaaagtttgtggaggtcatgtcggagtacaacgccacgcagtccgaatntaaccgcgaaggcgcttgcgcaaaggcgcgcattccagaaggcagcttggagaattcaccggncgagggagccacgaaaccagttgagggaggctggcgacggagcattgctgggaagaag

SEQ ID NO: 686896 - DNA, 163 bp, Homo sapiens
cgggtgatctagaggatcctgcctgaagaacttcctccatctcacagggcagattactggcaacaaaccccaaaacttttgtctgaggaagtcttgtgtgggactaggtctcactctatcacccaggctacagtgcagtggcacaatcttggctcactgcagc

SEQ ID NO: 686897 - DNA, 449 bp, Homo sapiens
caagaccttcaacttgttaaaggaaccatggttgccacgtatctcgcactcaacaggtccaaggcccccccccaggttaagcccattgagttatccattctgggccaacggggagtgaggaagtttccctccccccccctgttaggccccagggcatttgggccccagggcggtgctagctttacacagtcagcatgctttccaaagggagcaggccggaaccccagggccaaagggagctggaaccccaggggccggggaaactgccagccccaaacccccctaattagggtgttaaaagtgccttttccttccccaggatgggcttttttcgggtcagggtttggtggtggaaaacgattccctgtataaactttttttccttttttccccagctggttactcagggtttatctgtccctggcccttttaataaactgtttagttta

SEQ ID NO: 686898 - DNA, 674 bp, Homo sapiens
ggaggaattggtccatagtattccttagcgaggagttcgttccgggctctgcagctcttgacccggctggtattgtctccatagcgagccaattcctctgaaatcagcacacagcaaagggaaagaaaccttccaagtgaaagattgactgcgggatccaggaggctccatcagaaacttccagccaagttctagaaaagcacagcaaaccaaagacgcagcaaaggaaccaaacaagaggaaacctttgctaagggcatctgcaggccaagtgcctaaacggtggaagaaggataccaagggaggcagaacgaaacggagcaagccctcctccagcgaggaagatcgagggcccaggagacaagcaggagaaggcaacccagacgacgtccgcatggccgggagcgcgcgggtggcctccagggtggtcttataacagacggagatggtggcgaaggtgattgaagtgctcgacggcgccaggcccactacacgttgcgaaagcctgcttcccaggttgggagaaaaatcccaactctaattgcgcttccaaatagacgaggatgacgcctagagtcgaggctcgctgccagaacgcgcgaggcaaaagcccccccactattcaaccaagaccctaaaggctgcagctccagcaacttgactaccaggaaccc

SEQ ID NO: 686899 - DNA, 110 bp, Homo sapiens
ggcaacctctacctctggggttcaagcaattctcttgcctcagcctctgtgagtagttgagatcaggcccttgcactacgggctgggtgacagagtgaacggggtaccga

SEQ ID NO: 686900 - DNA, 461 bp, Homo sapiens
ggagcttaagaggacaaggaggatgtcatctatgttaggatagagggcatagaaggccaggagtcaggagaccggggttctggtcctgggattatacaccagctcactgaggagcttggtcctctctggatcaagagtcccaccgtgaaaatgaaggaacgggtccagataacactggagccctttcccccaagatgcattggcattcagaggagggggcaggtccagtcctctacggcctgtggggtggatgctgcctgggagggtgctgggtctatgagagaaatgagggtactcatgtgttccaaggtaaccatatttctgataggtccggggatcgtcggtctcatcgtcggcacggtggctttcagccagcagaatccaggagctcacggggggcccatcccaattcttaaggcatgggtaattcagccaggcctcagtttcctgggtgcctctgg

SEQ ID NO: 686901 - DNA, 272 bp, Homo sapiens
gatcaatcccccagtgcaaaacagggctaacggcccctgcaggacaacagcacgctccatccctcatggtcaactgcctttgcggccccggaattttgcccttcatttgcttttttttactttcctgagcctagcccgtccgtaagctccctcccctggttggttcccagggcaggctgactcagttgactgcttggtccaaacctggccctggcccttgtcagggtcagcctaaggaaatgggaataaaaaggccaaagagcccccagtta

SEQ ID NO: 686902 - DNA, 3100 bp, Homo sapiens
actcgtctctggtaaagtctgagcaggacagggtggctgactggcagatccagaggttcccttggcagtccacgccaggccttcaccatggatcagttccctgaatcagtgacagaaaactttgagtacgatgatttggctgaggcctgttatattggggacatcgtggtctttgggactgtgttcctgtccatattctactccgtcatctttgccattggcctggtgggaaatttgttggtagtgtttgccctcaccaacagcaagaagcccaagagtgtcaccgacatttacctcctgaacctggccttgtctgatctgctgtttgtagccactttgcccttctggactcactatttgataaatgaaaagggcctccacaatgccatgtgcaaattcactaccgccttcttcttcatcggcttttttggaagcatattcttcatcaccgtcatcagcattgataggtacctggccatcgtcctggccgccaactccatgaacaaccggaccgtgcagcatggcgtcaccatcagcctaggcgtctgggcagcagccattttggtggcagcaccccagttcatgttcacaaagcagaaagaaaatgaatgccttggtgactaccccgaggtcctccaggaaatctggcccgtgctccgcaatgtggaaacaaattttcttggcttcctactccccctgctcattatgagttattgctacttcagaatcatccagacgctgttttcctgcaagaaccacaagaaagccaaagccattaaactgatccttctggtggtcatcgtgtttttcctcttctggacaccctacaacgttatgattttcctggagacgcttaagctctatgacttctttcccagttgtgacatgaggaaggatctgaggctggccctcagtgtgactgagacggttgcatttagccattgttgcctgaatcctctcatctatgcatttgctggggagaagttcagaagatacctttaccacctgtatgggaaatgcctggctgtcctgtgtgggcgctcagtccacgttgatttctcctcatctgaatcacaaaggagcaggcatggaagtgttctgagcagcaattttacttaccacacgagtgatggagatgcattgctccttctctgaagggaatcccaaagccttgtgtctacagagaacctggagttcctgaacctgatgctgactagtgaggaaagatttttgttgttatttcttacaggcacaaaatgatggacccaatgcacacaaaacaaccctagagtgttgttgagaattgtgctcaaaatttgaagaatgaacaaattgaactctttgaatgacaaagagtagacatttctcttactgcaaatgtcatcagaactttttggtttgcagatgacaaaaattcaactcagactagtttagttaaatgagggtggtgaatattgttcatattgtggcacaagcaaaagggtgtctgagccctcaaagtgaggggaaaccagggcctgagccaagctagaattccctctctctgactctcaaatcttttagtcattatagatcccccagactttacatgacacagctttatcaccagagagggactgacacccatgtttctctggccccaagggaaaattcccagggaagtgctctgataggccaagtttgtatcaggtgcccatccctggaaggtgctgttatccatggggaagggatatataagatggaagcttccagtccaatctcatggagaagcagaaatacatatttccaagaagttggatgggtgggtactattctgattacacaaaacaaatgccacacatcacccttaccatgtgcctgatccagcctctcccctgattacaccagcctcgtcttcattaagccctcttccatcatgtccccaaacctgcaagggctccccactgcctactgcatcgagtcaaaactcaaatgcttggcttctcatacgtccaccatggggtcctaccaatagattccccattgcctcctccttcccaaaggactccacccatcctatcagcctgtctcttccatatgacctcatgcatctccacctgctcccaggccagtaagggaaatagaaaaaccctgcccccaaataagaagggatggattccaaccccaactccagtagcttgggacaaatcaagcttcagtttcctggtctgtagaagagggataaggtacctttcacatagagatcatcctttccagcatgaggaactagccaccaactcttgcaggtctcaacccttttgtctgcctcttagacttctgctttccacacctgcactgctgtgctgtgcccaagttgtggtgctgacaaagcttggaagagcctgcaggtgccttggccgcgtgcatagcccagacacagaagaggctggttcttacgatggcacccagtgagcactcccaagtctacagagtgatagccttccgtaacccaactctcctggactgccttgaatatcccctcccagtcaccttgtgcaagcccctgcccatctgggaaaataccccatcattcatgctactgccaacctggggagccagggctatgggagcagcttttttttcccccctagaaacgtttggaacaatgtaaaactttaaagctcgaaaacaattgtaataatgctaaagaaaaagtcatccaatctaaccacatcaatattgtcattcctgtattcacccgtccagaccttgttcacactctcacatgtttagagttgcaatcgtaatgtacagatggttttataatctgatttgttttcctcttaacgttagaccacaaatagtgctcgctttctatgtagtttggtaattatcattttagaagactctaccagactgtgtattcattgaagtcagatgtggtaactgttaaattgctgtgtatctgatagctctttggcagtctatatgtttgtataatgaatgagagaataagtcatgttccttcaagatcatgtaccccaatttacttgccattactcaattgataaacatttaacttgtttccaatgtttagcaaatacatattttatagaacttc

SEQ ID NO: 686903 - DNA, 373 bp, Homo sapiens
tgcggcgggaaccgggctggtggggagcggggcggagctggccctgcctctgcctggcctggcgcctgcagtcggctgcgggcctgctgccctgctgcctggccaactgccctgagctgcttgctgagtgccgagggagactgtctggggccttgcaccttggcagggcagccttgccctggctgtcgttgtgccccccctgcatgtgcaatgcgtgtgtgctgttttggcccatcggctgacagcctctccctgcttgcctttggaaaacccctggtgggttgttggctgtggccttgtgggtgtgcctgtagccctggccaagtgcaggggctttgggattttcccccaatttcccccccccctttttggg

SEQ ID NO: 686904 - DNA, 693 bp, Homo sapiens
  misc_feature (424)..(424): n is a, c, g, or t
  misc_feature (432)..(432): n is a, c, g, or t
  misc_feature (490)..(490): n is a, c, g, or t
ggagccccactgctgctacctggggaatggggcgcctgggggccgaggcagagggaagggggtcctcccgattagggtcgagtgtcagcctgggttctagtccttgggtgcggccccagtggccttttcccttcaggctctgtagcgtccctcctctgacagtctgcacgaaggcgccagtctggtgtctgcatgggtgtcggcaggctgggagtgatcactgcacgcccatcgtgcgcacctgcccatcgtgcaaggcatccgatggtgctacaccatgtagtcctccatgagcgacatgggaagggtaggagttgccgcccgtggcgggagggtccgcgggctgtcacctcatcgccctgtctgtgagcttctgggcacccctcgctggaaggttagcatactgtgtgaacatgcctctganaacgcagngtgccagggggcactgccttctcacagtttggctttgcgccggttcacccatgtgggngttccccttcaaaggcagttagagctttccgagtcgtggggtttccaagttgaggccttcaaagcgtggagagggagccccttggggggcaggggtggaggtaggggggtcggcgtgggcatgggttttcccccaatagaggctttggaaggcaaggaagcaattgcgccaaatttcattctagggcggagattatcgggcat

SEQ ID NO: 686905 - DNA, 124 bp, Homo sapiens
  misc_feature (42)..(42): n is a, c, g, or t
  misc_feature (68)..(68): n is a, c, g, or t
  misc_feature (70)..(70): n is a, c, g, or t
ctttcttaatgaataataaacaatcttctaagcctgaaaatnttaagtcatcattccaaatacgtagntnatgtaacctgcatggcaatttctttaaataagaatggttgtaattctgtaatca

SEQ ID NO: 686906 - DNA, 192 bp, Homo sapiens
tttgtatttttagtagcagccggggttttgccatgtggcaggctggtctcgaactcttgacttcagatgatccatctgccttggcctcccacagtgctgggattacaggcgtgagccaccatgcccggcctctttctcacctttacacctgtcttcttatccttacatctgttttcacatttggcgggggca

SEQ ID NO: 686907 - DNA, 949 bp, Homo sapiens
  misc_feature (148)..(148): n is a, c, g, or t
  misc_feature (156)..(156): n is a, c, g, or t
  misc_feature (174)..(174): n is a, c, g, or t
  misc_feature (227)..(227): n is a, c, g, or t
  misc_feature (412)..(412): n is a, c, g, or t
  misc_feature (429)..(429): n is a, c, g, or t
  misc_feature (445)..(445): n is a, c, g, or t
  misc_feature (537)..(537): n is a, c, g, or t
gggggcggggcgcgcgggcccgggcaaggcaagcgccggtggggcggggcgccagagctgctggagcgctcggggtccccgggcggcggcggggcgcagaggaggaggcaggcggcggcccggtgtgctcccccccggacggtgcgcnggcccggnccgtctcgcgaactcgcnggtggtcgcgcggcccctgctgctgctccgaccccgggcccctccgccgcgcnatggctcggccgctagtgcccagctcgcagaaggcgctgttgctggagctcaaggggctgcaggaagagccggtcgagggattccgcgtgacactggtggacgagggcgatctatacaactgggaggtggccatcttcgggccccccaacacctactacgaggggggcgtacttcaaggcgcgcntcaagttccccatcgantacccatactctccancagcctttcggttcctgaccaagatgtggcaccctaacatctacgagacgggggacgtgtgtatctccatcctccacccgccggtggacganccccagagcgggggagctgcctcagagaggtggaaccccacgcagaacgtcaggaccattctcctgagtgtgatctccctcctgaacgagcccaaaaccttctcgccggcaaacgttggacggcctcgtgatgtcaggcaagttggaaagagagcaaggggaaggatcgggagttcacagacatcatccggtccttgggaccaggttggacgcgtagcgttgaggggttaaagggtcccaacaaggcttgggcggagttactgcgtttaagagcaatggggcgggcgcccgatagggggtcagacgtttctagggagagtaattacgaggacgggaagttgaaggagcaggcggaaagttgttcggggacgatgaagattacttttggcggaggagtcctgaaagaacatga

SEQ ID NO: 686908 - DNA, 444 bp, Homo sapiens
tttttcccaacagtggataggctatttattactgcttcaatttccaaactcattattgtctattcagggattcagtttcttcctggttcagtgtagggagggtgtatgtgtccaggaatttatccttttcttctagatttttctagtttatgtacatagtggtgtttgtagtattctctgatagttgtttgtatttctgtggggtcagtggtgatatcacccttatcacttctgattgtgtttatttgaatcttttctcttttattctttattagtctagctagcagtctatctattttattaatttttttcaaaaaaccagctcctggattcattgattctttgaagggtttttcatgtctctgtcttcttcagttctactctgattttggttatttttggtctcctgctaactttgggtagggcggggtacgagctcgaatt

SEQ ID NO: 686909 - DNA, 101 bp, Homo sapiens
tgtagatatcaggtatgtacttcgatttttgaataaaccagatgtgattccagatgtctgaacttatagattctgtttatccagctgcgtttcacttccga

SEQ ID NO: 686910 - DNA, 396 bp, Homo sapiens
tcgtgccgaattcggcacgaggtccgcccgtcttctccttctgcatcgaggctttggcggattccacctaaacacctaacagtcgcggagccggccgcgtcgtgagggggtaggtacggggagtcgggcggtcttgtgcatctgggctacctgtgggtcgaagatgtctgacatcggagactgatttaggagcatccccgggatcacgctctattggttctccgccaccgtctccgagcccttggtcggcaaacttggcctcattttccccgactaccttttcctctgggcggaaggctttatttattcctttcatatttggaggccaatcactgtcactctttattttcctgtgggtgcaggaactggatttccttagttaggcaattaaattgt

SEQ ID NO: 686911 - DNA, 246 bp, Homo sapiens
gaccatccgacagccgaaagataacaaaacactacatgtacagagcgcgagcagtgcaggacatggtggctggagcatggctttgagaagcccctagacatgtgccatgagtgctgtgtgagtgatacctgatgtcagagtgcagtgctgcaaaagaatgaccccgagaaagtgctgaggacactacgacgagaaccggcatgctagatacacaatgaacgctcttcttagacgaactgaacaact

SEQ ID NO: 686912 - DNA, 123 bp, Homo sapiens
tccccggggagttggcgagagaaagccagaccatcgtaatttgatcaacatccaggcgacccagtcaactaactgcgtgttcttgtatgcttgtttcatactctcgttctggacgtttactcg

SEQ ID NO: 686913 - DNA, 273 bp, Homo sapiens
ggaattatatattcatcattctacaagttaagcagtcttgcgcaatcttgaaggatgtcacaggcaatgtgacaaaagttaggaagggatgtcctattagattgcaagaataaaacaagagacgataggtggtaccttgatcttacctaaagaagaaaatcattcttttgcactaacatgaggtcctgtttcaacaatacctgtcttaggtctgaaggctaagccagtcaggcacacatgaggtgtctgccaactcaggcaagagcatgtctg

SEQ ID NO: 686914 - DNA, 682 bp, Homo sapiens
  misc_feature (158)..(158): n is a, c, g, or t
aaaaaggaggttcaaggccggaggaaatcctccctgaaggttttaaacggacaaatttcggccaaaagaattagaagaggccttgttaataagtctccaaccgtttagaacgaggacgtccacttttattaaatttctaaaaacgggctcatggttgncaaaaaacgttaagggcctcatcacggcggttggctgctactaaaaacagtgtgccgccgtagcatagaggagctactaaatgcctcgtggaccgtagggcatgctgcaacccccacaaaaagctggttgcctttttacaacagatgttagtctcatagaatacagcacgatgcatgacacattcaagagtcaacagtatgctcacgtcctgggatatcagcatgactgcaaacgtagtgtcagagcacagtgtggcatgttccgcttaagtctgggattcgcagacaagaagcgagatcaagcgacagcattgtgccgatcctaaaaatgggcactactttctccactagacataaagggacagtttgactctcacagggatcacttctgctgcttgcatgtatgaaaacaggaatgtgaacgccctgttctcatgggagaccgaaagtctcaagcacctacatgtattggaagccttgtttggcatcagcataaatatgatggttcttagaatgaatacacc

SEQ ID NO: 686915 - DNA, 352 bp, Homo sapiens
agtgaagaatgggatgtgccggccagggtttggatgttaggggtgcttctcactattggggtgtcgctgctcttaagctctcccagtggattaagctaggaaatacatgtttgcatacacaccactttttaaaaaaaatttttttttttgagacggagtctcgctctgtcgcccaagctggagtgcagtggcccaatctcgctcactgcaacctccacctcctgagcaagttcaagcagttctcctgcctcagcctcccaagtagctgagactacaggcacctgccaccacacctggctaatttttgtatttttagtagagacggggtttcaccatgttggccaggctggtc

SEQ ID NO: 686916 - DNA, 480 bp, Homo sapiens
cacgaggggcgaagctaagcagctctacctccgggttttgtgctgccagccgcgccttggcacagtctacttttagctggcctacgtcggcactgctataaagtagctgccggggtaaattactcaggctaacccggtcatcatcggccaagagcaactgcccgacaccggcgccagccagataggaagcaacgatactgcctaagccgcctaagccaacaatcagcacactttgatttgctaaatgccattgccgttgctcactcatgtccggtaataataactgtgcgctataacggagttgttgtgccgggtttaagctggcagtagccgccgcacctttgctactctgtggcattcgctttctccagtaactgcattaactccagcgtactttgctcaggatctgccgcttcgggtatagccgtgaccaccgcaataccattaactccgctagcagcaacagccactaaccgctga

SEQ ID NO: 686917 - DNA, 358 bp, Homo sapiens
cattgagtatgatactgaacatagatacctgtctgcccgtgttgtagagggtctggtgtaatagtatcgcttgtaagagctgaccatgtattggacagtgcacatagtctaggacatctaggtatgatcatgggctctcactagtgtgtgaggcatagatccttcagcaatcagttcttcatggatccatgtgttttgcatgcagtaaggatccccattccatttatagtagtgctacagacagatgtctccaggtacattccattctagtgcgtcagttatcgtaatcgacagtaggtaacaccaggtagataacaagagaatagtggtgttagacaacattatctgtccatgacac

SEQ ID NO: 686918 - DNA, 165 bp, Homo sapiens
aagaagcatcctgagtctagtggatccacttccagaggctgcaccctcgttaaaatgctcttcatatctgttaaatggaggaagtgaaacatccttatgtttgaaggcagattggtgtcttacgtagcaaggaaggggtgtagcaaactgcagatccaagagtac

SEQ ID NO: 686919 - DNA, 388 bp, Homo sapiens
acagcccaaggcatcgagcgctatcccgagtggcgccaaacagagatccttgatatcacctgcccttgcgtcagcctgtatgggcgcgaagtcgcagcgcccgacaaagttcagttcgccttcgaccatcccaatcggcgcgtttgactcgcgctagaaggagcgtatctagcgcgttcgcgtcaggctatggccgttggggagccgcctcacgcctacgggcggtcgcccgcatgaggttgaaatgatcggtctggtgatcgtcactcacggacgcctcgctgaggagttcgtcgcggcgatggaacatgtggtggggccgcagccgggggtccgcgcgatttgtatcggccccgaagacgatatggagcaacgtcgcgccgatatc

SEQ ID NO: 686920 - DNA, 84 bp, Homo sapiens
acatctgtgtacttctgtgcgagcacgtatccggatgaccaaagacatcagtacttcggcgccgggacccggctctcagtactg

SEQ ID NO: 686921 - DNA, 637 bp, Homo sapiens
  misc_feature (63)..(63): n is a, c, g, or t
  misc_feature (91)..(92): n is a, c, g, or t
  misc_feature (158)..(158): n is a, c, g, or t
  misc_feature (311)..(311): n is a, c, g, or t
  misc_feature (373)..(373): n is a, c, g, or t
  misc_feature (416)..(416): n is a, c, g, or t
  misc_feature (431)..(431): n is a, c, g, or t
  misc_feature (453)..(453): n is a, c, g, or t
  misc_feature (465)..(465): n is a, c, g, or t
  misc_feature (480)..(480): n is a, c, g, or t
  misc_feature (482)..(482): n is a, c, g, or t
  misc_feature (494)..(494): n is a, c, g, or t
  misc_feature (515)..(515): n is a, c, g, or t
  misc_feature (523)..(523): n is a, c, g, or t
  misc_feature (556)..(556): n is a, c, g, or t
  misc_feature (576)..(576): n is a, c, g, or t
  misc_feature (602)..(602): n is a, c, g, or t
  misc_feature (609)..(609): n is a, c, g, or t
  misc_feature (612)..(613): n is a, c, g, or t
  misc_feature (616)..(616): n is a, c, g, or t
  misc_feature (626)..(626): n is a, c, g, or t
  misc_feature (630)..(630): n is a, c, g, or t
  misc_feature (635)..(635): n is a, c, g, or t
gaattcggcacgagaaaaaaaaaaaaaaaaaaaaaattctgaggaaagaaaggcatgcatganggctccattccttttcaaacataatttnntttctttattcttggcttttgtttgttgtcatctcttgggtctttgctcagcttctctcaattgtnccagagtacacagggacctctcatctactaatgagttctccagcaacataggaaaacccagaccagatattgatgtatgtggtagccttgaatcggaatctggcagactccaagtgcagggcgcataactgatcaagggccccagctactgtnctctgcagtcccttgcaatgttggtgcaggggtgcagaggccatgtttctcactgactaatnccagccagcggcccaatatgactgacattgggcttgacaactnccctggggtagcctnggacctgtcttaggctgtgtanagttaagggggncaccttcctcccttntncttaagtggggnagcttcaattccctttttttnagggtttntttgaccatttgtttttaaccaggggaattgtnttttggcagggtacttaatncctaaatggccactgtaagccctccncatgttnaannttntaaagtggantttngtccngg

SEQ ID NO: 686922 - DNA, 345 bp, Homo sapiens
ggcccggagtaaatgcacagagaaaggaagcaggcccgttggcaagtggttgtgacaagcccgagcaagtgtgtgagaagcctggtggcttgccctggctctctgtctcctcccatcgggaggacacagagagccaggaccaaagctccttatgtaagcagaccccagcctggagcataagagcatcaacgatccaatgctaaactccacttggttcagtgactgtggttgctcttacttcaatgccagctgatacctgtgcaatactgcacggcatctcaatcaggaagcacctgccgcagtacaccactgaatcgaccgcaaggactattctaaatatttctt

SEQ ID NO: 686923 - DNA, 656 bp, Homo sapiens
  misc_feature (648)..(648): n is a, c, g, or t
gagacgacgcatcgtcggcgtcggaggctgaggggctgccgcggcgggagcgcccctcgcgtcggtcctcgctccgcttggtgtcatgtgagttctcgtgagggacgcacgctgggtgagtagtagatgctttcacgtggtggacgaatggactggaccgccgcaggctgccatcccgatcatcaacgatagatagctaggtgcggatccagtgcagaggccattgcgaagaagcatggtatcgtgattcctgagacacgagtggtcactaggtgaagaacgggaggagtgcgcaagagcgaaacgagtgtttgctaggacgtcgcctggaagggctcgatagtttaatcgcactgtgcgctgcaatcggaccaaacgcaacaagtccggatgtctgagggcgctggtagggatagagataggtgaaagaagaaagtgcgccacccaggaacgcccctcttgcactccctaggcacaatggtctgtgtcgttgtgccgccgcgtccctggagacagtcctagttcactcctgacaagaggtgacagaaatgtaaagacactggcgagaagggagttgtatagacctatgtgacagtgtgagagaaagctgagccaatgaccgaaatgtgagaacaatcttgtgggacntttattgc

SEQ ID NO: 686924 - DNA, 561 bp, Homo sapiens
  misc_feature (349)..(349): n is a, c, g, or t
gcaccggatcctgagtatacagggtgtggttggagtcaccatgtggagtgagaagagggagggtgaaggtctgaggctgtgaaactccatcgtccacagatcaaaaataaacaaggccgggtgcggtgctcatgcctgtaatcccagcactttgagaagccgaggcgggtggatcacctgaggtcaggagttcaagaccagccttgccaacatggtgaaaccccatctctactaaaaatacaaaaattacccgggtgccgtggcgtgcacttgcaatcctagctactcaggaggctgaggcaggagaattgcttgaacccagaaggcggaggctgcagtgagctgaggntgcgcgctgcactccagcgtgggcaacagagcgagactcccggccaactgagtacacttcaactaatgcacatcacaggactacccaggtaggcgcagcgcgaaaaacctgaaaaggccccgtagttctgagggccacacgccgacgtggcgggtgtccccccacctcctcccagggctgacgcgtctgctgctccccctacacgcgactgc

SEQ ID NO: 686925 - DNA, 1378 bp, Homo sapiens
  misc_feature (561)..(561): n is a, c, g, or t
  misc_feature (842)..(842): n is a, c, g, or t
  misc_feature (844)..(844): n is a, c, g, or t
  misc_feature (855)..(855): n is a, c, g, or t
  misc_feature (923)..(923): n is a, c, g, or t
  misc_feature (938)..(938): n is a, c, g, or t
  misc_feature (940)..(940): n is a, c, g, or t
  misc_feature (960)..(960): n is a, c, g, or t
  misc_feature (1018)..(1018): n is a, c, g, or t
gctcaggagtctctggtagcctgcagaagtaagcctcatcatcagagcctttcctcgaaactggagtcccagatgtcatcaggttgagtgttattccagccactaagaatcgccctctgcttgttaactctaggaattagtgtgcttggagccgagatcgtaagcatctctgaatactctgccctctagagccttgcagccttaatggaaggttggataccaaggagggtgtaatggagcatcaagccagctcggcaggcagtgatggagctataactaagcatcctttagggttctagcctctccaggcatttagccgcgtcacatatagcatctaagttagctgtaggtaatgggcgtaagtacctgtcagacatttggaggcaatcctaccttgcttttgcttctagagcttagcatatctgatggtagtcaggccatattatcacatgtgtgactttccttgagtactataagaagcgtttcgtggccaccccgtaaactccagggtgggaccatatgtgccaattgcaatggcgacccctactcacatacacacanacctagccagctgtcaagggcagaatgaatctatgctggataagaaatggtggaactgcgttatgaagagctaatttactggacaaagaattccaaagcaaaaccagaacagtatgaatttgagcaggtctcataggttgagcaatttccccctaaaccaactgaaggctaaaaagcaacaggccattgtgaaccaatgctaagacgccctctatcatggtgaaaagctccatcaatgaggtatcttctttagtggtggtatgtaatggaacttagccatntntcaaagcaatngaaatgcattgctctggatctgttccttggcagtggactcagaaagccaacatgtggctcctcccagnccataaccagtattntngctgcttctgaatacaaatnggttggttttgacttcagattgaacttactgtagcctcagatgatttcccccctccgnctccaggaagaaagaatgttactgccttaatgaaaccattgaaaaagagagtgatgctcaaacagtctttcctacatgtaatgttaccctacagtagtcacacatagtgctgttcaatatagtttaggagtcagaggtctcgtgaaaaactctaaatgcgaaatcctatgccgcggggcgacttgtgacataataataggcagtggtcagggtacttggggaaaccctgggtgaggcgaattagcaggaaccttccctgagataaatcacccaagtgcaaaccaaagttgttcaagccttgtaactcgggtttctagcgggacactggcgcttatgcaaggctcgatcgtgacacttgaa

SEQ ID NO: 686926 - DNA, 344 bp, Homo sapiens
aaatgaccatggaaagatgataaatgatatttacctcatatgtcatgataactgttttttaaagaagatatctgtgccctctgttatcaggggtatgggaacatgcatcacttacaaacactcaatcaccgtgacataaagaaatagcaaaccttgaacatgtcagaacagtgcctgttcaatctacttctgtttcttgaacaccgagtttattctcaatattgtatccccaaaacaagtggtctttagaatatgatgtttactttctggtgagacttttgtgaaacatgtaagcgggtatatgagtatacacagtatgtaacaatttaataaaaatatattta

SEQ ID NO: 686927 - DNA, 1413 bp, Homo sapiens
  misc_feature (561)..(561): n is a, c, g, or t
  misc_feature (877)..(877): n is a, c, g, or t
  misc_feature (879)..(879): n is a, c, g, or t
  misc_feature (890)..(890): n is a, c, g, or t
  misc_feature (958)..(958): n is a, c, g, or t
  misc_feature (973)..(973): n is a, c, g, or t
  misc_feature (975)..(975): n is a, c, g, or t
  misc_feature (995)..(995): n is a, c, g, or t
  misc_feature (1053)..(1053): n is a, c, g, or t
gctcaggagtctctggtagcctgcagaagtaagcctcatcatcagagcctttcctcgaaactggagtcccagatgtcatcaggttgagtgttattccagccactaagaatcgccctctgcttgttaactctaggaattagtgtgcttggagccgagatcgtaagcatctctgaatactctgccctctagagccttgcagccttaatggaaggttggataccaaggagggtgtaatggagcatcaagccagctcggcaggcagtgatggagctataactaagcatcctttagggttctagcctctccaggcatttagccgcgtcacatatagcatctaagttagctgtaggtaatgggcgtaagtacctgtcagacatttggaggcaatcctaccttgcttttgcttctagagcttagcatatctgatggtagtcaggccatattatcacatgtgtgactttccttgagtactataagaagcgtttcgtggccaccccgtaaactccagggtgggaccatatgtgccaattgcaatggcgacccctactcacatacacacanacctagccagctgtcaagggcagaatgaatctatgctggataagaaatggtggaactgcgttatgaagagctaatttactggacaaagaattccaaagcaaaaccagaacagtatgaatttgagcaggtctcataggttgagcaatttccccctaaaccaactgaaggctaaaaagcaacaggccattgtgaaccactaaagaagatacctcattgatggagcttttcaccatgatagagggcgtcttgcattggtgaaaagctccatcaatgaggtatcttctttagtggtggtatgtaatggaacttagccatntntcaaagcaatngaaatgcattgctctggatctgttccttggcagtggactcagaaagccaacatgtggctcctcccagnccataaccagtattntngctgcttctgaatacaaatnggttggttttgacttcagattgaacttactgtagcctcagatgatttcccccctccgnctccaggaagaaagaatgttactgccttaatgaaaccattgaaaaagagagtgatgctcaaacagtctttcctacatgtaatgttaccctacagtagtcacacatagtgctgttcaatatagtttaggagtcagaggtctcgtgaaaaactctaaatgcgaaatcctatgccgcggggcgacttgtgacataataataggcagtggtcagggtacttggggaaaccctgggtgaggcgaattagcaggaaccttccctgagataaatcacccaagtgcaaaccaaagttgttcaagccttgtaactcgggtttctagcgggacactggcgcttatgcaaggctcgatcgtgacacttgaa

SEQ ID NO: 686928 - DNA, 965 bp, Homo sapiens
  misc_feature (247)..(247): n is a, c, g, or t
  misc_feature (311)..(311): n is a, c, g, or t
  misc_feature (314)..(315): n is a, c, g, or t
  misc_feature (317)..(317): n is a, c, g, or t
  misc_feature (816)..(816): n is a, c, g, or t
ggaaggtggggctgctggcctcccctgtcctacagccccagcctacctctgtctcctcagcaggaaagcaaagctgcggcctgagatctccttccaccaactcctggcatggccagaaagttagccagaaacaccagaaagtgccaggcagctaggaagcatggggagagccccctgaagctgcgtgtgtagtgcctgcttccgctgccatcccagaaatggacgagcttcaccctgagaacccagncacaccactgggacacatcctgacagtgacatgcacactcttccctggccccagcctggagagnagnntncggcacgagcaccagcctttgctccttctcccagtgggagtggagagaactgactgctggagtggagacagtcaaggctgtccttctgagggagcacagcacagggtctggtgtcccagggaggcaatctgaaattcaagccaggcctccccagcggagaggacacacccctcaccatgcagagtgacgtttagtaaactctcaaaagagagcacagagccccactcctccagccgacccatactctgcctccccactccagaccagtgaacaaggtggattgcccttaagccagctcagaggcaaagtccaaagacctcaggtgagtcaaacaataaaaacaaagaattaagaagaatccagctgggtgcggtggctcacgcctgtaatcccagcactttgggaggctgaggcgggaggatcacgagcaggaggtcgagaccatcctggctaacacggtgaaaccccgtctctactaaaaatagaaaaaattagctgngcgtggtggcgggcgcctgtggtcccagctactccggaggctgaggcagaagaatggcgtgaacccaggaagcggagcttgcagtgagccgagatcatgccactgcactccagcctgggcgacagagcgagactccgtcttcaaaaaag

SEQ ID NO: 686929 - DNA, 911 bp, Homo sapiens
  misc_feature (247)..(247): n is a, c, g, or t
  misc_feature (311)..(311): n is a, c, g, or t
  misc_feature (314)..(315): n is a, c, g, or t
  misc_feature (317)..(317): n is a, c, g, or t
  misc_feature (762)..(762): n is a, c, g, or t
ggaaggtggggctgctggcctcccctgtcctacagccccagcctacctctgtctcctcagcaggaaagcaaagctgcggcctgagatctccttccaccaactcctggcatggccagaaagttagccagaaacaccagaaagtgccaggcagctaggaagcatggggagagccccctgaagctgcgtgtgtagtgcctgcttccgctgccatcccagaaatggacgagcttcaccctgagaacccagncacaccactgggacacatcctgacagtgacatgcacactcttccctggccccagcctggagagnagnntncggcacgagcaccagcctttgctccttctcccagtgggagtggagagaactgactgctggagtggagacagtcaaggctgtccttctgagggagcacagcacagggtctggtgtcccagggaggcaatctgaaattcaagccaggcctccccagcggagaggacacacccctcaccatgcagagtgacgtttagtaaactctctccagaccagtgaacaaggtggattgcccttaagccagctcagaggcaaagtccaaagacctcaggtgagtcaaacaataaaaacaaagaattaagaagaatccagctgggtgcggtggctcacgcctgtaatcccagcactttgggaggctgaggcgggaggatcacgagcaggaggtcgagaccatcctggctaacacggtgaaaccccgtctctactaaaaatagaaaaaattagctgngcgtggtggcgggcgcctgtggtcccagctactccggaggctgaggcagaagaatggcgtgaacccaggaagcggagcttgcagtgagccgagatcatgccactgcactccagcctgggcgacagagcgagactccgtcttcaaaaaag

SEQ ID NO: 686930 - DNA, 251 bp, Homo sapiens
  misc_feature (144)..(144): n is a, c, g, or t
aacgggtgatgcggttgaggactacaggtggacgaagatggaggtagacgcgggtgaggatacaggtggcgacacgactggaggtagacgcgggtgaggactacaggtggacgaacgatggaggtagacgccggatgagtgctncaggtggacgaacgactggacggtacgaccgcggactgacggatacatggtgagagaagactggagtgtagaccgcggactgacggactaccacggtggacgaacga

SEQ ID NO: 686931 - DNA, 994 bp, Homo sapiens
ggacgcgtgggtcgacccacgcgtccgtatcttcattgaatctatgaagtaactaacttgattttgattttacaggctcataggaagaagggcctgccttgtctaagataagacttggacttggacatttgggttaacgctggaatgagctaagacttgggggactgttagaaaggcatgatcatgttttaaaatgtaaggacatgagatttggaaggggctgggggcagaatgatatggtttggctgtgtccccacccaaatctcaccttgaattgtagtttccataatccctacatgttgtgggagtaacccagttggaggtaattgaataatgggggtggttaccccatgctggtctcatgacagtgagtgatacctgaaggttttataaggggcttttcccctttcgctcagcacctcctgctgccttgtgaagaaggtgccttgattcttgtttggcattcaccatgattctaagttttctgaagcccttcccagccatgctgaactgtgagtcaattaacacctctttcttttatgacccaaaaaaaaaaaagagcaacacgctcaccacaattcatcataaaaaagggggggggccacaaaaaattaccccagagggggcgaacagagtatcgtgggtaccacgatttttggagagaggggtggccccgaaggggggatgcataaaacgcaagacgacggccgcaccccaccaacactggagggcaacatcaacggggggaccgtgagaggacccaacttacgggggccaatcagggaccacacacccagcaaagaagactcgggaaaaaaaaatgaacggtgcagtggtcacaccacccatgacgcgtgcgaacagagctcggatacgaaaatgcgcaacgagacaaacacacgagcacgacgagcagccgagacacgacgacgagacggcagcacgaacacgcgcactccaagagcacccagagcacgccacagagccgagaaat

SEQ ID NO: 686932 - DNA, 140 bp, Homo sapiens
ttctttaatgaacatcatctcgacactgatgcttgtctaaactgcaggattcccgagttaatgtcaaatcctccatacttcgtagtcaagaagcaggaacaagctcatcatacgcctcagagttatcgcatgaaggagtc

SEQ ID NO: 686933 - DNA, 253 bp, Homo sapiens
aatgtatagtgtctggctgctgtaacaatactacaaattgtggcataaaaaaaaaatcgatccctaagttctggatgtcagaactgggtgactttctcctgagactgtcctgatttttttttttttttttttttttgggctggaaagttggttgggggtaaggaaaatgaagggaaacgccaaggggagtttttttccagggaattggttgactttgggtggaaatttgatgatgggcccaaagaaggcccat

SEQ ID NO: 686934 - DNA, 375 bp, Homo sapiens
gtccctaggctactctagagatcccctgagtcagtagggcgctaaggattcaaacctggccaatgctctatcacctttgctcacgtgctcttcctgcccttcctggatctataggtgcagggtcatgttgctggctctgacccaatcccacaaagagcttgtgatcctgctctggcaccatggaagattaagcggtgatgaatcacccaggttttgatgtcattcctacagcaacagggagcccttggactcccagcaggggttggggcctcagagggtacatgaatcttaccccctgccctgtaattcctttgtcatcacaatgatagattcttttattattttttattttagagtctgtattaactgcttggg

SEQ ID NO: 686935 - DNA, 192 bp, Homo sapiens
gagtatccccatagcacccgtaccaagttacgtatttcacttcacaaatctaatatgtcctacctaaaaaatatggttggtaaatcttactctcataatttcaaatatggtatacagatttggttgaattctgttacacatttctacttactaatcagaatcgttattccatttaatattttaaaatggaat

SEQ ID NO: 686936 - DNA, 280 bp, Homo sapiens
aattcttctttgggaattactgtgttgctgttgctgatgcaaagaaggtctctaggaactcaattccaaattaaatcccacctagctatgcttgaaggacaagggattattgtgaataaccatggacaaaaaactatgctgctggccctagaaacttttacaggaagagcaaaaattaggttagggcaggtgcttaatttcaagttgtctggattaaaagggtgtcaaggaggttcagaattggctcagaatctaaggtggtgggctcatcagtcaaaaa

SEQ ID NO: 686937 - DNA, 126 bp, Homo sapiens
taggcaaatatacatcatcagagggccttatggaggtcacagcttaggagggcccatgagcagcctcgtcgtccgggggcccctcgatacaggcagctcgcaagcgagtacttcgtgggaccgtca

SEQ ID NO: 686938 - DNA, 541 bp, Homo sapiens
  misc_feature (242)..(242): n is a, c, g, or t
  misc_feature (259)..(259): n is a, c, g, or t
  misc_feature (262)..(262): n is a, c, g, or t
  misc_feature (295)..(295): n is a, c, g, or t
  misc_feature (314)..(314): n is a, c, g, or t
  misc_feature (323)..(323): n is a, c, g, or t
  misc_feature (335)..(335): n is a, c, g, or t
  misc_feature (346)..(346): n is a, c, g, or t
  misc_feature (376)..(376): n is a, c, g, or t
  misc_feature (385)..(385): n is a, c, g, or t
  misc_feature (387)..(387): n is a, c, g, or t
  misc_feature (418)..(418): n is a, c, g, or t
  misc_feature (430)..(430): n is a, c, g, or t
  misc_feature (480)..(480): n is a, c, g, or t
  misc_feature (488)..(488): n is a, c, g, or t
  misc_feature (523)..(523): n is a, c, g, or t
cccggctaatttttgtatttttagtagagatggggtttcactgtgttagccaggatggtctcgatctccagacctcatgatctgcccgcgttggcctcccaaagtgctgggattacaggcttgagccatcgcgcccggccctcttttttaaaataaagtagaatactactagaagaaaactctttctacagaagtggttgatatgcagataaatgtaacaaacatccttttttctctccttnaattttatttgaaggangcngattatttaaaagcaaataaaagttgtaatctntaataggatttattaggtngatagttgnaaaatatgccanaaactacccanaggccagaaggcaaagtggaggttacctgnaaaaattgntnaattttatgtgatgtgaatcacattattatnattcctaaagtncccctaaaaatctaatcattaaaatatatctagtgaaaaggctattagangaatttanaatccatgctatttaaattaagaaaggatgaaatnagtattccatagacacca

SEQ ID NO: 686939 - DNA, 304 bp, Homo sapiens
taatcccagcacccttgggaggatgaggcaggcggatcatgaggtccagagaaggagcaccatcctgccccacatggtgaagccccgtctgctacgctaacaaatgaccacaattagctgggccacctggtgagaaccatctcccccaaataagtttaagaaatcagccgggtgcaatggcaggcacactatggtctcaactattcaggaggcggaggtaacaattgccttgagcctccggaggtggagccccatgaccaggttgccccccagccctccagcccggggacagagccagacctgt

SEQ ID NO: 686940 - DNA, 186 bp, Homo sapiens
cagtcaataatctccatgggctctggcctagttttagaagtttcaatagcatcggggaggggtgctcctgaaggccaggcatggccaccacgtgacgctgttcttagtgaaggtttaagtaatattgagattatgcttttatgttgactttttatatttgggcctttatttactgctagtctgact

SEQ ID NO: 686941 - DNA, 441 bp, Homo sapiens
tgtggtcgatctctagcaggatccccagagcccaacctttctgttggcctatgccatacatgtgccgcgtgtcctcatggcgctaaagtgcccactactgaccagccaaccgtgactgtgaacttctcgaaagctgtttgttgaactctattcttcgaggcgattttcgatacactgcatcccgatgatgattaggtttttgataagaagctcttcgagatggattaagcttcttcggcgtagtatacgaggacgccttatggaatagctggaacaggctctggacatagctccggcggcgctctttagcggatatctctagtttattgttacagttgttctaactgaagatgttatcttaggctatgctgcatgactgtttggtccggtaccgtgctctaatttctaatcgtggtcctggctgttttctgtttgacatcc

SEQ ID NO: 686942 - DNA, 166 bp, Homo sapiens
cgttatgtctgctgtgcgcttcacaaaaaagccatcaatgacctgactgtggtaatgcctgcagcagtgtgctctcaggaaggctgaggttgtggacggaaccatgctcttccatctaggtatacccggcgctccagaccacagcgcttcagtcggaacttcgtgt

SEQ ID NO: 686943 - DNA, 789 bp, Homo sapiens
ggatcatgaggtcaggagttcgataccagcctggccaagatggtgaaaccctgtctctagtaaaaatacaaaaattagccggatgcagtggtgtgcgcctgtactcccagctactcgggaggctgagggaggagaatcacttgaacctgggcgacggtggttgcagtgagctgagatcatgccactgtactccagcctgggcaatagacaatagaatgagactctgtctcaaaaataaataaataaataaataaataaataaaattatgtcactttctacatatccagagatccttttaattcttgcaggactgagtttaatgataagcaataataatttgtttattgaagggatcatttgatttttacttttgataggtggcaagattttttcagaatatgggcttaaaaataaacttgctacattgggattatggctctctttttctgccctttggactagggaaatggacccaaccctgatttctggagataattcaagctttcagggcctacgtgaaagataatactggaacacacccacgctgccatcacatgctgtgttgctaggctgggactttattatttatgagctacttctgtgaggtgcaggaattaagtgaactggaaaaaacacatgggcagtaacacttagaaacatgggtggatctttaaatattaaaatccccagatggtgttcattcctggttcggggatttctgtagggcaagatatccaaggcactgtggcttttcactgtcttatcaagtatgcttctaatcaaatcct

SEQ ID NO: 686944 - DNA, 355 bp, Homo sapiens
aaccggtccttctccaacgcagaacatgcccgctttagaagaggtgtgcagatgtgctctctcacttgcccaccctactctttgtccacttcattaaggtaccgtacttgcctgtttcttacaagtatttgaggttgggtttggtttacgtgttccttaaaggacagtgggaacagacttggttagaaggagtcagcaagggccgggactgggtggtgatctttctgacggaaactcttggtccaagtgacggcaacgggactgacctgtttcccaggaccctttcggtgtgatagacaatacgcagctacgttgactaccccataggtggttttattttttttttttttttttt

SEQ ID NO: 686945 - DNA, 423 bp, Homo sapiens
  misc_feature (71)..(71): n is a, c, g, or t
actacggtagatatagagatactgtgagatacggacatgagtgttactcaggaaactctcagaataggganctcagtcgacacagtctactgtagtctataacacacttgtaagacactctctctgtcatcacatgtatggcaaagatgtcttcgtggtctccggaagacaaatctgaaatcagcgtgatgactggttttttatacctctccgactggtgttacagcgagggtgtggacccgaacaagcactgtggagtccaggacccggagggcaaaaggtcctgcacgcgatcactcacctgcaaggtgaagacaactgacctctaacctcacttcccattggttacacagcttattctgaccatcagttcgcataactttatttggccttgtgtgctttatattccttgataccagggaa

SEQ ID NO: 686946 - DNA, 81 bp, Homo sapiens
accgaggacacggccgtatactactgtactagaggatatagtggcgcggcgctctatgcttttgatatctggggccaagga

SEQ ID NO: 686947 - DNA, 347 bp, Homo sapiens
tacatattcgactcgagttagtaccagcgtgttcgcggccgacatatagttacacttgtgccatgagagagcagaattagtgcagaatgccaatggtccaggtcagcgggcccgcgggactgtcctggtgtgtagataattgtcctcatattcccagctgatctcggcgaggtgacattccgggtctactgagacttattaccgacagcagcatacagtccaaccacttgttccgggcttcagcatcccttacttctgctcccgcaggcttcgtgggtgcacaagatggtttacttggacctctgcctcatctttcttctcttgcgcttcagcctgcgcattctctt

SEQ ID NO: 686948 - DNA, 116 bp, Homo sapiens
  misc_feature (21)..(21): n is a, c, g, or t
tcggcctattatcggcacgtnctgctgtctatatcaaccaacacctgtgccgcataatagcgaggtgcgatgaatagcgaagtgccgatgaatagcgaggtgccgatgaatagcga

SEQ ID NO: 686949 - DNA, 426 bp, Homo sapiens
ggaaggaaggatgaagcctgcagcctgcatccatgtgcccgcagaagacatgatctcatagcagaatgactgtgtaatattccatggagtgtattgaccacatttgcttaatccagactgtcattgatgggcatttaggttgattccatatctttactgttgtgaacagtactgcagtgaacattcacgtgcttgtgtcattatggtagatagtcttcctctgagtgtatacccggtgatggtattgcagcgtcaaatggtagccctgcttttagttctttgaggaaacgctatactgctttccacaatggtagaacagatttacactcctaccgacaatgtatcagggtctccacaacttcgcaggcatctgttattttttgactttttaataatagccattctgactggtgtgagatggtatct

SEQ ID NO: 686950 - DNA, 140 bp, Homo sapiens
aggattatggtttcccgatactgaacattgacatgcaatatctcaaagcattctatcagaagatgtatggtatctcccatttgccaaggccatccgtgcgactaaaccacaagtgagattgactgagcaaatccgtggtg

SEQ ID NO: 686951 - DNA, 200 bp, Homo sapiens
  misc_feature (20)..(20): n is a, c, g, or t
  misc_feature (30)..(30): n is a, c, g, or t
  misc_feature (80)..(80): n is a, c, g, or t
  misc_feature (82)..(82): n is a, c, g, or t
  misc_feature (90)..(90): n is a, c, g, or t
  misc_feature (105)..(105): n is a, c, g, or t
cccgagaatcgcacggaggnggagaccccnctcatggcggccgacaccaggtggatgaggtccccagtggcgggggtggncngcttgagngagcggaaacagatntctgagagtgcctcgttgcgatgcatgaggcctcatctcgtattctccaccagctggtgcacagacagcgatgcgttgcatggctccaccaccgt

SEQ ID NO: 686952 - DNA, 253 bp, Homo sapiens
ctccagactgtatccaagtacttcttttctttcattcattcattcattcattcattcagcatttactatgtgcctctgctgggctaatgctgtggatataacagttaaggaggcagactgtcctgataaaatagctggctgggcatggtggctcactcctgtaatcctagcactttgggaggccgaggcgggaggattgcttgagcccaggagttcgagaccagcctgagcaacatggcggaacctcattttt

SEQ ID NO: 686953 - DNA, 133 bp, Homo sapiens
agtctagaatccctgggatctctgcagcaaattcgggcctaaggtgaagattgtacagccacttgacctccatctcttgacctcaagatcagcctgagtaacaaagtgagacctcatctctacaaaaaataga

SEQ ID NO: 686954 - DNA, 888 bp, Homo sapiens
ggctaatgggtgtgttcctggctggacttgatgtccaggcctgaggggttttctcgccgagtctcctggggcggtccggagctcgtgccctgtgtgtggggcccccatttgccgccgcatgcccaggccgccgccccccatcatcagctcggtccagcacgctggttctgtcatgagactagagctagatactttctaggtgcgggaagcaattatgtgcaggacaccgaaattatcgtgtctggacgactgtgatagaaacagacaccaacaacgattggggtcatactttgctgacaggcatgttttatactcaacaagaagtaggggaacttcttgtggccgctgtgatctgtgaattcagaaccaacagatgggacaagaagggatcctcggggtttattcgagcggattcagcttagggacgtcaggggtaggtcaggttcttaagaaggctatattatgggtgttcactaacttaaaagggaggaaggatggggggaatattggaggggtcattgcaatctattaaggcgtccggaagatgaccagattatggatcctattataacccaaatgggattctgtacgggttaacttcactccgttggatggaaggctaagggtattttaaggaagttttttccaagagtggtgggcctaatttaaagcgaattttagacttgaagtaacaggcttatgattgggtcccactcatttaattataaatttccatgggtttggggaatggcctggggagatttgtaaaggcaggaagagccaaaatgtgggacaggaagagttggatgttggggaagaaggggtatacacaggcggagggggaatgggacttgagagggcgctttatatttttgagggggacatgag

SEQ ID NO: 686955 - DNA, 118 bp, Homo sapiens
agaggtgatcagaggatcccgagtgtcgcgctggatatatagtacagggacttgccgtacttactcttgaattcagacctaatttacaatcatgtccacattcactgcgggagacact

SEQ ID NO: 686956 - DNA, 437 bp, Homo sapiens
  misc_feature (47)..(47): n is a, c, g, or t
  misc_feature (74)..(74): n is a, c, g, or t
  misc_feature (88)..(88): n is a, c, g, or t
  misc_feature (104)..(104): n is a, c, g, or t
  misc_feature (113)..(113): n is a, c, g, or t
  misc_feature (146)..(146): n is a, c, g, or t
  misc_feature (180)..(180): n is a, c, g, or t
  misc_feature (299)..(299): n is a, c, g, or t
  misc_feature (358)..(358): n is a, c, g, or t
  misc_feature (383)..(383): n is a, c, g, or t
  misc_feature (394)..(395): n is a, c, g, or t
gaccctgatgtgtgggttatgatatccatttaggagaaatctttttntcctaaactagtgtagcaggctctgtntcgtcactggaatntgcaccatcttagaanaatcactanaaatcgaaaactcatccaaatgctttgaaattntaatgcgtcgtagaattttgaagaaactttgatntccaagtggttttaagtcgtttggatctcaggtttgggagaaattgcatttctcccaaacaatatccagatcccgtgactactttaatgaacagagcataacttcggctacactaatcnaaatgaggcaacctcgggctctaattgaagctaacacaatttaaagaacattttgtganataacactttttccaattcaatgtncaagcacctcnnatgcctgaatttcggttgagcaggacataacaccacacaatt

SEQ ID NO: 686957 - DNA, 179 bp, Homo sapiens
tgagaccctctgtcctccgtgagagctcccttggctatatcaccgtttctctgatcactggttttcttatctgtagcttctgttctcctggttctttaacaggaccagtcgggcttcttccaatcgtagctcatccctcagctgcttgataagctgctgccgctccaaagcctgttagg

SEQ ID NO: 686958 - DNA, 119 bp, Homo sapiens
tagacatatacgaatcagctcgtacccggtgatgatgcaaacaattactgatcgtggattagagtgtattagtcacgcgtgtatgggaagtagtctctggtaatatctatgctgctggc

SEQ ID NO: 686959 - DNA, 488 bp, Homo sapiens
ctgacccagaggatccctaggtatatgtcgtgcctcaccaattccagtggtgaagagcttgagaagctcaggacagaggctgtgctgctggatggaggcgtctaggtacagaaactgtctttgttctatgccttttgtaatgagagtttcaagggtgcccacagcacgcatagcatggaaatgccttagaattcacaggctagcttctatctcgggagccatctttctcgttcccaaataaacctgccagcccctggggtaacttctcatccatcattctcttctctccaggtctgtctcttttctctctcattattctggccaagcacatacatgaaatgagaacaggagtgctgcttttttctggcagttttcaggatccaagaggaggaaatgaattgaggaagtagacagagaggaaagagcgcccgtagacaccatatttcttagatggggcaggactacggtatgcacgacatatacctagg

SEQ ID NO: 686960 - DNA, 105 bp, Homo sapiens
  misc_feature (19)..(19): n is a, c, g, or t
cagaagtcactgctgaccnctgtcagtggtgctgctgatccatggtaactgaatgtatctgaggggctgtgaagagttgatagacttagaggttacacctaaaga

SEQ ID NO: 686961 - DNA, 217 bp, Homo sapiens
cggactccttcacagacatccttcgtgccatcctgctgtcattggaagtcctaatcgaagatccggagcttcagataaatgcgcttcattttaattatagactggagtaatccctcccttcaaacaacggctccaaacctgacacccttcaatcccttaaacctggccattcgaaggggcagcacagacagtaaccccctggccccctttgtgacga

SEQ ID NO: 686962 - DNA, 542 bp, Homo sapiens
  misc_feature (36)..(36): n is a, c, g, or t
  misc_feature (63)..(63): n is a, c, g, or t
  misc_feature (100)..(100): n is a, c, g, or t
  misc_feature (103)..(105): n is a, c, g, or t
  misc_feature (118)..(118): n is a, c, g, or t
  misc_feature (170)..(170): n is a, c, g, or t
  misc_feature (194)..(194): n is a, c, g, or t
  misc_feature (201)..(201): n is a, c, g, or t
  misc_feature (209)..(209): n is a, c, g, or t
  misc_feature (232)..(232): n is a, c, g, or t
  misc_feature (248)..(248): n is a, c, g, or t
  misc_feature (403)..(403): n is a, c, g, or t
  misc_feature (408)..(408): n is a, c, g, or t
  misc_feature (410)..(410): n is a, c, g, or t
  misc_feature (415)..(415): n is a, c, g, or t
  misc_feature (430)..(430): n is a, c, g, or t
  misc_feature (432)..(432): n is a, c, g, or t
  misc_feature (511)..(511): n is a, c, g, or t
tggttaatgctttcggggcttttgctttcccccccngatcattgtgatttgctagtgctttgnttttcttaacacaaactccgggctctttggataaganaannngtgaacttctgcngggttctttcctggatgatgcgggcccttcattttttatgttgtcatttttnttctcaaattgggtaagggtattnggggggntctctctntccccttcttttttaaagggggnaatccattctgaaggnacattacaactgaccagctctcttgtcatggctggattttcagtaaagtttataattagtttcataatctgtatcttggtgaagtgatttcccaggaataacaaagcaaaaaagtctggaaaagaataggaaagcaaatgttggtaatgattagncacantnatgtnggttaacagtcttancncagccatctgcacagctgtgtccaagcgacagaccatggtgtcatcacacacttgactgatgtacgtcttaatcttgcnctgattttctgcgttcacactcaagttattt

SEQ ID NO: 686963 - DNA, 413 bp, Homo sapiens
atttcgggcttgggttttttttttgggtttgccgcccttttgggggggcccccaccttttggtgttgcccccaaaattttttttgggaacccagggggggtgaaaaggggttccttgggccccccccccttttttttttttgcccatagggtgggggcctttccccggttttcccaaagcctttttttaaacccctcccccaagattgggggaaatgctgggggtgccccttttttttttggccgcccggcgggtcccttacccgttttggcccattaaaatttcttatttgtttgcccccccccgtttaactccgggcggggtgcggttccttgcctggaaagggggccttgtccccccgatcctgggttttgggggggggttttttttccaaaaagtttttattttggtta

SEQ ID NO: 686964 - DNA, 121 bp, Homo sapiens
agatcctactaatgctgatcacagatgtgatctgatgtgttgttttaagttatcttgatctgtaacatcatgactgaggcgaatattcttagacagcctcatctgcttgtatccttagata

SEQ ID NO: 686965 - DNA, 1544 bp, Homo sapiens
gagagagctaggcacgtcaacaagttctggttttactcagctggtggagtagactcaacagctcgtacagcttgctaaatcgcgcttgaaccaagaacaagtcattgctgtgcacacttgataatggctttactgagaaaacgagaaagccagctctgctcgcaagcaggccgctcaacaacagcctggacattcaggctcaacagtgactaaactgctgctcacttctttctacaatggcacacaacaaccctaccaactatcagaatgcaagactagcaacccaccaacggcaacacagcaacttcagacacaacaccggctctcaaactaactgaaccccatccacagcgtcccctgcacacgcagcacacaccacgctcacacacacactcgactccgcgcgcgcactaacctctctatgactactaacacgcactctggcgcaacacctgcacacgctcaacactctgcgcagcaacacacttgcacaccatctgcaacaacccaagccaagcgccacgcgcctactcaaccccaatactggaccacccaacacgggtaataacccatacacatagcagcgacacccactgggactatcatagcacgctacctgccacacacacgcgcatgcccactcacacctatcgccacgggccaccacggccagcgcccacccaccgcacattcggacaccccgctccaacctcgctacactaacatcccccgcgcatcatccagacacaccgtaggaaacccaacacacgggcacgccccatcaagcttcagacgcaccacaaccgcctaccggcacccgcaaccgcaacgccgacacgcccgagctacccctgacacgcctcacccttaacgcacattccccccctttcagttggctactacaacgcgaaaccttcctcacaccaaccctcacacactcggctacacttccagcaccgcgctgggaccggcaaaaaccttcactctcagcacccgcccacgcctcgccaaaccccccctcttcggccgcacccgtcttcctccccaactgcacaacgctcactggtctgtacagcgcctattctacccctccgtgcacggaccacccattcccaacagcctgaacctacctcccaacagcacgccgaccccacccgtatgagaccgccagccccaaacgagcgcgctaccaaacaccacctcacacagcggatacccgcgtagaaaaccccttcgacgacatactggccttacgacgccatatgtggagacaccacacaaatagacaaccaaccctgcccactcgaacctcaaccccatcctcgcccccgcggaccacaacccgcagcggaaaccaactcttaacacacccacctcctggacaatcatagacccgcccaccaaatcacacaacacgaaatcaagatcgataccctctgggacgcaaacacaaaactcttaacccccgaacaacgcgcccacaaacaactgaaacactcctaccaccacagcgcccaaccccacccctcggccgccacaccacc

SEQ ID NO: 686966 - DNA, 208 bp, Homo sapiens
agcaccaggcccttgtggaaacagaaggcctgcaggggaggtgagagccataagcccccaccaccagggtcacgggcccattggcagtcccacaagggggttacccggactttaccgcacaagaactgcagccgatgtcccctagggcaggggactggcggggtggagagcagctcagggaattctgggtgctaaaccctgaggggca

SEQ ID NO: 686967 - DNA, 359 bp, Homo sapiens
ctctctagaactgaggacacactgaccaatctggcaggttaagcttcaggtaacccagttccctagggaaggggacaaacccctggacaggagctccctgctgcgtcacctgtacccccagagccccccagctcacctctcccagctgcacaccctgctcccctctggaccccagtactgctgtgctggttgcaccatgggctgtgtagtcctgctccttctccagagtcccctctggtgagctccagtacatcctacggtacggaggtctggagcacaagcacaccttgccaacctcatatccagaccaacccatcctccacacaaacagcgttgcactgttctcctccgtctaaaga

SEQ ID NO: 686968 - DNA, 1205 bp, Homo sapiens
ctcgacatcgccagtcgcggcccggccagctctctcagtgctaccctcctgcttcggcacaacttcacagccagcctcctcgaccctgcggatcaaggtcgaagaaggggctcgcatcgtcgacagccgcccgcccagcccagcccacactctggactcgccaagctagaccgctctcaagggctccaggcaccacaccaccctcatcaccgtcgccaccgtgctcggcgctcacagagccagattccagcagtcccctctcaactcgtctcgagttcctatcgggtcggactcccgcgcgccggagcaatcagcactcggctcggagggcgtcagccagtcacctcgcccccgctcacgtcgcgcagctcggcgctaccacagggcccagcgcccctcgacacgcaccgcacgaccagcgccacaaccaccggccgcccgcgcgcaacatcccccggcgccggctcctcggagccgcgacgaaccatccgagcaagacccatccactccccccacctcgcgcccgaagcgccccagcaccggacgccccgcgccgcacactcacccaccccacccccaactcacgcaccctcgcgcacgactcgccccccccaagcaccaatcgcacccccccgcctagacgccccctacgattcccaccctcgcaccgcggcaccgcgcccgccccccccgctcgccccccccgtccccccacccaccgcccacccgcacacacccccacccccacccctctcccccgccacccctgcaccccaaccccacccccgcccccatacaccacgccaaacctcacccacgccgagcttccccccccattcacccacaaacccgcgcaccctgccctccccccacgcacccgaactggcacccatcctcgcgcaccaacaacccacctggctcacccactcgtaccagcgccacatccctgccccacggaccgccccatacgagaccacaacaccacggccgcacgccacaccggaccacacagacgcgcatcgcaccacagacacccccaccccccgccaccccgcgccgcacccgcccacccgctccctccaccacgtccacctcggcccgccaccacccgcacccacccccaaagagcaacacccaccgcggaccaagacaacacccgagcacggacccagacccacccccccgccacacagccacccgccagt

SEQ ID NO: 686969 - DNA, 1048 bp, Homo sapiens
gctgaattgtaacaatgatgtgtgcagcggatgtgtcgtgtcattattaatggctagctcccaatattctcccatgggcagcaggaggactatggcgtgacaggataggtagagaacttgacactgttgccctttgagatgtgatcaggaggctggtggaatctcatgccttcattcccttcagtcccctgtgaactaggtgggggtgcattgcgggctcggtcaagcgtccgtatcatgcgaatgattgcatcgatgatttgcatggatagtactggacacatctggctatagacgtcactcaagagtggttgtagctgtcctattccctgggctagccttcgtctggatcagtcgatactttgtgactggcacatgttcattacgaggatcgcatacaagggttaactctcgtacatccttcagtaccacgtacgtgaggaccagagaaaatactgtactaaacagcacgcctaggtccgtttgcgctcatttgagcgtcgtgttggagctagagacttcgtcgcgtagtatgccatatgtacagcctaggtgcccttgaagttcatccttggagtcaaactgtgaaccttgagagtgtcttaccagaacatgggtggtcgtgacaaaggaattgggaaattgtagtgataagcacacgagacaagactagctatgttgcagagttcacaggctggtgacagcatatcaccgtacccaagttttatccataccccacgtggagggacatcatggtacgttacgaagtaactcgtcccttttcgcatctgcgcgcgtggaactacgttacgagagggactagggagcaccacaagtgtcggcgaatccgtgacggaaagaagatgcgttttgactgacacgcgttgggatgaccttttgcctttttacgcatctgagatggtgtcattccatcttctccagggccttggcgtgcccatatgaagcgaaagtgtcgcggatatttaaggagccttagccgaaggcgaagcccacatgcgagtaacctgtgtacggagtgactatggag

SEQ ID NO: 686970 - DNA, 434 bp, Homo sapiens
gaaaccccatctctactaaaaatacaaaaaaattcggagggtgtggtggcgggcacctgtagtcccagctactcgggaggctgaggcaggagaattgcttaaatctggaggttgcagtgagctgagattgcaccacttcactccagcctgggcaacaagagtgaaactccatctcaaaaaaaaacaaggaatatagataaccaatttctggcccccagttatccttttaaccttgcaaaactccttccttttggctagaagtgaagtctttggctgggagatccactttatgttcctattgagctttggaagcagaaggtctgaaggaaccgacaaagaccctcacagttgtgaagtctctgtttataccgagcagtagcggctgcttcgcccgtctcaaactgcggggacaggaagcatatggagccagttga

SEQ ID NO: 686971 - DNA, 178 bp, Homo sapiens
atcctatccgctgatccagcagctaggactacaggcacacgccgccacatccagcatggtgaaaccctgtctctactaaaaatacaaaaattaactgggcgtggtggcgggtgcctgtaatcccagctactcgggaggctgaggcaggggaatcaattgctggatcagcggatcgagt

SEQ ID NO: 686972 - DNA, 752 bp, Homo sapiens
  misc_feature (6)..(6): n is a, c, g, or t
  misc_feature (104)..(104): n is a, c, g, or t
  misc_feature (119)..(119): n is a, c, g, or t
  misc_feature (134)..(134): n is a, c, g, or t
  misc_feature (157)..(157): n is a, c, g, or t
  misc_feature (167)..(167): n is a, c, g, or t
  misc_feature (172)..(172): n is a, c, g, or t
  misc_feature (210)..(210): n is a, c, g, or t
  misc_feature (214)..(214): n is a, c, g, or t
  misc_feature (250)..(250): n is a, c, g, or t
  misc_feature (253)..(253): n is a, c, g, or t
  misc_feature (257)..(257): n is a, c, g, or t
  misc_feature (259)..(260): n is a, c, g, or t
  misc_feature (262)..(262): n is a, c, g, or t
  misc_feature (271)..(272): n is a, c, g, or t
  misc_feature (279)..(279): n is a, c, g, or t
  misc_feature (283)..(283): n is a, c, g, or t
  misc_feature (320)..(320): n is a, c, g, or t
  misc_feature (339)..(339): n is a, c, g, or t
  misc_feature (392)..(392): n is a, c, g, or t
  misc_feature (411)..(411): n is a, c, g, or t
  misc_feature (419)..(419): n is a, c, g, or t
  misc_feature (437)..(437): n is a, c, g, or t
  misc_feature (455)..(455): n is a, c, g, or t
  misc_feature (460)..(460): n is a, c, g, or t
  misc_feature (463)..(463): n is a, c, g, or t
  misc_feature (473)..(473): n is a, c, g, or t
  misc_feature (478)..(478): n is a, c, g, or t
  misc_feature (486)..(486): n is a, c, g, or t
  misc_feature (528)..(528): n is a, c, g, or t
  misc_feature (537)..(537): n is a, c, g, or t
  misc_feature (618)..(618): n is a, c, g, or t
  misc_feature (664)..(664): n is a, c, g, or t
  misc_feature (683)..(683): n is a, c, g, or t
  misc_feature (696)..(696): n is a, c, g, or t
  misc_feature (705)..(705): n is a, c, g, or t
  misc_feature (724)..(724): n is a, c, g, or t
  misc_feature (731)..(731): n is a, c, g, or t
  misc_feature (733)..(733): n is a, c, g, or t
ctagangccatatctgcgcttcacagaggggcactgcacctattgcgcaggaatgtttcgaccttgttcatgtgcttcctgaagcagttgagcagcccgtagtncttgagcggtgcgtnatggttgtgcgagtntgtgtgagagcttgctgtaggtntgcttgaggntctgnccagttcggcggctgccgtttttctgcctccccttttncgtntggatgtccttcctctagtgtcctttaggagggganagntatngnngntcgaggggnnagaaatnaggntgtgggcgtacatactcctgtggaaacgcacgggctncagctaagaattgatgagnagcagggatgtagtgcgtgagcagctctagattgtgattactgttggcgtttntctctcatgtggtgagtgngtgttggnaatagaagtttgaatatncagaatggagtgtctggngagtnatngcagagaatntaatnctctctgngtccttttggggataataggttttcttacaaactctctgggnagggtgttnaatgggccagccgggtgcgcgcgtaaggggcttgtgagcaatagcgtgggtcaaaaaagcctgtgatatacgggaacggtnttgggacgggcacctagcctcttagaaagccaggggcaggcgagancaggggcaaaaagccaggnagcaggggacgtncggggagcntgggagccatttgccactngggtgancngttcacaggaccctgaatt

SEQ ID NO: 686973 - DNA, 341 bp, Homo sapiens
cgagctcggtaccccggcccgagcctgctgaaccaagagaagaccgaagccgtcgaggctgtggagcggcggctcgagttcatcgacaaggaggtgtaagctcccgccatctaacctcatttctgtgactgagctaatctgaggctttcgctccgatgacagtgagcgcataaagaagcagatcacggacttacaggacaagcaagacggggcgcgaaccgaaatgtttgcgctgcaacagcaatcacagcaggcgcagaccgtgcaggcggcgtagtgggtgcgacgagcagtgtacgatgtcaaaagcgaaacgagggaattgagtcacgaagctggtg

SEQ ID NO: 686974 - DNA, 949 bp, Homo sapiens
gtggggacgccgaagacccgggccgctggtgcccaacggactgtctgaaggcttagcgaggcaactgtatatccctagtggtccaatgttgcggtcaaccctttcttgggatagcaataaatggatgtcactgaggaggtgttcggacaaagacttctggacattaatgtgatcggccccaagacttgcgatgacaaagggcagctggtgccaagaaatggagaaacgaggagcggctccaagtgtgtgattagtgtcttcccatagtcagccttcagtccatctcctggcttcagtcctttacaatgtctacgttacaacagcctcgctggggccttgactccaagatcctggcctatagagctggccccaaggaacattagcgtgtaactgccaagcacctggaacttatcaagactagccttcagcaggatgctctggatggacaaggaaaaagaggaaagcatgaaagaaaccctgcggataagaaggttaggggagccagaggattgtgctggcatcgtgtctttcctgtgtctctgatagatgccagctacatcactggggaatacagtgttggtgcggtggaggtaccccgtcccgcctctgaggaccagggatacagcccacaggccagagttgggctctagctcctggtgctgttcctgcattcacccactgccctttcccacctctgctcaccgttactcttcaccacaggtcaaatgagttctgccctgtgtaaagatccagcttccgtgccgtaaaggtggcgtcttactcaggattccgcagctgctgttcgtggccttgggtaaggcctcccctgagtacacagacaggcctgctgaaaggctgagatcttaccttaggcaaagaccaagatattttatcatgcgccactggggaatctggaggagtgatgggagagaaggaaccctggaggtta

SEQ ID NO: 686975 - DNA, 84 bp, Homo sapiens
aagacagcagcatatatctctgcagcgttgggctatttaactcctacgagcagtacttcgggccgggcaccaggctcacggtca

SEQ ID NO: 686976 - DNA, 546 bp, Homo sapiens
atgtgcattactttgatacggccgaggcagtacaattcacctgtatctcaggatttcaaggtatcagcttggtcaacataatgtgaccagagtctctagcaaaaagtatcaatatataaaaaaaaactaatacgtgcatcattgtaccgactggctgtccgtctacacacaggagggagggagagaggccagagcacttttagctacagtaccctttatactcttccttctttttctctttttttaaacaatgcccaagttttactttttcaactaaaagtaagtattcttacaaaaagagggtggtagcaggtcacagacccagctgggctgcagaaggtggctttggctacttactgtcaccccctaatcctaactgtgccttccacacccctaacagttcctcctcctcccattctttctgcattaccctggttcctggctctgcaactgtagccaggacggcctcagaagttccctgaacagagcttccaggcaggactttgcatacaggtgtacaacacacactgctggatacccacacac

SEQ ID NO: 686977 - DNA, 389 bp, Homo sapiens
atattgctagtctggcgcttccaattaggtgcatgagtaggtggcctgcagtaatgttagcggttaggcgttcgaccagggctattggctgactgagtagactgatggtttcgatcatacctagtattaatcttagagcgaaagcctataatcactgcgtccgctcattagcggatgtccatggctaggtttatagatagttgggtggttggtgttaatgagtcaggcagtagtccgagatggttagttgtgaccatataaatgattaagcatactagtataagagctcaggttagtcccttagtggtgtgtacggttatcatctgtcttcagattagtttgattagtcattgctggctgataatcagtcgggtgttaatgagatattt

SEQ ID NO: 686978 - DNA, 518 bp, Homo sapiens
tccgtgaccgttgtttactcatgtggccaggacagcctcctcctagctcccttcctggggggcaggccagcacttcctgtgtacaggatctgcagagaggggaaccagggcccaccaacctctaaaccaaagttcgtcacacaaatttagagaccagactttggagatgataaactgtccctttcatctgttaggaaactcagagacaggaagggcaagggactgtatttataaggaaaaggcaggacaaatatttcagaccccaggcttagctgcacagagccagggttcttgccaggaatccttgactaccaaatcatgatcttgcttcctttatcactgctcattaggacctctgaggaggctcaacagaaagaagagggagggggctggcaaggcatcagtgaaaaggcagtgccggtgaaccgggaagccagtgcttgctaatgagctgtgggctcctccaaggcccacactctgaaggttcccttccctccagacaggtgcaagcgtaaaat

SEQ ID NO: 686979 - DNA, 575 bp, Homo sapiens
  misc_feature (1)..(1): n is a, c, g, or t
ntcacagagtgaatgtcatttttgacttaggtatgagccttgtccgacaaccgcatggggaatcatttcgccccagaggagttggaacattgctcgccaacctggcatatagattgctggccgttggttttttgatctgttttcggcgagggttgctcgtgattgttaatccctttaatgcaccaaaattgtctgccaaacggttacgaaacgcactggtgacgggctctgccctgttttgcctgttcggcgcgggtcaactgtgggcgttcagtctggatgatgtgtcggccaaggcaaaagagctggctgggcagaaatacgaagctccgcgcagcaatttgccgaacgaattccgcgaaatgaaattcgctgactaccagaagattcgtttccgtaatgaaaaagccgagtgggccgatcagaacaccccgttcaagctgtccttctatcaccaggggatgcatttcgacaccccggtgaaaatcaacgaagtcaccgccgacagcgtgcatgaaatcaaatacgacccgacgcgtttcgatttacattcactgtgtacacattcatctgta

SEQ ID NO: 686980 - DNA, 296 bp, Homo sapiens
gacctaaggaaggaggaagtgtttgtaaactatgcatctgacaaagtctaatatccaagatctataaggaacttaaacaattgaacatgcaaaaaacaaacaaccacatttaaaaatggacaaaggacatgtaaagatacatattacccaccaaggaattatgaaaaaagattactcacattactaattcattaggagaatgctaattcaaaccccacaatgagaaccatcacacattattagtcagattggttactattaaggtcaaagtttagcaattgctggccaggttcttg

SEQ ID NO: 686981 - DNA, 211 bp, Homo sapiens
ttctgcatgatgaattactagaaatcactttgcaggagaggcaagctaagagccccgaatacagacgagctacctgagaacagcttaatagagcacagccgtctattttgcccaatagtgggcagatttttaggttgaggccaaaaacctaccgagcctggtgatcgctggttgtcccagatagaatcttagttcaactttaaatttgccc

SEQ ID NO: 686982 - DNA, 691 bp, Homo sapiens
  misc_feature (15)..(15): n is a, c, g, or t
  misc_feature (23)..(23): n is a, c, g, or t
  misc_feature (50)..(50): n is a, c, g, or t
  misc_feature (117)..(117): n is a, c, g, or t
  misc_feature (277)..(277): n is a, c, g, or t
  misc_feature (300)..(300): n is a, c, g, or t
  misc_feature (387)..(387): n is a, c, g, or t
  misc_feature (402)..(402): n is a, c, g, or t
  misc_feature (412)..(412): n is a, c, g, or t
gctccctgcctccgngtcgcagnccccgccgtagccgcctccgagcccgncgccacatcctctgagcagaagatggctgtgccacccacgtatgccgatcttggcaaatctgccagnggatgtcttcaccaagggctatggatttggcttaataaagcttgatttgaaaacaaaatctgagaatggattggaatttacaagctcaggctcagccaacactgagaccaccaaagtgacgggcagtctggaaaccaagtacagatggactgagtacggnctgacgtttacagagaaatggantaccgacaatacactaggcaccgagattactgtggaagatcatcttgcacgtggacttaagctgaccttcgattcatccttctcacntaacactgggaaaanaaatgctaanatcaagacagggtacaagcgggagcacattaacctggtctgcgacatggatttcgacattgctgggccttccatccggggtgctctggtgctaggttacgagggctggctggccggctaccagatgcattttgagactgcacaagatcccgagtgacccagagcaactttgcagttggctactgagactgatgaatgccaggttcagcactaatgtgaatgacgggacagagttggggcggctccatgttaccagaaagtgaacaggaagtggagaccg

SEQ ID NO: 686983 - DNA, 735 bp, Homo sapiens
agcggaaacggcgcggggtccgctatggtcggcggcgagtcgagggcgtactggcgacccggagtgatgagcccgcccgagagcgatgccgcgcgtggagacagctgaggaagcaaaggagcctgctgaagctgactatcaacttgagcttctgccgggacgtgttcttcctagaatggccacgttgacctgacgtggggaacgtgacggcctacccagttgaagtagctatagagctccgtggagagatatatgagataagctctaccagctttgcaagtatcttgcagaatgcaaaggatattggctatcaaagcattagtcaggaacattaaaggactgtaaaccaagaaatatggctgggactgcaagcctttagtctggagttcagatccaatgttcgttgtcagagccaggtgagcagctcttgagtcgggcgagcttacaagttggatgcatattcagaataactggccagagtacaagatagctggagaagcgcatgagaatacttatttctatgggacagagtcttattgggttctaagatgtggaaggagtgttttataaagaactgaagtcctgaggatgatgaaatgtgtgaaaattcctcgaatggagtttatgctggtcatcacaggaacagtctcaaggatatcgagtaaagtggaggactgtggctattctgtgaagcttgtttgagacatgaatccctcagaatctcagatttaatat

SEQ ID NO: 686984 - DNA, 438 bp, Homo sapiens
aagaaggctagcacatggactctgatggatcatcttgaggttatagaacctcttctagccaacctaggaaaccattccctacaatcactagaagataggtctcccctttgaatgaactcttgccattttaagtgaaaacccatggactcaaaacagtgttcttgagacacatgcttgaatctacttctattctgtggaatgtattctatgctgttactctcaagttcaataaatctacatatactgttagtattaccacttattacttagtactcatttctttgaaataaccttcatatcatgtcctgcttccctcccaccacacttctgggtaacagaaaggtgtttgtagttaatttgaagcttttaattatatttctcctttattgtttgagaattttatatatgtatacattgtgttattgtgttttgattaaa

SEQ ID NO: 686985 - DNA, 203 bp, Homo sapiens
  misc_feature (3)..(3): n is a, c, g, or t
  misc_feature (187)..(187): n is a, c, g, or t
tanttaaaaataacatagagaatgtaattggattgtttgtaacttaaaggataaatgcttgaggagatggacacctcattcttcatgatgtgcttatttaacattgcatgtctgtatcaaaacatctaatgtaccccataaatatatacacctactatgtacctatacaaattttttaacataattnaaaattaaaaatacgt

SEQ ID NO: 686986 - DNA, 539 bp, Homo sapiens
atcactcaattgaacaagatactaagctctggtcacagcttcttcctctgtcttgcccttgccttaccaactcctgccaaagagcctttgcccagggctgttatttcagatttgggaggccacctcggcctcccaaagtgttgggattacaggtgtgagccaccatgcctagccaattcaacagaatttgtaaaaggaaatgaaaccagatgtctagtgtggctgccttctgcttgagtggctggttagcctcattagagctttgtctaagggtgtctcctcaccaaagaaggcaatgttcccccaggtgacttaagtgacaaattctcttttatatcgtgaatttattcattctttcagtacactgttcagcatctaccttttaccaggtcctgcacttggtgctgaaatgcaaagatgaaacagacatacttccttgactgtgtagtagaggaaatgcaatatttatttattgtttcatttgttacataaacctatagcgaattgtattccagatgctatattaaagaaatgatatc

SEQ ID NO: 686987 - DNA, 208 bp, Homo sapiens
tacacacacaggggtaatagggaatttggcacacaccctgtccctagaaaggacagctgtaggtggagagtagcatactataagttataggaccatccaacttttcacacaaagctagaaaatagtatagttctctttaaagtataccaatatataaagcactagtgtgagtcaaacaaaactacttcaaacaaaacaagaccacata

SEQ ID NO: 686988 - DNA, 1283 bp, Homo sapiens
tggggccaaaaggggggaagggggggggcatcgaggggaaaaaaggggcgccctttattaaaaatatattttgggggagaattcatttcctcgagagcacgagagggggtataaaaagtggtggggtggcgccccacaaaatattaaaaatcttgtggcccgcggatatcccccgccgggggtgtgtgagagggggaaaagagggggtggggtaaaagaccccggggaaagggactctgcgggtcaaaccccacagggggggcaacccccagagagagagcggcaaaccttctcgggggagggaaaatatataataaaagaagagagggggggtaacaagagaggggagaaaaacacacccagagggcgaaaacaaagaggagacacaagagagacccgcggggcacaaagaaaaaaggagggggaaacacaggcgggccgcgcgagacgaacacaaacaaaaaacaaccgcgacgcgcaaaagagagcgagagaaaccaaaggcgaggtctcaaaacaacgaaaggggaggcccacacagagaacacagggaggatacagaggagcgagcgaaatccacaaaacaacaaaaaagagagaaaacgagtacaaagagagaagaattaaacccgaaaaccgtaggagcgagcacaaagagaaaacacaaaacgaaacaaaaagacgtgggagagacaagaaaaaacccacacaaaagggaaatcataatactcctcaacacacacagtctcgtcaaaacaacgacaagaacaacacagataaaaagcataggaggcgggaaaaaaatatattgtacctccaacagcagggagttacacacgaagcgccctaaaaacaaaagcagacaaaactagagaaaaaagagtcatattcaaagagcgggagagaatatatctaaacaacagagacaaacaacagcccacactctattagaagaggtagagtatagaacgcaggccaaaaagagaaataaactcgaatatcacaagacaagaccacctcatacaacacaaaaacacaaaacaaagaagtacacggaacacaaagcaagagacacgaggaacaaccacaagaccaaaaacacaggaaagagacagagacaaaaacagacaaccgaccgaacacacgaccgaacgaacgaaaaggcaagaagaagaagaaagcgagacacaacaacgagaaggagacgacaaccggggcaacacgagagcacacgagagcgacaagcgaagaggcagagcacgacggtcgcgctcgccccgttt

SEQ ID NO: 686989 - DNA, 427 bp, Homo sapiens
  misc_feature (334)..(334): n is a, c, g, or t
  misc_feature (352)..(352): n is a, c, g, or t
  misc_feature (371)..(371): n is a, c, g, or t
  misc_feature (389)..(389): n is a, c, g, or t
  misc_feature (404)..(404): n is a, c, g, or t
  misc_feature (422)..(422): n is a, c, g, or t
ttcatcaaaaagctttgtaggcggggcatggtggctcaggcctgtaattccagcactttgggaggttgaggtgagcggatcgcctgaggccagatgttcgagaccagcctggccgggatggcggacccgtctctactggaagtacaaaaaattggctgggcatggtggcaggggcctgtggtcccagctattcgggaggctgaggcgggagagttgcttgagcctggggaggtgggggctgcagtgagctgggatcgcgtcatcacactcctgcctggggcaacaagaatgaaactccatctcaaaaaaacaaaaacaaacacaaactaacaantaaaaaccccaaaaaagnttttttagttgttttcctntccactttaaacatggcnttttctgttgagagnattttaccatttcacttngagtt

SEQ ID NO: 686990 - DNA, 403 bp, Homo sapiens
ccagcctggagactatttgatttacatacaaactactaccttagaaacttttcaccgaagagccacccctcaggtctcatggctatgctcaagtggccaatgctctcactccttgacattacataacctccccgacatgcctactatagtttctcccataaagggtgactgtttaatcctaattctatcccatgtgtgacggttaattttatgtatcaactcgtctggactaagggatgcccagataactggtaaaacatgatttctgggtgtgcctgtgaggatgtctatggaggaggttagcattagaatcagtaaaccaattaaagaagactgccctcaccaaatgggtaggcataatgcaatcctgtggaggatgtgaatttaaccaaaagtgcaaagc

SEQ ID NO: 686991 - DNA, 852 bp, Homo sapiens
  misc_feature (203)..(203): n is a, c, g, or t
  misc_feature (278)..(278): n is a, c, g, or t
  misc_feature (308)..(308): n is a, c, g, or t
  misc_feature (316)..(316): n is a, c, g, or t
  misc_feature (325)..(325): n is a, c, g, or t
  misc_feature (328)..(328): n is a, c, g, or t
  misc_feature (330)..(330): n is a, c, g, or t
ggggctggggggtcggtgcggatattcagtcatgaaatcaggtagggacttctcccgcagcgacgcggtggcaagatgttgtgtgcgggcgcggacttcaaggtgatttacaacgagatgctgctctccatagggatgctcatgtgtcagccacacaagtctacaccatcttgatgtccagctcttggcattcttaaacctantgctgtagaagcagacattttagcatataactttgaaaatgcatctcagacatttgatgacctccctgcaagatngggttatagacttccagctgaaggtttaangggttttnggattaacncanangaaatgcctgtgaacccatagtgcctccaccagtaaacagacaatttcatctggcactttcatcgtgttaattagaagactgtgatgtgtaatttgatatacacggttttaaatgcacagagagcaggatacaagggaggcatagttcaaccaatgtgtgattctgatgactcattagcatgggatccaacggacattggggtcctacagaaaatgtgacattccattctggctttattggggatcatcaggtattttggaggatgatttcattgaaaagggggcctattaatcgaataggtttcttgaatataccaaattccttctatataggggtggtcgtggaggtttcggtgcaacatggtggggaatatgtggaaaagttggagcttaacgtggttatacaagggatgttgtcgggggtagggggaccacttctggttatgggtgtgtgtaaagtggtggaaaaaatgtctgtctgtggggtgtgctcgtgtatgttaggatgttacgtgagaggag

SEQ ID NO: 686992 - DNA, 763 bp, Homo sapiens
  misc_feature (747)..(747): n is a, c, g, or t
tgctggctctttgtagcgcgtgttgctccttggtttttctggtcctcttgtctgggtgtgtgggtcgcggtccctgtgttgttttcgttatcgccctttgggtgccccggtggatatgtttgtgttgtgtatcatttctttttggttgttgctccctcgtgttgttgtgttgtgtacgtatgtacattgtggtatatgtccttgtgttatagaaagcctgttatcgacacctggttcttgattcttgatgtgtcttagcaagtaggcttagtctatagattggtatggttggccgcgatcagttttttgaggtgtagcatgtgtggacttgtctgagttgatccagtcaacatctggaactctcgatggttgcgttcagaccaagtatcatatgtgggattcatgtgctccagtcagcccgtcctcgccatggagtcttctgtccgtgtccgtgcgcattagatgactgtacgttatgatagaatacccaggaagatcttttggtgacgtgtcactgggctgctttttctgcgcttcagttaatcaagtgttggcaaacgatgactttctcctggcccctgcctgctggagatcagcatgtcctgtcctttcagtctgatccatccatctctctctttgcctgaggggaaagatgagatgggccaggcagagaatcagaatctggacggcagtccatctagggaagtgggactgtgaggccatacgtgtgaaacgtctggactgtanctcagagtctttagtt

SEQ ID NO: 686993 - DNA, 830 bp, Homo sapiens
  misc_feature (181)..(181): n is a, c, g, or t
  misc_feature (256)..(256): n is a, c, g, or t
  misc_feature (286)..(286): n is a, c, g, or t
  misc_feature (294)..(294): n is a, c, g, or t
  misc_feature (303)..(303): n is a, c, g, or t
  misc_feature (306)..(306): n is a, c, g, or t
  misc_feature (308)..(308): n is a, c, g, or t
ggggctggggggtcggtgcggatattcagtcatgaaatcaggtagggacttctcccgcagcgacgcggtgggacttcaaggtgatttacaacgagatgctgctctccatagggatgctcatgtgtcagccacacaagtctacaccatcttgatgtccagctcttggcattcttaaacctantgctgtagaagcagacattttagcatataactttgaaaatgcatctcagacatttgatgacctccctgcaagatngggttatagacttccagctgaaggtttaangggttttnggattaacncanangaaatgcctgtgaacccatagtgcctccaccagtaaacagacaatttcatctggcactttcatcgtgttaattagaagactgtgatgtgtaatttgatatacacggttttaaatgcacagagagcaggatacaagggaggcatagttcaaccaatgtgtgattctgatgactcattagcatgggatccaacggacattggggtcctacagaaaatgtgacattccattctggctttattggggatcatcaggtattttggaggatgatttcattgaaaagggggcctattaatcgaataggtttcttgaatataccaaattccttctatataggggtggtcgtggaggtttcggtgcaacatggtggggaatatgtggaaaagttggagcttaacgtggttatacaagggatgttgtcgggggtagggggaccacttctggttatgggtgtgtgtaaagtggtggaaaaaatgtctgtctgtggggtgtgctcgtgtatgttaggatgttacgtgagaggag

SEQ ID NO: 686994 - DNA, 372 bp, Homo sapiens
gcggccgcctactactactactgctcgaattcaagcttctaacgatgtacggggacatgtacatacgtccagatggcctgaagcaagtgaagaatcacaaaagaagtgaaaatggcctgttcctgccttaactgatgacattaccttgtgaaattccttctcctggctcatcctggctcaaaagctcccccactaagcaacttgtgacacccacctctgcccgccagagaacaaccccctttgactgtaattttcctttaccaacccaaatcctgtaaaatggtcccaaccctatctcccttcactgactgtcttttcggactcagccagcctgcacccaggtgattaaaaagctttattgctcgcaaaaaa

SEQ ID NO: 686995 - DNA, 388 bp, Homo sapiens
  misc_feature (9)..(9): n is a, c, g, or t
  misc_feature (68)..(68): n is a, c, g, or t
  misc_feature (100)..(101): n is a, c, g, or t
  misc_feature (128)..(128): n is a, c, g, or t
  misc_feature (132)..(132): n is a, c, g, or t
  misc_feature (134)..(134): n is a, c, g, or t
  misc_feature (143)..(143): n is a, c, g, or t
  misc_feature (146)..(146): n is a, c, g, or t
  misc_feature (148)..(152): n is a, c, g, or t
  misc_feature (154)..(154): n is a, c, g, or t
  misc_feature (191)..(191): n is a, c, g, or t
  misc_feature (212)..(212): n is a, c, g, or t
  misc_feature (219)..(219): n is a, c, g, or t
  misc_feature (226)..(226): n is a, c, g, or t
  misc_feature (231)..(232): n is a, c, g, or t
  misc_feature (234)..(235): n is a, c, g, or t
  misc_feature (241)..(241): n is a, c, g, or t
  misc_feature (260)..(260): n is a, c, g, or t
  misc_feature (262)..(262): n is a, c, g, or t
  misc_feature (292)..(292): n is a, c, g, or t
  misc_feature (297)..(297): n is a, c, g, or t
  misc_feature (311)..(311): n is a, c, g, or t
  misc_feature (323)..(323): n is a, c, g, or t
  misc_feature (334)..(334): n is a, c, g, or t
  misc_feature (336)..(336): n is a, c, g, or t
  misc_feature (341)..(341): n is a, c, g, or t
  misc_feature (359)..(359): n is a, c, g, or t
  misc_feature (361)..(361): n is a, c, g, or t
  misc_feature (369)..(369): n is a, c, g, or t
  misc_feature (371)..(371): n is a, c, g, or t
  misc_feature (375)..(375): n is a, c, g, or t
gaaaaaatnagtaatttaaaaatctctataaaaatctgaacacataaacaaatctgtactaaaacaanaacaaccttctcactctacatataattaaacnnacagcatcaaccatctgaagtagaaancaanancacctccangantnnnnngnccccgacaaaccatgtagatggacaaacaagattggnggtctttagttgcgggcggcngccgggnctgcggnggggnncnngagccngcgggggggggtcggcttncngtccgggcggggtgggggggggggggcggnggggngtcgggggggggcngggggccggggngggggggcggngncggcngggccgctgcgggcgggngngcgccccngngtgncggccaggggcga

SEQ ID NO: 686996 - DNA, 442 bp, Homo sapiens
  misc_feature (264)..(264): n is a, c, g, or t
tggcggcggacggacagggtcttgctctgttgcccaggctggagtgcactggcgcaatcacagctcaccacagccacaaactcctggactctggtaatccttccaccttagcctccggagtagctgggactacaggcacgtgccacaatggctggctaatcctttaatttttgccgatacaagatctcgctgtttctcgggtcgacaatttcttttcttttttttttttgagacgaagccgctctgtcgcccaggctggagcgnagtggcgcgatctcggctcactgcaagctccgcctcctgggttcacgccattctcccgcctcagcctcctgagtagctgggactacaggtgcctgccaccatgcctggctagtttttttttttggatttttagtagagacggggtttcaccatgttagccaggatggtctcaatctcc

SEQ ID NO: 686997 - DNA, 381 bp, Homo sapiens
tggcaggcagggctgggccacggaactgggtcccaggcatcaaggccacgtgcgaggccagggagggatgcttcctcacgaggcgcgtcacgaagcgagcgaagggacagagaagccctgcggtccagtgggcgcttttgtcactgtttagcaatttgaggtgtgcatgagcactgtacagagcctcactctctctgtacattccgtccctggaggtgccctggtccccgctttggggatgggagttttgtagactgtactataaatcggcagctctatgttcttgtcagctcagtagttctgttaagtctggaatatgcagacagacgtaaagatgttttagcagaaattggacgacagacatagaacattgaaatcaag

SEQ ID NO: 686998 - DNA, 351 bp, Homo sapiens
  misc_feature (264)..(264): n is a, c, g, or t
tggcggcggacggacagggtcttgctctgttgcccaggctggagtgcactggcgcaatcacagctcaccacagccacaaactcctggactctggtaatccttccaccttagcctccggagtagctgggactacaggcacgtgccacaatggctggctaatcctttaatttttgccgatacaagatctcgctgtttctcgggtcgacaatttcttttcttttttttttttgagacgaagccgctctgtcgcccaggctggagcgnagtgagaactctgtctcaaaaaaaaaaaaaagaaaaaagaaaacacactgtatcaaagaagcctacacaaaaggctacatattatat

SEQ ID NO: 686999 - DNA, 110 bp, Homo sapiens
gcgtatgcccatcataacagtctgggcacaaaagctggcgggtctctctgatttgattgtacaggtgacgacgtgcaggcagttgagcagctgccgcttgactcgtggat

SEQ ID NO: 687000 - DNA, 539 bp, Homo sapiens
taccaatgtcagccttcccaggtagctgggactacagctggatctaccagtgaaagacttggtgaatccaggaagagagactgactgggcaacatgtaatacagtgtgggaacatccagttgcaggaaaacaagcttaacaggcccactgattctacattatgggtctccctctgtggtccaaggctggagtgtagtaagtgctatcgcaggtgactgcagcctcaaccttccaggctgaagggatcctcccagctcaaactcccaggtggctgaagactacaggtgctagccattatgcccaaataacatttggaatgttcgtatacgtggattctagaggggggtgacagcgaaaggtgggaccatccagttgcaggaaaacaagcttaaaaaacgcgcccctgattctacataatgctcctacctccggggcagcctctccagggcccagaaactttctccagtcagcctctacagaccaagctcatgactcacaatggcctatttagggccataccctacgtcacgggagcctcc

SEQ ID NO: 687001 - DNA, 198 bp, Homo sapiens
atggaggcccccagaagctgatcccgatacatcgacgaccaggttgtgagcaccaaaggggagcgattcaaagatgtgcggaaccctcaggccgaggagatgaatgccacatacatcaacctcaagccagccagaacgtaccgcttccattgaggcactcgccggactctgccctacgccttctaggctcagatccca

SEQ ID NO: 687002 - DNA, 142 bp, Homo sapiens
caaaacatatgatcccattaactcgatgctaagatatctacatggatacattaaatatattgatgggggtggcaactatgctggcaactggaggcaacagaaagaaatgaagtgactcagctttctggctttctctgcttac

SEQ ID NO: 687003 - DNA, 579 bp, Homo sapiens
acagaccaaggcactggtcatttttcatacatactaacttgacatgacactgtgcctcttagctatggcaccataaattgtgcctcattctgtgccacactccataacttgctcagttcagcatactgtccaacagacactataagagaatctattctaggttgaatcaaatacaaattttagatacacaccaaaatttggcagaatacctgtatgccattgctacacaataagctaccacactagccctagggattcacatcacctaattggaaaagtgtcaaatcaaagtctcaacatttgcacaagtgagagattaagctctatttcacatatgcagttcatcccacccataaacatgccaagacagagtcaacatcgtgtttctaatgcagcgactattcctggaatattccagtgcaactattcctgaaatagtttctttcaggaataaaaaaccaaacacaacttaaaaaaagaatcactaaacgaaacctaaagacagcacaataaaactgccaaaacgactgcatttctgtctacttggtagacctctaagggactctccctaaaagaaag

SEQ ID NO: 687004 - DNA, 199 bp, Homo sapiens
tatttgagtctgcttctcaggaggtttgtgaccaggcacgactcaatgatgacctggagatgtcacagattcctggcacagcgtgtcccagggcttcccaaaagtgtttgttgggcataatccccttaaggttgaccttggtcctgtacctttgtttattaattgctatggaactttctaaaattagggggattcttct

SEQ ID NO: 687005 - DNA, 195 bp, Homo sapiens
agactctagaggaccccctttaaatgttggatgtcacgcttgacccgcaactccgggttcgcggccacgtgttggagggatagttctgactgtggcgaactcctcctaaagagtaccggaggagcacgaaggttggctaatcctggtcggacatcaggaggttagtgcaatggcataagccagtttgactgcgag

SEQ ID NO: 687006 - DNA, 248 bp, Homo sapiens
  misc_feature (222)..(222): n is a, c, g, or t
tagtctcagtacagcataaaaggaagtagttgaggaaggggacagggaaatgttaatagaagctttaattttccagttcctgagttaaagctttatagactattcagatgcccccaatagaaacgtacctgtttgagtaaaagccaaagagtgtgtggggtcagagtggttgcttacttccaaaggatgatttggataaactggtaaactacattaatatanttgaaagcttagtttattcactgtgg

SEQ ID NO: 687007 - DNA, 520 bp, Homo sapiens
ccaatgggaaaggttctttttttttttcccaatttccctttttgggaaaaaaaaaaaagcctcccaatccatggggcctttttttaaaggaaataggaaaataaatttttatttggtttccaaggggggttaaattaatcggcccaggttttcttttgtttgttggcccggcagtatatatgaatttaaacccgggttttgaaaaaaaaaagggggttttttttttgggccctttgggaggctttggaacattaaaaagaacccttttcccactttttattttgggatacttttaagaggggggaaaaggtaaatttttcctaaggaggcttttggggagatttttttcaaaaaatgggggctcaaaggtccgggggggaaactggcacttaaaaagggggtttactaaaataaaaaatacccgggggatcttactttgttttgaaaaaagggtggggaactccaaaagttttaggcggggggggggaatttttaaacccacttttgtgaaggtgggtaa

SEQ ID NO: 687008 - DNA, 1034 bp, Homo sapiens
ggttgctgtggaaggtcggagaacgtgctaaggtggctgcgggagatgtcagttccaggaacgccggcgccggttgcgaggatgaaggtcttaaaggccgagctgcgccagttgcagtcctggagtgaacaggcagcggcaggaaaggctcgagagttcactccgcggcagcggtcaggaagcagccatcccaacggttctagtgacgtaagtacgtgggccgaaaattccggggaggctgcagctgttcgtgggccatgggggccctgaaagtccaccagtctctccaagggacaagtcaataccggatcagcaatgctgcaagactgtagcagcaatggcgataggcaagcaatcggtgggaatccgtctttggattgacagcccgaagtcatcttcctttcgcttttgcttcgggatgtcgccaggctggggttcacccactgacgccactggaacggagccgggcgtcccttggggctcggtggacccggagtgttgtcgcccagcgtcggtcgcgtgctcgcggctagtgcaccttgctgtacggcgcgtgagccagtgttcgacgccggattgcggtgctacgggcttgccgcgcccttgccgggttgcagcggtcggggtgggagcctgtccccggcaggtggccccaagttgtcccggcgtttggtccatggccgccgacttcgcgggatgacggccggtgcagagaacgggaggcgcgcctcagcacagtgtttgccacaatccaaaggcgtacgagaggaaagggtgcacagggaagcagcgagaagaatccgacgggatgggtaggcagcaagttgcaccctaggccgcatgcttacacgacaagtgctttgatgcacacgggcctaagtctggtgcgcgagaacctcccacaacgatgctgcgccgcttttattcctgacagcccggtcccactgagtcctcggtgcggcgaattccagggcgcatgaccaatccgcttcctgttccaagaatcagtgactcgaggctgtgtccctcgtaca

SEQ ID NO: 687009 - DNA, 392 bp, Homo sapiens
caaaaattagaaggaaaagtaaggcgttacatcaatgacaaatgtactgacgtagataatcatgctctagtaacgtaagagaacacccttatacttagagaatacacatggagatataataggggtaaacgaacattatgtatagcaacttccactacagatgtatcagaaaaaaagaaaatagtagtaatagatatatactacacaaatgtaaaagcaaatggagtaacaatgtaaaacaaaaggtgaatctagagtacatgggtatataaagattattagtactacttatacttgtaaatataaaaggaatattagaaatagtatactaaaataaaaggtaagaataaggagacagaatgtgcaagagaagaagcacgaaggcaggagag

SEQ ID NO: 687010 - DNA, 1036 bp, Homo sapiens
aatcgcagagtggcgttcactaatgcttaccgaacgaaaaatgctaggctatatacaactacacaaaggccccatccgttgtatggccccatacgggactactgacaacccttcggctgatcgccataaaagctcttcaccaaagagcccctagaaaccgtgcacatcatactcatcaccctctacatcagcgatcctcgaccttagactcgtcaccatccgcgtcttctagcgtagtgaagccgccgctcatccccgattaccctaaagcgacacttggctcagacgcgacaagacataagtgccatctggattaggctaattcttatgccagctcttcctatgtccggtaatacggatgtactgcatacatccttactgattcacgggatgagaagtctagaagcctcgaaagatcataagcctcatgagccggacgcacgcgagaggatagatacgtgcaagacaagtgtcctattatgaggacccctcacgtgaagtcattcgatcatgacttcatcgactccttgacatattgacacgttggatctcttgtagagcactctcactgtcacataatatcaaccgtatagaaaatgaagcatcgatcttagagtatttcgtcacttgcgcgagacaatagatctcgctctgggccttgaactatcgactatgatcctcctacaaggtcgtctaaggcctaagacggaatctccccatcctgaatcgtaagccagtcaggggcgatggtcctcgataaaagcgtctagagtcttacaatcactcggtacttcaccgtcacaggagctacacatatgcgactcttaatgctttgcattagcccgtatatacctctaagatccaggatacggataacactacctcaaacgactataatgctcacataacgggtggacaatatagagcatagcatgcgagaaggtcttacaggggtctatgtccccaagcaaccagtttgacgtgcccagtcgtgaagccgaaggaacccgggccgggcaccaggataagcacataa

SEQ ID NO: 687011 - DNA, 139 bp, Homo sapiens
cgcaggaattcctggcggtagggtgcgctccacccggcgtggcacgcccagtcttcggcgtcccttctcctttacatgatgtccagccatgacaggggaggtacggagtccacatctctcctttgctatgatcgcaggg

SEQ ID NO: 687012 - DNA, 166 bp, Homo sapiens
tcttgttcccaagaactttccccttttgccaaaatgttacaattgaaaggcatctatctgggttttcagtttcctgatatttttttaaaagatctagggtcctttttggaccctaaacaggggaatgctgacttttttcattctccaataaatttccctgaactga

SEQ ID NO: 687013 - DNA, 331 bp, Homo sapiens
cagaccctttatcctcatttgattgagctacagtctcagctcccaggacattgtattcttttctcagggttttctttttgcatatttcacatgcccactgggtctttccaaattcgggtagtctcaccatcagaatcatctcacatttcctctagtgtcttgggagggactgctgtgtcgtctcgctcctcaacaggcacagcatgaatgaacacaatgtcttctggtggtggtaagaacggctcctccttctgaccgatgttttattctactacagctattttgcagagtacatagggtagaatggcccggtctgccagggaatcctagc

SEQ ID NO: 687014 - DNA, 156 bp, Homo sapiens
aggattttcgttggggaaggaggagaccctggagagggacagcttcaagtcgcgttcacagaagtgtttactggggtctctatatattacccgtcgcgtacaagacctcagagtgactatcgagatctcccttcaccatttccagcgctatctctt

SEQ ID NO: 687015 - DNA, 268 bp, Homo sapiens
  misc_feature (73)..(73): n is a, c, g, or t
  misc_feature (77)..(77): n is a, c, g, or t
  misc_feature (96)..(97): n is a, c, g, or t
  misc_feature (114)..(114): n is a, c, g, or t
  misc_feature (117)..(117): n is a, c, g, or t
  misc_feature (136)..(137): n is a, c, g, or t
  misc_feature (157)..(157): n is a, c, g, or t
  misc_feature (206)..(206): n is a, c, g, or t
  misc_feature (217)..(217): n is a, c, g, or t
  misc_feature (265)..(265): n is a, c, g, or t
cctcccacagacgctgtccacctcccacagacactgtccacctcccacagacactatccacctcccacagacnctgnccacctcccacagacactnnccacctcccacagacantgnccacctcccacagacactnnccacctcccacagacactgnccacctcccacagacactatccacctcccacagacactgtccacctccnacagacactgnccacctcccacagacactgtccacctcccacagacactgtccacctcncac

SEQ ID NO: 687016 - DNA, 485 bp, Homo sapiens
tagtagagacaggtcaccatcatcatctccatggctacaaactttcatttaaggctacttgtcatcactcatttgatgtcactgtaatagccacataacatcttcccagatccgttcttgccttactccaaagtattttgcattgtgtatcccaagttatctctaaaaagcacaatcttatgtcactcctaggtggtgagagcaggactgggttgacgtgcagaggagcagcttggctgtgtagggccggggtggggatgcagtgtccagtggggagtctaagcccaatttcctggtcggggaccgtctgggagcagcccttcttctctctgcgaccggacttcgatgggcagtctcctttcctagctgggctctatcgctgggatggagattctacttccagcttggtatcttccttacctcatttgcccagtactcggagtgcggccatgcctttcagattggccaagcacatgtcctcatga

SEQ ID NO: 687017 - DNA, 231 bp, Homo sapiens
cgcaggtggttgtggaggttgtagtgagccgagattgcacactgcactccagcctggcgacaaagtgagactccgtctcaaaaaaaaaagaaaaaaagaggcggggggtcgattctagggatgaaaaagataacaaagaaaaataggatttaccttcccaccaggggtgtataaatttaagaaaaatttaccatcccttagaaagatgctatagctacccacaaccccctg

SEQ ID NO: 687018 - DNA, 274 bp, Homo sapiens
cccccgatttttccagaccattgcctgatgccaatgcaagcaagcaagaaaaccaggaccaaaattagagagccgattttaaaatcttgatgtaaaaaggacagataaaatgaaagtgctgataatcgatgatgaagaggattttcgtgtcgttgcggcctcctgcctcggtttgctgggtggtgtggacgtggccgaggcatcgagcggcaaggtcggactcgagatggccctcgccgaaaaaccggatgtcatactgctggatctttgcatg

SEQ ID NO: 687019 - DNA, 201 bp, Homo sapiens
gaggcatatgtctattgttccccacaaatatttcaagaaaaaatctgtattttctcgggatatgtcatggcaagaggaagaactgggtgatgaaagcagtatggattcgtgaaatgcctctcactcttacaagatagtgggcttagagataataaacttaccggtgtcatttaacattgaaactggcctatagaaaacaag

SEQ ID NO: 687020 - DNA, 130 bp, Homo sapiens
gtgatgcatcatcacataacgtgagatgatgcacatacatatgacatcacatcacaacccatcgtgtcacaaccatgcatagcacatcatgtcgcatcacatcgcatcgtcgcaccttaggcttggcgac

SEQ ID NO: 687021 - DNA, 230 bp, Homo sapiens
gcagcgtcctacagtgtagcctccgccttccgattgactggcctgcttgggcaaggcaagtaggcggcggcgctttcaaggatgcgcttgccttgaacacggtctaatgcttgctgcggggcccttggccaagcttgcacggtgcaagggaccttcttggttggccgaggccttcacaagcagattcagatggcagcgaacctacaagtatgttgaacaagcaagatccg

SEQ ID NO: 687022 - DNA, 395 bp, Homo sapiens
ccgttgttgattatatttgccttcgttggatgtcacacactacatttcaggttggtcaggatgactatggaggtccatggttttcattaccaacattttcagattctgaatgtcgatggagtctcactgaagagtcaccaaaggtgcctgccctcctcccctgcttgggaagtgtcagttggagactgtcccaagggtgctgcaagcaatccagtggcctgggtgttcttgtgctgctttcccatcttgcagtgtgggcatgggcaggggttgttccatgcatccattttgtgcatcatagccaatctcactcttgagcaaatgtgaaccacaaggcagtccacctcatcccctcaccacttcataattccacaaagcatgcactaaaacccatg

SEQ ID NO: 687023 - DNA, 336 bp, Homo sapiens
cggaccggatcggaattggtaggtttaggttacagtatggttgtcaagctagtgaaaggtgacaaagtctaaatgcgtgcagaacagtataattttaattaaacaagacagcgtgtatggtacaggtgaggtcgtgatggtgttaaactgatgcctatgtgtatggccagccacaaaccttggggatgtttattacctgtacatatatatacaaatatatcccatacatatgtatgcacacaggcatgtattaatttatgcgtgaaacttataaaattatatatacaaacacatacatgcacatctatctacatatacctacctatttcacaatcg

SEQ ID NO: 687024 - DNA, 1425 bp, Homo sapiens
agaaccgcaaggacacaccaaaaagacacaacaagccaaaaccccgcacaccacacgacataaacgacaccaccgacgcgcacaccgcaacaccgcccccccgcgactccacacaccacatcgcaaccaccgacgacaaacgacaatatgacaacaagcacagaacaaacagacacaccacacacgacacacacgcccccgcgcgcacacacggccacacccaccccaccatacaacacacaacacaccataggcacacacacaaccacaaccaacacaccaacgcaccgcaaccatacagacaacagaagcccgcagcaggcactcaccacatagcacacacacaaacacacaaagcacgcagacgcagacaccactcacacaagcactcgacacaacgcccaaagaacaaaggatcatagctaatatcatagcgatgacgcgacatcagacatcatacctgagaacccgccacacgacagcaacgccgagtaaaaggaagacaacgagaaacacacgcaccacacaatcaaatgtagagtacaaggaaaaggaccgatcagcatcgaaataccgaggggaacacaacatataatcgaatcagaaacaatcgaagaaatcgcacacacgtagctcgcaaagcaaacagagacaaagcagaactagaacggaagaccggatcccagacgccaaaatcaccaacaacgaatcgaccctcacatcacaccacagagagagacacgacgacgagcacagcgcatcacagatagcccagacggagcgccagatcgacagagagcaagacgcgcgacctaggaagctctcaatgatatcatgacagaggctgtagagaatttgatatagtatcgctataacagtagtaatagaacaaaacaaagcatgaccagcattagagtacagagctagcaacatcgtcgacgagataaagaaaagcagcgacatcagcagacagataccgccagacgacgcacgctttcgacacactaccaccacctacacaacaatcgaaagtgcaaaatagaccgcaacaagcaaggagatcacggacgacgaatcccacaaagccgacaccacacgcaccgtatgtagatcccccgagagcgcaaccaccacaatacgaacgagaaaatagacacctatatacatcactagccgcacgcagcacgagagccaaaccgcgagcgaacagatcacacaatcagaaccatgaacgcatctcagagcgcatgcaacaatctaagaacaaacagatacgacacagacacacaaaccagacacacagcaccgccgaccccgcaccccaccgacgacaagcccaaatcacgcaacggatcgccagaagacatcaacacacgacctcccgtaagcacgaccagcctactcatgcaagacatacacacacag

SEQ ID NO: 687025 - DNA, 126 bp, Homo sapiens
agctgagagtcagatctctcctaagtctcttctgttcagatatttgtcacctttacagtattacacagtgtcccctgggcccgggggtcatggccagaacgcagagactttatgatgaggacggtg

SEQ ID NO: 687026 - DNA, 201 bp, Homo sapiens
tgtaccggactcgcctttgtccgggtagtgtgtactgtgtgcacatgtatttgtgtgcctgtggagcagcacctgtgttgccacatttggttgacggtacatccatgcactgggtctgcaggtgtatttgcgagtgcgtgtgtctgtctaacacactctgtagatgtcgctcggccgtgaatgagaggggtaccggagctc

SEQ ID NO: 687027 - DNA, 1000 bp, Homo sapiens
gtgtggtaacgtgggtggaaactgggtgaagtgggtgaacctgatggtgcaaccatgtgggaatgatgggtgtgctggaggtgagagcttgtgggagccaaggagcaccttgtgacatctggatgtcttggcagtgagtgatgacgaggtgtgaggtggctagctcgacgtgcagggctggttgtgggccgttgagtgccatgtgatgtgatgttgttgtgatgtatgtgttgcccatgtgcatctgttggcatgacatggggctgacatcagctgaggtgactgatagtgtgccctgcatgctacggtggcttgtggaaatgaatgttgttgtgtgagccacggcattcactccctggtcactttttgggttacagtgactgttggcaccacttggtttgtgacctggatgtgtggcacggctggagtgtggcacatggttttggatcccatgaggccctggggcaactggaggttgtaagcttggcaaagtaatgcatggggcaaagggtgagggaccccatctgccctgggcatagtgtgaagtccctatcccatcccccaagagcctcgctttccccagtccttagttgaaatggacaggcgacggttatacggtggattccagatggggctggccgcggtgggatgacaatgcaccatcatcccctctgcaggccagtatcggtgtgcctccagaaatggcggtgcatcgcgccgcatgcttacgcacactgagttgacaatccatatcttctgcgaggcggatcgcctgaagaacattgcagcaaatagcattggggtagagccattagcgcccgttcacaatgggcgcacacatgacgcataacggtcctgcgtagggcaacgccaattggtctggccagcgtatagggtccaagcaacatagatggatggaaccacaaaggcatggagtcagaacaagggtcaatggactgggagtccctgaccaaaggtgcccaccttagaccgtactcaa

SEQ ID NO: 687028 - DNA, 1169 bp, Homo sapiens
ggagagagagagaatagtctcgattttgttgttttttttatttttccacgctaaatccacttaatttttctggtataaaacccctattttgtacccacaggtggaccctgagtccgctgcgcggaaactcggggtgggggctctgacaagggtgtccagtgaaaccccgagaaaggggaaaactgggggaaatacgagtcttccttccagaaggtcgggggctcaggtaccggataggcctaaaaaagggcctcaagaggtggcatggcaaaatttgcccagggtgtggcccggtgccacccccggggtctgaaggttgtaacagttacatgcgaataacagagcccaatcatggacacacgttctctaagggccaccggttgccggaaaaccaatcccagttgcccctcgtgggttgcacagggaaatggagggcgttacccagccaaaagacacccgggacggggccttgttcacctttgcaaggggacacgttggtggggctttgccgagctcttgtgtctccccccagatagccctcgtgccccggggggacagattggagacgctttggccacgagaggattggccccacgggatttggcgggggcccaccctcccttggagagcactttaaaaccccaagaagcgaagttgtggcccacttgatggtccccccaaaaatgaccaacaaagtgcctttagaacccttggtagcgcaggacccaggacagggggctcctggcataccggcaccgtggcaaaacatcctttcaaagaccctcacctccttgagaaaaggtggccccccaggaagaaaacacaagtgagccccgcaataccctaaagtgggccagggaaaacaacaacaaatcattccctcacggggacgatgaacaaatacggtgccctgacaaaagagggccaccacattgtctagacggagcataccacccacaaaaatcccagacatgaaaccagaaaaccccgggcactcagccacggacgtcaaaagcgcgagaaaccgccccggctgacacagcgaaaaccccgggaaacaggggccaccaacaagagacaggcccctaggcccccccgcaccgcagaaccccaaatattttatttgaaacaccccagtcgaaaccgcgacagaacaagacacaaccacg

SEQ ID NO: 687029 - DNA, 522 bp, Homo sapiens
tttcacctcaagttcccgcacagtgcccacagaagtatgtccgacaagcgtggcagaaggcagacacaatacaccatgggcagccacgcgatgggccaagaagattgaagccagagaaaggaaagccgagatgacagattttgatcgttttaaagttatgaaggcaaagaaaatgaggcacagaataatcaagaatgaagttaaggagcttcaaaagtcagctctcctgaaagcttctcccaagaaagcccctgggacttagggttctgctgcttctggtgctgctgcagcggctgttgattgttgttaaagttccagcaaaaaaggtcccctccgcgagtgaaaaggctccagcccacaaggttcctgccctgtaagccgcaggccagagagcagcgcctgctcccagagctcataagggtcaaaaagctccagcccagaaagcgctcgctcccaaggcatctggcaagcaagcatcagtggccatcatggtaagtaataaaggttctttttgacctgttg

SEQ ID NO: 687030 - DNA, 538 bp, Homo sapiens
tccgtactggcatttggtgaaggtgctgaggaggactgagttgagtttacaaatcagccttcttgacccttcggcttagcattttcaagtcattgacattctcttatacctgtgccgctgatctctagacctgccatgagtgtgaaagaggcttcgtttttaagtgacactttacccaaccaattttcactcaagaatcttcatattctattgtctcacaatcagaataaattggcattttcctcactcagtctactaggtgctttaattgtgtttagaaatagccttttgattcttttggatttgttttttgccctaagagtcttgatttccgtactaaattacctgacaaaactcactctctccaacatcaattaaagggatttaaaaaatataattacacttaaaacactagaaagagtcaagtttttagcatatgttatggcttgccagtacgagaaaagtgacttaacatccaaataaagaaaaatagttagccaatccattcattatgttgatatgatcaggtctccaagat

SEQ ID NO: 687031 - DNA, 291 bp, Homo sapiens
caaaaaaaaaaaaaaagaaaattagcctgatgtggtggcgggcacctgtagtcccagctactcgggaggctgaggcaggagaatgggtgaacccggcaggcagagcttgcagtgagccgagatcgcaccactgcactctaacctgggcgacagagcgagattccgtctcaaaaaaaaaaaaaaaaaagattgccaggcactggctggtcatgacgggtggggctgaaaagggacggcagcagtgctccacggctcctcttgtggctcccacctctgcacccaacgcgaacg

SEQ ID NO: 687032 - DNA, 407 bp, Homo sapiens
  misc_feature (255)..(255): n is a, c, g, or t
  misc_feature (305)..(305): n is a, c, g, or t
  misc_feature (320)..(320): n is a, c, g, or t
  misc_feature (350)..(350): n is a, c, g, or t
cgacagtgtgcataaaactctaacctggaagccttggggagactgattgagtgataaccccagttctcccatgtggttggtctcatgtcaattaaactctgctctactgcagtgaattcattttatctgtgcagtgggcaagaagaacccatctggcaattacagaacctagaacaataacagcatttctaaaaagtgttttcgagaaaaagaataatacacacatccccaaatgcacattttgtcttacttttnattcattatatcccttatatatataatattacaatatatttatggtattntttgtttttgttttnaagatggagtctggctctgcgcccaggctnaagtgtggtgcaatcccagctcactgcaatctccgcctcccgggttcaaatggttct

SEQ ID NO: 687033 - DNA, 473 bp, Homo sapiens
ctttattaattgacgcacactgaaatgaggtttaacgatctaagcaaatatgaaaatgcgacggggagttggcttgacaccagcggacaaggcaaacggacgaatgagggttcgagctccatccgtcccccttggacacatggaaggctgctatgctggggatgtgatgttataagcctaacgcagttagacattgctgcaacaagtttattaccctcctcggaaaagcaggtctccgtaacgggaggcttggggcacttgtctacaaaaactgcgaaatgatccataacagatttcagttgctctctgggtgcctagggcttgtgtttcaccagctcaacaagcgcagggtgtatattgatttgcacgtgcttatcataaagtgtgcatacatcatggtggaaagcgaatgttttagtattaaactctttgggaacgtatgtgagatggtcttccagagctgacaaggacgg

SEQ ID NO: 687034 - DNA, 249 bp, Homo sapiens
agcggctcccgtagcatcttatcctcaatactgtgcttttcttatatatgctattcttgtttcatgactgcaatacttgctctcacctctctaaggacagttaactttgctcctgttcactttttttttttttcccggttttttgggcccacccttgtggcttttgggggtccccgggctagggtttaagggggacctccggttcgccgggtttacaccgcacccacagcattggggaactcaacccgg

SEQ ID NO: 687035 - DNA, 177 bp, Homo sapiens
acgttgatcgaactgatcgacgccttcaatcctaagctcgtgtatggacggcttcatagcgcatactcagcgctgacttcgtgcgccactacaacgggcgactgctgaatatccacccgtccctgctgcccaaatacaaagggttacacacccaccagcgtgccctggaggccggcg

SEQ ID NO: 687036 - DNA, 323 bp, Homo sapiens
  misc_feature (138)..(138): n is a, c, g, or t
  misc_feature (165)..(165): n is a, c, g, or t
  misc_feature (185)..(185): n is a, c, g, or t
gggggggggggggccttttaaggggtttttccttttccccccggggggggggggaatttttaaaaacccccggttgttggggggcccggggccccccccccgggggcggggacctttttttccccaaaaccccctccncggggggggggggggggccccccccanaaagggggcccctttttttnggggccccgggcccccccccccccccgggggggggtttggggggggggttttccccccccccccccccccccgggggttttttttttttttttttttttgggggggccccctttttattggggtttggggccccccca

SEQ ID NO: 687037 - DNA, 643 bp, Homo sapiens
  misc_feature (110)..(110): n is a, c, g, or t
  misc_feature (585)..(585): n is a, c, g, or t
  misc_feature (588)..(588): n is a, c, g, or t
caacacgaggcacattctcttctccatttccctctcttattttttggctctaataaaacatttcttctcacaagtctctatccctcaatacgaataattaacccaaatanatatctacaaacctctactaactttttaacagacacaagaacttctcaattttattgtaattactacaaactatggtaaaagtaacgacaaaatttacttactaagatctggagggcatacatggaaaaagcacttaattcgaactcaaggaagtgagcatggggagctggaaggattcctaaaagacaatacaacaaaactgataacctaataaaaaatggcaattagctaaactacatggacccttaagaagatatatatacttaaaacaagctttataacagctcagaggtgagaaaagaaaacacatttattcataagattcacattctacccttcttcaaaagcccgacccaaacatcttttatccttctcttctcttttcccattaatctatttatacccctcttttacatttatcacattaaccttctattataatgattgagtaacatatccatctgcccttactanaanaagaactcattatagattctaccttatttttcatatcctacacattaataacccg

SEQ ID NO: 687038 - DNA, 342 bp, Homo sapiens
  misc_feature (112)..(112): n is a, c, g, or t
  misc_feature (132)..(132): n is a, c, g, or t
  misc_feature (196)..(197): n is a, c, g, or t
  misc_feature (235)..(235): n is a, c, g, or t
  misc_feature (244)..(244): n is a, c, g, or t
  misc_feature (272)..(272): n is a, c, g, or t
gtcctttcacatggagtccaacccttgggcagaaccccagatttttttcagtacttcacatgttctctcgttggcctgttccagatccctcttcatgttgcagcacaccaangctttggattcctccagcantattcgattacatgagacaagcttcttgatctgagccaccaatttcctgagtgaaggtccaggnnccaaacagctgggagagaaggccgttgccaaatgcctnctgtgtgancagtttcaacccactgagcatcgtctcncttgcagctggtcgtcccatgatttcggaaacgtaatggtagatcagctatctggaatctgcccagaggt

SEQ ID NO: 687039 - DNA, 233 bp, Homo sapiens
caaaaaaaaggtttcccagggggggccccaaaccccccccgggggtttttttttccccccccggggttttctgggcccggccccccattggggttcccaaaagggttttccccctggtttttttttcccccctaccagaaaaattttttttttttttttttttccctgaagtttgggcccccccccccccggggggaattgggtttaccccttaaaaattttggggtggggga

SEQ ID NO: 687040 - DNA, 155 bp, Homo sapiens
  misc_feature (155)..(155): n is a, c, g, or t
gcctacacgccgcccgctttgtgctgcagccatgtctctagtgatccctgaaaaggttcctgcatattttccgtgggtacttaacaaccaacaatcggatgggcggtcggaaaatcagccctttccaatacctgccacatcagggggttgggccn

SEQ ID NO: 687041 - DNA, 1366 bp, Homo sapiens
cataccacatctggcaggcttctcattcactggtggcagcacggcccaaccctccggtttcaccattggctcagcagggcaattcagcccagcccacggcacctgccacgtagcccttcattccggccaggccagccagcccaccacagcagtgtgccacaaagccagctggcatcccaacacacacagcccaccatacaacagtactgggcccagcctcttggcgtccaatagcaactggctcacaacctacatctggccaccactgggctcctccgaaactcccttcacccttcacagtcgattccacaccccagaccctacgaggacttacccacaacaatgctcgcacttcgcgcgccaatttctcaccacggacgctcagattgcgcaccgcacactacaaccggcacgacaactgtcgcgtctctctatataccaccccagcgctcattatacacacacctgcggcacctcgcgacctccctcactactcatattcacactatacatccagcacacgacacgccgcaacgtccatacaccattgtgcacactgacccacgccaggcacactcaccactaacacacccacacttcactcaccaccactacacccctacactctgcgcccccactctggttcgaacaaccacgcctctgacactctcccattatcaactcaccacaagcaacgtgccaactcacattccaacacccccacaaccccacgcctgagcaccaactcatggacgaccacacctaaaacaaccacactaccactacggacagcccccaacaacaaatgctatcaataccatcagatcccaccacccatattatacccgcgccacacgcacaacccccatcacctagacgaccacctacctacttataacacacacaaccaacacaccatcgcggcaccacccgccgcgtctccacacacacagtccacggacacacacacattctcaacttcttcaacccccttcaacacgtccacacgaccgtccgaacaaatcacaacggagcgcgataacacatcccacaacacatctctcgtctaaccactcccccaactccaccacagtaaccacgacgacgactttacactaaactctcccaccgtctgcaacacccatcgtatcaacccaatttacgcgacaccgcacgcgcacacacgtctaccccatatcgtacaccactctcaacacaagaatctatatcacacaacacaccacaccacaggagctcctatcccaacacacatcacactgctctactacacacccacacaaccagcccgtaccactagccacactgaacaccaagacgatgaccacacacaatacaattacatacg

SEQ ID NO: 687042 - DNA, 690 bp, Homo sapiens
tgatgcagagactcactaagatactccactagaagattagacccaagacacataatcatcagattctccaaggttgaaatgaaggaaaaaatgttaagggcagctggggagtaaggccaggtaaactacaaagggaagcccatcagactaacagtgaacctctcagcagaaactctacaagccagaagagagtgggggccaatattttaaagaaaataattttcaacccaaaatttcatatccagccaaactacataagagaaggagaaataaaatcctttccagacaaccaaatgctgagggatttcatcactacctggcctgtcttgcaagagttcctgaaggaagcactaactatggaaaggaaaaactggtaccagccactgcgaaaacacaccaaaatatcaacatcaacaaagaccaatgacactatgaaaaaactgcatcaactagtgtgcaaaataaccagatagcatcacgatgacaggatcaaattcacatataacattattaaccttaaatgtaaatgggctaaatgccccaactaaaagacacagactggcaaattggataaagagtcagactcatcagtgtgctgtatttgggagacctatctcacatgccaagacacacataggctccaaataaaggatgcagagaacccagaaaaacataccaagaaacacaatc

SEQ ID NO: 687043 - DNA, 1070 bp, Homo sapiens
  misc_feature (376)..(376): n is a, c, g, or t
ctttcgtctttgttcttgttggtattgctgcgttatttctcctggttttgttgttttttgttttttctctttttttcgttgtttttcttgtgttgtgtgttttttggcttcttggtggctgtttggtgcgctttggttgtcgtctgtctttgttttctttttttttgttttttttctgtcttgccccctctttgtgtctcactctgctgtgatcttcttcgtttctgttgctctgttccgcgtgtgttctcgtcgttgggtctgggtgtttgtttggggccccaatggcctctttgattatccggccctcaggtctcaccatgtcaagttgttgcccttcagggactttcctgctcccaagtcacgaaggtggaanccgttgtgtgccccccgagccctgtgtttttgttgaaaggcctccactgtggctcctctgttttacatactccttagtaaatgggaggtcccctggggcaaccagaccactgcccaccatttcagtgttgtgttcaggcccaggggaccggttctggaccaggccagctttaagtgtgagattttagtccaccaactcctggagtgtccccgctctcctgcttaccttaggaggtgagtgcccagggataattaccccccaatgctttctagtattgtttccccacctttaaatagtcctcgcttaaattcaccactggtgtggtctgatgttttgagagcactcacgggaataccaccctctttgcccacatttaccctcttctccccggattccccaggtggtctcgttgctctggcttccgcttcattgttcttaggccttccatggagtggatagctgcctccctccctcggctcgtttttgtgcctcttttgaagactactgctgcctcccatttctggggaagaccctttgagagcctagccccaggcctaagggctatagtttggtgacccagtgattttgtctttagcttttctatagtgattgtgcccgtcatatctgttttaagctcatggatccatggatttgtttaccatgtgatattttttattaaatcccgtattttcca

SEQ ID NO: 687044 - DNA, 604 bp, Homo sapiens
  misc_feature (24)..(24): n is a, c, g, or t
  misc_feature (32)..(32): n is a, c, g, or t
  misc_feature (37)..(37): n is a, c, g, or t
  misc_feature (50)..(50): n is a, c, g, or t
  misc_feature (74)..(75): n is a, c, g, or t
  misc_feature (103)..(103): n is a, c, g, or t
  misc_feature (122)..(122): n is a, c, g, or t
  misc_feature (179)..(179): n is a, c, g, or t
  misc_feature (190)..(190): n is a, c, g, or t
  misc_feature (214)..(214): n is a, c, g, or t
  misc_feature (250)..(250): n is a, c, g, or t
  misc_feature (329)..(329): n is a, c, g, or t
  misc_feature (401)..(402): n is a, c, g, or t
  misc_feature (414)..(415): n is a, c, g, or t
  misc_feature (507)..(507): n is a, c, g, or t
  misc_feature (510)..(510): n is a, c, g, or t
agaagaatgttgaatgcctaaganagaacccngattngccactttatganactcctttttaaaggagggaagtnnctggtggcccaagaaggatgtccaccantgcctatagcaccccggangctggcacgacccaagaaatgtgccccacccttcaatgtcactgaaggcccactgcncgttctttccnagttcccgaggctacgtgaaaggnaccacgctttgccctcggagacactttctaactggnaccctacccacatgagggtattccacgtattctccgtgattaccttcatctgcccccggagattgtgcctgcccccctncgcccgtagccgtcccgaagactggccggcctcggcctaaaggtttggagggtgagcgacctgcgagactcnnccagaggggaannctgaccagagatacctaccagacggagtgctgtgccccctggtgccgaccagaaagccgaggctggggctgggtcagccaccgaattcccgnttnagaggcggatttggtcgtggacgtggtcagccccctccagtaaaattggagaggattcttttgccttgaataaacttaccagcccaaaaaccct

SEQ ID NO: 687045 - DNA, 169 bp, Homo sapiens
tttagggctacctcgaaaaccaatggcagagtcttgaacagcagatctttctgcccactaggggagcaaagagctggaatttcggtgacttgtctttccaaacttttcctgtgcctggcggagaagattccagatggcattcttcttggccattcacacttcgtgccac

SEQ ID NO: 687046 - DNA, 334 bp, Homo sapiens
ttgtgatcgagctagagtataggataaggagtgcatgactggaagtggtatgtgctaagagtggagctgggggttccatcatggagtgcgttaggtgttgtgtagacccatgcagagtgtgaaggaggatgagtaataggaagagaaagcgaaatatgctgaagaggccttagagccagagcgagaaggagcagacagactctcatacataaggagttctggtgaaccagaatttctgcgagagattcaattatagcaaaactttatggaaccaaaaagcttacaaaccacatcagaagtttaatagataaactgcaggagagaatggatgcac

SEQ ID NO: 687047 - DNA, 171 bp, Homo sapiens
  misc_feature (109)..(109): n is a, c, g, or t
  misc_feature (137)..(138): n is a, c, g, or t
aatggaggatgagcagctgaaggtgtgggatgtgatcggccgctgcctgattattgatgagggagaagatgacctgggccggggaggcatcccttatccaagatcacanggaactccggggagaggttggcctgtgnnatcattgcacgctccgttggcctacagcacatg

SEQ ID NO: 687048 - DNA, 91 bp, Homo sapiens
ccgcctactactactactgctcgaattcaagcttttaacgatgtacggggacatggaaataaagcacccattgcttccctgggcccctgcc

SEQ ID NO: 687049 - DNA, 265 bp, Homo sapiens
gcccgatattttccatgcttatctaaacatttcatggtgcacgagaagaccttgatgtcctgagtgaccaatcctttcacgagggtggcgaccgctgtgtctactcgccttgtccctggggtcatggcggtggggtgcaagagaggcagttcttgtcgctgtcatctaaacacggttttctgataggagaggagcaagcatgcctctcttgatctcctgccttgacctctgcatgtaacagtttcctttcctccctcacaacgag

SEQ ID NO: 687050 - DNA, 105 bp, Homo sapiens
  misc_feature (86)..(87): n is a, c, g, or t
tttctttaaaatgtgcatctgcactcaaaaattcacacctaggatacagtaattatacctcctcaagaaaacacaaatattccaannaaaacgtgttgccagatc

SEQ ID NO: 687051 - DNA, 466 bp, Homo sapiens
aggatctggtacaacgcattggtgatctgggtctggccatgtctatggagttgtgactctggtacatgatataacgagtctgggtgtgttcgtgtctgaggaggtaggatctggtgcatgtattaggatctgggtctgtccatgtctgcgagatcggatctggcctgatctcaggactctacgtctctctcgaatgttctcgactaaagtcgatctggcccttgtcttgcgtgatctcgtgtctttcaatatctgaggaggtaagcagtctggtaccgtgtctgaggatctgggtctgtcaatgtctgaggaggtaggacctggctgtggtatatggatctgggtctcttcatgtctgaggaggtaggaaactgttacaggcctgaggatctgggtctgtcattgtctaaggaggtaggatctggccccagtatgaggatcggggtctgtccatgtctgagaaaac

SEQ ID NO: 687052 - DNA, 835 bp, Homo sapiens
gctgcatgaggggtccatacggcgttgtgcgtggattcccgtcgtaagcttaaaggtgaaattgttcagaagtgtccggagccacttgatgtcctgcaagatgaaggagtgaggatgtccgttaaggttcgcttgcatgcagagaaccgcactatagtggtggctagccgagatcgtatgacttctcacgtatggaacaggtacaatcgtatagagaaggaagatagtgagtggcgagtctaataatcagtaatactctcaagcatggaccgtgggatgaagcttctgcatggcatactcgtgcaagttgttgccacttgaaaaccctgctgatgtcagtgttatatcctcacaggaatactggccatgatgggcgtgtgcgtgaagtttgcgtgctgccacatgtgagccacgtccaagttgctggccgcttcactcctggaaccttcagctaaccagtatccaggcagccttccgggagccacggcgttcttgtggttactgatcccagggctgaccatcagcctctcactggaggcatcgttatgttaacctagctaccattgcgctgtgtaacacagattctgctctgcgctatgtggacattgccatcccatgcaacaacaagggagctcactcagatgggtttgatgtggtggactgctggctcgggaaagttctgcgcatgcgttggcagcattttcccgtgaacacccatgggatgtcatgcctgatctgtacttctaacagagatcctgcaagcagattcgccccccgaagagccaggctgcttgctgagaaggcagtgaccaaggtaggaattccgggtgaactg

SEQ ID NO: 687053 - DNA, 834 bp, Homo sapiens
tcgtgggaggagctgaagcagtgccaaggtagatcgaggacgccgagaagtactccttcatggccaccgtctaaccaaggcgcctccactaaagcaaaagggtcaaagtcacccagttttgcttgatgacatgcagagtagattcacccaaattccccgagccaaaactggccgaagatcttggtctcgcgtcgatctcacagtcctccactggacagcctacgcgttcagcgtgcatcctacacagaatagtctcgtgacactgcactttggaaagggggggcttgtttcactttcccccccccccggcaagctaaggaacaagccgatgcgccaacaaccaacgccgctaataatgtccctctctacacgggggtagtgcgcaacgggcgtaaccgcccaccaggactgcttatccgctggcatgcttggacaaggcaaagccgacgcttccaccagcggccccacggcggcccaagagggacgaccttaatctggggcacgcgggcccaccggatgaggaaggaaccttttgcacgggcaccattctgtcgccccaacggcgcgaaccctgcagcccaacaacactagcgaaaagccctccaaaccattcgggcttccccgttctggcggccaccattcccctgttggggtacacgattctgtctttcctcaacacaagttacccacactgctggggacatcaactagccacccgggcgtttggtgctccactcccacaatgtgctgtgcctgctcggccttccatacgcgcaacagacacgggacgcctaccagtatctgtggcagtcccccattgacggacttgtgcac

SEQ ID NO: 687054 - DNA, 269 bp, Homo sapiens
ttgggaaactttttttttcccccccccccaacacccccccggggggggggcccgagatgggtgggcctgggccccccttttccccaaacccataagaaccccccgtttttgtttgaccccggccccccccttagtcccaaaaaaagggaaggggggggtttaatttcaaagtcccggccctagggtggggcccccccccaaaaatccccccggggggggggggggttttaaaaagggaaaaaaaaaaaaaaacccttgtttaaatttta

SEQ ID NO: 687055 - DNA, 537 bp, Homo sapiens
tggagaacagaagtcttgctctgtcgcccaggctggagtgcagtggcacgatctcggctcatggcaacttctgcctcctgggttcaagcaattctcatgcctcagccttctgagttagctgggactacaaggtgcacaccaacatgccttggcttaaactttggggtttaagatagagacagtgtttcgccatttgggccaggactagtctgtgaactgttgacctcaggtgactctgccaacactcaggcctcctaaaatcgctgggatcacaggtgtgaacacaccatctatgcccggccaaataatggatttgcacaattctggtccaagtgttcgtcatacgtaatatgcacggagagtatagtcataataccagtgttccattgtgatcactaacataatattagtgggaaaaaccaagaatactataaatttgttataaaaagttgaagttcgagaagtgggtaaaaaattatgactggattaagtgaatgacactgagatactaatataaatgataattcttaagcatgc

SEQ ID NO: 687056 - DNA, 112 bp, Homo sapiens
  misc_feature (1)..(1): n is a, c, g, or t
ntcagtcagacgtggcgaccgttgagtaatatgcttaaattcagcgggtcggcaggtttgatctgaggtcgcgcgggtttggatgcagtctgtcatcggctttggatgccgt

SEQ ID NO: 687057 - DNA, 258 bp, Homo sapiens
gtcacggatcttagctttggtcaggacaataaggaagagaaagaaataatggatttcaaataggaagagaggaagtcagattgtctctgttcgcagatgacatgatcatatatttagaaaatccatcatctcagcccaaaatctccttaagctgataaggcaacttcagcaaagtctcaggatacaaaatcaatgtgcgaaaatcacaagcattcctatacaccaataaaaatgaaatgacagtttgaacatacaaaa

SEQ ID NO: 687058 - DNA, 930 bp, Homo sapiens
acagaggaagtaggagagtagaagggcagacggtatgtcgcgaacaggggtggggggtctattagacaggggacagggtgacaaccgacgtgcgctgaaggttgtggaagaatggagtaatagtgctagggacgattggaccgcacacacaccgtgggggggacccgcacctgtaattgaagaggcgttggtcaaagaagcggccactcggggaccccgtggcgcaaaagccaaattatgagtgcaacagagccacggtcgcccggcaaggacaccatgttttggccgcactttctggacgaccgggtcttcgttaaaaacccgcccccaaacggccgggaaacaaattgtgaggggcccgccccgccgccccaaaaaataaaggacgcgtgggtaacccccctcccggcaagccgtgacccaaaaaaagcccccccaaataactaggttgcaagaaggaccccgcctgtcaaccgtggaagcaacctcagggatctaagactcaaaggctgcggtgataagtggccgagaaaaaaaatttggcgccgggcccaaaaaattagaaaaaacaattggaaaaggcgcccctcgcgaacaagcaaaaagattgcttcgagcgcatccccgcggcaggtgacaactgcaccctggttcaaatggtggtacagcaaatatttccgcaaaagagactcatggaccatatggatgggacacaccatacccgtacatgcggagttgtgggctaatgaactaagggcaccgactgggtgtggcgcccgacccagaatacgcaccgacgctgtttgatacaaaaatccgagaagcatatcgacacaccatgggaaaatatcctttgtgtttaaagaaatgccttcccggggggtacccgggaaaaagtttttttttaaaaaaggccccagggaaaaaaaa

SEQ ID NO: 687059 - DNA, 146 bp, Homo sapiens
tatctctaacattaaacaaacatacatagtaaacctttaattagtatacactcaaggtacatacatggttttcctttctccttctaaagcatggaagagatttttttttttaaataagctgacaaaatatgaaaattaaaagaaca

SEQ ID NO: 687060 - DNA, 88 bp, Homo sapiens
  misc_feature (69)..(69): n is a, c, g, or t
tttaaaggcaaaaatcttttatttcaacttttagggtagccagcagcctcttctccacatctcagaagnacaaggagacaccctgatc

SEQ ID NO: 687061 - DNA, 147 bp, Homo sapiens
agtatgatgaaagcgtgttgactttcctcatctgtgtttccagtgcggtccaattcacggtggttgccaagcgcctcgttccatgtcaggtgaccagaggccgtataaaaggcagcctggaaagcagaggtacctctccgccccttc

SEQ ID NO: 687062 - DNA, 649 bp, Homo sapiens
  misc_feature (12)..(12): n is a, c, g, or t
  misc_feature (78)..(78): n is a, c, g, or t
  misc_feature (86)..(86): n is a, c, g, or t
  misc_feature (94)..(94): n is a, c, g, or t
  misc_feature (98)..(98): n is a, c, g, or t
  misc_feature (105)..(105): n is a, c, g, or t
  misc_feature (108)..(108): n is a, c, g, or t
  misc_feature (112)..(112): n is a, c, g, or t
  misc_feature (114)..(114): n is a, c, g, or t
  misc_feature (116)..(116): n is a, c, g, or t
  misc_feature (126)..(126): n is a, c, g, or t
  misc_feature (129)..(129): n is a, c, g, or t
  misc_feature (135)..(135): n is a, c, g, or t
  misc_feature (137)..(137): n is a, c, g, or t
  misc_feature (150)..(150): n is a, c, g, or t
  misc_feature (159)..(159): n is a, c, g, or t
  misc_feature (195)..(195): n is a, c, g, or t
  misc_feature (204)..(204): n is a, c, g, or t
  misc_feature (206)..(206): n is a, c, g, or t
  misc_feature (214)..(214): n is a, c, g, or t
  misc_feature (234)..(234): n is a, c, g, or t
  misc_feature (243)..(243): n is a, c, g, or t
  misc_feature (258)..(258): n is a, c, g, or t
  misc_feature (275)..(275): n is a, c, g, or t
  misc_feature (277)..(277): n is a, c, g, or t
  misc_feature (296)..(296): n is a, c, g, or t
  misc_feature (313)..(313): n is a, c, g, or t
  misc_feature (318)..(318): n is a, c, g, or t
  misc_feature (320)..(320): n is a, c, g, or t
  misc_feature (322)..(322): n is a, c, g, or t
  misc_feature (325)..(325): n is a, c, g, or t
  misc_feature (333)..(333): n is a, c, g, or t
  misc_feature (337)..(337): n is a, c, g, or t
  misc_feature (339)..(339): n is a, c, g, or t
  misc_feature (344)..(344): n is a, c, g, or t
  misc_feature (352)..(352): n is a, c, g, or t
  misc_feature (358)..(358): n is a, c, g, or t
  misc_feature (396)..(396): n is a, c, g, or t
  misc_feature (421)..(421): n is a, c, g, or t
  misc_feature (429)..(429): n is a, c, g, or t
  misc_feature (435)..(435): n is a, c, g, or t
  misc_feature (450)..(451): n is a, c, g, or t
  misc_feature (455)..(455): n is a, c, g, or t
  misc_feature (495)..(495): n is a, c, g, or t
  misc_feature (499)..(499): n is a, c, g, or t
  misc_feature (511)..(511): n is a, c, g, or t
  misc_feature (518)..(518): n is a, c, g, or t
  misc_feature (527)..(527): n is a, c, g, or t
  misc_feature (562)..(562): n is a, c, g, or t
  misc_feature (570)..(570): n is a, c, g, or t
  misc_feature (579)..(579): n is a, c, g, or t
  misc_feature (614)..(614): n is a, c, g, or t
ggtctcctgccnaccattaggacacaatgttctgcgtctggccagacatctgtggaaaggctggatacaggacaacgnacccatcnttccatcnatancaactanccnaggncncngagaccccanttnggagcncngtggaagtcagtntctggaggnagttctgacgcagagggggcaactgagaatagagcncaaagcccncngggagcgnggaattgggaagcttatagngcaggaggngctgccggagacccncatctgccagcagccangngttctgcagcatactctcngcgggcagctttgaccncatcngntntcngtgggttntgtntnaagangaagcgantgacangagccacagccacagcatagagcacggggcaccaacgngggcggacgcaccagttaccagggnccggaagnagagcngaaggagggccaggnngtcntcaggaggcactgtgtaacactccagggacacaggcaacngggncagaggcaggcncagagcncgcaaggcncccacgtgttccccaaagagggcaaggcgcaaggngacacttnaccgacgcngcaggggcaggaggaccagggcccaaagaggtggncccaaaagagacagcctcaaaatgatccaggaagt

SEQ ID NO: 687063 - DNA, 698 bp, Homo sapiens
tatatatcgtggcagtgggtcatgtttggccaacatcacccctatagtgtgggggagcataccaagaggggcccactttgtgtgccaacaccaagatagtgtgtgtctgcctttggccccaagatgaacaacatttggccaggggtgggattgacaaatgggacaatgtggccctaagtgctccggagaggggtggttgggttcctaggaggactattcacccagcataaaaggacttgtaaagcccgaagcatggtgccagtgcaagtcgaatgtcttgtcacaggagggggctacaagtgatctacacattagcatctgaaatgtgtgctctgggacctgtataagtgcggtgtatgcccatacccaggtgtgctccatcttttgttctccccattacaagaagttcatctcagaccatggctttgcacagaccagtctagttatttgtaagttcccatccatggccaaggtggatgaattcaaaggtcacacatcccgggtcctgagtctgaccatgagcccagatggggccacagtggcatccgcagcagcatatgagaccctgaggctatggcactgttttgagttggaccctgccgtgagacggtatcgggataaggccagttcagccaaaagcttcctcatccagagaggcgtcctgtgaataacgaacccatcaccgcggcagtttgtta

SEQ ID NO: 687064 - DNA, 290 bp, Homo sapiens
ctgctgctcaccttagtctcatcacacactgtctgccggatggatccctcttcaatgaactacatgaaggcaccaatttcggcgtggaccagagccaggctgtgaagatggctttgcacatggcaagtggcatgatcttcctacacacactagagcccctcatcccacgacatgcactcaatagccgaagtgtaatgattcgatgaggacatgactgcccgaattagcatgcgcgatggcaagttctctatccaacgtcatgaacttgccagttctcaaaacccgagagc

SEQ ID NO: 687065 - DNA, 977 bp, Homo sapiens
agcggcgaagcgcagctagcctggactgagaagtcagaagcgagaggaggaggagacgaaagcggagttcgagcggcagtcgaaaacattcgacatgcatagaacatagaagataaaactcactcgagggaagaaacagcacgaagagtagaagaacttggctagcaaacaagggtggacggaacgaactggagcaactaggaaggactgaacacttgacacgagatagttctccgacagggtggacggaagccaatacgcatcatgcgaacatagcagattgcgtcgtaagaactcgatgcgacagaggacaatgctgatgctttgcctgcacaataaagcttagagatggtacacgcatcggtcgttgtggaacacgtacgatgacagtcctatggcagagaatctttcacgtgtcggggttctggcctccttgctcaagttcgagaaaggagatggacatacacgacatatctagattctctttctgcgtctacaacggtagacattggctgcgaaaaggttaactttgttataggcctaattcgagacagttgcttgacgtggataaacttaaacacagtctgcgaatgctattctactaaagacattattcacaggcatacctttcttgactttacatggacactggcctactttgaggaaggtgtgtgacaacttttgtccatgagctgcagcgacttaccattcttttattgggaggacggtgagggaagaccaggcacgtgcgtaacacgcgtgacacacggttacaaaatccacctgtggttgtactattcttctatttctgtcactctgttaccttaggacctgtgagcaggcttttgctttcagtcagatttacaaatgtagcagggccctaaccattgcagtggaaaagcacctgcttaggctcaattaggattctctcactctgtctgttgtacacctatcttctataccctcactccgtcccc

SEQ ID NO: 687066 - DNA, 114 bp, Homo sapiens
gcggagcaggccgtgaagcacccccgcctgctgtccttcacgtcgcagctgaaggccggcaagggcctgaccatcgtgggctcggtgctggaggggacgtacctggacaagcac

SEQ ID NO: 687067 - DNA, 120 bp, Homo sapiens
tatgagagaagagcttcctgggatggaccccaccatctctgcaccttacgccactgcaagatgctggcctcggtgggccagccagcccctactactgagacccacccccatcctgggcat

SEQ ID NO: 687068 - DNA, 114 bp, Homo sapiens
cgaaagaatctggattatgaaggaagcaatggttcaggcagaggaagcggctgctgagattactaggaagctggaaaaacaggagaagaaacgcttaaagaaggtccaggtatg

SEQ ID NO: 687069 - DNA, 592 bp, Homo sapiens
caaaagagcaatccttatcagaattctaagtggcatttttcacagaactagaacagaaaaatcctagaatacacaaggaagcacaggagagcttgagtagccaaagcaattttaagaaagaagaaccggtcagacgcatcacatttcctggtttcaaattatagttcacaaagcgtacagtaagtcataacagtgtggacgtatggacctgagatagaaagagggacacagaccagtggtaacagagaagagcccagaaataaaccacacaaacaaggtcaactaatcttcaacaagggcctaaagcatacatacaataagcaaaagatattctcttctataaatgatgtagggaagactgtatattcacatgtaaaagaactactgccatacaccatatacaaaaattaactcacaatggattaaataattacatataagatctaaaactacaaaattcttagaagaaaacataaggaaaaagctcctcgatgtaggtcttggcgatgatatttgggacatggcatcaaaagcaaaaataaacaaataggtgtacacaaactaaaaagttctacatggaaataatcaatac

SEQ ID NO: 687070 - DNA, 162 bp, Homo sapiens
caccagctcagggcgagctggagagctgggctgggtcgatcactcaccgccaacagcgccctggctggaggttgagagggacaatctggcacagtgacctgtgccacttgtgagtgcatgaagctccatgtgatgaaacacaaccgtgatggctggaatcct

SEQ ID NO: 687071 - DNA, 586 bp, Homo sapiens
aagtccggactgtctaacggccaataacgaacggccgatatagcctttagtactctatacggagccctcagagtcaaccgaaccagattactaattcgcgaccatcacaactattagcgatccgcaataaaagcataactagccacgtcccgacagaagaccggccgactaagacggtcctaacgacgtagctaaatggaggcggacgtggaggaacgtgggcgatagctcctaaatatattccaccgatcgcagaagagaaactctcaagcggaaatgaagacactgcatgaacgtctaggaagatacagtctcctccaagaaccgctccgacaaagtatatatggacggccacataatctatatcacctgggacccaagatcgtaatctctaaaggtccacgtaaacgaaaaagaaccccggtgctctaaaagctgcaagatacggtcagtaggcggggactgaaacataaagcatcctcccgtcctcattaaaatcaggacggtaaggaactgcacgcatctaacctacgatgacgatggaatgaaatataggggaattaactgtccaggggaagcggtataa

SEQ ID NO: 687072 - DNA, 1221 bp, Homo sapiens
ggcgcacggactcggcgacctctccgaaccggccgccgacggccatgcgagaccaactccagcctctatcatgcgcgctacgctcctctgcccgtgcatggcaatgcaccacagacaatccgactggcgtcgatcaggaatcaccgacatgacacaaagattcacgtccatccgctcggatccatgatcgagatgttgggggctctgtggaggacctgattgccaaaggcaccctgtctcattaagtaactcaccagggcgaggtgaccagtcactgatgaaccgatggaggcccagttctcgcgaagagtgtcctcaatgaactatcgatggactgcccagtactaacggggagatttggcatcgaggacgcctctcctacagtgtcttcaacagtcgtcttctgatcagagggtctcctgccaacctgatgggatcccctaccaatccatctgacaaagctagcgtggagcattaggctttgcttggaatccgactcaccaagttacaaacagtggataacgtccagtcacctacgtgcaacgaatggtaccttcgctatgacatccagctatggctcgggcaagcctctccgggtaccgtgagccaggacactgtgtcaggtgcccctgccagtcagcgtcgtcaagcctctgcccctggagacggtgtcaaacgtggcacgaggcacggtctttgcacgcaaggacaaccaagcacacaaggaatcaccttcactcgcaaccacagttcgactaccatcctagggactgagcaacccaccagcatctacgctcaacaaacgtgctggcccggactacgacgcaccctgatgaacgcgcgaagatgatggcaccaacccatctactcattcataattgagccagtgaccagaatcgcatcttgacgtaacatgcctgccagacggacaaaaaccgccatgtaacgggatcctgaaacaccaaagagacccccaaagaccacgccgtcacataaccacttataacatactacacaatacacaccataaaatgaaaaacatacccaactctccacaaccaactaccaaagaccacaccataacacaacaccctcaataataacactcaacatcctactaaaacaccagtaataactaaatacaataaactaaatcacataaaaacacaacacccacaaccaatcacctcacatatagactccctcacttcctcacacata

SEQ ID NO: 687073 - DNA, 983 bp, Homo sapiens
  misc_feature (206)..(206): n is a, c, g, or t
agaacggtctcagcaactgtctgttctcaatctggccatttaagtttagctagtaaaagactggttagatgataacaattgcatcgtacaaccttcataaaggaacaggagaatgtttttgtggaccacttgtgggttattctttctattagcgcttgtggcagttcttaagttattaggtttctaatatatcagtactttttaantggataacatagcttgaccacagaatatttgtcacaagaattttgagacccatttaataaaagcttaggaactgatgaacattacacaatacaaagagacagaagagacacattataataagcgggaggtcccttgttcctcataatcattcccctcgtgggggcctcgagtattactgcgtcccctgcctttgtctttttgttagcaagggggccctcccattaatggcgtatgtcctctccgatgaggaccgaaattagtccatgtctggattggagaccaacgagtgagagttaagcggagaacaatactgagtccggccgagtgcccaattttcggttgaggaacagcactctagtttcgaggtggaggtcgtgcaattgagggcgtgacctcagtaaccactaagaacacacattcctacaagcgacgcatatcgtgttaacccttttacaactttctttctgtcgctctttcagtttgtttgacagccacttcaggcagtaatcgtctcagctttccttgataacatttgtctgggcaaaacggggatctatgacttttcccgcctaattgtatttctacctcccagctgtttgtgtaaaaaaaacccttatccaacccctttaattaacccaacttccaacaaaacggcccttcggctttaaaattctccttcctttcttctccctttaattgacattaaacactaattctccaccagacctcctaagcgaccagaaaattatacctaagcaaacctttaaaaaccctcc

SEQ ID NO: 687074 - DNA, 1954 bp, Homo sapiens
  misc_feature (14)..(14): n is a, c, g, or t
  misc_feature (71)..(71): n is a, c, g, or t
  misc_feature (75)..(75): n is a, c, g, or t
  misc_feature (77)..(77): n is a, c, g, or t
  misc_feature (81)..(82): n is a, c, g, or t
  misc_feature (132)..(132): n is a, c, g, or t
  misc_feature (153)..(153): n is a, c, g, or t
  misc_feature (155)..(155): n is a, c, g, or t
  misc_feature (190)..(191): n is a, c, g, or t
  misc_feature (202)..(202): n is a, c, g, or t
  misc_feature (216)..(216): n is a, c, g, or t
  misc_feature (233)..(233): n is a, c, g, or t
  misc_feature (239)..(239): n is a, c, g, or t
  misc_feature (245)..(245): n is a, c, g, or t
  misc_feature (249)..(249): n is a, c, g, or t
  misc_feature (252)..(252): n is a, c, g, or t
  misc_feature (342)..(342): n is a, c, g, or t
  misc_feature (374)..(374): n is a, c, g, or t
  misc_feature (422)..(422): n is a, c, g, or t
  misc_feature (441)..(441): n is a, c, g, or t
  misc_feature (447)..(447): n is a, c, g, or t
  misc_feature (463)..(463): n is a, c, g, or t
  misc_feature (474)..(474): n is a, c, g, or t
  misc_feature (520)..(520): n is a, c, g, or t
  misc_feature (530)..(530): n is a, c, g, or t
  misc_feature (539)..(539): n is a, c, g, or t
  misc_feature (543)..(544): n is a, c, g, or t
  misc_feature (547)..(547): n is a, c, g, or t
  misc_feature (550)..(550): n is a, c, g, or t
  misc_feature (565)..(565): n is a, c, g, or t
  misc_feature (572)..(574): n is a, c, g, or t
  misc_feature (578)..(579): n is a, c, g, or t
  misc_feature (581)..(582): n is a, c, g, or t
  misc_feature (610)..(610): n is a, c, g, or t
  misc_feature (684)..(684): n is a, c, g, or t
  misc_feature (797)..(797): n is a, c, g, or t
  misc_feature (804)..(804): n is a, c, g, or t
  misc_feature (806)..(806): n is a, c, g, or t
  misc_feature (808)..(808): n is a, c, g, or t
  misc_feature (831)..(831): n is a, c, g, or t
  misc_feature (884)..(884): n is a, c, g, or t
gtccactccgggcnggtacatcatccccctgcaggccctgcctcacaaccacagagtcccgccagcagccnatgncnttgnntgtggccctgaccaagggtggagaggcccgaggggagctgttctgggacnatggagagagcctggaatttntnttgcgaggggcctacacacaggtcatcttcctggnnaggaataacangatcgtgaatgagntggtacgtgtgaccagngagggnggtggngtgnagntgcagaaggtgactgtcctgggcgtggccacggcgccccagcaggtcctctccaacggtgtccctgtctccaacttcacctacagccccnacaccaaggtcctggacatctgtgtctcgctnttgatggaagagcagtttctcgtcagctggttttagccgggcggagtntgttagtctctccagaggnaggctngttccccagggaagcngagcctgtgtncgggcagcagctgtgtgcgggcctggaggttcgcatgtgtcacctngagctgggcnctaaccatnccannccnccncatcgcttgtttccncctcctnnnccgnngnnctggcccccaacgtgtctaggagagctntctccctagatcgcactgtgggccggggccctggagggctgctcctgtgttaataagattgtaaggtttgcccncctcacctgttgccggcatgcgggtagtattagccacccccctccatctgttcccagcaccggagaagggggtgctcaggtggaggtgtggggtatgcacctgagctcctctntcgcccntncngctctgccccaacgcgaccgctncccggctgcccagagggctggatgcctgccgtccccgagcaagcctgggactnaggaaaattcacaggacttgggagattctaaatcttcacgtgcacatctactcctttacatcaaacagcgggcaattaggcacatcgaccaacaccaacacaaaacaacaaagccaacacaacaacacaacacaaacaacaaacaacacaaaccacaaacaacaagaagaccacaccacacaacacacggagcgccggcgacgacaaggccacacaactctacacggcagaggccacgcacacacccaaacaggcgccgagacgaagggacggaacacggaccagcaccacaacggagccgcacgaacacacaagcaggcggggacaaacacacgacagctacgagccaaaaggcagcgggcgcagcagcgggccacacaacaccgggaagacacaagacgccggcaacaacaaacgggaaacgacaaacggagcggagataggagggtggaagcggaacggacaaaaccaacaacacgacgcgcgcaggggagggcgcagacaccaccgcaacaggccgcgacccccgacggcccggagagagagcagcaacccgcacgcaccgcgcgccgaccgaccggccgcccacaacaccaccggcaaaacgcaaccacacagcacgcaacaaacaaacacaccaagacccacgccgccgccgcgaccacacagcacacgaaacccacgaacacaacaagaaagaaacaacccgccccacgccgcacacccccccacacgacgcgccgcagcaaacgaacaacaaagagcgcaaaccacgcgcgcccaccagaaagaccagcgagggagcacgcgcggcgtccaaggagacgaacgcagaaggagacagccgaacgcgggggcgggacgagagaggaccagaaacgccataagcaaagcgacgagaggactcagcgcgagcgagagaggacagcgaaagagcaaaaagacaaacggaacaaaggacggagacgagggcgggcgtcagataaaagaggaccagcgacagaacagaccggacgacggaaagcagacacgaccgaacagagggagcgggcaacggaagcaacgcgaag

SEQ ID NO: 687075 - DNA, 162 bp, Homo sapiens
ttttttccggtttttccccccccggggggccataaatttttttttttcccaaggttccctttcccaaggaaataatttttgggggggggcattgtttcttaaattttccgggggttaggggggacttttttttggccccttctgggggggggaaaggttcca

SEQ ID NO: 687076 - DNA, 166 bp, Homo sapiens
gacactagtggatccaaaggcttcggcacgagagaatggcaagacaagcagcaagaacaagaaaggttttaaagaaagatgttgcttactatgagtttcaaggtgacggatgatgccagctcctcctaaggacacagggctgggttggtaaagagaaggctatggt

SEQ ID NO: 687077 - DNA, 221 bp, Homo sapiens
gtataagcatgcaagtctcatgtcacagcattatacataatagtgccaactgggatccaacagagaactgagttacacactgaagcataatactaagtgtgatactcagtgtgatgtatggacaactaataaaacaagcaatgtgaggctgggtgccggtgctctcacctgtaataccatgcaactaagggagggcgggagcttagaatccaagtgcaata

SEQ ID NO: 687078 - DNA, 915 bp, Homo sapiens
aaagctgaaactatgatagccagatgggttgtaacctcagggttaaccggtatctgaagaatgacacattaccttgggagtagcctggctgggaggcaaactgactcactgcgtcccggtaatgcgagcagtgcctccacaagagcgcggaccggttacgtagacgcaatgaagttattgagggagtgccaccgcgggggctgtgcctcggtcacatattgtatcaagacccgatgatcggtcatcttcacttggagagttcctgtttgatggaatgtagatctcttgagtgaccgtggtgcgctatggttctccactctggttgatgcttgccgtccatgttcctcgctgacagtcctttgttttgtgcactctcatgaaatgttctcacggactaactccctcacaaagggcacatagtgtggattttggagtgcttcgagcatttggcaatccccttgggacagaagagagagcacaatgggtatggaaccaggagtcccagaataaagattgaacgagagacagtgattctaattgaaagcggcccgaagcggtggaattgggcaagaaaagatggagaaaggtccgacgtcgtaatggcttaacggcctattggatggatataccctaaaagtcgcaattctacaccgcttttaactcactgcattaaaccgaaaggggggactaagcgaacaggtgggtggtcactggcttgaatttcgagaatctaaagccaagtgtttgtccacacaaattgagaacccctttaggaattggaacggttacacaatggttttggaaaggggttgaggtgggacttcgcaaggccaggccaaatagggcgttctagagagaattaagaatacaggggaagagacagacactcattccgagaaaataggccatctaagg

SEQ ID NO: 687079 - DNA, 422 bp, Homo sapiens
  misc_feature (107)..(108): n is a, c, g, or t
ctccataatgtgtgcccatcattttgtatattcttccaggaaattattattttctttttttttggagacaagagtcttgctctgtcgctcaggctggagtatagtgnngccatctcagctcactgcaaacaccacttcctgggttcaagcgattctagtgccttggcctccctagtactgggactataggagcgtgccaccacatccagctaatttttgtatttttaatagagatggagtttcaccatgttggccaggctggtctcgaactcctgacctcaacagttccacccacactggcctcccaaaatgctgggattacaggcgtgagccaccgcgcccggcccgtttgcatctttttcagaaggggtatcagtggcttagaattagtgatagtattactagttgtatgtacaatttca

SEQ ID NO: 687080 - DNA, 102 bp, Homo sapiens
gcggccgcctactactactactgctcgaattcaagcttctaacgatgtacggggacatgcaattttgcatttgaataaagcctgctttttaagtgttaaaaa

SEQ ID NO: 687081 - DNA, 896 bp, Homo sapiens
tgagattctcgccctgagcaaggagcgacggtctgacgtcggcggaggggagccggcccaggctcggtgaggaggcaaggttctgacgtgggacacggctgacctggaggaccagaggtccccggaggagcactgaaggagaagatctgtccagtgggtcgtccattgcccaggctcctggccacagctcccgtctgttgtccgtgagcagagtcatcatgcctcttgagcagaggagtcagtactgcaaggctgaagaaggccttgaggaccgaggagaggtcctggggcctggtgggtgcgcaggctcctgctactgaggagcatgaggtggctctctcctcttctagctcgtagatggatagtcaggcctgggggaggtgccctgctgtcgagtcacgcagatcctccccagtagttcctcatgggtagcctccagctcccgcgatctacatgaactactcctctctcggagccaatcctatgaggactccagtaaccaagaagaggaggggccagggcaacttcccgtgactggagtccgagttccaagcaagtactcaggaggaaggtggcagagtggtcccagattctgtcctcatagtatcgagcggaggctgctggtgacgcacggcagaatttgggggggacgtgtcgtcgtccatgtggcaggatttggtatcctgtgatcgtcagcgagagtgccggttcgtgggggggcttggatcggcgtgtggggtgggccctggcctgtccttttgcactgctgggtttctagaggctggggtggcgtgtcagccgggggctggagcgggcatcagaggggtgcccggggaaggggggtgttgtggggcggacttggtcaccgccctgggtggccgcacttgtttcgccca

SEQ ID NO: 687082 - DNA, 221 bp, Homo sapiens
  misc_feature (213)..(213): n is a, c, g, or t
atctatacaggatccccgtgagtcgtttaatgtcccggcaggctgttgaatggtccaccattctccacttgttggtgtttctaccgtgtagtaccgtcacttacaaaaatgtctagttcaccgtatgggatgtgtccagccaggaccagatccggccgctctgtcggcattactacactggtgacccaaggttctcattcttcgtactgaacngtcgtccg

SEQ ID NO: 687083 - DNA, 162 bp, Homo sapiens
ggatccccacaacatgtcggggctgggagaaacactggcacgttaggaaccctcaggtagttcggcatcagtaccaagtccaccagatgagggagggacactggccatagaccacatgacaaagggcctctgatccatgctaatgaggtcagcatgttctga

SEQ ID NO: 687084 - DNA, 196 bp, Homo sapiens
catgtgccagctgactgcatccaatgcctgtgtgctgttccttctcgctgcggcccttgatgctcttagtctgagtgtccctgctggggccctgaagctgtttacttttgaaaacaattagactgtgttcaaatgcattgccctgagcctgcactgtgatacctgcagcctattgacataattggaatagtgacct

SEQ ID NO: 687085 - DNA, 390 bp, Homo sapiens
cgctcttttggctcccctggggatcttcttgaaactcgggttttccctccttggttccgttgttttcgggatggggtcccggttggcttccattcggtcctcccttggtgtccctggggggcttttttgggggccccttttcggcccccaatttccccggttgtccgggtccctggtgtataatggcccgctttttccatataccctgtgtatctcctcccggagattttaactcatctccgggtcccttttaatccctaatacggtgttattgctccgtggttctttggtgtttttatttgtattatttttattgttgccttgttattttttttctggtttattttcattccgtggttggttggttgcccggtttgggtttatttcaga

SEQ ID NO: 687086 - DNA, 544 bp, Homo sapiens
acacacgacaaaaatgtacttcaataagcaatgcacccctacccattattttccattatactgtggaccaatgtgaactgctatttacaaagtaattttattttttggtaagaacaaattaactatcagattagcaaaccttttttttaaattttttgttttttttttggtttatttaacttttaaatggagggtgacccggggcattaagataacttccacttctttcaataaagacatttggtggcatgctatttattggtttaaatcatcggtcatgccttaacaaaaacctcctaagaatgtccgaattgggattggtaggcacgtgcaactgagatcttataaacattagtggtcacttcatgggttggacctaagtgacaatatgcgggtaccggccaggcttggaccaactatgataacaaacagttaaacagcactaatcagagatttatcccttaatttcccccaattaccctaccgggcgaatgtccggtaacatcatgaaggccaacacattaactatttggtggctatggtc

SEQ ID NO: 687087 - DNA, 927 bp, Homo sapiens
gaaggatgttttccgtctcgtagcgggccctgcggcccctctttggtttctctgggggccccacacgtggggcccctctctcgcccggtggggacccccgaatatgccgcttctttttacaggagattttctggggttccaccgctttctcgggaggggggttttccccgctgtattgtgggggcccacactggcgccgaggtgttatttgggcccccctgttggccctccccgcgtccttttggtgggaccccccaatggtggcggcgcgccctcttattaccccggggggtgtttccgggcggtattaccccacgcggggggtgttcgggggattcgcggcccccccttgtgtgcccccctggggcggttcttcccgggggtgtgtgccccccttttccccccgggcggaagtttgcggctgtccaagacccccgggtgggtcgtgggtgggggatatcaccccggcgcccaccctagtggagcgcgtccttctcgggcggcactgtggtatacttattccgcggggggttttttcacccggcggtaattacaccctccgggcccccccgcgcgggtggggccgcccccccacgtgtgttgctcctctccccccgcttcccctctgtggggagccccccggtccccttgggggccccctttcccatgtgttcacgccgcttttcccaggaggtgttccactctcccccgggtacccttggttattacggggcacactcttggggcacccgacagtgccaatttcgtcggtgggatcccccccctgtcgtagctctcttccgcgggaggagccaccaccacggcccccccggtgtccccccccccccccccggggtttttttgtgaaaaaatgttttttttttttttctcaaaaaagggtcaagacccccccccctctctcttcta

SEQ ID NO: 687088 - DNA, 285 bp, Homo sapiens
tgtgtaccttctcgaggaggacggggatggcctccctgttgtggtgctccttgtggccttccttgaggaggagcggggatggcctccctgattggggtggtccttgtggcttcccctgaggaggtggtggaccttgttgctgctggcctccttgtcggggtggtccctgtctgagggccatcattctggttcccaccaccagcagagggttgagattgctgtcctcccaaaggtgatgtcggtcctgacgctcctcatctatgaactgctcagagtctcctccca

SEQ ID NO: 687089 - DNA, 293 bp, Homo sapiens
agatacatcacgtgtttagcgatggttgctggcactcagcaagtgcttgacaatattcgctatcattatctcacaaaggggtggacaaaacaccaggtgtaggctctaggtcatgctgctcacagcacagaacgccactcacggaagaaggctatcattgggcgctgctgctgaggagactggttcaatctcaaatccatctccttgaccagctacacatcacgggcgttacagtaacagggaacgaaatgtaacaatgtgtacacgaaaacaggagtacaacctgccggtgg

SEQ ID NO: 687090 - DNA, 395 bp, Homo sapiens
gatcgaccaggacccaacgttataacccacggtcgtgtcatcgcccttgagggtgacccgtgtctctttgccgttgttcaaggcaccggtggccaggttgttctggagcttcgcctcgaacgggttcagcgtcgggccgccccccacagataggtaatcattgacccggtagacgagagtcggttgcagggtgatcgcctgggtcttgctataggcgccaaaatagcgaccttggaagctgctctcataattgttgaccagaccgaatggaacatagagccccaggccggctgaaaaaccctcgtcaagaggtgttgaaaaataggcgaaggggacggcggacaaggggacggattacccttgctcgttcctgtggcgtcgacgcggccgcaatt

SEQ ID NO: 687091 - DNA, 132 bp, Homo sapiens
gcggcgtagtgaatggtgcattgagggtctaacagtggcaggtccagcgcagatgaaagggttccaccagatgtcagtgaagaacctggagtagaacacatctcagcacactccagtgagtgagcaggtgta

SEQ ID NO: 687092 - DNA, 371 bp, Homo sapiens
  misc_feature (30)..(30): n is a, c, g, or t
  misc_feature (37)..(37): n is a, c, g, or t
  misc_feature (137)..(137): n is a, c, g, or t
  misc_feature (341)..(342): n is a, c, g, or t
  misc_feature (346)..(346): n is a, c, g, or t
  misc_feature (349)..(349): n is a, c, g, or t
  misc_feature (366)..(366): n is a, c, g, or t
ttatgaagctgccttacggaaaaagctcgncgctgtnagacccaacctcctcgtaaaaggccattttcagcagctggaatgtgcaggagcgcagctggagcccgtcctgcaggagctggtccacaggggtctggaanctgatgcgcttctccttggtcagcgcagccaccgggaaggagcggaccaccacctgctccccaaccagggggtccgtgggcatccccgtgaagatgacccggtacgtggtgaggaagacggcgccctcagctgggagcaatgtggtcccccagcactgccccccgcgccctcctcacgcccatccggcagcaggtagacgcgcnntttntancagcacacacttctcancccgg

SEQ ID NO: 687093 - DNA, 940 bp, Homo sapiens
tgagggcgacgctgtcctgcctgggtgcgtctccggtggggcggcgggggtggttatatttacgcccgccgggggggcgccgagtttgtgcgcacgccggcgtgtcttgtggttgctcagccggtcgggtgttggtgtggtggactcttcttgcggcggacacgaaggggcgtggtttcgaatgttttcgttgtggggggcgtcgcatctgatgtttgttcctccctccgtgtgtgtgagatatacacagggtggtgtggcactcgcacgtacgttgttggtggctggtgaggagaacccttctcctcctctgtgtttcctgaccgagatagcttggggggcggcggctcgacatggagactcactcccaccccgtctgggtgggggtgctggctcccctcctgctggtggtgggttggggtgaatagaggagggtggtcgtctcaggatggatggaaatcagtggtggtgtgtctgttattaagatagataggtgcggcggcctttcgagataaaggagtgttgtttattgagagcgaccgctgtctgtctgtgtatgcacacacgcaggggtgtttgtcttgtttctctgttgtgtgtggtgcgagtggtgtcgtgcggagtatagtatgtgggtgtgtctgcccccggggtccctcccacccgggtgttttctgttgttgtggttttgcgttggtgcgcgtggtggtggatttcacctctgtggtggggtagtgttgttgtttggtggtatgcatttattctggtggtcgacgggccacttggttctcgcccgcctccttgtttgcccatttcattctggggggtcgtctttttggtgggaatataatttcttttggaaaaaaaaaaacaatttttcccccccccggttttccccacttttaaaaaatttttttttaacccccccctttttttttta

SEQ ID NO: 687094 - DNA, 602 bp, Homo sapiens
tactcaacggaactttgtcaagcattagatggttgtaggtgtgtagctttatttctgggccctctattctgttccatatgatctatgtgtctgcttttgtaccagcaccatgcttttgtaccagtatcatgcagttttggttactgtagccctgtagtatagtttgaagttgggtaatgcgatgcctccagctttgttctttttgcttaggattgctttggctttttgggctcttttttggtttcaaataaattggaatgcttttttttctgattctgtgaagaatgttattggtagttggataggaatagcattgaatctataaattgctttgggtagtatggccattttaacaatattgattcttcctatccataagtatggaatgtctttccatttgtgtcatctctgatttctttcagcagtgttttgtaattttggtagtagagatctttcatctccctggttagctgtattcctaggtatttaatccttttggtggcaattgtgaataggattgcattcttgatttggctctcagcttggatgtcgttggtgtataaaaatgctaccatactttgtatattgatttcgtctcctga

SEQ ID NO: 687095 - DNA, 1313 bp, Homo sapiens
  misc_feature (801)..(801): n is a, c, g, or t
atatacacccctttttcggagaaaccccccacccacccgtttttttccgtgagacaccacaagtttattcgttatcgttaataacccccacaaaaacggtgtagtagtttcccaccgcgatgagatgtttattgcccctcatctccttctccctctcctctttatccccacaaaaaatattgtgccctcgtgttacacaacagtgtttgttccacgccttctttataaaaagatatttccctcttttgtaagataaaaaacggttaaagctggtctcgaacaattttgttttaaattgtttgtttgtccacttttatggagaagctttaccccccacacgttataaagaagattgggtttaagagccccctttctgtaggaaccccccacaaatttttgtgggtccccacctttctttctaaaccccccccgcttccaccacacagacctcgggcttctatcaccccggaaatatgtgggagttctcacacgggtgtccccccccccgccttataatggtttaggaagagggtgtgagcaccccaccctctatgaaatttggcgctcttttttccctcggccctctcccccctctcgagatacgagaaagaggagaaagagagacagagagatagagcccgtctttggggttttttgttggcgccacccctcgagattttttatagcccccacatcgtgtgtaggagaaacctccatcattctctcacatgtatcccccctcttctttttctcggcgcggttgttgaaaaagctctcgcgctcgctttctctctatagaanaaagatgcgccactctctccacacatttgtgcgctctgtgttatatccacagctccacgctgcgctcgcgaggagaatattctctgagaatatagcctctatatgtacacacacaacactctttttataaatgttatataaattatttttgtagaaactcttgggtcttgggtgtttgtgggcacaccctcggccacccccacttctcggctcgtggaccacgcctctctcgcacagtgccctgcgggctgggcacagttttgttgattctctttaaagtttccttccctaccccgtccccctattttctggttaagagttttcttagagagagttctgtttagagtgtacctcctcgccacctttatatggctttaaaatagttactctccccttttatagtggttcttctttggggcccattgggagaaagagaaatccatagtgccactgttttgatactgaatattgacccagatgtccttttgtaaatataagaacccgtcccctcc

SEQ ID NO: 687096 - DNA, 363 bp, Homo sapiens
cgtcagttacatgaatattcatttaacaaaaaccataaattatttacttagaaaacagtaaatgttactgtaggggacaccttaataaacgtgattataaacataaatcctaagcatctaaaaaaaaaaaaaaagggaggaggaggggacccagaccccccccattctatttgggagacccttaaaaagaaaggacctcattcttaatttggttaaaagaaaaatataacaggattggaatatatttagctgggatattttagggcctgctagcactggaagccagagttcactgggagcattctgactaggaaggagaaatctcaatcagtttacacaaattcagggcatgctttaggggta

SEQ ID NO: 687097 - DNA, 811 bp, Homo sapiens
gaagcgcagcgggccgtaggagcggtccgctgagccttgagcgggccgcggtgtgaacatgagagctctaaacgccgtgtcccttgggttcatgccgcgcgccctagggccggcctcggtgcgggctgcgactagcgacgcgagtgagactgagctgtgcgcggcgggccggcgtgagcgcgttctcatggcgttggctgggacgatcggggaccctgctcagatctccgtcttgtggtggtagaggtgctggggcttcgaccagggatctggtgaggcttgaggatcattgttgtgcacgatttcgtaatactaatctaggttctgcctagcgagcactcgatgtgcatcgccaggttccctcggggttggtcgactaccgaggataggtacatggtcacctaagcagaagcgggttgctgaggggcctttcaggcttgggttattgcgcctcgaatcgttggcactggacgtcccgtgggttgcccgttgcttgaccctgtttgagccacaaggtctctctctgagccagcaagttgtgccattggaaacgggccaccagggaccccaaattggaagcgtggcgaactacaagtttgcgcacaagagtggtaaaccacctgtaacaagaggggaagagagcgccgatgggagatagtaccacccgttgctggtggtttggaacgcccattgtgatttacacgcgtggacggtttccattttgttgcggcaagatagttgccaaatacgttctcttctaattaccccgtggaaacaaatttacccatttgtgttacttggaacgttcgaa

SEQ ID NO: 687098 - DNA, 116 bp, Homo sapiens
tgggtctagaatccagatgtccccgatttctgcttgctgagagataaagtttttttcagtcaagggcaatatcagtcatcccgtgacatgtttggcttttgggagtttgcccagga

SEQ ID NO: 687099 - DNA, 901 bp, Homo sapiens
attatatttatgtgtagaactaatatatgaaataagtaagtgtagctcccacaaggtaaacttcatggtaagatgcactgttctgattatgtaagcattgtacatcttcttggaaataaaagataaaagagcgatacacaaagctttcttttctaacttttccaagcaaaatctaaaatgttttatgacatttgttctggctgtgatcttaaaataattcatatctaaatagtatttgtctaggagatgctttctctctagtagttagaaattaaatctgtgtcagcattcctattaatgtctcactttactttcaagtaatattggtgctatttaacattttacagtaaatgttacttctgatactttagtacaatttcaactacagtgattcatgtagacgagaccggggacgtttgttccctctggggtacttgagctactatgtgtcaatactactaaaacttactagctgctaccaaatttgaagatctctctaatatggtatgtaccacaggataaagttattcttgtcatttgaactgtagagtcctatccagtgtgatgactcactgtgctttgacacaatctcattattctgggccgggaaatggtggctcacccctgtaaatctcagcacttgggaggccaaagcggggtggctcatgaggtccaggagatcaagaacatcgggcaacatgtggataccccgtctttataaaaatacaacacatagttgcgcttgtggcatgcacctggtatgcaaacaccgggaggctgacaaggaaatgctgaaccgggaggaaggttcaggagccaaatatgcggaaccgcggcagaaaaattgttctcaaaaagaaagaaacaaaaaagggggtaaaaacaggacaacaacgcacat

SEQ ID NO: 687100 - DNA, 381 bp, Homo sapiens
attatagggcttctgcctaagcctctccctccagccataggcagctttcttaactatcctaatttctctcggaccaatggaacacagatcaagactcgcccatcaaatgccctcctaccatttgttactaaagggcattattgagtatatgctcaagagaaaccaccacattctggcagaatgctactttaacacgattagcatctatcagagtgtaggatgactctttaatcagagctcttatctattcagttacacaaaccagaaatccactacctttactattactcctatttaaccaattttcaagtcctgtaaatgcaacctcctaatttctctcggaccaatgtggtgacgagcgcggatacgtaatagtcatcg

SEQ ID NO: 687101 - DNA, 244 bp, Homo sapiens
aggggggggggggggggcccttttttccccccgttccccccggggtttttttttttgggggggggctttttcccccgtttttgggggccccccccccccccttttcccttttttttaaggcccttttccccggggggggggggggggcccttttaaaaaaaaaccccccttgggggggggggggaaaaagcgggtcccccttttgaattttgggggggggggggggccccccagggttcccaat

SEQ ID NO: 687102 - DNA, 421 bp, Homo sapiens
cccgtattaaccacaggccttctaagcatgaatgctgcatggcaatagacacaatgagcagaaagttagacggagcgacacagcgtgcgggatggggctcttcggaatatagactgctgccataaggcaagaaaaaatagaataggaaaggattttatcttgacgtcaccttattagaaagcgacgcaaactatgtgccagcagccgcgataatacataggtcgcaagcgttatccggaattattgggcgaaaagcgcccgtagtttttttgctaagtctggagttaaatgctgaagctcaacttcagtccgctttggatactggcaaaatagaattataaagagggtagcggaattcctagcgaagcggtggaatgcgtagatattaggaagaacaccaataggcgaaggcagctaactt

SEQ ID NO: 687103 - DNA, 478 bp, Homo sapiens
cgcttggtcccacaccacttctaataccgctcgaagcagccctgaggaacatcgcccattatctctccatactaccccccaaaattttcaccactccaacacttcaacactattttgttttatttttcttattaatataagaagacaggaatgtctggcctctgagccaaggcctgcatgtatacatccagatggcctgaaggaactgaagaatcacaaaagaagtgaaaatggctgattcctgccttaactgatgacattaccctgtgaaattccttctcctggctcagaagctcccccaccaagcaccttgtgacccccccgcccctgcctgccagagaacaaccccctttgactgtagttttccactacccacccaaatcctataaaactgccccacccctaacaccctttgctgactctctcttgggactcagcccacctgcacccaggtgaaataaacagctttattgctcac

SEQ ID NO: 687104 - DNA, 211 bp, Homo sapiens
  misc_feature (34)..(34): n is a, c, g, or t
ctggggtgcagcgctcgcgacgttttagcaaggncgagactaaggctggtcagtgattatggggaagagtcagggcccatcagaggaatgaagtggctaagggtgcctccagtcccaatagccacaagtgaattctgttgaaagggagttctagcatctcacaggccgaggggagccatcagatggagaccgaagtccagagagcgtcctc

SEQ ID NO: 687105 - DNA, 173 bp, Homo sapiens
ggggctgcctgtaggtacttgttttcggggttcggcagagatgtgtttaagctgctgtggccagaagcggggggagggggggtttggtggaaacttttttgttatgatgtctgtgctggaaacgcggctgtgcacgacattcaattgttattattactgctaacaaaaacaac

SEQ ID NO: 687106 - DNA, 399 bp, Homo sapiens
cctagaggatcccttatatgctgtctcatgatatgctgcctcagcctcctgagtaactgggattacaggcaccccctgccacacccagctaagtttgtatttttagtggagacggggtttcactatgttggccaggctggtctcaaactcctgacctctggtgatctgcccacctcggcctcccaaagtgctgggattacaggcatgagccaccatgcccagccaaagatcatttttttatatagacttcagccctttgtaaatattgtaactggggagtatagagtagaaaaaaagtataattaaaacatttgttctacaaattaacctttaaaaatataattactgctaaaaatagagtgctgttacacttaaggaaaattagtgccattttggaaa

SEQ ID NO: 687107 - DNA, 202 bp, Homo sapiens
cgtcgactgggtctcaatggaaacagttccgcccccttaggtcgaccttggaaatagggtaggagggcatttttagttgttccagtggccaggggtgctactggcatttagtggcctggagccagagatgctgctaaatgctcagtgcccagaacagccaccccacctccaagaattgtcctaccccaaatgtcgtcgacgc

SEQ ID NO: 687108 - DNA, 443 bp, Homo sapiens
  misc_feature (424)..(425): n is a, c, g, or t
  misc_feature (430)..(430): n is a, c, g, or t
  misc_feature (433)..(433): n is a, c, g, or t
tgggaagtcctcatggtatatatattttaagtgcaatggaatttttaaatttaaagatatagctttatgaattgagaaattaggcctagctgtaggctatgttacagaaatatagtcattgaatgatacagacatataaaggtagtagttgtctcattgttaattcgctgctgggagagcagatgagtcataccctataaggagtaggcatgccttgtaacgtatgtccccagagctgtcatttgcataagctgcaggccatagattcctgattccctcagtaactgaccgtacgacaatggagctgatccgcggcactctagattttcagggtagggcgcggcacccctgctttcaaaagattcgtgggaaagaatggttggaggaatgagtttcacttccaaaaaatgaaaaaaagaaagcnnggcgnccncccccccggg

SEQ ID NO: 687109 - DNA, 560 bp, Homo sapiens
ctcccggacgtaggtacgttgtggggccgggtactgaggcctgcgctgtctctgttagcttttccgactctagggccacgaatgcgcgccagtagccgcggagcctgggcaggaggttgcaggccgcggctgcgcggagaagctctgtaccttcgactgtacccatatgaaggctacgctgtaggcttactcaggaactatacggcatattctagatggcgaactaggtagttgttaacaatgtacagcacgatcgagctttagttacacaagcgtcaaggcatgtaaaacgacagatgtgacgtaaagattcccgacatgtacaagctaactgcgaccttactggtcaggcctaaaggcataggctccgcaactcgcttgaaccactggcaagacctgtggagtgaaatagggttgtgtgaaacactgatagcaccttgtgtcccgatggtaactataagcggacaggtaaacgctcatcgttttgggaactttcagccaggaaacagtggtttggtgaccaggaacaggtaactcttattggtcaatcgtaaagtgga

SEQ ID NO: 687110 - DNA, 1389 bp, Homo sapiens
  misc_feature (685)..(685): n is a, c, g, or t
gatcctgtctccgccagtggggtgtgcgcgctctctgatatgcggtgtactaccgaaaagggggagtcgtctgggaaaggagagtcatctattgtggtgcgtgtattgcaagggtatcttattcgagcaggatattgtgatagttttgaaacagaggcacatgttggcgcaagaaggagacagagagccttatgcttgtcaagagaatttacggagggtcatgtcagacctagtgatgatgtcatagtggcgtatctcggcgactacgcatgagtagggcatcgaaattccctcagagacgtaacggacggagctgagttggggaatcatcacctctgcgatcttgggggcatgtgggtagactttgctatgtgacaggagcaatgcttgttctgggtgagaatggcacgcatagtggtatagggaacccaggactccataaaatgcctttgggttgcccctttttgggcgccagtgtcggattggcaggttgtcagatggcgagagccccgaaataagaggcgaggtaaacgacacgaatccgtagatccccgtaggtgcccgttgcaggttggacacgtgctaggacactgcgataacgcaggactaaccgtaggcggatctcacgttggtctttgacaccaggggctccacacctacgcgtgcaggtatcggcaggggcaanagggcttttactcattgtccaaccgattgtgacatgtatggggtcttaggattttgcacactgaatgacaacagggttgcgcaacagggggacttattggaagaggaaatggaatttcagaagggcagaatgcctatgataatttaggggttacgccgtttaactaaggaaaaacgcttttaaacggtactccttgggacaagtggaccttagtgccagaacacgagggggttcgtaattggtgccttacgtgcgaggcggaagtatttggcacgaatgtcattggtgtcctggaacggggtcggaacagaaattgggcagacaacagagcccggattccgtgacgcccgctgtaaatacccgcaagtgtcgtggcccatgaggtggtgatcacacctgtgtggccgactttcgacatgcgtgaacgtgtaagttggcaagtggggaattacgagtggcggttaattaacagtgtcaaaagggggatctgttttggagaggaaaaagagcacatttcgtcaatgtgggacacagttataacacttgcttggagctattagacagttgggtagagacccacgggactgtgaaaacgcagatgagtatgacaagtgcgattggtcttcgcatgtagtgggggagaacaatgatgaggggacacagattaatcgttgtggcacattttggtgatacactgtgaagac

SEQ ID NO: 687111 - DNA, 1105 bp, Homo sapiens
  misc_feature (367)..(367): n is a, c, g, or t
gccctttcacgatacgtcgggatctcccgatcccaggtgtgtgacctggtactcgaatgccgtttggcgactcgcgtctctcgagtcttctgctccgtgggcttcttccctgtgccggccggggaccctgatccgtgggcgttcttccccgtgccgtgactctgcgcagtccggcgggcgccgcaagaatgatgcatggcggcgtcgggggcgcgcatggtgcggggagacggggtgctgggcctgagaggcgtgtcggtcggacaaaaggcagtgggacttgggaactagtctgctgtggcacggccatccgtgcccctggacgtatgacaggactcgagagccactagttcgacctgctatctanctagttgaatacctccggtacctatacttttccgtcgcttatccacggccaattgcggcttttcctcactgttgggggcgcgtctgttattgtagcccttgacaccgaagctaggcgagcttgggctacttttgccacgggccctgggacatgttctggtgggggcccttagcgcccctgtgtgtggcccgcaccaaaaagtcgcgccgggagccccggtatgaggcttggaggcctcgctaggcgcacgttcaccaagaatttggcccacgaacgctcgcacgcaagggccaatggtacccggaggaggaacaggtggcggcgtcgttttcacctatagtgcaatgttaactaggaaccttattgcaaggaaccccagtccccgggcgaaaacagattccgtgaacatgaggcctaccgagacgaaccaggaattttccttagccggtttgccggagagtttgtcagaccgaactgggggcccaattggccgggagtaactgtgggaaaaaccatttggcaccggggttgaccgaggattggaggcttggggcctttaggtgccaaggccaaaaggttagttatcttccttaagccaagggcaacggctggcaaaccccagtttggacccccgggttttccccttaaatatgggtcccctttggcccggcgaaagggcacaggccccttgggggaaccaccaaagtgggccattggcgcatttgaaaggcctggccc

SEQ ID NO: 687112 - DNA, 276 bp, Homo sapiens
agcccaggaattcaagaccagcctaggcaacatggcgaaaccctatctctacaaaaactacaaaaattagccaattaggtgtagtgacgcatgcctgtagtcccaactactcgggacactgaagtgggaggattgcttgagcccagggaggtcgaggctacagtgtgccatgactgctccactgcactccagcctgggtgagtccctgtctcataaaaataaaaaataaaaaggtgaagtttatggtaaagtgtatttcaataaagctgttatttt

SEQ ID NO: 687113 - DNA, 435 bp, Homo sapiens
  misc_feature (54)..(54): n is a, c, g, or t
  misc_feature (177)..(177): n is a, c, g, or t
gagcgggtactccaggtgccaggctccgccccgcccctgaacggcgctttccgngatccggcgggtgccggaagtgggcgggcggcggctggctttgctgcggctggacgtgccggttggacgagaccggtagccttgggggacgcccaagccctgtggcaacgtccccggccttcnccgtccccccccccggaaggcaaaggggaaagccccgggctttggccggaacggcggaacgggccaaacggacacaggcccagacgcgggttttcctcggccggtgtcccccctgctggcaacaggtcccggggggcgcgaaaggccctggggggcccctttttggacaaacagggcccgggggggggcgcgcccccccggggacaaacagagcgcccccctttttccccccccctggggccccccccaaaaacttcg

SEQ ID NO: 687114 - DNA, 345 bp, Homo sapiens
gaccagtagcgtgatcagagctatctcccgtactgtgccgcagcctacccagatcacagacgatcaggtggctccatagattccagtggagtgaacaatcttagggcagatagaacctggcggagataccaatgccactgaaggcacgaatatttggtggcaaagaccgagcgggcactattgtaagtggcagtgaggttttgtggaaagatcaactgctagccgggaagacattctgattctcactcagtcctacgcacacaagagcctctgactcctatagtgaatacgttgcttatcgcgtccatgtggatggctaccttgctctttccaccttacaggctg

SEQ ID NO: 687115 - DNA, 106 bp, Homo sapiens
tctcgggcgactgccaaccgccaaacgcagctcggtggggatgtacctattaagctcatgaaccatagaggtatctcggtggcccctcattaccatatgctgttct

SEQ ID NO: 687116 - DNA, 281 bp, Homo sapiens
cacgaggtgaatggtcaaatgttacttcatcacagtatgactggcgtcagccactactaaaagctgatgaggaacctcttaaccttgattggggtgaagatcaagacagtgccttagatgacgaggaagacgatgctgttggtttagcgatgaaaacttcatatgacatggaaaaacgataaacaatcatatcacacggcctcagaccctaacatgttacctaatacctcaggaagaggatgatcctgaaggtgatactgatgttgactgtgcttgctgcc

SEQ ID NO: 687117 - DNA, 827 bp, Homo sapiens
ccctgggaataaatgccaagccctgacagaccacctgctcacggcaggctggcctgcagactttgtgtttgctagaaagagcggactctgtgacgaggcccctcggcctcccaagaaggccatggactactcgtctgtccagcagaggagtgtggaaatggcagtgagtgactgacggatggagtgaatggcgaatggctgggtgccaagcatgatgtgtgtgtatgcatgagatacccctgtggtggcctgcagcgatgggtgatacatgacatgctgtcaggcaaccatgtgtggtccacagacgtcgaggagatcacctggtgacccaggccccatacggggtgcggcaccatggttggtccagctgcacccctgaagaggagctggaacctgctgcattgcttgacagagaatgggtacacaaacctgcctgactgtggtccagcccagacactcacccaccgagaacagcaaaaggccaaaagcccaccctcgaaggctgggagtggtgactaaccagttctcgtggggctggtacaaggccccttggactatagctcgttcacggatgtttgtggatctaggggatctaccagacctgtgaggcatgaggggggacaagctttcacccaatcacagcacctagtgaatgacggagggacaacacgggtcgaccaggcttacgttctgacgagaggaagggtacatgtggacaaagtgaaatccaacaaacccgggcccattgtagacccctgaaccgtaagtacacacggatcaatcggggatgcgtgcagctatgggggtacctcatgttgtccgtaacg

SEQ ID NO: 687118 - DNA, 840 bp, Homo sapiens
agggatgatgttactgtgccgagtcggagaaccgacgggacgagattatctgaattcttggtgaaaggtggatcacctctcccttaggccaactgtcaagccttaacctgatcctcataggcagaatgacttcttttaacttgtcatccctttgtaatatatgtagacatgtccaagtatatagtagtatatggatattcttaacgctactttctagagggcataattgtaaagaagggcgtcatgagctagatgttcacccaagatatactttcagcaacgaaggtctaggactagacgaatgctgatatgagaacgggaagtgtggtatgtacttggtgcgcaccagagaggtctgtgcgcagtcaaatgttaagcaaccgatgtgggatagttcacaaagtctgtccaagcaccgatggtgcttaattggctactacacagttggaaacagcctatcgttgaagatcaccctgcattttatgcttcaaggaacactgtgatggcttgctaggttctaaatatatctatacagtgtggtatctatgggatatcaagttgcccctccgatttacttcagtgaacgccgttaaaagcctttgggggaaggtaccacagtgagcagtaacacgatcttttcacacggttgctggagaaggcggacaatccccgcacagtgtaaacagctcaagtcatttaaggaagatatacaggatgaacacaattataggaataaagagccattataatgcgcagatatgggacaagggccttggacaagaattagatctaagtatggcgacatgatttcaaaggtagggccaacgaggatgaaggtgc

SEQ ID NO: 687119 - DNA, 498 bp, Homo sapiens
  misc_feature (74)..(74): n is a, c, g, or t
tccccccactgggttcgagttcagtgaggcacagtgtcggactatggtttatttagttggagtcggggggaggncaggggtattttcagataatggattttatcccttagagcaaaatctattagtctctctcagtttatcaatttaaatggctttaggcttatagggggtgtaaactttaagaatataattctcccattcaagtttacagcaaacatctagccaccttcaaaacaaagaagatacagaccatcatttagcaatactaatacatgattttccttggggatggcaggtttgagaatcctttagcaacaggacatacttcccctaaattacagtgaattatttataacgagataaagctttcaggtacaagctgaaggtggggtgtctaacaactaaaaactatcactaaatctcaaagagaaagttcttgcaaaatatgtaaagttcacaaggcgcagacattttccttctttaggcttttatctaagg

SEQ ID NO: 687120 - DNA, 199 bp, Homo sapiens
taatttaattgccacagaacctctaatccctgtaattaactgttagtcaaagaggacagctctttggacactaggaaaaaaccttgtagagagagtaaaaaattaacacccatagtaggcctaaaagcagtcaccaattatgacagcgttcaagctcaacacccactacctaaaaaatcccaaacatataaccgaactc

SEQ ID NO: 687121 - DNA, 248 bp, Homo sapiens
agagatctcaacacgactcacacgatcacagtctgtgttcacacataattgtagtaaatgatgcaacggcagtagatatagccactccagaaggtaccagaccgaagttagggtaaatagtaaatacaatacctctggtaagttaatcatcagttaataaaggtcatatatctatcttctgctggtgacaacttgttgtctcagtatagtctgtctcaagaaagaactggttcagattgcggtgtttg

SEQ ID NO: 687122 - DNA, 931 bp, Homo sapiens
tgtcctattttggcgtaagaaataatggaaactcagagaaatggaatgctcttgcctctagtgtgtcaaccaggagaccatgaactttctaactcatgcatgggatggactggtcatagtccccgtcctactgtccatatgtcaatgtaagcttggctaaggttttatttctgtctatagtacaaatcaggagcactaatgtgctcaatgaatgtaatgcagactagaagaggtgtttaggcgagagactattctctccatcctcattcacaataatgttacaatagttgtgtgtatggtaacgttactatatgtaaaatcatgaaagtggtaagttctagtagatcagacaaatgtgtttccattgatagggcatgccttggctcatggaggctgtcttcgtatcaggctgttaatgaagagacatcatgactacgatgaaaactagagtacatgatatgaatgtgggcataattactgaggagaatgaatactgtggacaggaatttaaggtataaaaatacagttttttggaatgttaggattataggttagatgtctagtattcattttgtagggatgcaaaggtgtgatcaaggttgcaagtctaaagttccttggaggcaaggttctgggacagctaaactgtttgaatcatggcatattggatcatgctaatacttactttaggtaccccacagaacggaggtaaggggcgggggggatgccatgaggatggcacacggaccccggtaccgtcaaacgggtggacgaaccaacgaaaaaagggtgacccacaccgaaaaaggaacacaacagaacaaaggccgaagggctaaaaatcacaaaaaaaaaaggcaacacgcgacaacagaaaagagcgaaagaaggacaaggagaaaccagagaaacgcggacaccctacaacgtg

SEQ ID NO: 687123 - DNA, 908 bp, Homo sapiens
  misc_feature (885)..(885): n is a, c, g, or t
  misc_feature (887)..(887): n is a, c, g, or t
  misc_feature (889)..(889): n is a, c, g, or t
  misc_feature (893)..(894): n is a, c, g, or t
gctcttgcgctgtcctgttaatggcgggcagtagccgctgaggggatgcagataaccgcttcccgcacggggaaagtctaccctgcctgccactttctgctcgccgtcagcgccggagctcgccagcatgtctgtggtaccgcccaatcgctcgcagaccggttggccccggggggtcactcagttcggcaacaagtacatccagcagacgaagcccctcaccctggagcgcaccatcaacctgtaccctcttaccaattatacttttggtacaaaagagcccctctacgagaaggacagctctgttgcagccagatttcagcgcatgagggaagaatttgataaaattggaatgaggaggactgtagaaggggttctgattgtacatgagcaccggctaccccatgtgttactgctgcagctgggaacaactttcttcaaactacctggtggtgaacttaacccaggagaagatgaagttgaaggactaaaacgcttaatgacagagatactgggtcgtcaggatggagttttgcaagactgggtcattgacgattgcattggtaactggtggagaccaaattttgaacctcctcagtatccatatattcctgcacatattacaaagcctaaggaacataagaagttgtttctggttcagcttcaagaaaaagccttgtttgcagtccctaaaaattacaagctggtagctgcaccattgtttgaattgtatgacaatgcaccaggatatggacccatcatttctagtctccctcagctgttgagcaggttcaattttatttacaactgaattcctgcgcagtggagaagtaaaagaagccgcttgtctctgtgagcacagctatatacagtgtagaataaatntngntagnnaagttaaaaaaaaa

SEQ ID NO: 687124 - DNA, 384 bp, Homo sapiens
  misc_feature (12)..(13): n is a, c, g, or t
  misc_feature (361)..(361): n is a, c, g, or t
  misc_feature (363)..(363): n is a, c, g, or t
  misc_feature (365)..(365): n is a, c, g, or t
  misc_feature (369)..(370): n is a, c, g, or t
gatcaaaaaganntggaggagttggagtaagattaatggctcccatattgtttgtgattttatagtaattgtttttctttgtgttgtctgcacatattacaaagcctaaggaacataagaagttgtttctggttcagcttcaagaaaaagccttgtttgcagtccctaaaaattacaagctggtagctgcaccattgtttgaattgtatgacaatgcaccaggatatggacccatcatttctagtctccctcagctgttgagcaggttcaattttatttacaactgaattcctgcgcagtggagaagtaaaagaagccgcttgtctctgtgagcacagctatatacagtgtagaataaatntngntagnnaagttaaaaaaaaa

SEQ ID NO: 687125 - DNA, 320 bp, Homo sapiens
  misc_feature (16)..(16): n is a, c, g, or t
  misc_feature (37)..(37): n is a, c, g, or t
  misc_feature (95)..(95): n is a, c, g, or t
  misc_feature (300)..(300): n is a, c, g, or t
gtaactcataccgttnttgctcggtaatcaccgtcantaatacggaacggccttcaccggtatagccaccacgtgcatcattaataatggtcacnccacggcgcattttatcataaatgccttgcaccatttcatctggtttggtcgtaatgatcatgacctgcatttgctgctgacgggtataaaaggcatcaatcatgcgtgaactgacaatcacaccaacaattgagtacagggcgtatttccaaccgtaagtcaaacccgccccaatcataatcagtgcgttaaagccaggattgnccggtcctatcttaagccaa

SEQ ID NO: 687126 - DNA, 262 bp, Homo sapiens
tcgatctcatagcaggatccccccggtaaatgtgatactgtgagcgcagaggcatctacagtctcatgagactgtgtgggactgagagtgccttcagttcctgcaacacggaaggaaagacacatgtcagtcaaagcctcgtgttgtgttgaaccgtgaagagactagatgaaggatcacaacaattcaactcccatacttctgtccatacagcgtggtagaggtattctgaagaccttatcccgtgaaactgtccaccaga

SEQ ID NO: 687127 - DNA, 394 bp, Homo sapiens
aaggggagaaatggggcttattcagatggtcctccctaaatggacagatgagtccagagttcctactgctaaaagtagttactctgcctccccttaaaaaggaatggcgatggccgggcccggtggctcccatccgtaatcccagccctttgggaggccaaggcgggcggatcccgaggtcaggagatttagcccatcctggttaacatggtgaaaccccctctttcctaaaaatactaaaaagtacccgggcatggtggcgggcccctgtagtcccagctactcgggaggcttaggcgggagaatggcgtgaacctgggaggtggaacttccagtgagctgagatcgcgcccctgcactccagcctgggggacaaagcgagattccgtttcca

SEQ ID NO: 687128 - DNA, 716 bp, Homo sapiens
  misc_feature (693)..(693): n is a, c, g, or t
  misc_feature (695)..(695): n is a, c, g, or t
  misc_feature (697)..(697): n is a, c, g, or t
  misc_feature (701)..(702): n is a, c, g, or t
gctgaagcctgcaagcattagtgtgtcgctcccattcaccgactttccgaggtaccctcttaccaattatacttttggtacaaaagagcccctctacgagaaggacagctctgttgcagccagatttcagcgcatgagggaagaatttgataaaattggaatgaggaggactgtagaaggggttctgattgtacatgagcaccggctaccccatgtgttactgctgcagctgggaacaactttcttcaaactacctggtggtgaacttaacccaggagaagatgaagttgaaggactaaaacgcttaatgacagagatactgggtcgtcaggatggagttttgcaagactgggtcattgacgattgcattggtaactggtggagaccaaattttgaacctcctcagtatccatatattcctgcacatattacaaagcctaaggaacataagaagttgtttctggttcagcttcaagaaaaagccttgtttgcagtccctaaaaattacaagctggtagctgcaccattgtttgaattgtatgacaatgcaccaggatatggacccatcatttctagtctccctcagctgttgagcaggttcaattttatttacaactgaattcctgcgcagtggagaagtaaaagaagccgcttgtctctgtgagcacagctatatacagtgtagaataaatntngntagnnaagttaaaaaaaaa

SEQ ID NO: 687129 - DNA, 192 bp, Homo sapiens
aagtcgagctctgtacccccctcggcactgggagatcgcgggcgtcccgtgccgtggactggacgtacttccccgacgccgaccccgcctttcctgccgacgtgactgcccggatctgccagctggcagggaccgacggcatcctgggcaactgccacgcatcggggacgcaggtcatcgacgacttcggcg

SEQ ID NO: 687130 - DNA, 1175 bp, Homo sapiens
gctcttgcgctgtcctgttaatggcgggcagtagccgctgaggggatgcagataaccgcttcccgcacggggaaagtctaccctgcctgccactttctgctcgccgtcagcgccggagctcgccagcatgtctgtggtaccgcccaatcgctcgcagaccggttggccccggggggtcactcagttcggcaacaagtacatccagcagacgaagcccctcaccctggagcgcaccatcaacctgtaccctcttaccaattatacttttggtacaaaagagcccctctacgagaaggacagctctgttgcagccagatttcagcgcatgagggaagaatttgataaaattggaatgaggaggactgtagaaggggttctgattgtacatgagcaccggctaccccatgtgttactgctgcagctgggaacaactttcttcaaactacctggtggtgaacttaacccaggagaagatgaagttgaaggactaaaacgcttaatgacagagatactgggtcgtcaggatggagttttgcaagactgggtcattgacgattgcattggtaactggtggagaccaaattttgaacctcctcagtatccatatattcctgcacatattacaaagcctaaggaacataagaagttgtttctggttcagcttcaagaaaaaggtaagttattttgttttcaaaggtagccatctaaaaattctgtagaataatttcaaggatacctctatttgtgttttctcaaagttccttgaacttttgggtttattgtaaaactaaagatgtataccatgcttttagtttcaaatctgtggctaggaaatctaccttgaaagacacaaccaaaatgtattaatgagaattatcttttttcttacactttttattaaatgtaaaattggtaatttatattttagccttgtttgcagtccctaaaaattacaagctggtagctgcaccattgtttgaattgtatgacaatgcaccaggatatggacccatcatttctagtctccctcagctgttgagcacgtacagaaagttgaacattctttgggtcatccatattaactgtcaaatttaacatattctgagccacttgtgaaggtatagttcatgaattatgggctttaacgaaactaagaaagtagatagactcttaga

SEQ ID NO: 687131 - DNA, 562 bp, Homo sapiens
  misc_feature (422)..(422): n is a, c, g, or t
  misc_feature (459)..(459): n is a, c, g, or t
  misc_feature (480)..(480): n is a, c, g, or t
  misc_feature (512)..(516): n is a, c, g, or t
  misc_feature (518)..(518): n is a, c, g, or t
  misc_feature (520)..(521): n is a, c, g, or t
  misc_feature (524)..(524): n is a, c, g, or t
  misc_feature (526)..(526): n is a, c, g, or t
  misc_feature (530)..(531): n is a, c, g, or t
ctgtcttcccagcacaacgaacaaacttcgtaattgagcatcgatcttatcaaactcttttttcaaggactttaggctttgggtattctcatacagctcgttcgtatatgccccacagagcaacctgccaattgtatctctagtgtctttttgctcaaactgctcaaacctaaagatttcatcaacagggctcaactgatcagcgtaaagcaaacgcagaacctgatgcatcgtaatattgcctgaaatctccagagaaacatcaggcattccgagtaatctgaacagcgcttgagaaaaactttcggtcgttaatgagcgacggtacggatatctattccatgcattagccggctgctttaaagatagttcatatgcgccactaaatatatccatcggagagccagccgttttggatatanccctagccaaagtaacaaccataccattaagctcganctctaaatagacacgactgcnaagaagcgcagcagtgctccaatccgtgagannnnnancnntcnanagtnnataaaattaagtatggtagactttccgtatg

SEQ ID NO: 687132 - DNA, 793 bp, Homo sapiens
  misc_feature (770)..(770): n is a, c, g, or t
  misc_feature (772)..(772): n is a, c, g, or t
  misc_feature (774)..(774): n is a, c, g, or t
  misc_feature (778)..(779): n is a, c, g, or t
gctcttgcgctgtcctgttaatggcgggcagtagccgctgaggggatgcagataaccgcttcccgcacggggaaagtctaccctgcctgccactttctgctcgccgtcagcgccggagctcgccagcatgtctgtggtaccgcccaatcgctcgcagaccggttggccccggggggtcactcagttcggcaacaagtacatccagcagacgaagcccctcaccctggagcgcaccatcaacctgtaccctcttaccaattatacttttggtacaaaagagcccctctacgagaaggacagctctgttgcagccagatttccttcaaactacctggtggtgaacttaacccaggagaagatgaagttgaaggactaaaacgcttaatgacagagatactgggtcgtcaggatggagttttgcaagactgggtcattgacgattgcattggtaactggtggagaccaaattttgaacctcctcagtatccatatattcctgcacatattacaaagcctaaggaacataagaagttgtttctggttcagcttcaagaaaaagccttgtttgcagtccctaaaaattacaagctggtagctgcaccattgtttgaattgtatgacaatgcaccaggatatggacccatcatttctagtctccctcagctgttgagcaggttcaattttatttacaactgaattcctgcgcagtggagaagtaaaagaagccgcttgtctctgtgagcacagctatatacagtgtagaataaatntngntagnnaagttaaaaaaaaa

SEQ ID NO: 687133 - DNA, 883 bp, Homo sapiens
  misc_feature (655)..(655): n is a, c, g, or t
gggaatgaagtacgaggtgggtgtggttggtggtgatgatgactatcttagtgctggataatggagcttacaacgacaaaatcggtgacagccatgacatatgtgtcgggtattcctaatgtcagttcccggtcacaaagagcacgtcttaaaacttttagctggcaagccagatagatgaaataccagagacccttctggactcttttacatcctcccttttcaaaagggctacttggtgaatcgggatgttcagagacccagttgggattacctttctggcacccggacctgtatcaggtgatgtcttagatacgtaagtattattatcagcgtgaaccatagtttaagcttgcgacttcaattacaagaatctaatgaattgaaagttctattggaagaatacctagtttccgggcagtattaagagtaaaatgcgtggggctctccagggcacataggtatgtccgagataatccttccgaattatgctgtatcatgtagataggggatattcctttagggacatatagtaccttatggtagcaggtcaacacgacagaaggaagcaatattcggataaacgtggggaggaaaagcacttaagcaatcatctgaaggagaccatatctgcacagggcgctactgtttggtngcacccgccttgtgatttccccagtgacgcacagctggcacgggttcccacgatcccccagacggcttggcaagcgcaagggagagacaacgcatgttcacgtgggcgccgactccgaccacaaagggccggacccggcacagggtccggcaacacctcggcacaccgggcgcgcaagggggcgaaacccacccagacgaacaggaccaaggcgacaccagagcatca

SEQ ID NO: 687134 - DNA, 974 bp, Homo sapiens
  misc_feature (963)..(963): n is a, c, g, or t
  misc_feature (968)..(968): n is a, c, g, or t
gctcttgcgctgtcctgttaatggcgggcagtagccgctgaggggatgcagataaccgcttcccgcacggggaaagtctaccctgcctgccactttctgctcgccgtcagcgccggagctcgccagcatgtctgtggtaccgcccaatcgctcgcagaccggttggccccggggggtcactcagttcggcaacaagtacatccagcagacgaagcccctcaccctggagcgcaccatcaacctgtaccctcttaccaattatacttttggtacaaaagagcccctctacgagaaggacagctctgttgcagccagatttcagcgcatgagggaagaatttgataaaattggaatgaggaggactgtagaaggggttctgattgtacatgagcaccggctaccccatgtgttactgctgcagctgggaacaactttcttcaaactacctggtggtgaacttaacccaggagaagatgaagttgaaggactaaaacgcttaatgacagagatactgggtcgtcaggatggagttttgcaagactgggtcattgacgattgcattggtaactggtggagaccaaattttgaacctcctcagtatccatatattcaaatacaaggccgggcgaggtggctcatgcctgtaatcccagcacttcaggaggccgaggcgggtggatcacctgttgaggtcaggagtttgagaccagcctggccaacatggtgaaagctcgtctctactaaaaaatgtaaaaatcagctgggtttgatggtacaagcctgtaatcccagctactccggagctgaggcaggagaattgcttgaacctgggaggcagaagttgcagtgaaccgagattgtgccattgcactccagccctggacaacagtggagactccttctcaaaaaataaataaataaataggaacaaatacaaaagaaggagagaatgggtaaaagtgnatganttgccg

SEQ ID NO: 687135 - DNA, 442 bp, Homo sapiens
  misc_feature (162)..(162): n is a, c, g, or t
  misc_feature (186)..(186): n is a, c, g, or t
  misc_feature (246)..(246): n is a, c, g, or t
  misc_feature (313)..(314): n is a, c, g, or t
acttgggcaagagtcttctgagggagtccacatttttaagttggatatatttaaattcgggacccaaatggaaggccgctgagacagcctatgattttagagcagttaaatttagtgaaacactggaaagaatcacaaatagagacaacttttgggaagagntctgcaggaagatttgcccaactnccccgcccacgaaaagttctctgaagggagacaaaaagatgggacgtacacaaatagccnggcggaaagagccacacatctccacatggaaacatgagagttgagaaaatcctccaataagccaacnngccctgagcttcctgggtctctagactcgaggaagggaatttttcaataaaatatttcatacacagagagagtcaaagctgtcacaatttttaatttatccatcacaaaattcaacacgaaaaaaagg

SEQ ID NO: 687136 - DNA, 551 bp, Homo sapiens
  misc_feature (298)..(298): n is a, c, g, or t
  misc_feature (320)..(320): n is a, c, g, or t
  misc_feature (335)..(335): n is a, c, g, or t
  misc_feature (337)..(337): n is a, c, g, or t
  misc_feature (339)..(339): n is a, c, g, or t
  misc_feature (350)..(350): n is a, c, g, or t
ggagtttagttataatgaaattgatttgtagtctgttttgccgtaaacttgtttgtctttaaattgttcttacagtgatatcttactatttttaactgtctggggtttctgatatggggatttcagcccctggttaatcagtcttgtccctacaagtccctgatgcagtatgtttatttgtgatgtttaaagaacatttcttggctgggcgctgcggcttgcgcctgtaatctcagcactttgggaggctgaggtgggtggatcacctgaggttgggagttcgagaccagcctgacanaaacatagctggaataccccgntactcctaacttaanananacttaccaaanacaaactctaagctgggggcgtggtcggtgggttgtccctgtaatcccaagctattcgcggaggctgaggcaggagaatcgcttgaacccgggaggtggaggttgcagtgagctgagatcctgccactgcacttccaaggtccatggggggttgacagagcaagactccatctcaaaaaataaattacaattacggaaaaa

SEQ ID NO: 687137 - DNA, 275 bp, Homo sapiens
gtccacccacctcgtcctcccaaggtgctgtgattacgggcgtgagtcactgcgcccggcgactgtctcattctgtctggcccgctgacatgtaagacatgcctttcctcctcgttcaccttctgccgtgatcgtgaggcctccccagccacatggaactgtgagtccaggaaccctcttttgtttataaattacccagtcttgggtatatgtttatcagcagtgtgacaatggactaatacagggggacagacagacagaggcaggacaagcag

SEQ ID NO: 687138 - DNA, 842 bp, Homo sapiens
  misc_feature (169)..(169): n is a, c, g, or t
  misc_feature (176)..(176): n is a, c, g, or t
tcaccttccgttcctgtggaaaaaactcccccggaagtgttttgaagaaacacttttgcccacaagtggttccccagggccttttgtggcctaactccgtctgtcaactcggatggctgcaaaaaaccttgggcaggcacacccatgggcagtaaacacttgttctggncccacgnccacgcatttctccaagtaagcgaacacaaagtgtaagtgcacacccggcaccaccactggggcagacagaggagggctgacccccccttatgagtgggagaacaaattgaagagggggtacaccgactcgtgccacgaagccacagacacattatggagccatcattacctccacttctgggaaaatatcttagaaggagtatgaccacaaaactctacgggggaccatttgtttctataaccgccggaatccacacaggtgcgcaaacacattatataggttgccgtagataattgcatgcacaccttgagaaactataaggtggactctattaaacaaagcacactaatggcccaccgggaccatttttaatagactcggaatatgggtgttccttgcagtagggtaacaacacgattgaactagtaacacttacagggcgcgctgcaatactgaaggagagcgcttttttaacccccttgtaaaacaaggtgcagcaaagcgaaacgacagctggggtaacccacatagccctggagaacacgcttttggttggtcctcctacaagaggaaggggcgcacttcatcatccacagaattcatgctggtgggccccgcataaattcgttacaatcaaaaaaaaccagatcttctggaggacgaa

SEQ ID NO: 687139 - DNA, 315 bp, Homo sapiens
cagggggaaaccgtgtctctactagaaatacaaaaatcagccaggagtggtggcacaggcctgtaatctgagctactcaggaggctgaggaacgaacattgctcgaacctggaagccagaggctgccgtgagccaagatagtgccactctgctccagcctgagtgacagagtgagactgtctcaaaaaaaaaaaaaaaaaacccctcccaaaaagaagccctaaaggtacccgtaatgcagcaagcaataagtaaggtttggtatgtgtgtggaatataatgccgccagacagagctcttggggaggagactgcc

SEQ ID NO: 687140 - DNA, 167 bp, Homo sapiens
aattacgagatctacatctagcttagccatgagtcattaccatcccatgctgtgccactgtggtggccttgacatagccctcagcgatagtaaagtgcatggtgggcacgacgccactcaagccaagtcccaggaacacgcctgctcttgtctgccggtgaaattct

SEQ ID NO: 687141 - DNA, 1231 bp, Homo sapiens
cgcagaccagacttcgctcgatactcggtgcgccatcgcttcgcattttcctccgcaaccatgtctgacaaacccgatatggctgagatcgagaacattcgcatcacagtcgcacacactgcacgcacagcacagcagcacgccagcagcaaaaaatccactgccttcccaacgcacaacgatggcacccaggcagaagcaagccaggcgcactcgtcactgcaggcgatgcggcctgacacacctatgcagctgataacagtttcacagcaacgccactaggcccatatcatttacttattagcattacgtattatagacctggttttaaaccatatagctaacagacatgccccaacgcagggttgtgggactcacacgtttatacccgtgcaactggtggctggccccccctgattccaccagtcaaacgaaaccatcacttgcaccaacgcgcacagggaccgacgtcacctggaccatatgatccacaatcgtggtcctactcctactctgggctgggccaggggacccggaaacgcaaccacttgagcactggctacggcgttgcacccggaccgcacacgtggagagttgggcccacgacccaagggcggaacgggcgaccggacaaggatgaccacagtcctacaggacttacaacacccaaaccgctgggaaccccacaggggtggtcccctggcaagggcaggtacaagtggcaccgacaaacactacacggacgttgccaccgtcataagcaagcagcacgggacacacacatttgacatactgaccagacgactagcggcaccgtgtgcacaacaaaaacaactaaagaaacaggcccacaacacacaacacacctgcaacacagacacacacaaaaacacaaaagcacaacaacaacaaaacaagacaagaacaacccacacgacacacacgcgaagcaaccaaccgaaaagccacacgagcaaccccactagaaagagcaagagcagagaaccagcgaagaagcacagggacagctagaggaagaagcgcggtcaccaaagaagacacaagaaacacaaaaaacagagagagactagaacaaccacacaaccaaacgaccagcacagacaacaaacgacactcggcaacaaccggacgagagcagagatagcaaaccagacaagaaataaaagagtcgacaagagagccatgcacaccaatcacaccacagagataa

SEQ ID NO: 687142 - DNA, 509 bp, Homo sapiens
  misc_feature (23)..(23): n is a, c, g, or t
  misc_feature (93)..(93): n is a, c, g, or t
  misc_feature (99)..(99): n is a, c, g, or t
cctagaggatccgtatagagcantacctcacaagcttcttagtcatccttaggtgtctttgacatgcatccctgctttacatgctctagtgtnccttcncagggcttttgtcggccccacgtgggcagccagaatgttggggtgatcagatccaacaccaggccttggggcaacgaagtctggcagagtcaaaggaaagagaaaagacagtttgagagagaaagtgggtccaggtggccaacgcaagtatggaggctgtgaaggccctgagctctggaagcccagactatttattggtggtcaaacaaagaaacaggtggtgagaatgtgtgggtcaaaagggcaagcacatgatctacagctgtgatagtttagcatttcctttgaagcatatggaacatattctgctacttgagataatagggagcatgttcttccagtttaagctagaagcaaggagccagcaagtctagactcattccagaggccacgaggggtatggctctgat

SEQ ID NO: 687143 - DNA, 226 bp, Homo sapiens
  misc_feature (73)..(74): n is a, c, g, or t
gctcttttgtcacattcggcttgctcctgctgccccacacacactaagcccaagccatacttccgggtggacnnccttcccagcccaactgttgtattttcagttcttccagtgtgaatcagttaatattctcgggaacgagggagaggttgatcctattagggaatcaaccacagtgaaaaggctttggccgctttttgttttcgcgctcctctttgttgaacac

SEQ ID NO: 687144 - DNA, 752 bp, Homo sapiens
gggaacgcgcaggctagccgttggcaggcgcaggtccgggagctcatggcggtggaaggatggaatgacatgtgtgaagttctgcgtctacgtgcgtcgctgtcgtggccttttgcggccgtgtgcacgctgtggactgattcgccgtgggtgtcgggggacagcttgttcctgagtctgaccatattccagggggcatacccgctggctctctgctgtgccatgtggatcatcaatcgcacgctgggtgtctctccgtcgttcctggtggctttttgtgggctgctgcggggtcatgccaggatgaacctagttgtcttactgatcaacggtttgccgactctttctgtctcttattcatgttgggggacggtggccgccggccatgtgtctggctatgctgttctacgagactacaggtgatgtccaggaagtttacataacaagacttcacggcagcagactggaagaacttacccgaacaaatcaatccatcagcatgcttcgcatcctggagcaggagtgcatggcacgattgttaacgtgcgtgtgcgggcatgctagactacgacgagattggagaggaaacatcgcctgtccagtgtcgcatagcagccgagctccctcgacgtcgctgctggcattgaactgtttactggtgcggcatgtcgaggatgtacttgtcatacgcagcaaagggcgatgccgataatggacgggctcgtgttgcgcgacagatccgggcggctgag

SEQ ID NO: 687145 - DNA, 130 bp, Homo sapiens
  misc_feature (82)..(82): n is a, c, g, or t
tgagcccatcttggatatgaaggaatgtccccagcaaggtacatatattgcatacatcctctgacggcaaaaagagtatgtnataaagatcccattttttcccttgtgtgtgggtctagcctaacgtacc

SEQ ID NO: 687146 - DNA, 457 bp, Homo sapiens
accctggctgttcaagctgacacgtcggttgtgacgtacgaacagactgcgtcccagatgagtttccaggcttttgacttgatggctgattgcagaaggagtcaggtgcagctcatcggctgccaggctgaaactctccagccgggcggccgattcaaaggctcgtagccaggcgaaattagggatggctcgcatgagggtgccttaaacaggtgaatatttttaatcaatagctgaaaaagcttcgtttgtcattcatggttttcgacctctaccatggttttacgtttcacccgtacgctgcgctggatgggctggcgtgcgggcaacgcaacatcttgccgaacccgaaggagaccttcccatgaacgctaaacccgatatcaatgaaattttggccatgacgggccgaaagtcgatttatcagcccgaacagcaaggcctgatctgtcgacgc

SEQ ID NO: 687147 - DNA, 326 bp, Homo sapiens
gtattaccagttgtaaaaagtatagtaactataccttttgaaagactttcctccccatctaattaggactaaatagaaccatctcttagaagcaccatctatcgatagtcccttgcccacattcttaagtatctgctagccattatgaggaaatcagtgtactttatgttcttagctcccacaatttagcctaaatatttgccctggcatgcttataccggtccaagcaagcattagctcatagcgtattcctcttccttatttaaaagtgttcttacctttctcagcattccataagttacttcctttgttctcctctatctttg

SEQ ID NO: 687148 - DNA, 390 bp, Homo sapiens
  misc_feature (96)..(96): n is a, c, g, or t
tcgcgccaggcctgtggcagacggacgctcatgatccaggataaaaattgtcgcgacggcagggggctggcaggggagtgcgctcccaggcacatncgcttaaagtgtgttaatgacttgtcagcaagtttctttaccttcccacacccctcttctcaacgtccccccagagtcctcaggggggccttcgacctgcaaaagcctcatatgagtgcgaggggccccagctcccagggcggccgatggagcctcacacggtcaccttctccatcacgctttcagccacgtggacttcgtctgcctggacggtgacagctgctgactggccgcatatgtgctggtgatctacccagtccttgcgttggcagaaggtggagcagtagttgaccc

SEQ ID NO: 687149 - DNA, 133 bp, Homo sapiens
  misc_feature (2)..(2): n is a, c, g, or t
anttcatggcagctataccacagactcagaacactcacactcgaccacactgcccaggactactccaccctcacctccgtctcctcccacgatctcgccgactgctggtgtgccgacagcccacccgcctgtt

SEQ ID NO: 687150 - DNA, 817 bp, Homo sapiens
ggcagtcgccggtacatcggggatatctggctctttcctcttcgccttaaattcgggtgtcttgtatgaataagtcaaagagcagcaaaagccaacgctatcaggccagcgttttaaaactagaaaaagagatgaaaaagagaggtttgaccgcttactcagtttcaagactgtatttgattgcaagggcttaatctgaaaccggatactgattgggaagcagtgaggctaagttgtctgtgatgcttcgtggagcaaaaacctttgatttagccgtgcgatatgcgagaaacgactcttgtgacattctggtggctggtggaatgctggcccgaggtggtacacgtggccagatgacagtgatgcgtacagagtgtctgcgtgtttgcagcgccaaggaagatctagagagcatgcaagcattttgctcaggttttggaacaagtaaatcaggggctacaaatagctggagaaaggtttgaagagtgaagtagaaaagctgtgatgttcctgagaggttttcagagtcggagaggaacaagctagcgatgtgactggtgttcttctgggctaatgaacactttaatgcatccattcttaataggctgttataatgaaaattgtgtttaaaagaaaggaggttcaggagcgtttgtgggaagctcttgaaatcactggtgactggaaacgattcaaggaagtaacggaaagtttcggaaaatcgcatggtgagagaggtgggaactctctggcaaatagaagggggcacgtaaaaatattctgggcggtgaagagtaaaatgtggaagaccaggcga

SEQ ID NO: 687151 - DNA, 389 bp, Homo sapiens
  misc_feature (35)..(35): n is a, c, g, or t
  misc_feature (40)..(40): n is a, c, g, or t
  misc_feature (120)..(120): n is a, c, g, or t
  misc_feature (370)..(370): n is a, c, g, or t
tttaagtttaactccatcctatttaaaaaagtgangttanaaaccagatgagtttttaaggtcccatctcaacctctaaatgagatactagcaaaaacaaggaatccaccacttccaganccttatgaaacccaggaaaaggtggggcacagtggctcacctgagggcaacagttggagaccagcctgaccaacacagtgaaaccccatctctactaaaaataacaaaaattagctgggtgtggtggcggacacctgtaatcccagctatttgggaggctgaggcaggagaattacttgaacggggtgtgggggtggggggtggaggttgcagtgagctgagattgcaccattgcactctagcctgggcnacagagcgagactgtctca

SEQ ID NO: 687152 - DNA, 335 bp, Homo sapiens
agaatgtgtcagagtcaagagaatcaaatttgctctttaaaggagcagggtcaaagtcttcccggttggaatcaagaatcagaatagctcctcttgcagaactgccttcgtcccccaaagcagagatcaaagggctgatcatctggcctgacggcagcttgtagggccactctcaatgggcttgaaatgcctcctcagcatagcgataagtgacgaatccgtagttgtccccttggacacggaagtgggtggtgcactcctcaatctctccagaacaggagaaccactgttacagctctgaatcgagtcatgcggacaggtatctttccaatgaa

SEQ ID NO: 687153 - DNA, 157 bp, Homo sapiens
cccagctccagactgaagtagaggaggcaggacaggaagtccaggaatgctgaggcgcaggccaagaaggccatcacggatgccgccatgatggcagaggagcttaagacggagcaggacaacagccgccacctggagccaatgaaggagaacatgg

SEQ ID NO: 687154 - DNA, 154 bp, Homo sapiens
taagatacaaaccataaacccttctgtttgtttaacagagggaggtcaatctttttcatgaaaccacatgtggccttccagaaagtcaaaggttctgcaggaactagattttacagacaaagaaaagaagttgaagaagaaagaaaacatcatt

SEQ ID NO: 687155 - DNA, 210 bp, Homo sapiens
  misc_feature (130)..(130): n is a, c, g, or t
  misc_feature (155)..(155): n is a, c, g, or t
  misc_feature (159)..(159): n is a, c, g, or t
  misc_feature (162)..(162): n is a, c, g, or t
  misc_feature (189)..(189): n is a, c, g, or t
agctactcaaaagccaagaactgccctcaccccaggctgagaagagcctccccaagctgcgtctggagatcatcgacaaggacagcaagactcgcagactggacatccgggaccactgacccttgagaangtgtgaacaccatctagagccaccntccntgncctatgtcccttcatatccaataaagncccattggctgtggcatggca

SEQ ID NO: 687156 - DNA, 158 bp, Homo sapiens
tttgaaaaggccctttttttttcccccccttttaaaagaacccatggtcccgttagcttttaaagggaaagggggctaattagtaaaaaatttaaggccaattttttctgctggcctgccaagtttttagggttttaaaaataaaaatttttgaaata

SEQ ID NO: 687157 - DNA, 216 bp, Homo sapiens
taatcacagcagcactgatgaaagcctccaggagtgataaggccactgtctagcaaggggtaataaagcctgtctcatctggtttagtctatcatcactttcttcctacttcctacttacttctgaggattcttcatacagataggttccagattccccccaaggggtccgaatcaatctacttcttacctcagtacttggtactgaaattcacga

SEQ ID NO: 687158 - DNA, 584 bp, Homo sapiens
ctagttctagtcgcgacggccgcccttttttttattttgtggccttacaaatgatcaatttccaaatggacttttctgtaaaaatgtgtatacccaaaaatcggccaagtatgttctcggtcatcgcctatctctttaaaaaggattcatgataggtattattagcacaaatcttcgggattgtccaccttgatgtagcagtatgtgatactttgttttaccgaccagctcctatgctacgcaacgtaatctgtatgcagttgcattcattgttagcacttataagattaacattatgctacttaccaaacagcaaacgcccgggtttgattacacacatacagtatgggacgagacctctgaagtcgaagtcagcgcacaccctggtatcacgcgcgtcagcgtatgtctcatatatcgctctttgctcaatttgcctgtccacactcactctcgaaaattagttacaccaccgcacatgtatcacccgaactaccaatccactgcatcaatatgcaacgacaccccgtacacacaccataccatgaaatatgactaccaaccgctcatagtgccagctccac

SEQ ID NO: 687159 - DNA, 239 bp, Homo sapiens
  misc_feature (143)..(143): n is a, c, g, or t
cgctcagagctaccacgctcacatctgaggccctgggaggccttgatgagagtcccacagacgctacttaacgggggactgcgaggccgtctctgagtccccagggcctaagggtaaccacgcacacacttagggctcagggntctcgagggcaacccctgcagcctccgatgccgtgtcttgtgtcgtctcgaccatgggctgccagaaggtgctgcctagtggtgcacgaacgtagc

SEQ ID NO: 687160 - DNA, 366 bp, Homo sapiens
  misc_feature (299)..(299): n is a, c, g, or t
tgatggcgctgatgacacccgaagccgccgccaagaaatggatcaaggacaacccaggcaagctggatgcctggctggccggcgtgaccaccgtggatggcaaacctggcctggaggcggccaaggccaagctcacgcaataacgaaccacgcaatagcgctacctcggggcaggaccgtgcctgccccgggttgatttcaatctatgcaggtggaagctcgctatcatgcttatcgatcaaaaaatacccctgggccagtacatcgcgtcgttcgtcgagtggctgacccagaacggngcgaattacttcgacgccatcgcgcaaggcctggagttcatgatccatggtgtcatcagcgccatca

SEQ ID NO: 687161 - DNA, 1210 bp, Homo sapiens
gcaacttgttggcaatgccacgggcaaagtgggtgtttcagcacatgctatagtgagctccggcttcgctgtctatataaccagactccactaatgtgtcactgggtagacggagctggactctatatttagccaggaagcctttgcctccttttcaggcagtcaaaaactgggtctaggtcaattgctctttgtctgttgatggagcgagcagttgtgaggtctggactctcgttcgaggtattgtgcctgtgagcttgggcgttgcgagtcgtggcttcagaatcaagtgttgggaaacccccgcacccctcagcccgatcgtgaaacggacagctgtcagcctgggtgggcgggctgctgaggatggtgtcagcacggaatggggctgtggccctgaggtttatactttaccgagccaatgtgaccctggtaacatgccaagtaaacactgccatgatcctggggctaagagctgcctttagggacaggctcgtgtagatccagtatgaccctgagagatgcacctgaccaggggcccgtcagatggctgaaaaccacggtggtatgtaagtgtttccaggcagttgtcagcagctgccgggtagtgtgtagtgtgcgacagcaggagagttcctggaggacaagggactggggaccacatctccaacggttctcctgcttgaatcaacgtgatgcgtggaccagacaggcacagacaaggcaagggtcaggctggataaagtaggggaaacgggacggagcccactcgtccttcacaggactgtggacccaaaactaaggcgcaacacattaccctaccacaggtcacaggagaaagaacgacatgcaccacaagagcctgaacggcctggacaccactgggtgcactggaatggcgcctcatagacggagtggcccagcagtagtaccgccaggtgaactaacacgcagaaaccaagcggtggccccgtcaaagaggacccgtcaccggagaaccacaagcgttcaaattgtggaccaggacaagggggtccaacacaacgcgaagaaacacacataagaggaggacaagcacgaaacatatcaatgacgaccacgaccacaaattaggcaatcgaggcacatgacatcatacataacgtacaacgcactagagcagatacgataaacatagcaccactcgtgaccgccacccgtctgtctataa

SEQ ID NO: 687162 - DNA, 138 bp, Homo sapiens
agaggaccccctcccattatgagaaactgactaaaatttgccctcccatcccgttagagttatttaggctctgtaacagattgggggataaaaagatgttcagatcatttttcgtttctacctcccacgaacggatct

SEQ ID NO: 687163 - DNA, 1521 bp, Homo sapiens
  misc_feature (360)..(360): n is a, c, g, or t
  misc_feature (1393)..(1393): n is a, c, g, or t
atcgagccaaggcactccagcatgggcgacagagcaagacttcatctcaaaaaaaaaaaaaaatgtagctgggcttggtggcatgaccctgttttcccagctacttgggctgaagcaggaaaatcgcttaaatccgggaggcaagacggttggttagtagacgccggaagattcgcgcgccattttcccagccttggcgcaaccaaggaggggaaacttccgggtcttcaaagacaaaaacaacaacacaatacgagacagcgcacacacgagacacccctatacgcttttcacaccgccaagggcattttgttgctacaagttaaaaaccaccttcggtgtgtatacacatcagcggcnacacatcggggcgctgtggcatcgtcacacaatcatacgaactccacgcccccataacacacaggggggaggctccaccgggcgaaccaagtctctcgtgtgcacccacgggggaaaaactcgcgcggaatcacccggggtgttcaccccaaaagaacctttgtttggccccccacaacaaacaccgcgaggcagaaaataaagagaccccccccttgtttattctcgaaccaccgctatataaccccccccaaataaagaggggtgcaccagtcatcggcgaccaacaagcagctgtgtgtcttcgacaacaacgacaattgggtggcgccccttctgtagaacgacgaagatgatcatcccaccattgtgttggcgacaaacacactacgtcccgttgaccttctactaaacacgcgcacatacaactcacacagcgtgggggaggcacaactccaccccaccagccgctttaattacaaccacgacggggggcgtcacaacccacacgtgttgtgcataccacgacagcccacacaataatttcgtcacccctcgcagcagacactctggcggaccaacaacaacaccatactctcagtgcccgctggacgtatctcggcggcaaaacaaaaaacaacacaccacttgtgatagacgcgccctcatcgaacgcaaacgaaaattcgtagtgccgcgaagcatctaaatataacagagcacccacccaactcttatctggacagcacacagacaggcagttactgactcgaggaagcagtaataatctacacgcgcccccccgcactatctattaaccaggggtgtttgagacgacaaacatcagtcgtcgccacatcggcaacagcttgtcgcacacacccccacctatctgaggaggatgaccgacccccaccacaaaaaccacagctgtggtccgacaaaacacatcgctcccacatgttgtgtgggtcgaggagcacaatttatcgctaacgacagaccgacgcagtgtttaacacaatcatgtcgncgagcatctacccaaaaaaaaaatctcccccaaagagatgtatgctgatttcacgccaggaaacaacttgtggctaaaaagtcgggccacacactattgttgtgagacaaccggaaggagtgatactg

SEQ ID NO: 687164 - DNA, 1045 bp, Homo sapiens
  misc_feature (1045)..(1045): n is a, c, g, or t
agcggagcggcggcgtacagagcgagcgctgcgcagtgggccgactcatgggggcccacgctcgagcacgttgggccatatggtgctcttcccagtctggtaccttgatacagctcgtgcgtcatgaaagctgtaaccagccgtcatccaacgccaaatcgcgatcgacccatcgaagaagcccgtgaaagatcgaagttacccagcgtagcggcatcatcgtactcggggtcagatctatcaaagctcaatgagactcgcggcgtcttccgcattggcccctgcgcgacacccgcatcacactcctgggcctccctgtcgggccagtcagacagtcgtacctctcggctctagattgattggaaacctaggtcagtgcggccctataacgacactatcttccacgcgagttaattgatcaagggctttcgtagtgacactttggtacagtcaaaagggtgtttacatttcaacagtgtacaaccgcaatcccgcaaagattaatctccccgcctgagatgcgcgcaaagattggtcctcgaggataacccttgagaacgaaggcaatcggcgagaagtattgagacgaaacaaccagactttgcaaggttatccatgggggtgccaccaagattgaagttcaatagctttagggatcctttacccccaagtgggtgccaaaacatcgtggaacaagctaccggcactaatttacctgaacccttggaacagattatcaaagggtccaaagatcacacgcttaattccaattcacaatgaggtaacctaagggtcgaaataggagatgcgaaagagttagagtagaccattgtcgaagttcctggccaagaggcgaaacgtagagataaacaaaggcgggtccaagatacaataccccacaaagaaaatcggcccataggtccacagtgcattatgaacgtaccccctgacaggccccaactaccaaatatgggacaaaaggtggacaccccacttggaaagttgagaccctaactagcattagggtggtttaacccaatcacan

SEQ ID NO: 687165 - DNA, 143 bp, Homo sapiens
aaaaaaaaaaagcttcaagagagtccccaaggaggaacggagggaaatgaaaatatttctgatctcctaaaatcccttcagaaggcgtgacaaggagagaaacgaaggataactagagaaaaagttgaatcagaaaatctctg

SEQ ID NO: 687166 - DNA, 453 bp, Homo sapiens
  misc_feature (199)..(199): n is a, c, g, or t
gtgatcggctgggagaggccatattaccctgactcctgaagttctggaacagctcttcctgtacccagtgttacccttgttattttgtaaacttacaattcaggattgctcatggatattttttgggggggttgcgggcaggtggatccacattagtgatgattatcttggcataggaggcctgtgggtgtaaacttgnagcaaaaggatcagatacagtgtcttggaggggctgaaataacctatgaattgttgctgatagcctgttcaacctttagtagggacttttcagcctcaggagtcagaaccctaatggaattaggatcagggctacccttcagaattgcaaatagaggttttaaatcaccggtggttagcttaaggtaaggtctaagccaattaatatcacccaaaagtttttgaaaatcatttaaggtatgtagctgcgatcac

SEQ ID NO: 687167 - DNA, 216 bp, Homo sapiens
gtgatcggctgggagaggccatattaccctgactcctgaagttctggaacagctcttcctgtacccagtgttacccttgttattttgtaaacttacaattcaggattgctcatggatattttttgggggggtgggcaacggtatgtgtgtgtgtgtgtgtgtgtgtgtgtgtgtgtgtgtgtgtgtgtgtgtacagtccttatgtcctgcgatcac

SEQ ID NO: 687168 - DNA, 945 bp, Homo sapiens
aagaaatggcagagacggggcccggtgcttatgacgatggaagattgcagtgaagacgcagactagaggaagctggatggcataccacaaagaacggagacagagtgtgtctgtgatgtgcgaggacgatggaaagctgattcgtcttccaaatgtctctgtatgctgactcagatgtgcgaaaatgacagcacatacagactccgagagcagcagctcttccagctcctcatcctcctcctcctaccatcgtcctcatcctcctctgtcctcttcatacctctgagtcctcctactgaagatgaatgatggaatgaggagctggccagcagcccttccctcagcctcccctgcccccagagaaagtcccatgtgcccaacgccatgcaccattgtgtaatgtgtgccatgtgcctgtgaacatgtggtttgcatgtgctaccccagatacagcaacctccatgcactgaagcatgtgattgactatactcacatgacataaggccttgcagtgaccccatctgtgatgtggatgctcagaccccatccatgatgactgcacatacattaatggatatatacaccatatgcataaactactacttgacgttgggtgatccacaagattattattaaaaataaaaacaaaaaagataaatatatattacttgactctccaccaccactcttaccaatcatttactataacaactaactctcacctcacacactccacaactcccatctcgaatactgctcatacccgcctcttatctctgtatcacaactactaacaactataataacattagaagctaaccattcactcacgaccagagacacttataaccacaaagcctgtgtcaaaacactttaactaacgtctctccctccttcatcaacccatcaaaataacatacttccacactacccttactacaccag

SEQ ID NO: 687169 - DNA, 241 bp, Homo sapiens
  misc_feature (130)..(130): n is a, c, g, or t
agctcattggcagaaaacggaactacttgtgtgtgaagtagataggactcgaaaggcaccaggtgtagtcacaatattgaaatttccgaatgagggagagacaggtacctgtggatgtggtcgagatganagaaaccctcatagcctttggctgggaaccaaatggaagtaagtttgctgtgctggacggagaggctccgcggctatctttttttttctaccacggtccaaaacaacggga

SEQ ID NO: 687170 - DNA, 449 bp, Homo sapiens
atggggaattgacctgaggaagatttacactgggtctcgtggtggtgcgggtcaggggaatcaggtgtggggaagatcaactctactctcccgattcacgcgcaagtgagttcatgccacgacagccgcaccaccatcggggttgagttctccacccgcactgtgatgttgggcaccgctgctgtcaaggctcagatctgggacacagctggcctggagcggtaccgagccatcacctcggcgtactatcgtggtgcagtgggggccctcctggtgtttgacctaaccaagcaccagacctatgctgtggtggagcgatggctgaaggagctctatgaccatgctgaagccacgatcgtcgtcatgctcgtgggtaacaaaagtgacctcagccaggcccgggaagtgcccactgaggaggcccgaatgttcgctgaaaacaatggact

SEQ ID NO: 687171 - DNA, 982 bp, Homo sapiens
gtgtggtgtggttcatgcctgtaaacccagcactttggaggccgaggaggaggatcaagcctaggagttcaagtgatccctccacctcagcctcccaaatgctggaattacaggatgagccaaagactggcatatatggtatatttcaatttttctttaaagatacaggaatgaatatgttcaggtatcatgtaaaaatataagaattcagaaacaattgtgatcacttatggctgctaaaaattattggataaaatctaatatctgaggagtgtggtgtggtcaatgcctgtaaaccagcattttggtaggcgaggcagtaggatcaagcctaggagtcaagaccaggctgttgcagcacgcgcaaaaccccgatcttctacaaaatacaaatactagcaaaaccaagttagggcaatgggtgggcaccattgctttgttactgccccaagccactttaaggcagcgatcgatcgtcgcaaggattgccgcaaccgtccccagtccaataacttggtggtatctgtaccacgcacgcgcagtcctcgatagcttgccctgggtgggtcttcgaactccctacgattacacggggttcctcgcaacttcagctcccaaacgcgtggggacttccaggcaattgaccaaaagaactggcaataatatggattacatcacacttttgcttctacagactccaaggaccgtacatctggccagggcaccggcttaactctcagcagtcacaacagtgtgcctcatcgggggtcaacaacacactgcacaacttccacactgggagacgaggagacaaggaaaaatgaacctagctggctgctgacacccacacagcactcacagccgcgccacacactacttgatctacagcgcacatgtgcacactcgccacatgacgcccacaatgtctcctacacccaccgcactcgttcgtcacttcgcttccacgcacccaacacacgtc

SEQ ID NO: 687172 - DNA, 512 bp, Homo sapiens
ttgaagacaccaccatgttttattccaagatcctgggcatggaggtcactactttcaagggaaaccggaaagcattgtgtttcggagaccaaaaatttaacttacacgaggtgggaaaggaatttgaccccaaagcagctcaccctgttccaggctccctggatgtttgtttgatcacagaagcacccctggaggaggtgatcgagccctaaaggcttttgatgtccccattgaagagggcccagtattcagaacaggagcaaaggggcctattctatccatctacttccgagatccggacagaaatctccttgaggtgtccagctatgtcacttcatgattgacactggctttttcttctattgtgatccacaaaatgtcattttacctaatttcctacaaatcccagagacctcgaagaactgagaacttcggcaacaggtttatggtgcaaacgtttgtgtctagaaagcctccattcaagctactccaataaacgacaaatctctcca

SEQ ID NO: 687173 - DNA, 331 bp, Homo sapiens
catttttaacgagtatactggagtgtcagcacggctagctcacgtgtcgacggaacttgtacaggggaggcatgcaccgcagtggtgaatacacgtcgaccaggatccatgtatgcgatatttggacgtcatcacggatctcatatatctaaggaacttgtctagggaggtatgcatcgcagtggtgaatacacgtcgagctggaggcatgcctggatgcttgggtcctggaggatccttctagagtcgaaccaggctccagctataaccgactatttggagcgttcagcacgagatgctacacgtggtcgacgtgaacttgtccatgggc

SEQ ID NO: 687174 - DNA, 398 bp, Homo sapiens
  misc_feature (46)..(46): n is a, c, g, or t
  misc_feature (63)..(63): n is a, c, g, or t
  misc_feature (125)..(125): n is a, c, g, or t
  misc_feature (137)..(137): n is a, c, g, or t
  misc_feature (174)..(174): n is a, c, g, or t
  misc_feature (181)..(181): n is a, c, g, or t
  misc_feature (188)..(188): n is a, c, g, or t
  misc_feature (314)..(314): n is a, c, g, or t
tccgttttgtctcccttcctttcctccctgtcccttctgtttgtgnctttgtgtttgcctttncttgtttggtgtgtccggcggcggggtggtgtggtccttgtggtggcgctttgtgtggggcnggtggcgggctntgtgccgtttttttcctttgtcggttttgtttggggngtggctnccgtggntgtttgtccctttttcttttgttgccttgtcttcctttttttccgtggctttttgggggcttgcgtcgtttttccccgtcgttggctttcctttcctttcttttcgggctctcctctggcttcgtngtgcttggtgttcgttcctgttttcggggggctctgttggtgggcggcgtcggcttgttgtctcctcgtcgctccttttttttt

SEQ ID NO: 687175 - DNA, 212 bp, Homo sapiens
  misc_feature (141)..(141): n is a, c, g, or t
tgcatggctgtcgatgcatggctggcgagtgcatgctaacacctgtaatcccagcactttggaggttgaggaggtgatgtcacctgaggtcggtagttcaaaatcagcctgaccaatttggtgaacacccgtatctattanaaaatacaaaaaaataagctgggcgtcgtggtgtgcacctgtagtcccagctactcgggaggctgaggtgg

SEQ ID NO: 687176 - DNA, 369 bp, Homo sapiens
ccaaaaagtgcaccagtccagtaatgcagtgcatatgccgaaagtttcattcagagggtattgacaggtaaaaagtttccaacaaagacaactctgtttattatctcattagcagcgcgcattcgtgccacagagccaatgtgattggtcatagtaactatagtagctctagccagatcttctttactgactgattctcgcttctccttatcagtcatattctcagtgctagatgcatcagcgcaacctgttcagaccaaatctttcataatctcctccataaatatcacctctctctctctctctctctctctctctctctctctctctctctctctctctctctctctctctctctctctctctctc

SEQ ID NO: 687177 - DNA, 1293 bp, Homo sapiens
ggagccagcatgggatgctgggatgctgggggaaacgactgccaggaaagctatctgcgccatgagagggctgactggggcgctcgggaagcctgacagggcttttgcgcacagcttgcctggctggctttgctaccctgtcctgctgccagcccccgagtaactgctgctgaccatgtgcaccccagttcctgtgtcacctgcatgctggagatgctcgcctgctcgcgtgcttggggggtggtgccctggagctggcccctgcagtggaccctccccgagaaccgcctgtggcctgcccggtatgtgcactagaaatggaacagcccttctaaccaacgacgactcatacacagctacgggatacggccgggcccctggtggcctctcatttacacagattacaaactccttgaaacctgagccttggcggtgtcaacctgtgccgagccccttagccgtgatgtctcaaaggcgccttgggtgctcgcgggtaccctggccccatgagtggcggcgtgtggctggctaggctacttttcgtggtccagggctccggacacccggctgcgtctctcagagctcgcctcttcggacgctggaacggccttgattgtccccgaacagcaacggcggtgactcacgacgtacgccttacacccccccggggcacagtactttttacccccgcggcgcgtgccaagcggtggacggtgcagcggggcgcagggggcggcgtccccgaggagcaggagggcttcgcccgcggggccttttgtccacaggcccttggacgaatcttgccatggtattaaccctcgtttgcatcccccaaggtgtctctgggcgcctaccgcgggggccccgggtgggcccggggcgtttaagccggccggtagccctcccggtttacccggctcagcaggcgttattccccaggcctttgtcgctctcgggaagcggcccaggcattcgtcagcgtggaccggggggcccgtctacccgcgagccgccctcatgggtgtcgtcccccaggggccgccgcctttctggggcgggcccccggcaccctttgttttgtggcgggggcgcccacccccatatgtgggagcgcgccccgcttcttgcgtaggcagagctcgttgagctccgcgtgggttcgttctatcgttccgtacccgccccatctgttgcacgtgtccgttagcccggagttgcggagctgcgctcccagcgcgctggcccgctgtgtgcatcgtctgctatattcttatgaacacgccagccgccgtc

SEQ ID NO: 687178 - DNA, 319 bp, Homo sapiens
cactcgaatctacaggatcccccagatgtcgcaaacgacgacaatataaagaatgactagcgaccggatgaaactacaggaggttaggtctaaaaatggctgtaactacaagggctatgtaggctgatagaagagtatgcaatgagcgatttacggtctgtttgtcgtaggcagatggaactatgtcataattatgcctcatagggatagtacaaggacggggtaggctatgtgttttgtcacgggggttgcagaatgagtgtgaggcgtataataccatagccacctaatataaagagtactgcggcaagtactattg

SEQ ID NO: 687179 - DNA, 863 bp, Homo sapiens
agcggagtagcgatagcagcggcgtaaaggcctctgctatgcttactttatccatccctttttcccacctgttcgccaccccaagccgctaatccaccaatgcagcaagcgcagaaccaagagaaagtatccgtctgtgagcattgtctctctgatagacaaaccacattacggctgccataaattcctctcgagcacttggacttcaactaccagcaggccatgcagcatcacgcccttgcctctggcgtaggaactgcaagatccagcatgcattgcggccctccttcctcgcactcaggaccaagatagagccaacccaagcctcactttgatttaaaaaaaaaaaaaaaaaaaaaggccgggatgccttctttccctggtggtggagggaactctaaagccaaagcctattattaggactgggaggtgtatttatcaacacctatcaggggcatatggtggccctcaattctccatatatcagattatcttcaagcatttaaaacaccgggacagtcgggcgccgggggtacgcgtcggtaatcccagacacttggggaggccgaggcggggtggatcgttggaggtggggagttcgagaccaacctggccaactggggtgaaagcccgtctctggttaaacaatttacaacacatattacccgggcgtgctgaagggcgcctgtaattccagtactcgggagcctgaggcaggacaattgcgttgaacccgggagcgcaaggttcgcattgagccaagatcggcgccaatggcttccaacctggggcgaaagaacaaggcttgggggcggaacaacacacaacaaacaagagggacaaaacaacaagacacacagggc

SEQ ID NO: 687180 - DNA, 382 bp, Homo sapiens
tagaatctgcaagtgtatattgggacttttttgaggccagctttggaaacgggatttctatgaagatattgccttttccaccataggcctcaaacggcgctaaatatccacttggaaattctacaaaaagagagttactaaactgctctatcgaaaggaagcttcaacgctgcgagttgaaagcacacatcacgaagaagtttatgagaattcttctgtctacttttgtatgaagcagtcacgtttcaaacgaaggccacaaagaggtcaaaatatccacttggagattcaacaaaaagagtttttcaaaactgctccgtcaagaggaatattcaactctgagagttgaaggcaggtatcccaaagtagttcccgtcgacgc

SEQ ID NO: 687181 - DNA, 281 bp, Homo sapiens
tcacacagggtgttgtgggcccaagtgttaaaatcttttccccctgggcccccattggtaaatttggccctaaaaagcccccccctgcccccgtgggctttgggggcccaaaatttggattttcccccccccccctttttaaaacaaagggggggggagccaaaacccccttcctttcccccccccgtccccccaggataacagggtttccttggccgctgttttttgggggtggggtgttgctttttaaaaccctttttttaatttttgggccaggccca

SEQ ID NO: 687182 - DNA, 720 bp, Homo sapiens
agctgacccgtagaaggcggtggaccagcctgctgccagctcttctgggagaagaagctgagcggcctgaacgccttcgacattgctgaggagctggtcaagaccatggacctccccaaggtgcctgcagtggtggtggtgacctggtctgcacggagtgatgacgctgctgtctggccatcgccagtcgccctgcacactagcaccatgcccatcactgggacatgctctcgtgcctgcctgtggatgaatgaacccctggctgtattggctcatacaccactgcagcccctagtgcaaatgccttcatgtgtgacctgactgagtgacactcagtgaatgcaggaagagcttggtgcagcagtgtgcggaatgcggctggatgtgaggctgctgatggccgacatgctggctgcacgtggatgtgagctggcccgtgacggggatggcgccgctggacaaggcctgcgctgatggactgacgacgagtgaagactgagtgaggaggaggagtgagtgagcccgaccctggacccggagatggagcacgtctagggcagtgtgctgcggtggccactgtgggtgctccctggacgtcggggtcctggcagtgggggactgcctggtgaacacagatgtgcttgggatgacgggtgctcccaacagcttccatctccctagaagagccaagcgtcccgtcccgtggagtcgctaagccag

SEQ ID NO: 687183 - DNA, 430 bp, Homo sapiens
acccggatatgattaatgaagtagatgctgatggtactggtagaattgattccgtgaatttctgacagtgatgggcatagacaatggtgaagacacagacagtgaaaaagaaattagagaagcattccgtgtgttggataaggatggcaagtggcatatattagtgctggaggaagcttcgccatgtgtatgacagaataccttggagagaagttagatcagatgaagagatgttgatgaagattgaatcagggaaagttagatatagatggtgatggtgcagtgtaaacctatgatagagtcgtgacacgtgatgaccagtaaagtgaatgacctgttcagaatgtgtttaatttcttgtgcacaattgtctatttgccttagctgtgtagtagctaatcggtaaacggttctccctgtgtcagaaaat

SEQ ID NO: 687184 - DNA, 238 bp, Homo sapiens
agaagcaagaagtggaaatacccagtgtcatcagatgagttggagagatgtgagtagatgcatgatggagtatgattcagcacaaaaaggaacgtgaggcgggcacggtggctcatgcgtgcaagtcccagacactttgggggtctccttttagtcaaaagcgagaaaatgacaagaaagagattaaaattccatgtttcccccccccgccctaaacactaaaattttaaaaaagatg

SEQ ID NO: 687185 - DNA, 374 bp, Homo sapiens
gagggggtgaggggtgacacccttggggagggggcctgcatatggcactgcctgtgtgcacatggtgtatgtgggaatcggtcctggggactattatgtgtgtatgatgccacaattgcacgactgctcgctattccaatgctcctgacttgaccccgccgacccccctgctcagctcggggccctgtccacacttcatggcctgtgtatgcgcgcagctctaggagctccactgacatatagacaagatgtgacttacattaagtttttcccttgaggatattactattatcttgtacagaatattatcctcttctgtgccaactgctgtccgtgctgatgacattgccccctgtagggggggtgcggcccct

SEQ ID NO: 687186 - DNA, 706 bp, Homo sapiens
agcggtcaagagatcgagaccagtctggccaatatggtgaaaccccgtctctaccaaaaatacaaaaattagctgggcttggtgatgtgcgcctgtagtctcagctcctcgggaggcggaggcaggagaatcgcttgaacccaggaggcggaggttgcagtgagtcaagattgcaccactgtactccagcctggcaacagagcaagattccttctcaaaaaaaaaaaaaaaaaaaaggtttacctccaaaaaattcatccccttccaaaatcctttggcctcttcataacttatcagtggctcacttgggacttggcgccttgctggggcgccaaagaaaggatttccatttgacctctgaggggttctatctaaaatcactggacaaaaagcagattcaggggagaaaagacttccaaatttggtgaatgtgtacttgggaagcccttcaaattgaggaacccaagagatccacgaaatactggtcctttttttaatgcctcaggtttcaaccaacgttatggcccagctgttgtcgcaacttttgcttgggacaaaagggatttaatctagttctattagactaatggtcctatagaggcctgtctgtctgggattcttctgggacctctctgagcttacattttctccctccgggcgtatgggcgcagacccttcctgaacgggcgggaactcttataaccta

SEQ ID NO: 687187 - DNA, 1001 bp, Homo sapiens
cttgctatagtctatcaggtacttgagctacctgttcgctcccttggatacagctgtgactctttaatcagtcctcctgaatagattgctagccctgtgggcacaataatgtgccagtgtgatggaaaccattctccggttggctttactaggccaggcgaatcccagtcgagaattgatggaagcgttatttacctgtgagttaatgtgcttgtattaggaatgcttgaatttcctaattagaccaatgtgggacaggaggtctgggggggttcttgctcaatttagctgttagataccacctaaactattttgtattagagaagcagtatcttttagtgaatacgtcttgtgtaatatatattcgaaaggcatctgtggcatattttagggctgtattataatttgcaaagggtttaatgttggattctgcatgtctacacatacaaatgacgcgggctatgctcctcgtgacagagagtgatggaaagagcaggttctatggagtctatggtcattgaagaataaccatgaagattgggtcatcgctgtggtcatgaaatgcgaggcaaagtttggtgcaagatttaacatagtctcttatttattgttttgtgaattggataaagatggatttctatgtaaatagactgttgaatcctgaattaccacggtactaaaaaaattaggtgtgtaaagaaatgctttcttgatgtgaggtaaaagtagttatgtacgtcttgaaatggactgtactttggttcgtccttatgataacatggtaatcgtaattggttaaaaccatccatgttgtaatcgtaatacttataaggaattaagaaggtggttggtcgggacttgacaggatgggggttttcaaaacacttgtttttaataaggttttgtgtgggatgcataaatagtttgaaggcgggaaaaaaagcgtctcgttgagggagaagggttgaaaaaaaggaaaaaaagggatattaaaagtggtt

SEQ ID NO: 687188 - DNA, 418 bp, Homo sapiens
  misc_feature (134)..(134): n is a, c, g, or t
ccttctccgggggggggtgtccagaaccaggtgtctctttctttttgtggaagagggttttatccccaccacctctcccttggtgggtgggagctattgggggccggggaacaattcaaaaccccccccccccngtgtgggttcccaggggccctttttttcttttaacaggcttcccgggggccaaaaccggtgggccccgggggaggttttttttttttcctttgggggagggggttttgcccaccccctaacccagaaaggccttttcctttttccggggtttttggtttggcgggcgggcggcccccccttcccggggtttttgggttggccggggggggtttggggggtcccccttttttttttttcccgggcccccgcgtggggttttaggccccccccccctccttgggga

SEQ ID NO: 687189 - DNA, 149 bp, Homo sapiens
ctggggctggggcagtcttttcctggcttcctctgccaagcttcctggctctggtagagtgagacttcagacgttctgattgccttccggattgtcatctctccctgccccagggaattgggaaggattgttgagggatcattctaatt

SEQ ID NO: 687190 - DNA, 357 bp, Homo sapiens
  misc_feature (21)..(21): n is a, c, g, or t
  misc_feature (335)..(335): n is a, c, g, or t
cacctggctggagtgcagcgncgtgatcatagcttactggagcctcaaactccctgtgtattagttcattttcatactgctgataaagacatacccgagactgggaagaaaaagaggtttaattggacttacagttccacatggctggggaagcctcagaatcttggtgggaggcgaaaggcacttacatggtggcagcaagagaaaatgaggaagaagcaaaagtagaaacccctgataaacccatcagatctggagtgaataaatctatagacttattcactatcatgagaatagcacaagaaagaccagcccctctgcattgcatttacctncccctgggtcttttcccacaac

SEQ ID NO: 687191 - DNA, 318 bp, Homo sapiens
atgtcttatgggctaaaggacaccggaggtagttgatagatcgagaatacacaaggacactcacagtcacacatagaacctagaaacaacactccccaaaacagatgtagattcaacaaaatactatcaaaagccataaagcatattcagtatatcatgtttaaattgttccgacaggtatattgtgtgtatacccgcacaaatgttactgtcattaaactaatgatcctattttcttcttctcaaaaaaagtcctagaaatctgtatgtgatggcttgatgaagtttagtcactttataacaggttaagcttttaaa

SEQ ID NO: 687192 - DNA, 1188 bp, Homo sapiens
  misc_feature (122)..(122): n is a, c, g, or t
ggttatgtgccgctgtgtgcttctcgatgtcgaatctacacaccgtatccagcacatgggatctgtgcatgtgactgcacgacaaaatgagcgctttagccgatatactcggaggatacctnggaagtgagggatgcgacatggaggagatgaggtactggaattatgtagtgtattccctcttacagctaagctagttgaggagagtcgatagtcgaggcaagcttcgagagcaaattgttgtaaataggtgcacctgggagagtccggtctaaagcacgcctacgtaggtcgcattgtaggaccgataggtatcgcgtacgtgctggaatctatctagtaacaggacacggacgtgcaatttggctagccgggtacgcgcaagcctccatttctagtagctttccctttgaccaattgcccgaagagggatcccaatattggccagttagcggtccaccagccgacaagacgcgcggtccgatatcaagacccaacaagcctttgtgcaatagcacgttagacaacatggaatggaatgaggaaccgctaatactgaataatcgaaatccacccgccggagtgttaatcgcttattcgaggaatccaaatataccatggtgatgacgacactttcgcacagggaaaagccactatgttccagtccgctgtttggtaacttgcggatcctttctcgtcgggcgccacaatttggattcatacacccgatattcgtagatcgcagattctaaacgtgccaattttcaaacttttcgtagggaattgagacatttataaaggcgacatggtccatgaacacaggcgcttttacacaacatcaacgtgtttgccaaatagcgcgcccatttccaacactttgtggtggatactcccacatggcggaactatatatcaaagcgggcctcgttggtggacctcacggacggataaacgctctttacattgggacttgggcagcttttttcccggtgcggaagaccgctctgggaacccatgtatccgccgacatattccgattcacacagaaagtttcgacgaaacaaacggggatacacccgccataacgctaggaaagtttcccctttggccagagaagaacagcacaccaagaagacgtgccaccgaccacgaagcgaacacacggtcccaatcagaaatcgaatcaca

SEQ ID NO: 687193 - DNA, 104 bp, Homo sapiens
ttagcttgtaccgtttttcttgtccagtgtcttgtgtgaggagggtctttgtaggagcacaacgcttgtgaccatgcacaacctgtgtgaccatgcacaacctt

SEQ ID NO: 687194 - DNA, 330 bp, Homo sapiens
  misc_feature (95)..(95): n is a, c, g, or t
  misc_feature (212)..(212): n is a, c, g, or t
  misc_feature (230)..(230): n is a, c, g, or t
  misc_feature (234)..(234): n is a, c, g, or t
  misc_feature (236)..(236): n is a, c, g, or t
  misc_feature (244)..(244): n is a, c, g, or t
  misc_feature (249)..(249): n is a, c, g, or t
  misc_feature (259)..(260): n is a, c, g, or t
  misc_feature (262)..(262): n is a, c, g, or t
  misc_feature (271)..(271): n is a, c, g, or t
  misc_feature (274)..(274): n is a, c, g, or t
  misc_feature (278)..(278): n is a, c, g, or t
  misc_feature (282)..(283): n is a, c, g, or t
  misc_feature (285)..(286): n is a, c, g, or t
  misc_feature (288)..(288): n is a, c, g, or t
  misc_feature (290)..(290): n is a, c, g, or t
  misc_feature (295)..(295): n is a, c, g, or t
  misc_feature (299)..(300): n is a, c, g, or t
agtgcaaggtcctgggctctaggtgatcatttcataagtcctttacagataaagaaaaagtagtgtttgtatgtttgtttttaagtaaccccaanacaaatttatattgtattcagcaaaattggaattcaggtgtttaattttagaacatgaagtgcctgctgttttaagcattgacttgtataaaaagaattgcatgtcataaaagtaancttatgggttttctcctntctncngtatatgnccccntcatcatgtnncncccaccccnttncccncccnngnngngnagtanaggnnctttgttgcaataaagatgctgctgaaatt

SEQ ID NO: 687195 - DNA, 186 bp, Homo sapiens
catagccccacatttattcgagcaccagttctcagtgacaatctcaactgagcaaactcttgcagcgggggcataacttctgccagtaggtagataacccccattatctgctcccccatccacacggaatcacatcagcaacatgtgcgtacaacacattaattttctcaccagacggcaccatga

SEQ ID NO: 687196 - DNA, 147 bp, Homo sapiens
gtgcagcctgaggtcgatctcgaggatccctgttaacatagtttcaaatttaacgtcacgttaactctaccaaatacagagtgccagatagcagaggcttgtagggggtctaggccctacatttacactaatgatgtctcgcacagt

SEQ ID NO: 687197 - DNA, 125 bp, Homo sapiens
ctggacgtcacccaatcaactgtttcttccccatctatttttagttgctcattgcttccagacagctctgcctcgttctcttaatctaatcagataatagacttctacaaatactttttgaacag

SEQ ID NO: 687198 - DNA, 979 bp, Homo sapiens
  misc_feature (501)..(501): n is a, c, g, or t
  misc_feature (513)..(513): n is a, c, g, or t
  misc_feature (528)..(528): n is a, c, g, or t
  misc_feature (531)..(532): n is a, c, g, or t
  misc_feature (677)..(677): n is a, c, g, or t
gccccatgttgtgtgagagagatctcttcgtggtttaattgtggcccacccgggttggacccccccccgttttgtgggggacaattctctttttacgtgcgcttttttttgaaccccccaactgtgtggtcctgcggtgtttccttctgagatattaaggggggtataccggggggggcaacaacagtagctttgtaggtgttcttttccccccagaagttggtctcttttcttgggaagggggggccccccctgggcgtttgtttccacgacccctgggacccccccagcgtgttggccgccagaacccagcgccccatgccccccagcccccaaggccccaaaaatgtgttacaaggggaccctccttgccccagtgctccccgaacacgccaagcgcgcttcggaggggcccccaaggggaaaatggcacccaggaaagcgtgaagacgccccccactgtcctcgggaagccccacggccacaccgtggtcacattcncgtacctttttnaaaaaatgaaagtanagnnaaaaaaaaacctgcaaatctagaaacctttttagagaaaaactatttaaaactgtcagatcctgaccagcaagcccccccccagccccccttccaagtgactccgtgccttgagtgtgtttgcgtgtttacacccgtccctttgntggccgcccccgtgcgagcggcacccctgccctgccctccacaaaattgggttccaagggctgttccagacaactgccaacgtcactgagggccctgccccagcggccctggccccaggctttattaacctaaaatgtagctcccctagcgctaacctaggaacccccgctgcctgctggggggccacgcccctcatgcccttgtcccaggcccggggccttcagcgttgaacacttccttgcttttttcacatgttttatggaattgttcacctggtttgaaataataaaatgtagaaaga

SEQ ID NO: 687199 - DNA, 415 bp, Homo sapiens
gagagactgaagagctgttccaaacaaggagactgaagagaagtactagttaggagcagtgtgtgatgctgttgttataaaggatattactgagataactggtcaaaatagagtggggtgggggggtgccgtgcacagtggctcacacctataatcccagcactttgggaggccgaggtgggagggaggattgcttgaggccaggagtttaagaccaacccgggcaatatagtgagatcccatctctacaaaaaatttaaaaattagctgggtgtggtgacatgcacctgtagtcccagcttctcaggaggcagaggtgggaggatcgcttaagcccaggagttcaaggctgcagtgagctatgatcacaacactacactctagcctggacaacagagtgagaccttatctcaaa

SEQ ID NO: 687200 - DNA, 1605 bp, Homo sapiens
  misc_feature (501)..(501): n is a, c, g, or t
  misc_feature (513)..(513): n is a, c, g, or t
  misc_feature (528)..(528): n is a, c, g, or t
  misc_feature (531)..(532): n is a, c, g, or t
  misc_feature (677)..(677): n is a, c, g, or t
gccccatgttgtgtgagagagatctcttcgtggtttaattgtggcccacccgggttggacccccccccgttttgtgggggacaattctctttttacgtgcgcttttttttgaaccccccaactgtgtggtcctgcggtgtttccttctgagatattaaggggggtataccggggggggcaacaacagtagctttgtaggtgttcttttccccccagaagttggtctcttttcttgggaagggggggccccccctgggcgtttgtttccacgacccctgggacccccccagcgtgttggccgccagaacccagcgccccatgccccccagcccccaaggccccaaaaatgtgttacaaggggaccctccttgccccagtgctccccgaacacgccaagcgcgcttcggaggggcccccaaggggaaaatggcacccaggaaagcgtgaagacgccccccactgtcctcgggaagccccacggccacaccgtggtcacattcncgtacctttttnaaaaaatgaaagtanagnnaaaaaaaaacctgcaaatctagaaacctttttagagaaaaactatttaaaactgtcagatcctgaccagcaagcccccccccagccccccttccaagtgactccgtgccttgagtgtgtttgcgtgtttacacccgtccctttgntggccgcccccgtgcgagcggcacccctgccctgccctccacaaaattgggttccaagggctgttccagacaactgccaacgtcactgagggccctgccccagcggccctggccccaggctttattaacctaaaatgtagctcccctagcgctaacctaggaacccccgctgcctgctggggggccacgcccctcatgcccttgtcccaggcccggggccttcagcgttgaacacttccttgcttttttcacatgttttatggaattgttcacctggtttgaaataataaaatgtagaaagaaaacaaaaaaatatataataccacacaagaaatggaaaaccgacacgtaaggcaagttgagccaagaacccagcacaaaagaaggaagcgggggactcgaaatagtattgtgccacctgagtgaggactcccaggacagctctgattggtttattcgaacagggggcaccgcatgaagtggcagcctgtatgtctgatcgaagccacgacgacatcatacacccggatgaaagaacattgagtgcttgagcttgggccggagcgcctcatgccgtgggtggttctccccgtaggccacaggaactcaacaaatttgctgtcctctacctgtgaagtactgctcaaagtacgggcggtagtcaccacgtgtctttcagccgtcttggacaaagttgtgacctacgacatctcaggaaagaattacgaggaggcagatagaaactcttgagaaattggcagcgtaaaaccaagttttccgaacccggttttgggcaaggttccttacataaacggtatgaagaacctctcttcagatgaaaatacgaggatacccacggcgtccagcaaacaaaacggagcacaccccacacgaggagctaatcacaggaacggccaccacatatcgc

SEQ ID NO: 687201 - DNA, 1409 bp, Homo sapiens
  misc_feature (961)..(961): n is a, c, g, or t
  misc_feature (1150)..(1150): n is a, c, g, or t
gcggtggctttgacgccaaaagacaggtgtgcctgaaacactacccctacgagcccaatatgggtaaaggaggacgcactcattagtcgatcattgtcagctcacttgagacatcgctaggacttccggcgcatgagttgcacccacatacgtggctccaagtctgtatctactcaaaatgcgtgtggccagtcgtactcaacagtaacctattggaatagcacatgttcgaggaagggaatcgcgtgcgtgaggagtgtgcacaaagggtgctccctttgaaggtattgcactgcgggtccttcgtgcatcaacccttgcatagaaattttgcaccttgttggcacactgttgggctcatccactccatcttcgtataatcccgttcatctaggtcggtgtcgaggcattcatccgacgcactcgccacggcatacacggttatacctccatatgatagcacgctcaatcgcgattaggactatgggccacctacgggcactcacacttgcagactatagttgtaaattcaacacaaaacacacacttcgcatttgaacattggaggcacacttgatctctcggaatggctttgcgacatgttaagctctagtgcgcgcttgccatagagactcttggccttgactcttgtcgttggtaggagctggatcactaaacggacacgcatcgggcttaatcattcccctatgagcagcttaggggtcaagccacggcgtcacaattaggacacgtggctccgccaatatccatagaggcatgcaaacacgaggaacgcttgttcgccagctctacatcatacccacagctgttgcagcatcttggtcgacgcgttagattagtgcaagcgacaccacacttgttcgaattgtccccataaagttggcgttgagcacgcttccccgtcaatgccatgccgcgtgtgaaaacatacacccactcncttgtacaggtgccacacacgtcacgagttcgcaccgtgccgacacctcatcctcacacgcaggccattgagcacgtagcaaacgacacccaacacgtcttgcgcgcctcactcccatattccctccccgcctacctccacgccgcatctttagtcccagcctctttcctgagctgtgccctcatccgncttatttgtaaggcggttcaggctcatcgcacccgcaccgttgcacagtcatagtcagacgttagccccgcagagctccttccctacggtaagcaccaacttcgcacagttcgtaccgactgagcgtcttcgcatcgtacttcggacgttcgcaacgaccagtatctaccctccgcgctccccgacggacacgctcgctcatctccttccagacacgtgctcgccaactcagccttcaactggctcactagcgtcaatt

SEQ ID NO: 687202 - DNA, 800 bp, Homo sapiens
cagaaaaagagactgaggcaagttttagagcaggagtgaaagtttattattaaaaagctttagagtgggaatgaaaagaaattaaaatacacttgaaagagggccaagtgggcatcttggaagacaagtgccccatttgaccttggacttagggttttatatgttggcatacttctggcatcttgcatccctattccattgattcttcttttggggtgagttgcccacatgctcagtggcctgctagcacttgggaggggagtgtgcacagtgtatttactggagttgtatgcatgcttacctgaggtgttgttgcttaccagccaaatgtccctaggaggtcatattcataaactccatgattttgcctctaaatgtgcatgcttgagcccactcacccaactcctgggatcttatcggaaagctgccgatcgctagtttcaggtgtttctatctattggaagatggcctttccctgatgctggctgcaaccaattattactttacgagagagagcatgagagctgtctcaccatcatcacctgatggttgcctgacattcctggtgaggttgggaggatgcctgtcctgccctgctcatgcctgaatagctacctgctgtaacaaaagtactatctatggtagctgtagccatagggaaatgcatttcttcaggtgaaacttacaagtcaaaattagtcttttaaagacaacattgaatctccttgttaaatctccatcagagctcttggaagaaccaggtggcttattagtgcatgagtaagttttaaaaggaatct

SEQ ID NO: 687203 - DNA, 1098 bp, Homo sapiens
  misc_feature (796)..(796): n is a, c, g, or t
gttccggtctcctgatgttctcggcctttttcgtggcgcaccggccctggcggatggccacccgcgcacttgggtaccctccctacctctggggaaactggggctacagaggttctcgctccccgtcctgtcttccccgcccgcttttgctccctcagttgcctgttcgtcggttctcgagttcctccctgtcccgctcagctccaaagctacggggacggggttgtccacaggcgctgccatgtgttgaagctctgccccttggtctgagaatgcaggtacatcggccactggtaccccccctttgggcaatatgttctgcgtctttaaccatggtcatgttctagtgacgaaggggaaggggggacacatgcttaggtctcccaaggctgcctctaggacggggcccctgcttctccaagcctggacccccagcatttgcccgacaccagcccgctgccgccagcccaagttccagaaatgctttaacagggagcctcctgcaccagtcccccaaccccaagccggctcggaggccccaaacggaaaaagcagcacacgaagcgtgagacgccaccattcctgggaaccacagtccacactggctcattctcgctagctttgttaaagcacaattggaagtaaaggttcttcatatagactgcaaatctagaaacctttttagagaaaaactatttaaaactgtcagatcctgaccagcaagcccccccccagccccccttccaagtgactccgtgccttgagtgtgtttgcgtgtttacacccgtccctttgntggccgcccccgtgcgagcggcacccctgccctgccctccacaaaattgggttccaagggctgttccagacaactgccaacgtcactgagggccctgccccagcggccctggccccaggctttattaacctaaaatgtagctcccctagcgctaacctaggaacccccgctgcctgctggggggccacgcccctcatgcccttgtcccaggcccggggccttcagcgttgaacacttccttgcttttttcacatgttttatggaattgttcacctggtttgaaataataaaatgtagaaaga

SEQ ID NO: 687204 - DNA, 1724 bp, Homo sapiens
  misc_feature (796)..(796): n is a, c, g, or t
gttccggtctcctgatgttctcggcctttttcgtggcgcaccggccctggcggatggccacccgcgcacttgggtaccctccctacctctggggaaactggggctacagaggttctcgctccccgtcctgtcttccccgcccgcttttgctccctcagttgcctgttcgtcggttctcgagttcctccctgtcccgctcagctccaaagctacggggacggggttgtccacaggcgctgccatgtgttgaagctctgccccttggtctgagaatgcaggtacatcggccactggtaccccccctttgggcaatatgttctgcgtctttaaccatggtcatgttctagtgacgaaggggaaggggggacacatgcttaggtctcccaaggctgcctctaggacggggcccctgcttctccaagcctggacccccagcatttgcccgacaccagcccgctgccgccagcccaagttccagaaatgctttaacagggagcctcctgcaccagtcccccaaccccaagccggctcggaggccccaaacggaaaaagcagcacacgaagcgtgagacgccaccattcctgggaaccacagtccacactggctcattctcgctagctttgttaaagcacaattggaagtaaaggttcttcatatagactgcaaatctagaaacctttttagagaaaaactatttaaaactgtcagatcctgaccagcaagcccccccccagccccccttccaagtgactccgtgccttgagtgtgtttgcgtgtttacacccgtccctttgntggccgcccccgtgcgagcggcacccctgccctgccctccacaaaattgggttccaagggctgttccagacaactgccaacgtcactgagggccctgccccagcggccctggccccaggctttattaacctaaaatgtagctcccctagcgctaacctaggaacccccgctgcctgctggggggccacgcccctcatgcccttgtcccaggcccggggccttcagcgttgaacacttccttgcttttttcacatgttttatggaattgttcacctggtttgaaataataaaatgtagaaagaaaacaaaaaaatatataataccacacaagaaatggaaaaccgacacgtaaggcaagttgagccaagaacccagcacaaaagaaggaagcgggggactcgaaatagtattgtgccacctgagtgaggactcccaggacagctctgattggtttattcgaacagggggcaccgcatgaagtggcagcctgtatgtctgatcgaagccacgacgacatcatacacccggatgaaagaacattgagtgcttgagcttgggccggagcgcctcatgccgtgggtggttctccccgtaggccacaggaactcaacaaatttgctgtcctctacctgtgaagtactgctcaaagtacgggcggtagtcaccacgtgtctttcagccgtcttggacaaagttgtgacctacgacatctcaggaaagaattacgaggaggcagatagaaactcttgagaaattggcagcgtaaaaccaagttttccgaacccggttttgggcaaggttccttacataaacggtatgaagaacctctcttcagatgaaaatacgaggatacccacggcgtccagcaaacaaaacggagcacaccccacacgaggagctaatcacaggaacggccaccacatatcgc

SEQ ID NO: 687205 - DNA, 277 bp, Homo sapiens
tgcaaccacaacagccgagacaggcgagagagattaaaggaagagagagagagtagaggaagagagagaggagaggaagagatagaggaggggaatagactgaggacaggaagagagcgaggaggggaagcgagacaggaagggcagatagaggagaggaagagagagaggagaggaagagagaggaggggcgtcgagacatggagtgtacgacgacgttttacggacacgacgacgaggacgacggaagacgacgagacggaggggacggagacga

SEQ ID NO: 687206 - DNA, 85 bp, Homo sapiens
cccccccccccccccccctggggtaccatttggaaggggggggggtcccccttttttttttttacaaaaaaaccttaggcgggga

SEQ ID NO: 687207 - DNA, 884 bp, Homo sapiens
  misc_feature (9)..(9): n is a, c, g, or t
  misc_feature (118)..(118): n is a, c, g, or t
  misc_feature (120)..(122): n is a, c, g, or t
  misc_feature (124)..(126): n is a, c, g, or t
  misc_feature (129)..(129): n is a, c, g, or t
  misc_feature (139)..(139): n is a, c, g, or t
  misc_feature (142)..(142): n is a, c, g, or t
  misc_feature (144)..(144): n is a, c, g, or t
  misc_feature (147)..(147): n is a, c, g, or t
  misc_feature (151)..(151): n is a, c, g, or t
  misc_feature (157)..(157): n is a, c, g, or t
  misc_feature (171)..(171): n is a, c, g, or t
  misc_feature (186)..(187): n is a, c, g, or t
  misc_feature (190)..(190): n is a, c, g, or t
  misc_feature (196)..(196): n is a, c, g, or t
  misc_feature (209)..(213): n is a, c, g, or t
  misc_feature (220)..(222): n is a, c, g, or t
  misc_feature (224)..(224): n is a, c, g, or t
  misc_feature (237)..(237): n is a, c, g, or t
  misc_feature (250)..(250): n is a, c, g, or t
  misc_feature (253)..(253): n is a, c, g, or t
  misc_feature (255)..(255): n is a, c, g, or t
  misc_feature (257)..(257): n is a, c, g, or t
  misc_feature (285)..(285): n is a, c, g, or t
  misc_feature (293)..(293): n is a, c, g, or t
  misc_feature (309)..(309): n is a, c, g, or t
  misc_feature (357)..(357): n is a, c, g, or t
  misc_feature (379)..(379): n is a, c, g, or t
  misc_feature (774)..(774): n is a, c, g, or t
  misc_feature (791)..(792): n is a, c, g, or t
  misc_feature (881)..(881): n is a, c, g, or t
taaaaatanaaacaataaaaaaaaaaaagcaaaaaaaaaaaaaaaaaaaaaaaaaaaaaaaatttaaagctcatctcgatccctcaatggggtatacctatattcccggggggcccgncnnncnnnggngcgctcgggnggncngcntgcnccatcnggggcttgccctcngggggctgtctcggnnggntcgggnccatgggggggtnnnnngggcggnnntncagaatgtaagtnaaatacgatttgnttntntnttccggggtttaatacatctttgaggtntccaaacncatacatatgcctaangctgtcaatagcgattacaggacaatctgctggtgttttctgtatgtncagaagaggatgtctaaatttntcacaatcggcatgtaaaaagtttattgtacctttttcacttattaattgccgagctacttcattctggaatatttctaaactttctgtatcttctttcatgtgaaagagtatgagaaaaggcagtccttcttctgtcaattcctctccattttcaaatgttatttctcggacaagaggaacacatttatcttgaatccaattgtaagtcacatcaaaatttgtcatagctcccaagtacaccatatccggagcagaatgccctggtggtttgtagattatgttgtcgccactatatctttccggttttgaaacatccccaaatgcagaaagaaaggcacagtcatcatgcgaaatattcgctactcgttcaaaaactctatagttgtccgagtncttttgctcaaaatatnnaatgatatttcttttgctgcgatcaagagtggtgatttctgctaagtcccgaatttcttgaatggggtcacttttttgttgcctgaagnaat

SEQ ID NO: 687208 - DNA, 549 bp, Homo sapiens
atggctaagtgattcggatcatggtcttcagagtcgtgaagacagtgcgctggtcaggatatctcaggttcaggcaatgagatgactagtctttctaattctgaatcatccttgtccttagtcaggatagcgtgacagaattgaggaatgtcagctttacaggctgttcttaacatggggtttaagcggtaatctgtgttctgggtgatctggcgcatggttatcatctgtgtgcatttgatatccaacaattcactgtttttattttgcttcaagcatccccccatggttttagaatctgcttccggacagaacctctttatcatctgcttgcaaaccctcatgagggtgtagtctagctctgggtccatcatctctgtctcctgcagcttaaatactttttggtggcagcggatgcttagctgcttcttgttttctttcagacattcgataatctgagcgttgcatattgcaagcggaacagaagttttgatgtcactcttgcaggttcgtatagatctggtccaagcgatgtctcagaattccagt

SEQ ID NO: 687209 - DNA, 179 bp, Homo sapiens
atcctagaggatcccctgtatctccgtgccccagacgttgccaagatatccctaggaggtcatacatgggcccctggttagagaaccgactgtctctaacaccctactgacaacccctgatcgactactagccaacatcatactcccataactactactcctaccctacactatccacc

SEQ ID NO: 687210 - DNA, 204 bp, Homo sapiens
gcctgacttagaggatcccctaaatggctgttacctaaatggctgtacctaaatggctgtgcaagaggtggtgaggtcgatcggggttaatcgatttacagaacaggctctctagagggatatgaagcaccgccaggttcctttgagttttaagctgtggctcgtagtgttctggcgagcagttttgttgatttaactgttgag

SEQ ID NO: 687211 - DNA, 185 bp, Homo sapiens
  misc_feature (54)..(54): n is a, c, g, or t
gggggagggagtttcaccatgttgcccaggctggttttgaactccagggctcangcccacctccacctcccaaagtgctggagattataggtatgggccactgtgcccagccctatgaagaatatcttcaaagtatataaaatactgctttttgaaaataggtacaacctcttcatcttgacaac

SEQ ID NO: 687212 - DNA, 521 bp, Homo sapiens
  misc_feature (421)..(421): n is a, c, g, or t
aacttttaaaaactctcattggagtaagtcttttcaagatgatcctccacaatggaggcagcgttcctacttgtcatcacacagctgaagacattgtttcttaggtgtgaaatcggggacaaaggacaaacagagacacacggcattgttcatgggaggcatcgtcaccctcctgggtgtactgtgggaattttcctgtgtgatggaaaacagtggccacacgggttgtgctgtacccacccttccccggcagagatggccctcggccatgtgccgcttgcattccacctctctgccactccactggcaggcttttggtcatgtttccggcacttgccctcatgcccttgaactctcatccggcttggtaccctagcctgctggaccccgtccgaccttggaggccgagccctatgtctcnaggcccagccctagccctctttctcgctcaaattctaaagtagttgttcctcgtttacggtttcccttgcgctttgtcgaaattgggatcatgtgtcata

SEQ ID NO: 687213 - DNA, 145 bp, Homo sapiens
cggacgggctgtggcatctttgatggtgttcacctagagtagatgctagtttgtcagacagggttatcctcgtgaggttgcagtcgagccgagatcgcaccattgcactgctgcctgggacgacctgagcacgccacgcctggct

SEQ ID NO: 687214 - DNA, 180 bp, Homo sapiens
cgggaggctccagagactactatagcagccgggaggtcaggagttcggtgggctacaggtgacccgggaggctcggggcggggtcctacaggaggacaggttatggacaggttgacggttacacacaacggaggtgaaaaaccctttccctggcttccagggatcggtgcctttccatat

SEQ ID NO: 687215 - DNA, 212 bp, Homo sapiens
ttgtaggccgtggaggcaaggccggtgcggtgacagcacttggatcaccgtcgagcgcaccaatcaacacgccctgtgttcaccaaacggcagacggacgtagttctgcattacccactgttcaaaccagcccaaaatatcgctcaaagaaagtcgcaagcttgtccagcaccgtctgcttcttggctgcatggccgttgtttttggaaaat

SEQ ID NO: 687216 - DNA, 915 bp, Homo sapiens
cgtgcgcgggtgtcccgggcggggggggtggatagtggggtctgggccctgtctgggggcggagggcgggcccgctagtcggcggggttggagggtgggccgcgcgacccgcgcctggttgctgcgtgtgcctcccgcccgctgctgcggcgccggggggcgcccgtttggttcttccggcggggtttggtccgcgccgccggcccaggccgcgcaggcgtgctattttggtggctcccgccggctgccccgtgcagtggttgcccgcggcgcgggtaggatgccggcgcactgtttcccccgagagatcgcgggggcgagtgccccaacggcgactctgtgtgcggtgcgccctgggccggcgttccctcctcgggggcgcccgctcacgtcggcgctcggacacatgctgggtgggaccatttggacgcttgaggcgccggggtggtggaatgaggattcgcgcggcgtggcttccctcttgcctggtttgtgggcacccgctcgctggaggccgctcgcccccgtggggccgcctctgctggcggggagagtgtgtgtctcgcgagaggttctctcgcgtgagcgggtgccgggcgcatctccccacgatccacgatctttgtgtggaaccccctgcgtgtgtgagaaaagagtctaagtgtgagtagccctcgcgcagagaagcagcacgctcgagtgacaggtgacagggaacacaccgagtggatgggtggacatcccgttcacgtgagcacccgccccctgctgattcgcattcctcaagacttgcgggcgacgcactgctatgcacccctccacgccccagcaagttggaccacgcaccaggtgttcccctccgctccacgcccgatcataatttttttcttgtctgggacccgcccacatagtcaa

SEQ ID NO: 687217 - DNA, 426 bp, Homo sapiens
atatgtattcataggggcaagtaaaatcatggaaaactcaaaaagaaggggggacatggtcagtttaagctaaaagaaactttctaaacaatgtataggtacacagcaaaattaaacaaatccaacaatatctgaagcttagtgtacatagagtggtaggttgttattcaataaaattattcccaaaagtgtatctcctaagagtgcagttcccatgagtcacttcctgaacccattgaccaaaggtgggacagaaacaatcctgtagaccttgacattcagacagatagtgagctgcttactgatcatatatagcatacgttactttacagcagaggaaaccattgtccacaaaactagatgttcttttggggtattatgtacagacttgtccaatacatgtgtgtggtacctgcgagttgctga

SEQ ID NO: 687218 - DNA, 1190 bp, Homo sapiens
  misc_feature (1)..(1): n is a, c, g, or t
  misc_feature (387)..(387): n is a, c, g, or t
nctctgtattacttctcgctttgctgcgctattacgcagtatcatcgtgttcacggtgtgtagctccgtattctgtgctcagtgcggtagtactactgggttttctctccccctagtggcgccattttccatttgccgccaccgttgttatactcgtcgtgcaccccccccgaatgtgggttttcgcacccggccccgtggttaggactccccaacggctttttcccgggcggtcttttcttagttgggagatcccccttgggtggtgttcccaccagaggagtttcttgttccagccggcgttaaattagtgtgtgagaaactgtcgtcgtgtcgagtggaaggggccactttccacacagggagataatcccccccttcttgggngccccaagaatgttttctcaggagtgtaatatattagccttaattttagattttccttggctccatttgttcacgagatatacctttccacggaagagatggccactttatgaactctcacgccttttggtgtctccacggtattatacagccccacttataaggtacccacttgtgagcccactaagaaggggagacccactgctcgtgttttctgagttggcaccacgtgtgttctaatgtgtttaaacaacctcgaattgtggtctttcgcactgttgcactaaaaaggcgcccacaagtgttaccacaggaccccactggaaccactgtggtccacatgttttctcttatggctaagaccactattataacttaatttttcccaacactcgtataagaattttggggtataaaaagttgttctccacgttgccttcttccccacttccacaatgagcgagaaaaaaaagcttaattgtttaccacttatacttaattttctaaaacccactgtaactcccacttgaaacaccactttttcacaacttaaaggttctgcactagcacgagcttttaataaccctctgggatttattctcggtagaaccacatatgtgttctacactttttttcactaattatatattgtgtatgttaaaactattttccacgttgttttgtctgtaaaactgtctttatcacataatgcttaatggttctttgtaccacacttttgaaaagtttctacctgtatataatggatgttaacccgtatccataaatcccttcgtataatctta

SEQ ID NO: 687219 - DNA, 638 bp, Homo sapiens
  misc_feature (306)..(306): n is a, c, g, or t
  misc_feature (471)..(471): n is a, c, g, or t
accaaggacccgccaagatgggccgtgttcgcaccaaaatcgtgaagaaggcggtccggtgtcgtcagtagaaaagtactaacggcgcgcgcgtgggtcccaatgaacttccgacacgtagactagcgacgttgatgctgaaggaaggatcgctcatatataccgccagacgaatatacacgtctgccgtcagacaagcataggcagtgtttactgtcagctgcgatctggagtgtagaggcgtaacttgcgagagagtgccctagtaatgaggtagtctgtcctattacagagacgtgccacggnaaggaaggagagatgacgtaacaaggaggaaagagcgaaatatactgctctacacgtggagagatcgtctagacacttttgggataccagggacgagtgtagtggcaagctgagaatacctgagcaactactgggagattgacgtgaatgcgttgtgggcatctntgcggcacagtatcatagtccaacagcgttcaggtgtcatcgtcatgtccgtaccagtttggggagatgatagctctcaaaaattgcaccatcgggaggtaacctgatgtcgacatttatatagctgttagttggctgcattagtcttcgatgacacattctgggac

SEQ ID NO: 687220 - DNA, 345 bp, Homo sapiens
  misc_feature (4)..(4): n is a, c, g, or t
tttnggattttaatccgcccctctatagggattttggcccctgaggccaaaaatttggcccgaggaggaattggggccccccccagtgcccagcaaccccttgttcccccgctctttcccctgtgggccccggggttggtttcccccagtgccaacccgagagctccttttggaccctgcccagccccccgccctgttgccccctgcccctgcccccgtggggacatggcagcccaaagccaaggttgggtgggcgggtgccccaaggaccctttttgggaaccccttttccccgggctgggaccaataaatccacccttgtttttgcagttggtgttgccccca

SEQ ID NO: 687221 - DNA, 427 bp, Homo sapiens
gtattcgggtgggtgtataaagtgagtcttcctctctcagctgtggctcttgcctccacttcatatcctgctgaagcctcacagatacagcactatgtcttggattctcaatctcagactgtaagcaaatatacttctgttattataaattacccagtctgcaggattctgttacagcagcacacaaggaactaaaacacactctataggcagtgactactcactgtttttaccggataactgctgggcaagggactggcttcaatgaagtactttctcagcagatgtttgctgggggtcaggactactccacgcaagatgtagtgaacagaaatagggcccattgctgaagcaggaaatattgcaacgtcttcattccctgacttgatgggcgcatacaggtggcagcgcacgatgacagggaact

SEQ ID NO: 687222 - DNA, 304 bp, Homo sapiens
cgtcgacctttcctgttacacgggccaagtgagattgtgggtaactatacaaaacatttctattatcttctaatgtgattaattttcaaggacacagaacctaccagaatatgtaatcaatcttggtgttagaaaatttcctagtaacagctaaaacacatgagagtgtttccttacaatggcaagctagccaagtaactgctacctaggccttaacattttgtctaggccttaatactttacctaggttccaacaaatcctagtgaacttaaaaggaaaaactcacacatgtgccgtcgacgc

SEQ ID NO: 687223 - DNA, 351 bp, Homo sapiens
atttttggagcccctccggtttgaacagaagatggtaccggtggagtgctaaaaccccccctatatggtaaatatattttgggttatgtagtaaaacaaatatgcatgtcattgtgacactttatttgttaaaacatggtagataatcacattttctgggccctgtaaaatagtgttactgtaatactctgttttgccccctgccttgtttacattaaacaggatatttggtaaatttttttgtatggaaagttgtgtaggttactgccagttttccccgcgtctgaaatttttggcccccccggggagaaaccctccagatggtctttgtttccctaccctctctccaaa

SEQ ID NO: 687224 - DNA, 243 bp, Homo sapiens
gtagaacacggccagcagtagatgcaacctttccataaacgtgtgtagctgtggtggtgccttctggcagaaaagcagagaatacactttgccttgttcatcacgaggggctgccgaaccccctcacccttaaatgtatgccgtcttcccagcccaccatccccatcgtggacatcattgctggcctggctgtcctgtcctgatcctacctgtcctgtccttatgctaggcgcgttaccgcac

SEQ ID NO: 687225 - DNA, 482 bp, Homo sapiens
  misc_feature (188)..(188): n is a, c, g, or t
aggatccggtctccccttcgtcggaagggatcactccacgtccgctcaggtggtagctagctataacagacttctgctcggaggagagtgcagcgaagaagagactagctctcaacgccgtagaacagaccggagagtgcccagtggcgcgccgtcggcgagtcagtttagcctgtactggaccgtgnaaccctgagcgctgaggctgtggggtcgcgggattctactgggcctcgccagcttccacagtctgctgcggtctgtggaatggggaaggataaaatacagactttggtttattttaaaaaatggtattctgcctgaactaccaggtccatggtttgcttttggcgcttgcagaagcaccaggacgatctttccaaaaatttctgcagtagtttaactaaccaatgaaataaatgaaggttaaaaaaccacaacagatcattttctcctcttgccctttatattatatttgttaa

SEQ ID NO: 687226 - DNA, 191 bp, Homo sapiens
tacgagtagccctccatttcacatccacatattcatcatcagccatttcaccatctccacttcccaggcaatcatcagtcatcatcgcgtccacacctccatcatcctccctcactcatgcctcagcacaggcacatcaatcactcatcgcatgttccattcatcagccacactcgcacacagcccccaca

SEQ ID NO: 687227 - DNA, 389 bp, Homo sapiens
tgcacttgcatttgcggtcgactctaaggtcccccgttacgaccctccgtaacgacgcctccgtaacgtcctaacgacgcctccgtaacgacgcctccgtaacgaccctccgtaacacgcccagactccacaagctgcgctggcgctcccgtaacgagcgccagcgcagctggtggagtctggggctgttacggagggtgttaggagggctcgttacgctgttaggaggcgtcgttacggacgagcgcccaactggtggagtctgggcgtgttaggaagcgtcgttacggaagcgctgttacggaggcgctcgttacggaagcgatcattacggaggcgctcgttacggaagctgttacggagggctcgttacggagggtaccgagctc

SEQ ID NO: 687228 - DNA, 125 bp, Homo sapiens
cgaatgacgacacgatatgatgctgacgtgctgcaattacagatacatctggcacatcatctatactctctgaaggagtcacctagtgagcgagtgcagatgacgcatggacatgccgcaagatg

SEQ ID NO: 687229 - DNA, 824 bp, Homo sapiens
  misc_feature (34)..(34): n is a, c, g, or t
  misc_feature (95)..(96): n is a, c, g, or t
  misc_feature (108)..(108): n is a, c, g, or t
agcggggctctcggcccaggctgcggtaaatccnggcttgcggccgctggcgtagtctgtggccgggtggtcgttgctgcgcgccccgagccccnngagccatgcagntgtcctacgccatccggtgcgccttctaccagctgctgctggccgcgctcatgctggtggcgatagctgcagctgctctacctgatcgctgctgtccggcactgcacgggcaggaggagcaagaccaatatcattgagcttctttccccacgaccccacggtccagtaggacacaggtcaaggacgcagctaccgcaccgcgctcggcctctggcaggcgtcctaggacgcctcccggccgacctaccccgcgatctacagcgcggccctgcctgaccgaaccacccactgcgacccacacacgagtgctgcatccctgcgcacaaggcaccgcccaagacgatgcaacaaccccatggcctgacaacccttgctccccgggctacctgacttgggcacagcggcctacgcgaaaccgagccaccctggcgctgatccccgctccgcttccccgaccagtaaccagcccgggccccaacccacaaatggcacgcgacacagccgggcaacgccctgccgcccacactcgcctagacaaggggacacacacaacaggctccggactagtggaacgcccacagggacaccactctctggggaagcccaccagacaaaaccattgggacgcgccagctctgccatgccgggccactcccggctccagagccggccaacagccgatcgcgacagggtcctgggaccaccccgctttccgg

SEQ ID NO: 687230 - DNA, 242 bp, Homo sapiens
  misc_feature (103)..(103): n is a, c, g, or t
ctttttattttttgtagagatgaggtctcattacgttgcccggactggtctccaactcctgggctcaagcgaactgcccccctaggcctcccaaagtgctggnattacaggtgtgagtcaccgcacccggcctatcttgactaattcttaattgtccttctagcccaactcaagcatcatatcctcagggaacttaccctgaaggtccaggttgacctaaatgtcccttctgtcgtcttctc

SEQ ID NO: 687231 - DNA, 355 bp, Homo sapiens
aggcccttttccctttttaaatctgccaaatctgattaccttgatgaattccggtgtattggatgtgtgaatataaaaatttgaattctcccggggggcttggtttttgtccaaggatgttggcagtgggcccttagttttcctccggaattgccatcatgttagactatattcggaaaaaatgctgggggatataattttgggtactgatataaaatcctccagatggaagtttagccgaattgtcccgggtagtccctagcgcttttatatgccttattttgtaatttgtttggtctgcggcccctttttataccttccatgtttccttttataaaaaaaataagccagtcca

SEQ ID NO: 687232 - DNA, 192 bp, Homo sapiens
gttccattggtctacatgtctgtttttatgccaataccatactgtttcgattactgtagctttgtaatacattttgaaaactggaaggttgatgccttcagttttttcttttgctcaaaactcctggccgggcgcggtggctcatgcctgtaatcccagcactttgggaggccgaggcgggcggatcacgag

SEQ ID NO: 687233 - DNA, 397 bp, Homo sapiens
ccttagagctctgtcatgacacagtagagctgttgcccacggcagctgactaactctgacttgcgctgaccagagaatacagcatgaattgtagccatgctgttgctgaagttactgtcgcacagtttcctgtttcaagcggaacgtgcttatgcaggcacaggatgatactatttaacacacttctttacaattagtagaagctgtgacaatacgtctgagatacagttagatgcttgtgtagcatgctccatatgagttccagtgcccttccacgcctgaggttgtattgcttggttatccctactgccggagtcgaggacctctttaggctactgagttttcctctggtgcggctatttctagacgttctccagttcttatagctcttttcctc

SEQ ID NO: 687234 - DNA, 367 bp, Homo sapiens
tcggaatcctcctcctcctgggtgacagagcgagactccgtctcaaaaaaaaaaaggaaaaagaaaaaagaaaaaaaaactggggtaaaggttgggggaccacttacactttaatttctatttcccatttttatggggctcctccacatctctccatgaccctctatggattatgacccctgtttcaaacttaatttacttaaggtttacttgggccatgaaactataatacccaataccggcttacaaactcctccgatatagtcattccaatatcctattggtcttcacaaagtctctggaaatctggcaaaattggtgaagggaagtaaggggcaaggagtgagctaaaacagcaagataggag

SEQ ID NO: 687235 - DNA, 159 bp, Homo sapiens
gaagacccagaattcgcagaggggactgggcgcaatgtcacacgaggacacacggaaaccgcctaacgatgaggagataatctcggaaaggttacggaaacctgggaattcggcgaatccctgcgatcagggtaaaatcagaagcagcggatgcggccg

SEQ ID NO: 687236 - DNA, 1025 bp, Homo sapiens
cgacgtggactatactctacaaaccacaaagacataggaagactatacctattattcggcgcatgagctggagctcctaggcagagctctaagcctccttattcgagccgagcatgggccagccaggcaaccttctaggtaacgaccacatctacaacgttatcgtcgacagcccatgacactttgtgaataatcttgccgttcatagtaataccacatcataatcggaggctttggcaaactgactagttcccctaataatcgggtgcccccgatatggcgtatgtccctcgcagtaaacaacagtaagcttctgactcgttacctccctctctccattacatcctgctcgcatctgctatagtggaggccggagcaggaacaggttgaacagtctacccgtcccttagcagggaacatactcccaccctggagcctccgtagacctaaccatcttcttccttagagctgagcaggtgtctcctctatgcttaggggccatcaatttcatacacaacaatatattcaatataggaaatcccctgcataacccaagtacgcaaatcgccccgtcttcgtctgatccgtcctaatcgacagcagtccgtacttctcctatctctcccagtcctagctgctggaatcagtatactacgtaacagaccgcaactcaaagcaccttcttcggaccccggccggaggagggagaacccaattctatggcaatatcgtatatctgagtttggcggtcaccctgaagttatattcttatgctaacggggttcggaatatttccaatgtaactactactccggaaaaaaggacccttggtcctcggcttggctgggcaatagaatcaatggcccagggtttcggggtgcgccgccatttttagtggaaaacagtcaccccgcggattatcccgggacaaaagacgagcccgcgagaagagtgtgcgcccggagaaaaacagaggcgcacacaaaatccggcggcgcgtggcaccacagactctgatcaaacgg

SEQ ID NO: 687237 - DNA, 111 bp, Homo sapiens
tcatacctgcactgatgtcatacctgcactgtagttcatacctgcactgttgttcatacctggtcgctgtatcggggggggggagagcgcggtgacgggtctcgctccctc

SEQ ID NO: 687238 - DNA, 335 bp, Homo sapiens
tctggcaaggaccctaagcaatggtatattctagtctgtaggctacttcttagatgcatgggaaaagcaatggctcccactaagggagggtgaaatgccagaattactctagcagctgctggaagaagggattgaaagattcacagaagtggtcttgctgtcgccgacctaccacctgaggccagtatactccccaaatgatacactcttcacgaaagccattttcctttcctacgcggctcaccagtctcactataaacccccgatgccccttctcataggcatctcatctgctcaatcgctgttcccagacccctcactacctttcctttcta

SEQ ID NO: 687239 - DNA, 473 bp, Homo sapiens
  misc_feature (473)..(473): n is a, c, g, or t
ctaattggttcttcgatgacgcctccctttggctgctacagccctcctgctctcttaacatcaggatttaagcctgatgttaaatgctgtaacatcagggagggatgtgaggtccctcccttgctgttaccctaggtttacagattttcattcagctctttttacaaactgcagattataaaaagcagtgacaaatttccactcgtctcgtcatcgaagaaccaattagcttctacgtctcatcactggacattcagggctcttctgagagccaggatgggagactttccctagctcgcctcacgaaggggatttcctgcagatgtgaatctgtttacctcaggttgggacttgaatccatgtgctgggacttgaacccagccaaaactcacagacctagtttcaggacctaatgaagctcaggttcttgatgtcttattgcagaaagaattcagtgatgagacgtagaaggn

SEQ ID NO: 687240 - DNA, 569 bp, Homo sapiens
aaatacaacatagaccgaaagatgtaccaatgcatagtagaagcacaggagtcccaatgcgcggcgatagcggatgaaattcaagccgaaaagctcacgtgccggcgagacggcaagtgttagaatgagaaaacggaccgtccagagcccgagaagctgctcaaaggccttgaccgggttggctccaagactgtcggttgcccccaagtaaaaataccaaacccctggcgttaggccgatgacgtaaagcagccagaccgaggcgctcttccagtgtcttgtgccagtgaacatgacggccatcagaagttcttccgcaggtccatgccggcgtaaaggctggcaacgtcttccgcatagccattgaacatcaaggttggacgccggtccgaactgaagaagccccctgtcccgatgcgtcgctcagttgcctggctccatcggggatgatcgacctcaggattaacgttggcaaaaaaaccatactcgcttggcgcgacgatattccaggtgttctttggctgcgtatcggtcaacgaaatacgaacaatcgatttgcgtcccttgaa

SEQ ID NO: 687241 - DNA, 371 bp, Homo sapiens
tcaaaaacaaaactaaaacaaaaaccaacacaaatgtagtacacaaatgaaaataattactgtgttaaacacagtttcatagaaaataaaagaccaatcaaatacaataagctgcctttttagatgggtatgttattcttctttcacagttaaagaaacaggctcagagaatgttatttgattggaccgtgttgcatttctggacagtgcagctgagatcagactttgtgtgtaactccactagcctaccagggtgcctctcataaagctaagaaatgtaaatttggactaatatacaaagttgccagggcagcactgggtcaattctacatacagtacttctatgttcatcaagggaaaccttacgggaa

SEQ ID NO: 687242 - DNA, 140 bp, Homo sapiens
tgacatggactgattccaacacagtgctctctttcccccttccctgacatcagcggaattgcagcatccctgcatgcctgtccatatacaacccctctttgaaaaaatgacacatgagaataaactcctacgaaagccct

SEQ ID NO: 687243 - DNA, 491 bp, Homo sapiens
  misc_feature (36)..(36): n is a, c, g, or t
  misc_feature (77)..(77): n is a, c, g, or t
  misc_feature (84)..(84): n is a, c, g, or t
  misc_feature (103)..(103): n is a, c, g, or t
  misc_feature (138)..(138): n is a, c, g, or t
  misc_feature (142)..(142): n is a, c, g, or t
  misc_feature (160)..(160): n is a, c, g, or t
  misc_feature (231)..(231): n is a, c, g, or t
  misc_feature (253)..(256): n is a, c, g, or t
  misc_feature (259)..(259): n is a, c, g, or t
  misc_feature (262)..(262): n is a, c, g, or t
  misc_feature (264)..(265): n is a, c, g, or t
  misc_feature (267)..(267): n is a, c, g, or t
  misc_feature (275)..(275): n is a, c, g, or t
  misc_feature (280)..(280): n is a, c, g, or t
  misc_feature (282)..(282): n is a, c, g, or t
  misc_feature (285)..(286): n is a, c, g, or t
  misc_feature (288)..(288): n is a, c, g, or t
  misc_feature (296)..(298): n is a, c, g, or t
  misc_feature (301)..(301): n is a, c, g, or t
  misc_feature (304)..(306): n is a, c, g, or t
  misc_feature (309)..(311): n is a, c, g, or t
  misc_feature (315)..(315): n is a, c, g, or t
  misc_feature (318)..(318): n is a, c, g, or t
  misc_feature (322)..(322): n is a, c, g, or t
  misc_feature (324)..(324): n is a, c, g, or t
  misc_feature (328)..(328): n is a, c, g, or t
  misc_feature (330)..(330): n is a, c, g, or t
  misc_feature (337)..(337): n is a, c, g, or t
  misc_feature (353)..(353): n is a, c, g, or t
  misc_feature (360)..(360): n is a, c, g, or t
  misc_feature (363)..(363): n is a, c, g, or t
  misc_feature (369)..(369): n is a, c, g, or t
  misc_feature (394)..(394): n is a, c, g, or t
  misc_feature (408)..(408): n is a, c, g, or t
  misc_feature (423)..(423): n is a, c, g, or t
  misc_feature (491)..(491): n is a, c, g, or t
agggatttatagcaaaccctatataaagtgaatganttaatacacagagtgaagatgactagggtagaataatttcngaaaatntcaaattacagcacttganacaaagactgatgataactatctgtaccataaaantttncatgccacgaaaacattnatttttaattttaaatttttatgtaaaacatagttataaaaagagtattacatttattataaaccagtganttactcagagaaatatttatcnnnnccnacncnncnccagtaantattncnccnncnggcccccnnnagnagnnnccnnnactntcntttntngggngnggggggngggcgggggggggggngttttcnggnggctgngtctactccttgatattttggggcngcttcaacaaatgngactcaataacctgntgaacacttctatagcctagggctacagctagatccatagaattatatccagagtcagtttcaattgn

SEQ ID NO: 687244 - DNA, 314 bp, Homo sapiens
ctatgatcagactagtctaaccaaatactctttatactctttcttttttttgggtaagagagggggtctccctatgtggcccaggcgggtcctgaagtcctgggctaaagcaatcgtctggctctcacctcccaaggggcgggcagatcacctgaagtcgggagttggagaccagccggaccaagagggagaaacccggtctctatcacaaaaggcaaaatgaccggggcgggggggggggcaccttgtaatcccagccatttggaaggctgaggcggaagactggcttgaatccaggaagcagagattgcagt

SEQ ID NO: 687245 - DNA, 949 bp, Homo sapiens
  misc_feature (1)..(1): n is a, c, g, or t
  misc_feature (66)..(66): n is a, c, g, or t
  misc_feature (93)..(93): n is a, c, g, or t
  misc_feature (120)..(120): n is a, c, g, or t
  misc_feature (124)..(124): n is a, c, g, or t
  misc_feature (126)..(126): n is a, c, g, or t
  misc_feature (128)..(129): n is a, c, g, or t
  misc_feature (148)..(148): n is a, c, g, or t
  misc_feature (150)..(150): n is a, c, g, or t
  misc_feature (160)..(160): n is a, c, g, or t
  misc_feature (174)..(174): n is a, c, g, or t
  misc_feature (187)..(187): n is a, c, g, or t
  misc_feature (210)..(210): n is a, c, g, or t
  misc_feature (215)..(215): n is a, c, g, or t
  misc_feature (225)..(225): n is a, c, g, or t
  misc_feature (232)..(232): n is a, c, g, or t
  misc_feature (268)..(268): n is a, c, g, or t
  misc_feature (283)..(283): n is a, c, g, or t
  misc_feature (285)..(286): n is a, c, g, or t
  misc_feature (290)..(290): n is a, c, g, or t
  misc_feature (298)..(298): n is a, c, g, or t
  misc_feature (302)..(302): n is a, c, g, or t
  misc_feature (334)..(334): n is a, c, g, or t
  misc_feature (353)..(353): n is a, c, g, or t
  misc_feature (382)..(382): n is a, c, g, or t
  misc_feature (386)..(386): n is a, c, g, or t
  misc_feature (388)..(388): n is a, c, g, or t
  misc_feature (407)..(407): n is a, c, g, or t
  misc_feature (424)..(424): n is a, c, g, or t
  misc_feature (430)..(430): n is a, c, g, or t
  misc_feature (435)..(435): n is a, c, g, or t
  misc_feature (480)..(480): n is a, c, g, or t
  misc_feature (494)..(494): n is a, c, g, or t
  misc_feature (536)..(536): n is a, c, g, or t
  misc_feature (540)..(540): n is a, c, g, or t
  misc_feature (547)..(547): n is a, c, g, or t
  misc_feature (552)..(552): n is a, c, g, or t
  misc_feature (556)..(556): n is a, c, g, or t
  misc_feature (578)..(579): n is a, c, g, or t
  misc_feature (593)..(593): n is a, c, g, or t
  misc_feature (605)..(605): n is a, c, g, or t
  misc_feature (609)..(611): n is a, c, g, or t
  misc_feature (643)..(643): n is a, c, g, or t
  misc_feature (666)..(666): n is a, c, g, or t
  misc_feature (670)..(670): n is a, c, g, or t
  misc_feature (682)..(682): n is a, c, g, or t
  misc_feature (718)..(718): n is a, c, g, or t
  misc_feature (731)..(731): n is a, c, g, or t
  misc_feature (745)..(745): n is a, c, g, or t
  misc_feature (752)..(752): n is a, c, g, or t
  misc_feature (866)..(866): n is a, c, g, or t
  misc_feature (916)..(916): n is a, c, g, or t
naacacattgcattttccacttacaatacagtgtttataaagcgcaatgccattcccctcccctgnccatatgtcccatattcaagtattganaatgcccagtaacttactatagcagcntaantntnnaaaactgccacaaaatttncnacgaatttangtccttcaaatgtnttaaatgtgtggnacaatgctacatctacacttggntgggntggtcggccncttgggngggggggcctgggggggcgccacggggggggggggntccaccaccaggggntnncccnggggttcntccngggatgcgtcctgcgctctggtacagcttggngatggtggggttgcgaacnttctccagctctttctgttggtgttcaanttgntncttctcggcagtgtgattnttatcaagccagtgganaatttngttanacttgtgcagaatcttctgtttgtgctcatcgttaatcttagacntatgaaggtttctnaatcttcaacagttagactattcatgttagaagagcaatagngaantccaagnggaantctngggatgaacaccttgtgccctnngtcttctcaatctntcaggctttganactnnncagacttcctgggaccataagtttcaatggtnttcacttgtctcaaaaggaaccnagancattagatgaanagataatcttgcttctctttttcccggtactcttgntccacagcagagnacattgagatatancattggncatcaatgtacaaaagtgactttcaatctgaggaacacctcggggtgcaggaggtatgcctgtgagttcaaacttgccaagcaggttgttatcctttgtcatggcacgctcgcnttcataaacctgaataagcacaccaggctggttgtcagaataggtagtgnaggtctgtgtctgcttggtaggaatggtggtat

SEQ ID NO: 687246 - DNA, 139 bp, Homo sapiens
tgtcagtcgctctggcctctcctcccagttcaacccaaaaaggcataattaaactttacttcctctctttcttcttctcctcttcttctctctcttgcctctatgcctgtatttctggcaatatgacaggcctgcctac

SEQ ID NO: 687247 - DNA, 205 bp, Homo sapiens
  misc_feature (111)..(111): n is a, c, g, or t
tggttttgtatgaggtcagtgctggtggttaagcagcggcgtgccgtcccgcaggcccctggtacagtgaacttgtcagtgactttcagaatgttgctttcgtgcttcttnaacatttcctctcttgagctaggattgttacagaaccccgggtgcgtactagcctgatataggtatcatgtggtcctggctaagacaggaggaa

SEQ ID NO: 687248 - DNA, 200 bp, Homo sapiens
gggtgggtcagggtagaagcggggaagggatcacacgtggaggaagaagtcagaagcagagacaaacgccggtgtcactgctgtaccaagatcaacctagggggttacacaccacagtcgtgtattcatacggggctgtctgtggacactgtcgggctagtcgggggggtagcgaggcgtcgaggttcgtaactcatggt

SEQ ID NO: 687249 - DNA, 440 bp, Homo sapiens
cgactactactactaaattcgcggaagtcgagaaaattcttaaaagaaaaaaaaatgaaagcgggtctaagagacagagacaacttttttccccaatataacaaaccagcttttggaggtagagatttatttcttattaaaaaatggaaaataatatttatttggccaggtaaggtggctcacgcctgtggtcctaggactttgggaggctgaggcaggcagattgcttgagctcaggagttcgagaccagcctgggcaacatggtgagaccccgtctctacaaaggtacaaaaattggccaggcgtggtggcacttgtctgtagtccaaggtacttgaaggcctgaggtggggggatcacttgaacctgggtggtcgaggctgcagtgagccgagatcgcgccactactccagcctgggtgacaaagtaagaccctgcc

SEQ ID NO: 687250 - DNA, 174 bp, Homo sapiens
ctcccaagcaaggcagctgtctcacactttagcaaggctgtgagagacacatcagagccctgggcacgtcactggttggagcctgagagtagctccctccttttctatcgtgagctcttcctcctccacctcacagcagcgagcacagctccagcgaacacagctccaaagaga

SEQ ID NO: 687251 - DNA, 475 bp, Homo sapiens
tgccacacacatggattgttccattccccagcacctttccacaatagccaaagaccatagaatccaatcctaaagggccccatgataacagattgggttaaaagaaaatggtgggtatgtataccatccatgggaatactatgcagcccagaaaaaagaacaagatcttgtctttgcaggacccatggatggagctggagacccattatttttagcaaactaatgcaggaacagaaaatgccacgtgttcccacttatacgtgggagctgaatgatgaggactcatgagcacaaaaaagggaacagcaaatactggggcctccttgagggtggaagctgggaggagggagaggagcggaaaaaataattattgggtactaggcttagtacctgggtggtgaaataatctgtacgacacacccccatgacaagaatttacctatgtaacaaacccgcacatgtaccccagagtcta

SEQ ID NO: 687252 - DNA, 832 bp, Homo sapiens
  misc_feature (90)..(90): n is a, c, g, or t
  misc_feature (95)..(96): n is a, c, g, or t
  misc_feature (99)..(100): n is a, c, g, or t
  misc_feature (112)..(112): n is a, c, g, or t
  misc_feature (126)..(126): n is a, c, g, or t
  misc_feature (134)..(135): n is a, c, g, or t
  misc_feature (141)..(142): n is a, c, g, or t
  misc_feature (153)..(154): n is a, c, g, or t
  misc_feature (161)..(161): n is a, c, g, or t
  misc_feature (163)..(163): n is a, c, g, or t
  misc_feature (216)..(216): n is a, c, g, or t
  misc_feature (224)..(224): n is a, c, g, or t
  misc_feature (524)..(524): n is a, c, g, or t
ttcaggtggtggaggaaaaggcgctccgtcatggggatccagacgagccccgtcctgctggcctccctgggggtggggctggtcactctnctcgnnctnnctgtgggctccnacttggttcggagntcccgccnncctcanntcactctcctnnaccccantnaaaagtacctgctacgactgctagacaagacgactgtgagccacaacaccaanaggttccncttgtgcccttgcccaccgggccaaccagcacgtctggggctgccgtgtagggcaaaccagtatcgtaccgtctccagcccggaattgatggcagcgctggtcatcagggccatacactcctgtcaccaggtgatgaggatcaaggctatgtggactcgtagtcatcaagcgtctacgctgagagggctgtgcaccccaagatttcctgagggagggaagcatgtctcagtacctggatagcctgaacggttggggactgctggatggagctttcgggggccaagcgggcttgcgtcacnttacgactggaaaagggcagtataaacagttcagcccaacaagaaatcgtccaccagaaccgccgagctggcgtaagaaacgtgggacatgattgccggcgggacaggaatcagccgaatgctacggctgatccgggccatcctgacagtccctgaagatccaatcccgagtgctttctgcttgtgtgccaaccagtagcagagaaaggatatcatcttgcggggaggacttagaggaactgcaggcccgggtatcccaatctgcttttaagctctggttcacgtctggatcatcccccagaagactg

SEQ ID NO: 687253 - DNA, 139 bp, Homo sapiens
cacaggctttggagcttctcaccatctatgcctgggagcaggggagtggagtgcctggattttgacactgccgaaggtttccggacgtcctggcgctggtcacactatgtcgggtgctctgcatcccctgcgaggttta

SEQ ID NO: 687254 - DNA, 242 bp, Homo sapiens
  misc_feature (227)..(227): n is a, c, g, or t
tctctccacacgggaagtgaaaagagtaatatgtctgcttctcagcttacattaggtattcttatttttctatgatagttcaattatattaatatttattacagccataaatgtttcagaccaacacaatctatttttggggggtggggtgtggtaggaggagaaaaaggaagataatcctagggcaaatggagagaattctagaagaataacctatttagatgttngccagtgtggagaga

SEQ ID NO: 687255 - DNA, 337 bp, Homo sapiens
  misc_feature (90)..(90): n is a, c, g, or t
  misc_feature (95)..(96): n is a, c, g, or t
  misc_feature (99)..(100): n is a, c, g, or t
  misc_feature (112)..(112): n is a, c, g, or t
  misc_feature (126)..(126): n is a, c, g, or t
  misc_feature (134)..(135): n is a, c, g, or t
  misc_feature (141)..(142): n is a, c, g, or t
  misc_feature (153)..(154): n is a, c, g, or t
  misc_feature (161)..(161): n is a, c, g, or t
  misc_feature (163)..(163): n is a, c, g, or t
  misc_feature (216)..(216): n is a, c, g, or t
  misc_feature (224)..(224): n is a, c, g, or t
  misc_feature (247)..(247): n is a, c, g, or t
  misc_feature (257)..(257): n is a, c, g, or t
  misc_feature (260)..(260): n is a, c, g, or t
  misc_feature (267)..(267): n is a, c, g, or t
  misc_feature (329)..(329): n is a, c, g, or t
ttcaggtggtggaggaaaaggcgctccgtcatggggatccagacgagccccgtcctgctggcctccctgggggtggggctggtcactctnctcgnnctnnctgtgggctccnacttggttcggagntcccgccnncctcanntcactctcctnnaccccantnaaaagtacctgctacgactgctagacaagacgactgtgagccacaacaccaanaggttccncttttcccttcccacctcccacnacacactttntcntcccttnttcaaacaaaaccacccccccaccctaaattatgtgcatgcctttgacaacatgtgccaaanacaccttg

SEQ ID NO: 687256 - DNA, 305 bp, Homo sapiens
catcaccccttcttctgcttccgatctcctgcgatcgctgggcatcccggcgccctgcacccgcctggctcatttatttgtatttttagtagagatggggtttcactgtattagccaggatgctctccaatctcctgaccttgtgatccgcctgccttgaactcccaaagtgctgggattacaggactgagccaccacgcctggcctattttatttcagtataagttactgtagtaattaactggaaactatgtacctggcagtgaaatctattcacagcaaacttactccctgaatatcccccc

SEQ ID NO: 687257 - DNA, 106 bp, Homo sapiens
cggatccgttgcggctgcagctctgcagtcgggccgttccttcgccgccgccaggggtagccggtgtagcttcgcaagtttagcgcgggtgttacccgaacccatg

SEQ ID NO: 687258 - DNA, 798 bp, Homo sapiens
ctggtacgcctcggagtaacgggatagtgcgctgtgctcgaggggtgcctggccatggcctgagcgagcgagtctagccatgcaggggtgagggggctgctggctgtctgtgcggactgagacaggcgaacccgacgcagaagagtccaccaccggacagccagcacatccacgatggagcgtcttgtcgcccgtggtgaccttcccagatactattgtgctgcaccagcgcctgcctgcgagcgctcttcgtggccggtggaccacgatggagctgagccgcgagctgcaggccctgcctggccgagctgaactgccgaggaccagaaccgcctgggattacgacttccagcgaggacatgcctgctgctggggcccttggacgcctgcagtggaccgaacgtggacatgcgactcggtgcccgcgttctaccgcgagacggtgcaggtggggcgctgccgccttgctgctggtgccggcggcccgtcgcggtcgcgggtggcatgtcatgccccggacacgtcggagaccgggcgcggctgaagtcccctcgaacgggcttccgagggggaagggcggcaccgggaagcataggcattggccctatagggttgatcccccgggaattccccagtgggtcacagtgagcgatatggaacgcgaccaggagggactagtgagccggcggtggacactgggatatgcacaggaagtagggggacggtaggaagtaccgcgtgcacggtgagtcagctagagataacagaaaacactgatgactacggtgagaggcggta

SEQ ID NO: 687259 - DNA, 180 bp, Homo sapiens
ccggtctcgtacgtgctgtcgcgcttgacgtggatgcggcggacacggtcccgcagttccacggtctcctcactcttcactgggggaagcctggctgcggctacggcttgtggactccaacaaggagttgtcggggacgcggggagtctacatagagtaggacgttgagtgtctcctcat

SEQ ID NO: 687260 - DNA, 369 bp, Homo sapiens
ccagaatctgtttggcaagtcagggttctcatacaggagacttagtgaacaaagcaagagaaaatgctcagggtccaagtgcagtggctttatgcctgtaatcccagtactttggaaggccgaggtgggcagatcacctgaggtcaggagtttgagaccagcctgaccaatatgatgaaaccccatctctactaaaaatataaaaattacccgggtgtggtggtatgtgcttgtaatcccagctactcgggaggctgaaatgggagaatcacttgaatctgggaggcagaggttgcaatgagccgagatcgcgccattgcactctagcctgggcaacaagagtaaaactccatctcaaaaaaaataaat

SEQ ID NO: 687261 - DNA, 184 bp, Homo sapiens
atcatgaagtgagcaacattggggtttcctggggacaaggtggagtcgggcaatgggagagccctgtctgttcacatggactcagccttctcagcacctggtctggctttggtgctgacaaagaatagccttgtatcagatcaacacggagcctgatgggcctctcggaagtgctgtggacaaa

SEQ ID NO: 687262 - DNA, 1078 bp, Homo sapiens
gcctcatgtagccattcgtaatcgcaatgggattcctaatgcttaccgaacgacacattctaggctatatacaagctacgcaaaggccccaacgttgtaggcccctacgggctactacaagccttcgctgacgccataaaactcttcacccaaggagccccgtaaagacccgccacatcgtaccagtcaccctctacatcaccggcccgagcttagctcgtcacaccatcgcatcttctactatgaacccccacatccccagtagccaagccccatggatcaaccgtcaacgctagggcctcctgctttattgctacgccacactctgcgcctacgacgtatactcacactcctcatgatcagggtcgagcatcaaacctcaaacctagcgccctgactcggcgcacatgcagagcagtacgcccaaaacaatctcatctgaagtacagcctaggcgcagtcattctagctatcaagcatggacctaataagtggctccttgaagcgtcatccaaccttatcacaacagccagaacacctcctgaatgactcctgccatgcatgacccttggcataatatgcttgatcgtccaaaatacagacagagacacaaacgaaaaccccatacgaacattgaccgaaggggagatccgaacataagactccggactacaacagtcgaatacagcacgaaggcacccataccgaacctaacatacatagccagaaacacacaaaacatgcactgcataattaaaacaccacttcaagcactcacaggttcttgcctagagaaccaagcatatgaccgcaccgtctccccatgaaaatctacgagcaaccatcatctaaggccaccacaaggagacctaaagagagtacaccactcagcagtggcgtaatcgaagtcgagcaacaggcgataccccccgggaaaccagataaggagacgacgacaacaccagagcgcccgatgacaagacagtgcgtaagcagagaaaaacaataagcaatagcagagcctatgcagactggctccagtaacacagaaccaaggatccgagcaatccccggtcaa

SEQ ID NO: 687263 - DNA, 175 bp, Homo sapiens
aaatctgagtatttcgtgtgctggtgagaggacagcgctgcccagaacatactgaaatacaggaggcatctccttaagctggtttgcaagtggactgcctgtaacatctttgggcacatcaaaaatcttttcaatttttgggtatgcgcacttgtcagccggtaaaatatgtgca

SEQ ID NO: 687264 - DNA, 400 bp, Homo sapiens
cgtcgacagaacctatgtgaagaattcttcctgttggatttgtttatttgttttgttttctgagacaggggttctctgtgtagttcttcctgaaactctgtgtaggctttcctaaaactcaatttctaggacagacagacttgcctccagctcagagatccatccatctgcctctgccacctccgtgattggataaaaggtgtgcaccactgtgccccagcgtagatagaatttttaaaaaactgtttaatatgtagtccaggttggctttgtgtttgtttggtttggtttgaaacagggtctctgtggagccctggctggcctggaactcagtatgtagaccaggctggcctcgaactcagagatccgcctgcctgggattaaaggggtgcgtcgacgc

SEQ ID NO: 687265 - DNA, 248 bp, Homo sapiens
ctcgataagggccaagcgtgtaatccagcacttggggagaccgatgtgcagccaccacgtcctttttattttattgtagagatgaggtccttgctatgttgcccaagctggtcttgaactccggggctcaattgatctccccaactcagcctcccgagtagctgggactgcaggtgcccaccaccacgcctggctaattttttgtatttttggtagagacggagtttcaccatgttggccttatcgag

SEQ ID NO: 687266 - DNA, 105 bp, Homo sapiens
gttacaaccctatggaagaagggaccgccactccaatcatgtcacaaaaactttaaatggcaatcgcattcaccgaagggcgaaggacaggccgagctaaatgca

SEQ ID NO: 687267 - DNA, 1036 bp, Homo sapiens
  misc_feature (77)..(78): n is a, c, g, or t
  misc_feature (120)..(121): n is a, c, g, or t
  misc_feature (155)..(155): n is a, c, g, or t
  misc_feature (166)..(167): n is a, c, g, or t
  misc_feature (176)..(176): n is a, c, g, or t
  misc_feature (181)..(182): n is a, c, g, or t
  misc_feature (203)..(203): n is a, c, g, or t
  misc_feature (205)..(206): n is a, c, g, or t
  misc_feature (221)..(221): n is a, c, g, or t
  misc_feature (253)..(253): n is a, c, g, or t
  misc_feature (257)..(258): n is a, c, g, or t
  misc_feature (260)..(261): n is a, c, g, or t
  misc_feature (314)..(314): n is a, c, g, or t
  misc_feature (363)..(363): n is a, c, g, or t
  misc_feature (411)..(412): n is a, c, g, or t
  misc_feature (478)..(478): n is a, c, g, or t
  misc_feature (493)..(493): n is a, c, g, or t
  misc_feature (563)..(563): n is a, c, g, or t
  misc_feature (641)..(641): n is a, c, g, or t
tgtcctgaatggtgagctgtgagcgcagcctggcctgtggtgcccggtcgagcccgcgccatggcggccgaggtganngctgtggccggaagcggggctgttggcggctgcctggccaanngacggcttgcagcagtctaatgtgccctggacantaccccaaaannggcggcgcncctcnntcgctgtcgcgtgacgccgangnngccgagcctaccaantggtgccgggagtacttgggcggggcctggcngccnnanntgcatccctgatggagctgagtggtttaccccgtgagcggaggcctcagcaanctgctcttccgctgctcgctcccggaccacctgcccagcgttggcgagnagccccgggaggtgcttctgcggctgtacggagccatcttgcagggcnntggactccctggtgctagaaagcgtgatgttcgccatacttgcggagcggtcgctggggccccagntgtacggagtcttcncagagggccggctggaacagtacatcccaagtcggccattgaaaactcaagagcttcgagagccagtgtngtcagcagccattgccacgaagatggcgcaatttcatggcatggagatgcctttcaccaaggagccccactggctgtntgggaccatggagcggtacctaaaacagatccatgacctgcccccaaatgggcctccctgagatgaacctgctggagatgtacagcctgaaggatgagatgggcaacctcaggaagttactagagtctaccccatcgccagttgtcttctgccacaatgacatccactcctcatcctgactccaccctcccactccttggatttctcctggagcctccagggcaggaccttggagggaggaacaacgagcagaaggccctggcgactgggctgagcccccaagtgaaactgaggttcaggagaccggcctgttcctgagtttgagtaggtccccatggctggcaggccagagccccgtgctgtgtatgtaacccaataaacaagcttttttttca

SEQ ID NO: 687268 - DNA, 398 bp, Homo sapiens
gtcattacctggcagaggcaaagaaaggtgagaccctctcccaagaggagcagagaaaactggaagaagatttgctggagatgtacagcctgaaggatgagatgggcaacctcaggaagttactagagtctaccccatcgccagttgtcttctgccacaatgacatccactcctcatcctgactccaccctcccactccttggatttctcctggagcctccagggcaggaccttggagggaggaacaacgagcagaaggccctggcgactgggctgagcccccaagtgaaactgaggttcaggagaccggcctgttcctgagtttgagtaggtccccatggctggcaggccagagccccgtgctgtgtatgtaacccaataaacaagcttttttttca

SEQ ID NO: 687269 - DNA, 1055 bp, Homo sapiens
ggctatttctgacgggtcgctccgcgaatatgcagctcaattgccgatggacgatcaaacccgtagatgctgagatcgataagtgctgtaaccctgggcctgggggtcgaccgcgtcgcaggtgaggcgctttcgtggaacgctggcgtggggcctgcgagaagaaggacgtcctcgtggcgctcggctggccagtcgcactgccatgacgcgcatggtgactgactgtgttcctccgtcacggcccagcagtgagaagcttcagagaagagagaacgccgattgatatgagcgtgatacgggatcgaatggaacgttatgtccatagaaagtagtactttcatggaagggcccagacccattcggggaactctcccttggttcgtgtaccaaatcgggactttacttcaactgcagcgtggaccaaataagtccaagaacagaacgtgaggacttctgagcgatcgtgatcacgtgtcgtgaaaacgagtatctcgtttactgagatagctagatgagaccacagtggtccgcctgaacagacgagaggcaataatggcttctgcaaagcgaactgacggccactacagggcacgtcccatgattgccgtgggagccgcgaacggccaattgctcgcggtacgactgatcaatggctgacacttttcgcattcttctaatctcctgctatctaagcacacctgtgggcattgcgcccagcccctactagtgcatactttcactggcaccgacgtggccctttgctcgcggctggacaaccattgcgcgcccacgcttccacgaaggcacacgctgtggctggacatggcaccgccttgtcccacacggctcctggcaccgaacacaaatttctacctcgcaagcccgcttgcaggccacacggaggaaatgtacccggctatcctcttgccacgcttgggcttcgtcttgcccaccgggcagccctcaattcgcgtcttggtggggaagtgggaccttctcggcttggattttccccccatacgttcccctttcacaccatcgaagcacatatc

SEQ ID NO: 687270 - DNA, 121 bp, Homo sapiens
tatagcagctttattcataattgccaaatcttgtaagcaaccaagatgttcttcaacaagtgaatggataaatgaactgtaatatgttcatacaatgaaatacggcagggcttgatggctc

SEQ ID NO: 687271 - DNA, 993 bp, Homo sapiens
gtctttcccttcggtgtgccactgaagtatcctggtgtcgccatgggacgcgcccgtccgtagttaccggtatggtaagaacaagccgtacttgcaaagtctcgtatttcggaccggggtgtccctgaatgcgcaagattcgcattttagatcgggagtgcggaagaaggcagaagtgggatgagtatctcgcgtcgtttgatggtccatcaatgctggtcagaatgagatcatggaggcagggtgatcgctctgcaaagacccatggcagggcgtggcgcggagattgtgtgccagaattaaagatagctactgtgctaacacaaggtttgtgagctaagagagtgtgctctccagttatccggggtgcggcatccatccccttccacagtcaatttcgctttcaaactagattgttgtcgctgtgcgtggggctggactaggctccaaagcgaggcaatgcgaaggggcctttggatcaggccccaaggggcaactgtgcgacatgggctgtcactatatggcgaagttactcagtgtccatccgcaaacaatgcgtgcgagaactaaggaggcgatgtgatttgaggccctgcgaggggccaggttcaagggtttcctgagccggcagaagatccgcagctcagaggaggtgggggttgcaccagagtctcgatgctcgcgtgaattgtgcggactctcgcggggtggcagaagccggtcaagtcccagaatgggctgggggggggcacgggcagtcccccaataggtgggccttctggtggagggggggggcctgggctcgtaaaggggccgagtggggggggccccactttatatccgaaaaatgtcctgccctgtcacaaaaaagggaaaagggcacaacgaggacaccagggagaagacacggaaacagaaatgtacaaaaaaaaacaggggggggaaaaagaaaatgcggcgcaaaaagagggagacgggggcaacacgggaaaa

SEQ ID NO: 687272 - DNA, 971 bp, Homo sapiens
gcaatatggtgtgcaggcgcttcgtggaggttggccgggtggcctatgtctccttatggacctcatgccgtggtgaatggtcgcgcatggtagatgtgatctgatcagaacaggtctttggtcgatggaccttgccctcaagtgaggatgacgggccatgcctttcaagtgcatgcagctcactgatttcatcctcacagtttccgcgacaaggtgcccaccagaagtatgtccgcacaagcctggtccagcaaggcgagcacatcaatactgaaatgggtagccgacacgatgggccacgaagattgaggccagaggaaaggaaagccaagatgacagatttgatcgtttcaagagttatgaaggcaaagaaaatgaggaacagaataatcaagaatgaagttaagaagcttcaaaaggcagactctcctgaaagcttctcccatgaaaagcacctggtactaagggtactgctgctgctgctgctgctgctgctgctgcgtgctgctaaagttccagcaaaaaaagatcaccggcgcgagtaaagaggctccagcccaatgaaggttcctggccagaaaggcacaggccagagagcagcgctgctccaaaagctcagaggggtcaaaaagctccacgcagaaagcacctgctccaaaggcatctcgcaaggaagcattaagtggcagtcattacaaagcaaacgaggttctttctgacccgtcgaaaagagaaaaacaacgctccggggccatcatggcggggccgcggcgaggggacggatggccctggcttagttggtccgacccttttttgcccaagtggaaaacggcggcccatagggaggctaaacgaacgcgtgacgacattccacaaacaggtgtgcacccgggcgctccagtcggagtgcaacaaacaccccagatccaaacatgcacagtgctgtctcaacccacatattactacaacca

SEQ ID NO: 687273 - DNA, 936 bp, Homo sapiens
tgaaacaggccttcttactggatgtacagaatataagagccatccaccagcatctcctccctcctgtgcagcaatcactgaaatttgtgagggtgaggaatacgttaagacaaagtgtctggaccctccagcaaacaagcaacaagttgccggagaaagtgaagaagatccttgcctctttggactctgttcagcatttcctcaccaataacgtttccctcatcgttatcggggaaacgaagaagtttgggaaaacaatactaggctactttgaacattatctgcactgggtcttttatgccatcacagagaagatgacatcctgcaaacccatggccaccgcgatggactctgctgttaatggcattctgtgtggctatgttgcggaccctctgaatttgttctggttcggcatagggaaagccacggtgctcttacttccggctgtaatcattgctatcaagctggccaagtactatcgcaggatggattcagaggatgtatacgacgacccgtctcgatactgacaactggagttgaagctgcttgaacaacaagatagtcaacatggaaagcatcacagattttggatagttctgagtcttctagaacgttccaagtgcagaagaacactgggtgggactccagcggcactagaacatgggatccgtggtcttacggtagccctttgtccgatgaaccgcttcatggtgttaattcccccttttccttgccattctgaatgatctccgccgggtgggctcacctttctttcccggtttccatttgcacctaacttgtggggctgttcccgggggaatttccgtgaacccttccgggcaccggccccctctccttgtgtgtggtccccccccaaagtttgttggacagcttttcttccccgtcagaacctttaccagagggggggccccgcac

SEQ ID NO: 687274 - DNA, 202 bp, Homo sapiens
gattagttcgagtcggatgacccttcgttgaggtctccgagttgtgaataggcggggacaatggacgagccgggtgggctggaggtgaagtgtcgtgatgctatgggtccagggtagtggatgaggagctgtaaatgagatgaaaggtatgtctgcttggggaagaagttgggccagtatgagtggggcagtacaaggttat

SEQ ID NO: 687275 - DNA, 266 bp, Homo sapiens
aatccgtaccaaaataaaatcaaaaaaagcctgcatagatggatcacagccaaatctaccagacatacaaaaaagaactagtactaatcctgctgaaactattccaaaaaaaaaaaaaatcagggaggaagggttcctccccacttcattctatgacgccagcctatgcgtgataggcaaccaaaacaaatatttcctactgattgggcaaatgtgtcatgacaaaaattcccaagtgtatattccccattcataacatagattgg

SEQ ID NO: 687276 - DNA, 866 bp, Homo sapiens
aagctactttatctccgtacgccttctctcctacctaagtgcgtgccgacacccgatggaagattcgagtggacatggacatgagccccactgaggccccagaactatcttatcgcgttgtgcactaacaggccgacaaagcattatcacttataaggtggataatgatgaaaatgagcaccagttatctttaagaacggtcagctttaggggctggctgcaaaggcatgagtatgcacattgtctgacagcagcaggcaatgcaattacgcacaggcagtccacattaaagtaacactggcaacttcgacaaatgtactgtacagcacaaccggtttacccgttggagggccttatgacaataacaccacacagtaggtctataaggtctgaacgtgtaggtatcagggcccagtgcatattcagtggcaccagcaactctagctaagctgcaggcaggaagcatgcccgcagctcagcacagatgcaagaggcagcgaggcatggtgaacctctttcacagtatatactggacacagcgcgacgatgcccacatgagcaggatgggcaggcacagggatcccaccacgcagaaaaaaagccaccacaacctggcacgaatcaatgacacactgaccagacgaacgaatgcatagcaagacgcgactggaaagacctgcaagggaactgaagtgagagaagggaaacccagaaaatagacacagaaatgcgaggacaacgccgacgaggacacaaaggcaggaaccagaaggaaaggaaacgagcagtaaaaagggccaaaaatcggatagccaaggcaagacacaatagccacaaaacagcacaaaacagaaagaaccatggga

SEQ ID NO: 687277 - DNA, 298 bp, Homo sapiens
gggggacattttgtcttgaggcgggtctgaccgtcgccagccatgaagtgtagtggcgcgatcttggctcactgcaacctctgcctcctgggttcaagcaattctcctgcctcagcctcccaggtagctgagattacaagcgcacaccaccacgctcggctaattttggtatttttagtagagacggggtttcaccatgttggccaggatggtctcgatttcttgacctcatgatccgcccccacctcagcctctcaaagtgctgagattacaggcgtgagccaccgtacccgacctc

SEQ ID NO: 687278 - DNA, 117 bp, Homo sapiens
tgtgggtctcttcttgacagaggtagagcatcgatccatagttggaggagatgagacagagggaagtgtgagagggagtgcctaaggatttgcccagaggtgaaggtgcatgactgt

SEQ ID NO: 687279 - DNA, 186 bp, Homo sapiens
taaggtgcgctttctataggagtgtgatctaatactcaagcctgaaggaaaactggaattattcaggtgaatgggcgggtgtcaagaagtgtagagagtatgacatttgagaacccttgaaagtagttcagatgggccttcatgcttagacggaggagggagtatagtgcgaaaccaacagacggt

SEQ ID NO: 687280 - DNA, 337 bp, Homo sapiens
  misc_feature (332)..(332): n is a, c, g, or t
ttttgagatagatcgagtctcactctgttgcccaggctggagtgctgtggcgtgatcccagctcaccgcaacatacgcctcctggaatcaagcacctctcccgcctcagcctccggagcagctgggattacaggcactcgctaacacgcctggctaatttttgtattttagtagaggcagggtttcaccatgttgaccaggctggtctcaaactgctgacctcaagtgatcccctgtcctcgggctcccaaagtgctgggattacaggcatgagccaccacgcctggccgagaattgttaactaggaatcaagttgataaccaggcaactanaaagg

SEQ ID NO: 687281 - DNA, 1060 bp, Homo sapiens
  misc_feature (694)..(694): n is a, c, g, or t
cccctaaaagcctaaatgggaaaaggaagagactcatatcaatcattgtcgtcagttgggactactgtaagattcgggtcaagtccagcctagcgtactggtccatctgatctataaatgcggctggcatcgacaaatagaaccattgacaaaattctgacgaaggaggctgctgaggatgggaaagggctccttcaagtatgcctgggatcttggataaggctgaaatgctgaggcgtgaagcgtggtgatcaaccaattgatatctccttgtggacaattccgagaccacggaaggtactagtgtgactactcattgatgccccaggagcacgaggagactttatcatcaaactatagatgacgaggggagctagtctcagggcttgactgctgctgtccgtgactagtatgctgctgcgtggtccggttgacatcttgcaaagctgtgtactcgtcccacagaacacttgggtcaggaccctgtaggagcgatgccgcttctggtcttagcacatctgggtgtgatatactaaactaattggtctgcgctgtttaaccaagaaggtgggacttgccagctggagaccatccacgtaacagtgcgcagtagagaggagtaatgagggcagatgttcgcttaacgcggaaagttcagggaacgtttgagcattttaacgcagcaagttagggnctagcaaacctgccgtacaccaagatacgtcaatctttggttgcccaaatattgccgtgggtttgcgcacattgcgcttgtaccaacctcattgcggtgggagagcccaaaagctggaataaaccacttgcgcctattgggttcccacccggcgaatcggggaacaagtgtccaccacggcggcacaggggattgggcccaatggccccgagtaggtaacccactctcttccatttgacaggcgtctttagggacactgggcattcgcttaaacaaagcaagtgtcggtcgccaaaaacttcgtacaacaagccccccttttgacggctctgtgggcgaaccccccaggggtattgctctcaacga

SEQ ID NO: 687282 - DNA, 480 bp, Homo sapiens
  misc_feature (126)..(126): n is a, c, g, or t
  misc_feature (167)..(167): n is a, c, g, or t
  misc_feature (201)..(201): n is a, c, g, or t
cagtaaggacaaaattaaatgaaatgtgcaaaataactgcacaaactctgtgctgggtgcctggtgacgcggaaccgtcggctggcacgatgcgcccccacgtggaagcttgcaaggactgtgttntggacaaggacctcctgaggcacccatgctgcagttcccanaggcttaaggacggctgcgggacgtgtgggcgtntgggttgggtcacctctccaaggatgccttctctgaccacccagcgtagttccccaggcactccgtcactgtcctgctgtaaccccttcctggcgatcctcttcgcctgatatttttgtgccccctgatggatgagctctgctcatgaaaatgcaaagtcccttaagagcagagtctgtgtctgttcttttggctgcactgttacctgcacagagaagagtgcccaaccgagattgtgcattcaatacgtatattttattagttgaaataaatgaatga

SEQ ID NO: 687283 - DNA, 321 bp, Homo sapiens
  misc_feature (10)..(10): n is a, c, g, or t
  misc_feature (35)..(35): n is a, c, g, or t
  misc_feature (46)..(46): n is a, c, g, or t
  misc_feature (62)..(62): n is a, c, g, or t
  misc_feature (64)..(64): n is a, c, g, or t
  misc_feature (125)..(125): n is a, c, g, or t
  misc_feature (136)..(136): n is a, c, g, or t
  misc_feature (139)..(139): n is a, c, g, or t
  misc_feature (142)..(143): n is a, c, g, or t
  misc_feature (147)..(147): n is a, c, g, or t
  misc_feature (162)..(162): n is a, c, g, or t
  misc_feature (179)..(179): n is a, c, g, or t
  misc_feature (198)..(198): n is a, c, g, or t
  misc_feature (211)..(211): n is a, c, g, or t
  misc_feature (213)..(213): n is a, c, g, or t
  misc_feature (219)..(219): n is a, c, g, or t
  misc_feature (230)..(230): n is a, c, g, or t
  misc_feature (232)..(232): n is a, c, g, or t
  misc_feature (234)..(234): n is a, c, g, or t
  misc_feature (237)..(238): n is a, c, g, or t
  misc_feature (241)..(241): n is a, c, g, or t
  misc_feature (252)..(252): n is a, c, g, or t
  misc_feature (261)..(261): n is a, c, g, or t
  misc_feature (320)..(320): n is a, c, g, or t
taaaaagaanaaattttattccaattcttcaaaanttaaacgtaanatgttgtttccaaaangnaagtaaccctttaaaaaaaagttttattatttcatctttctttgaaagttttttttttcancttttctttanggntcnncagnagaagccagaatctngaggggcccagtaaggngcccctgacccgccaatcngattaagtttctncncaaaantcagggccaanancnggnntcnaaaggaaaggntttggggcntttcaaacacttgcggaaagggggagaatgcattgttacccaaaaccacaagacccaant

SEQ ID NO: 687284 - DNA, 484 bp, Homo sapiens
  misc_feature (126)..(126): n is a, c, g, or t
  misc_feature (167)..(167): n is a, c, g, or t
  misc_feature (201)..(201): n is a, c, g, or t
cagtaaggacaaaattaaatgaaatgtgcaaaataactgcacaaactctgtgctgggtgcctggtgacgcggaaccgtcggctggcacgatgcgcccccacgtggaagcttgcaaggactgtgttntggacaaggacctcctgaggcacccatgctgcagttcccanaggcttaaggacggctgcgggacgtgtgggcgtntgggttgagatggagaaaacatagcatgctggagcagaagggagattgaggagaagaatctggcccagcaaagaaaaagaattccaattttccttccctcaaggacaacctgcccatagataagcgccttgagaccaaagcccattatggttgctgccaggcagcttggagacacaggaatggcctcccaacatccctgacctcggtttttgatacctttgtaaatgatatccctaatctgtctgctcctgaaatccccccctcgttttaaaatgttttccta

SEQ ID NO: 687285 - DNA, 114 bp, Homo sapiens
cagatggaataatgtgaggccagtgataagtgaagcaatgggaccttcaccctgcccccactgctgcagacagaaggctgctcagtgccctgaaggggtcagtacactctgtct

SEQ ID NO: 687286 - DNA, 354 bp, Homo sapiens
tctatcaagcccaatatttacacttgtgcaagttacacatgtattgcccacataaatattcatcaagatttcttgatgtaaatctgggtccaattgaattaaaggatagttacactgccgtttaatatgagacagtgaaagcagctagacccctaccctgtaatccccatcaaggctcgtcacagatttcacagacaattggggtaaccgtgtggtcgtttactgcacatgacaacagcatctgagtgtgttaatgattaaacagcctggtatctcttacacaacttttgtagcacatcaagaagtggctcctagaacttctatagtgtctctatatcctatatgtagtgtcca

SEQ ID NO: 687287 - DNA, 238 bp, Homo sapiens
  misc_feature (4)..(4): n is a, c, g, or t
ttgnaaacttcgatattcgtatttgaatatatggtggctccgacaggaatcgaaccagtgacacacggtgcttcaaaccgttgctctacctactgagctacagagccataatggcggtccagacgggaatcgaacccgcgatcttctccgtgacagggagacgtattaaccactttaccactgaaccttattggttgcggagacaggattcgaacctatgaccgataaagcttcccga

SEQ ID NO: 687288 - DNA, 882 bp, Homo sapiens
  misc_feature (568)..(568): n is a, c, g, or t
  misc_feature (575)..(575): n is a, c, g, or t
gccgccaaggtgctcggttcttccgaggaaccgctaaggctgcgttggggtgaggccctcacttcatccggcgatagcaccaggtcggcagttccaagccactagactctgcaccgctgcgactggcctctgctctccgtagctcgtcctgacatcatacttcgtggcacctcgagttcgtagcgactgaagcgagtgatggtgactaagtacaacgggatggataacgatcagagtgccctcgattcaacagcagccgtgtgttgaatgtttgcatgcctgtattcgtgcgcttgtggcttgtgttggcaaaaaggtccctggacgcgaagcgtacaatcgatttggcgagctctacgatctgtctattgctacgggggccgggttgtgagccgtgcttctcaatgcaggctgagctgtctgtcagccatgactgagacggtacctggcccgcgccgtcgcaactggcgtgcctgactaccagctctgatggacgcatagaagatggcaaatgatcaatatgaaatgcataggatatctcgatggacgttctgagtgactgagccantggtggnccttttcgggatcttttagtgtggacctaaacggcgctgcatgtgtataagtacacccgtgtgttccacatgtatatgggcacgccttgcatcggtgtcttacatgaaccacgatagaagacatatccacagccacctttagtgatcccaagggaaatggattaaaatcccggggttagtttggcagcctacttaataagattcccttgcacccccaatggagagtcacgccgaaccataacgtttcaaattggctccgtagaaacgttgaggcttttataccggaggtccgtccgctacaaaaaag

SEQ ID NO: 687289 - DNA, 1296 bp, Homo sapiens
ttttcctgcgcaggagcctgcatggggcgtaggcagccatgtgcctgcccagccggaatggcatggtcttgaagccccacttccacaaggactggcaagcgtgctgcgtggccactgtggttcaaccagcctggccctggaagatccgcagactgtaatgtgccctggcaatggccaattgctgcgcctgcatctgctcctgcgcccctgctgtctgggtcccatcctggcccatctgtgcgcatgccccacggttctggtaccacactgaagtgtgcgctgcctgtgtctggctggcttcagccttggaggagctcatgtggtggcacggcattcacagagaatgtgtgtgccctggaccatcggcatttcttgtggatccgaggaggcggaacaagtccacggatgtcccctgcaggccaacgtgcaagcgtgtgaaggagtacctgtccaaactcatcctcttccccaggaagccctcggccccaagaagggaggacagttcttgctgaagaactgaaactggccacccagctgacccggagcggtcattgccctgtccggaacgtctattagaaggagaaaagctcggaggtcatcgactgaggaagaggcaggacatttcagaagccttcgcgtaggtctcctgtactgggccctgtgcacaaacagccccgggctcgtatcgggcaattacgggggcgaaaaaggatgccaagggaaagcccggcagaaacagggatgtctgaagccagaaacaacttaacgcgccttcctggggacttgggagtcacgtcgggcaggtcattagttgggagtcatccagacggtggatgtgtacggtggcagaaccaagcttggggccctggcgaatcggggcttcagctgctttgtggaactaccgtccctgccacgcgggattttgggcggcttaacttggaacagcaccaggtcacagcgccgtggataactggctttaactttcctggtggttaggaagggcaccctggtggggggatgattaagggggaaacaggtgacactgactggagcagcggggggggttagcctatggtagtcgtgataggagtaaccaagatagcgattgaagttcaaagaagtgggacagcttgtgttatactgtacgatgtattataagcaaacggtaacagtgattggcgcaggatgttcaaacaggtggttgaacccagggccggtgagacaattgggtgggaagagtacgaagcgaggctgggagcactgtatataaagacatggataagaagaggagagatg

SEQ ID NO: 687290 - DNA, 744 bp, Homo sapiens
tggaaaaaaatttccactcctgtgtcccccagggggggagtgcaaggactcactctcagttcagggaaaccttgtgcctcccaggaaaatcgttgtgaacccgggaggcaaaggtaatagggacctgagaggctcccgccagtgtgccctctccagccgggtgcaccagagccgagaacctcagtctcttcaaaacaaaaaaaaaaaatttttattggcgtgcactcacagaggacagaccagttttttctcccgaccattactcatcaaagattttacgttggtgtattattatagatacacataggtgcttttacatagagcaggttgcaggttgagggctcttaaataggtttcacaagtgaaaacgttttcctctcgtgggactcattacagaaaaaaaaatttttttgtcttcacaacttcataacaacgcgtgggaacacctccatgagggttttggggatacattttgtgtggaatgtgcaccgtggggaaatcttataatatacgcaccaaaatatcatctctcgttggcagacctacaaaaatcttacacagagggggacctctttaccattaattgtatagtcttcagaagccaaccagaggatggtgccttatattccccacactttgtactgggccttgttgcacggttgcggctttttgggcccccgtggcccaggtgtggggacagaacccctgtgttggtgacataggaaatttgactgtgttcccagt

SEQ ID NO: 687291 - DNA, 269 bp, Homo sapiens
  misc_feature (25)..(25): n is a, c, g, or t
  misc_feature (113)..(113): n is a, c, g, or t
  misc_feature (115)..(116): n is a, c, g, or t
  misc_feature (125)..(125): n is a, c, g, or t
  misc_feature (140)..(140): n is a, c, g, or t
  misc_feature (166)..(166): n is a, c, g, or t
  misc_feature (169)..(169): n is a, c, g, or t
  misc_feature (185)..(186): n is a, c, g, or t
  misc_feature (200)..(200): n is a, c, g, or t
  misc_feature (230)..(230): n is a, c, g, or t
  misc_feature (249)..(251): n is a, c, g, or t
  misc_feature (254)..(254): n is a, c, g, or t
  misc_feature (258)..(258): n is a, c, g, or t
  misc_feature (260)..(262): n is a, c, g, or t
agggttgtcctgagggtctaggggntggagggggtggaggtttgtgttcgggggtttattgttgagggtgtgggtgtggggatttgggggtggtgggtggtggtggattgggngnnggggggtgncgagagggtttttgngggggtttgggctgtgaggtgtgggntgngggagggggggggggnntgtggggggatggntgtggttttgctgggggttgtggggggagntgttggggtgcagttgttnnnggntggngnnnggggtgt

SEQ ID NO: 687292 - DNA, 133 bp, Homo sapiens
gagaaaacagataagcgtcgggtgtagtcaggtttctcttttacaggcttatactcatgaaaatctagtctgaagcttttgagaggcagacagccaagatcctggagaaatagtagataggcaagttagtggg

SEQ ID NO: 687293 - DNA, 764 bp, Homo sapiens
  misc_feature (395)..(395): n is a, c, g, or t
  misc_feature (426)..(427): n is a, c, g, or t
  misc_feature (441)..(441): n is a, c, g, or t
  misc_feature (444)..(444): n is a, c, g, or t
  misc_feature (455)..(455): n is a, c, g, or t
  misc_feature (472)..(472): n is a, c, g, or t
  misc_feature (489)..(490): n is a, c, g, or t
  misc_feature (495)..(495): n is a, c, g, or t
  misc_feature (497)..(497): n is a, c, g, or t
  misc_feature (534)..(534): n is a, c, g, or t
  misc_feature (547)..(547): n is a, c, g, or t
  misc_feature (553)..(553): n is a, c, g, or t
  misc_feature (558)..(558): n is a, c, g, or t
  misc_feature (566)..(566): n is a, c, g, or t
tatataaacagtttatttactctaaacagcaacacagacaaaaggccatataaacacaaaggaaggggcgcaaaaccgaaatgctgcccgggggtctgaggctcaaaagcagcacagcccaggttctagaaaggttctagagaggagcggcaggagggagggtgcatttccatacagccagctgaggccaagtgcagctctgcacggtgagaagcatgcctgcattcccagaagcgaggaactcgcccctgggggacttacccaagtattaaaagtttataattttacagcagtgtgaaatactgacatcaatattaaaataaaagcgagttttacattaacaatcaaaaatacaaaagaccgaaggaagagaccctgtttggaaacgggcaatncagcgaatcgagaccgacacccgggggggcnngggaagatggggcncgncaaaccccccngggtgactagtctggtntggagcaactttagatnngcaanantgttgtaacagttcttgccaaaccatcccttcctttngacgatgccacanggtcgntgctnatgagggngcaaacttctgggctggtgctcggacccttttctcgtactccactctgtttggcgcagtaaatcgtgtaggcctctgcttgagctgggtctcggatatgggggccatttagaaagtcctgtatacctaataggacctgttgattgtgatgggtggctccagtccttgcctcctctaagatggacgggcccactgtccc

SEQ ID NO: 687294 - DNA, 920 bp, Homo sapiens
  misc_feature (119)..(119): n is a, c, g, or t
gctgtgcacctgctcattcgccgagcccaacccggcccttggggggcaacccacggggccccccgcagtgtgctttcccccgggggcgtggtgtccacccctagtgacgcccccccccncccggggggattcctggggcccttctcgccggggctcgcgcctggacgcgtttctctttctaagccacgcagcgctctcgctcacgcacgtaggcgtttgtgcacggcgccccccggagcgcggtttctccccgaacacacccggcaccccagaaaatggcgcgagcactccccgaacggggttgggcacccggctctttcagggcgcgccggggcctcataaaactttccgcgcggcaccccacagcacacagcgcgggcacagccacaaagttcatgccggtgggcgtcaaaaaccggccgggctcaaaggccacacattggctttccgcaccgttgggttagcacaccccactcggcgcactagggagatggccgcgcacacagacagaatttcttggggagactgtcgaaacagagagccttgcgaggtcacacccctgagaagaacctcccagagtcccatgagcccgtgacggagacaaatgttgccctgcactcctagctgcctcggggaaacgcgggagacaggggtccacgggaaggctataatgggtggctctagccgagaagtgtttctgggggacccacaaacgagggtccccataaggggctgcatccccccaacaacaagggagaggggacaaatggggagactttttttacccaatcacagagaaaaccggtcccttttttttaagggcttccattattgaaaaaagaaacaaaatgccccccaagcactatgctggtcatgaactgcttccaaatggtggaggtaattaaatgcccactgtgtta

SEQ ID NO: 687295 - DNA, 1137 bp, Homo sapiens
gctctcttgtctgctcctccttctccagtgctttccctatctggcccctcttctgggcctcttccctggggcctcccttccgcaaggccccttccggggggtctttccttgacggggggccccctcgtagttgtctcgccccaccaggggggtccgtttccccgtggacggctgctgtgtggcatttgagggtctgacctatcgacggcatgcccagggcgccgcagtctgctggaatggaacggaggacaacggcgccgagcgcctcataaagaggccctcctggatgccaggactggcacggatatgatcaccaccttgcaacgtacatgccgggccacctgtctccagggaggacgaccatctctagcccctagaggacatgtaactagagcatctcccgaggagccgcgaaaggaccgggacagcaggccccagggacagccccgccgcacaggatgtgcgctcctgaggcctagaaccatttccaagctcgagtttccttcccagactcctcctacccgctaggtgtgcccccttgagcctccggaggcgcggcgctctgggcctgtatctcagaagggacggggcacagctacacagactcaccaaaggcccgcctgcacatgtgtatctctcgatcattgggactggtatgcactgtcacaaggtgcacacactcgctcagtgctcacactgcccatgctgagatcgttccctgggcctctgccctggcctgctgtcccatgcacacacttctttggcctaaagggcttctctctcaggacctctaatttgaccacaaccaacctgggcttcagccacatcaagtgggcactggaagctaggggtgcatcattggggcatgctcacattgcccacacatctcacagcacagcacagggtccctgcaccagattcagatttacatgacctgactctcctcacgttcccgccctgctgtccagagctgaacatagacttgcacattgagatgtcatcctggagtgtcacatgggagtgcttataggcagcatcataccataggcctactgcttgcatatggggccaaaaccagtgatacagccaccttcttggaaagggtatgcaaattactcgcgggggatggaaaagacc

SEQ ID NO: 687296 - DNA, 366 bp, Homo sapiens
cgagtggatcacctgaggtcgggatcacctgaggctgaggctgaggcaaggagaatcgctggaacccaggaaagaggttgcagtgagccgagatcgcaccattgcactccagcctgggcaacaagagcaaaactccgtctcaaaaaaataaaaaagatgttcagagaaacagttccatttactaagtcactgctggtggccaaagcctagttaatgttctgaaaatctccatcgtgtttgttcctcttctgtgattcttattttctcttctattttcacctgccatattttttcctgaggctgacaactgtttggtaggatataagaggatttaaaaattagtaaagcaaattacttgcctttgtt

SEQ ID NO: 687297 - DNA, 165 bp, Homo sapiens
ccggtcgcttttggatctgggatttgagtctacaccaagtggttttagaagttaattctatgatcccgagttggttgcaattctggacgtctgacagaagcaatgcagatccttcctggagggacatagtctcaacctaggccttatagaattcccacagataag

SEQ ID NO: 687298 - DNA, 764 bp, Homo sapiens
  misc_feature (401)..(401): n is a, c, g, or t
  misc_feature (404)..(404): n is a, c, g, or t
  misc_feature (406)..(406): n is a, c, g, or t
  misc_feature (408)..(408): n is a, c, g, or t
  misc_feature (411)..(411): n is a, c, g, or t
  misc_feature (413)..(413): n is a, c, g, or t
  misc_feature (415)..(415): n is a, c, g, or t
  misc_feature (417)..(417): n is a, c, g, or t
gggcccccgggctctggtcgaaatcatgtgatttcccttctgcgcagggttcccggatcccgacatttggcccccaaggtcagcccattcacgtgtaacttgaccggtctttgccaaccaggggcacccaactcaactggcgtgatttgacgaacggttttccggggcggcggcccaaacggagggcgagtccttgtagcccccgatggccgcgtcctgacaggttccgtccgccctgaggtttcgatgtaggcgttccacccggccatggcgctgctactggggctgctttacggcgctgctgctggggcccggactgggctcgaactgcctcggcttgcgggcggggggaggcggagagcttcggggcacgcgcttgccgttcgggcccggctcccttnctntncngcngncntngttgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgta

SEQ ID NO: 687299 - DNA, 371 bp, Homo sapiens
  misc_feature (7)..(7): n is a, c, g, or t
  misc_feature (24)..(24): n is a, c, g, or t
accaggntccccgggccgaacatnggcccaaaaccgttccccagggaaaattcggggatccttcggtaaaattacggggaccccgtggggccttccctccgggaaaattggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgta

SEQ ID NO: 687300 - DNA, 400 bp, Homo sapiens
tgagaagagaagaagggatgaaaatcaatatggacagaatcggagggaaagcagcaagcgactccgtgagccactggatggagatggacatgaaagcgcagaccgtatgcaaaggacatgaaggcgagcgtggagccggcgcctccagttagcagagacacgttttcctacatgggtacatcttccttgggttttcagattttaatacaacagtcaggaaaatggtaatgtgtaaaaggtgtttcccacttgatggggggagtttgagctggtgtttatcatcttcattcttatgtgtaaagattatttagaaatcactaaggccattatttataatcaagtagtgcatgcacagggaatactagtatttcaaacagattacagttgttcatttaccatg

SEQ ID NO: 687301 - DNA, 1468 bp, Homo sapiens
  misc_feature (69)..(69): n is a, c, g, or t
  misc_feature (100)..(100): n is a, c, g, or t
  misc_feature (127)..(127): n is a, c, g, or t
  misc_feature (130)..(130): n is a, c, g, or t
  misc_feature (207)..(207): n is a, c, g, or t
  misc_feature (212)..(212): n is a, c, g, or t
ggtgactctcgctagatccctccaaagcagaccggtggcgatgtcagcggatgtccacgagctcgttanctgcgttcggggaaggttggggcgtcagggnagctctcggatcacagcagcccccgcnctntcctaggcctggcccggcagagcccccagagtggaccccccagcgactggggttttttccccactcctccctccttntggtntgatgcggcagcgcgggggctgcggggcctgtttgggacgaacagagctctcccttggtaagacttattttgttaataaatggaatacttggctatattcaaaaaaaaaacaaaaaaaacaaaaaaaaacaaaaaaacaaaaacaaaacaaaacaaaaaaaacaacaacaacacagcacagaaaacacaacaacacaacacaacaaaccaacaacaacacaacaacaaaaacaacaacaagaagagacatgacgatgagcgggcggcaggcggggagaggggaagagccacggttaaactacatgacaaagatgtagtgagcggagcggcgggcgacggagcccgccggagggagaagaacggcgtgagggagagtcagcaacaaggcatgtctgcacacatcgtcagccgatgaggagcacgaggcgaggagagaggggggcagagagaccacaaataagacaagaatacagaggcgagcgggcagagagccggagagagaatacagcgaacgtggcgagacctccgcgacgaggaaaaggctgagaatctagtgtagatgatgagacgcgatggcgctggaagagaccaaccgagataaagagcgaccggacagaaacaacaaaaacaacaagaacacccacgaggggtcaggggagcggagaggagaagacagcacagaggacgcaagaacagaagccggagggagaggagagagagagaagaggaagcgagaagacagcgcaggccgagaagggaagagagcgcagagaaagaaggaggaagagggaggaggagacaaagagacgaaaagacgcagagaaaggaaacagggaagagagcggggaacagagacgggacggaaggacgaggaaggagcggggggaggggaggagagggggggagggagggggccggagggagagcggggggggaggcgagggggcgagggccagaggagaagggagcagagagggacgaggcgagagaagggggccgaggcaggcgggaccacgcgaaggcaggggagagagaagagcgaggagcgcaggagcgggagagggagaggagaggagacacgagcgcgggagcggagagggagggaacgacagggagcagggaggagagaggaaggagacgaaggaagagacagccagaggaacaggaggagcgcagacacagcgaagcacgtgagggatagaataggagcgagacagaaacaggcggggggggaggaagaggagcgaagaagagcg

SEQ ID NO: 687302 - DNA, 502 bp, Homo sapiens
actcggacgaggtaaggactactgctgttggcctgcgagcagataaagtcgatccggcaggatctgacgggtgcagggcatccgcaccgagtccacgggtggaggtgtacgagacccatgcccggatcgccttggagaggggtgaccatgaagagtttacccagtgccagacgcagctcaagtcgctgtacgccgagaacttgctgggaaatggtgggcagagttaactggcctaccgaatcctctattatatcttcaccaagaactcggggagacatcaccagggagctggcatacctcacacgagaactgaaggcagatctttgcgtggcccatgctttggaataaaggacagccggggccctggggcaactaccaccgtttttcccggctctactgccatgcacctggcatgtctggctacctcgttggacaagttggcagatcgggagcgcagggtcgccctcaggggcatgatcaaacctgtttgcggggccaagtc

SEQ ID NO: 687303 - DNA, 1535 bp, Homo sapiens
  misc_feature (69)..(69): n is a, c, g, or t
  misc_feature (100)..(100): n is a, c, g, or t
  misc_feature (127)..(127): n is a, c, g, or t
  misc_feature (130)..(130): n is a, c, g, or t
  misc_feature (274)..(274): n is a, c, g, or t
  misc_feature (279)..(279): n is a, c, g, or t
ggtgactctcgctagatccctccaaagcagaccggtggcgatgtcagcggatgtccacgagctcgttanctgcgttcggggaaggttggggcgtcagggnagctctcggatcacagcagcccccgcnctntcctaggcctggcccggcagagcccccagagtggaccccccagcgactggggtcctccctccggaaaatggtgaagaaaattgaaatcagccagcacgccaagtacacttgctctttctgtttttccccactcctccctccttntggtntgatgcggcagcgcgggggctgcggggcctgtttgggacgaacagagctctcccttggtaagacttattttgttaataaatggaatacttggctatattcaaaaaaaaaacaaaaaaaacaaaaaaaaacaaaaaaacaaaaacaaaacaaaacaaaaaaaacaacaacaacacagcacagaaaacacaacaacacaacacaacaaaccaacaacaacacaacaacaaaaacaacaacaagaagagacatgacgatgagcgggcggcaggcggggagaggggaagagccacggttaaactacatgacaaagatgtagtgagcggagcggcgggcgacggagcccgccggagggagaagaacggcgtgagggagagtcagcaacaaggcatgtctgcacacatcgtcagccgatgaggagcacgaggcgaggagagaggggggcagagagaccacaaataagacaagaatacagaggcgagcgggcagagagccggagagagaatacagcgaacgtggcgagacctccgcgacgaggaaaaggctgagaatctagtgtagatgatgagacgcgatggcgctggaagagaccaaccgagataaagagcgaccggacagaaacaacaaaaacaacaagaacacccacgaggggtcaggggagcggagaggagaagacagcacagaggacgcaagaacagaagccggagggagaggagagagagagaagaggaagcgagaagacagcgcaggccgagaagggaagagagcgcagagaaagaaggaggaagagggaggaggagacaaagagacgaaaagacgcagagaaaggaaacagggaagagagcggggaacagagacgggacggaaggacgaggaaggagcggggggaggggaggagagggggggagggagggggccggagggagagcggggggggaggcgagggggcgagggccagaggagaagggagcagagagggacgaggcgagagaagggggccgaggcaggcgggaccacgcgaaggcaggggagagagaagagcgaggagcgcaggagcgggagagggagaggagaggagacacgagcgcgggagcggagagggagggaacgacagggagcagggaggagagaggaaggagacgaaggaagagacagccagaggaacaggaggagcgcagacacagcgaagcacgtgagggatagaataggagcgagacagaaacaggcggggggggaggaagaggagcgaagaagagcg

SEQ ID NO: 687304 - DNA, 444 bp, Homo sapiens
acgcgaccgcgcgttcaaaaactggcctgggcaacatggtgagaccctgactctacaaaaattcaaaaaattagtgtggtgtgactgtacatgcccgtagtcccagctactcaggaggctgaggcaggaggatccctttagtccacgagttcaatccatcagtgacctatcattatgccactacactccagcctcggtgacaaagcgagaccttgtctcaaaaaataaaaataaggccaggcatggtggctcacacctgtaatcccagcaatttgggaggtcgaggcgggtggatcacctgaggtcaggagtttcagaccagcctgggcaataggtgaaaccctgtctctaccggaaaaaaaaaaaccaaaaattagccgggtgtggtggcaggtgcctgtaatcccagctactggggaggctgaggctcaagaactgtttgaa

SEQ ID NO: 687305 - DNA, 309 bp, Homo sapiens
  misc_feature (155)..(156): n is a, c, g, or t
  misc_feature (160)..(160): n is a, c, g, or t
  misc_feature (188)..(191): n is a, c, g, or t
  misc_feature (198)..(198): n is a, c, g, or t
  misc_feature (200)..(200): n is a, c, g, or t
  misc_feature (203)..(207): n is a, c, g, or t
  misc_feature (209)..(210): n is a, c, g, or t
  misc_feature (212)..(213): n is a, c, g, or t
  misc_feature (216)..(216): n is a, c, g, or t
  misc_feature (224)..(224): n is a, c, g, or t
attcagccacaccactggccttcccttccccagggcccccaagggtgtctcatgctacaagaagaggcaagagacaggccccagggcttctggctaggtgaagaaaattgaaatcagccagcacgccaagtacacttgctctttctgcctgtcannctcncctggctccagcctcccctacccagggnnnntgaagtnanctnnnnngnngnngtnggagtggnttaaagagctggtgtttggggactcaataaaccctcactgactttttagcaataaagcttctcatcagggttgcaaaaaaaaaaa

SEQ ID NO: 687306 - DNA, 274 bp, Homo sapiens
  misc_feature (2)..(2): n is a, c, g, or t
cnaggatcccggctatcacattatctacagaaacatactttgactataatgaaattaaaaaaaaacacccaaataatatttttcttacttgatatacccaacttagtttaagtagataatgggaataccaagtatacccattgccccgaaaatacccatttactgtcccatttaaaactttggaattgctgggattaaagtgatccaaatgccgaaatactaaaggaaatccattgttccccgggtaactaccactttgtattgatctaccagt

SEQ ID NO: 687307 - DNA, 382 bp, Homo sapiens
  misc_feature (32)..(32): n is a, c, g, or t
  misc_feature (35)..(35): n is a, c, g, or t
acacgcgttgtcggtgtgtctgggctcggacntangtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgta

SEQ ID NO: 687308 - DNA, 437 bp, Homo sapiens
  misc_feature (32)..(32): n is a, c, g, or t
  misc_feature (35)..(35): n is a, c, g, or t
acacgcgttgtcggtgtgtctgggctcggacntangtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacttttttttttttgccttgtttgtggttaattaaaacatttggtgtgtgttcta

SEQ ID NO: 687309 - DNA, 109 bp, Homo sapiens
gtcgatctacgatccttctgctccctcttcactctaggcttatatctgttctactgaaacagctctatacctggctggtgaatgacttcttgtcttcaggatcagttct

SEQ ID NO: 687310 - DNA, 515 bp, Homo sapiens
  misc_feature (32)..(32): n is a, c, g, or t
  misc_feature (35)..(35): n is a, c, g, or t
acacgcgttgtcggtgtgtctgggctcggacntangtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaatacactacataaaagaaagcccaggactctctttgggttgcggaaaagaggtcttgaggtgccacatgttcttgacttgttacgtggcccatgtttcgtgatcgcggggtccatccgccggttgcct

SEQ ID NO: 687311 - DNA, 386 bp, Homo sapiens
  misc_feature (32)..(32): n is a, c, g, or t
  misc_feature (35)..(35): n is a, c, g, or t
acacgcgttgtcggtgtgtctgggctcggacntangtcgcggcgacatggccaaacgtaccaagaaagtcgggatcgtcggtaaatacgggacccgctatggggcctccctctcgtgcaaaagtggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgta

SEQ ID NO: 687312 - DNA, 425 bp, Homo sapiens
  misc_feature (32)..(32): n is a, c, g, or t
  misc_feature (35)..(35): n is a, c, g, or t
  misc_feature (383)..(383): n is a, c, g, or t
acacgcgttgtcggtgtgtctgggctcggacntangtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtancaaaaaaaaaaaaaaaaaaaaaaaaaagtcgtatcgatgtcg

SEQ ID NO: 687313 - DNA, 346 bp, Homo sapiens
gattgcgggcattagcagatctgcctctcaaattttttttgagacggatcttgctctgtcgcccaggctggagttctgtggcgcgatctctggtcaatggcaactttggctcccgggctcaagtgattcccctggcttaagcaactggagtagcttggattaccggtgtggtccaacatggccggcaaatttttttatttttagtagagattggggtttcaccatgttggccagcctggtctcgaactcctgaactccagtggtttggctggttcgggctcccaaagtgctgggattacaggcttgagccactgtgccaggccaaggactaaatccttctaagttg

SEQ ID NO: 687314 - DNA, 279 bp, Homo sapiens
aagcaaaatcattcactatcaactgtaaagtttgcccagatcaaactgtatgtcttaaaatcactggattggaccatgtgcgtatttaataataaaacaatcaatctctcaaatacctttataatgtaatgaggcgaaagtcaacttagtaagattacaacagatatctaagtagataaacacgggaaactaatagtaggtgcatgtctgtaaagctcttcccatatttcacttttaacaatgtatagggacaaaaattagaagtattggccattattc

SEQ ID NO: 687315 - DNA, 178 bp, Homo sapiens
actctgctgctggcttgttgtacacacctgtttctccaatccaggccacgtgccttcacctagcgggagacacccagctgtcagggggcaggtcaggctgcagagtacaacccaggcaggtggccaggacacagagtgccatccccaccagaccccaagcaggagcagcaggaggaat

SEQ ID NO: 687316 - DNA, 1158 bp, Homo sapiens
tggcaatgtttttttcccataatattaactgttttcccgatgttaaaatatttattcttcggggaaccccaagtttcttttacagggccccgggatcaatttaaaacagttgggaacaccggtggcactggttaaactggtctttctggggcagcctctttagctgggggggcttgtagtcacagctacagtcttctatcaaccttaaaaacggagtgactctggaaatctcgagctattattgaaagaagttctgagaatttatcaatctccaacaactttgccagtggatttaaccagcaagatgtaaggtggcatgggttgaatcaaagaggaaacagccgttacacccaacacatttggctttaggcgtcttagaggacggcgcgcaaattgcacaacttgggaacgcaggtcaaagggttcctggagcctttgtgactatagaacagggcatggcttgttagcatttggtaaccttggtgagcgccttgtggcacttatacaaaatatgttcgctgagaaagagtaatttgggcagagatctactctgggcgacgacataattatatacctgtgtgggagcaccctgtgtacgcgggaacaacgcaagagagatatacacgcttcagcaacgacgggttatacggcacagtctcccgcaagagcacttgtggggaccccccattgtggtcctcggatcgattggacatgtgtgtctagcgcacacaacgcgtcttgtttgtctcaaccttttggaatttcctggggggacacccctgttgtagaaagaaagcttggggttctacactaagtaactaaaaaacgtgaggggggaccataaagggccacccaatttttggggacggcggaattaagtcacccaggggggacattaatggggggaacggtgcgaatagagaggttcgtgggacacccccagaaagcacagtcccacaggcacagaggacaatggggcacttataaagatgcaaaaccaaaccaggtgggctaaaggacgagacacaatagtactaggccaccacagcggaccgaccaagaatctcgggggacacaaaagagccacccatgagaaggaaatacccctgaaaagaagtgggtctccgggacgaggacaacggggatactaacacaaat

SEQ ID NO: 687317 - DNA, 890 bp, Homo sapiens
ggcggtgtaatcccgcctaatcctcggcgggtatatctcgctgatcatatgttccctgtatgttgggtctgcacattcgtgcctcgtgccacaatgttgccccccctggtacgttttctaaaaggcgcacagaacctttagggaacattgctgcctttaacaatagcagagtctgagattgttcccagctgccccaatagagatggtcaccgccgcggtagttcttaacacaatttctataacaagcggggtccccagtctgcaacaccccccgtgagtgctttcattttacgggggccacaatttatgggcacatgttgaccaattgtggggggcccaaatggcaaacgaaagagacgaaggcaaggagtggcttccccaccgccccgatggatcatgcgagtaggggccccccaaagccggcagcactccaagggttgccacgccgtggtgtaaaagaccaacagggcacataaggcacgccaaacaacaaaggggttatccccccacatggaacctaccacgcctctgggcagagaaaaaggacagataaaagaataccctcgtgttcgtaaagagtacccatttaaagacggataaatacacggggccaaataataaagggggcaacaaaatatcttgttctaaaaataagacagtgtgacaataacaatgttacgtaaacccgcggggggtacaaacttaagatgctggtgaaatttctaagagagaccccccaaaataacgcgtgttgggatccacgatcggttagatgggggtaattcgactgcaactatgaggggagtattatctccctggcggccaatagggcccgagcgccgtcataaacccccccccccccacccccattaataagatagcaacagaca

SEQ ID NO: 687318 - DNA, 118 bp, Homo sapiens
  misc_feature (49)..(49): n is a, c, g, or t
  misc_feature (63)..(63): n is a, c, g, or t
gttaagaacaaatttaaagtttcctggttctgcaggatggtgcaggctntgaaacagtatatnactatttaaaattctgcctctaatttcgttgtttactttttgtagttattgtcat

SEQ ID NO: 687319 - DNA, 898 bp, Homo sapiens
acacgtatcctgaaaactggagggcttcaaggctctcatcgctgctcagatacatcgtgggctcaggtccgagtgctctccggaccaccccacttccatattggccagaccaatccgcacccctgaatatctccgcaaatttcctgcacggcaaggtcccagcatttgacggtgatgatggattctgtgctgtttgacgagcaacgccattgccttactatgctgagcaatgaggagctgcggggaaagtactcctataggcatgcgagcccagcgtggtgtcagtgggtgatgcgtttgctgataccggagtattatgtgccccacagcactatgtacctgagatgttccccatccgttgggctatcatgcaaccagcaaagcaaacagctacgggccccaatccttggaaggaacattggcacataggcggcaccgcacacgatcgcatggggctggaattttcatcggtgcgcattggcattgggcacttgcctctcacgtatggatacgcaacgaaggggcagcgtattttcctgagattgagagacgggaaagcaggaagctgaccactatagagtcgttgccacaattacaccatgcttgggttcctgtcatcacacattgttttgtggggcttcctatataagactaggtttacctaagcatgtccctatactttctgccagatcgaagtcgcatttcactcgatagtaagcgctaatcccgccttgtgatttcccttgcgaaacgtggggcaattcataccacaggatccccaagattttacccgggtgcctgtctttggggatcggaaagtgaacatagctgcttgtggaactaagaatggggccccagttttggatggccttaaacaagtttttgccattaagaatac

SEQ ID NO: 687320 - DNA, 719 bp, Homo sapiens
agacgtcagagttgagagacagaggcaccccggacagagacgtgatgcactgaataagtagatcataatgactgaaaaagccccagagccacatgtggaggaggatgactatgatgagctggacagaaagctcaattatacgccttcaccacagaaggccctgaaagagctgtaggaaatggacaaagatgatgagagtctaattgagtacaagacaacgctgctgggagatggtgctgtgttgacaagatccaaaagcccccaatgcatgtgttacccgattgaccctggtttgagagagtgcccaggaaccaatcaccatggaccttactggagatctggaagccctcaaaaaggaaaccattagtgttaatggtagattctgaatatagagtccacacctacaggactggggtgaaagtggataaagcaacatttatggttggcagctatggacctcggcctgaggagtatgagttcctcactccagctgaggaggctcccaagggcatgctggcccgaggcacgtaccacatcatgtccttcttcaccgacgatgacacgcaggaccacctcagcttggagtggaacctgtcgatcagattgagcggacagaatgaatgatacacccctttccccaccttgtcacctgaaagattctctcaggcgtggtcagcaccctggccctcttcctgtccacaggtgggtccgttttacat

SEQ ID NO: 687321 - DNA, 1073 bp, Homo sapiens
ggcatatcgcagtgaatggccgtgagtaatcgcgtgacgagcacgccatgaacgggctcgggacacagcatcgagagtacgaggtagaggggagttggtcggagctagatcacatacattgactactaccgtcacagtacgcatactaacgcagtagtgactagatacttcgtgtcctaactcatgtttgtacggtaagtatcgtcttctgggatatccattatgatactctcaagagatagatagaatgaagacatgctcttcaggtggagattagacataacaagttgagtgcggtggtgataaaagagtggaatggtactcacgcattgcgaggggtagaaatgagacatggcttgaggatccgttggcattggagcttacgagatcacctggaaagcgaggaacacgagccaaaaatgatactcgtgaggtaaataatcaggtgtaacatagacgcactcgctatggcagccctcgttttaacacatgctgcgtacccggtacggacactgtgaggacgtgccaccgggaagaccaaagtacccctagctggccccaccgcgcagctcacatgaatggtaatttagatagatggtggaacacggactgacttcggcacgagcgccaggtacatggtggcaccagctcagttgactggggacggtaccagagggcaccgttaccacagacacggaacactctcgatcggaccattccaagagggacaccacacgacatggaccgagccaactcggaggaaatccctggactgcccactggcttatgacaggcaggacgccaaaagacaattgcaaccaaagaccagagacagggagaccaaaaacactcagaaagccattcagtaagggaacgtacagggggccgcgcaagccaggccacagggagactcggtggccccccgaaatacagtcaacagtccacaggcaaggggaccacaggggcaatacacagaaaaaccaggagtgaaacacaaaccgcaacacggcaactcgccaaccacagcgctcgggccaccagcacgacaatcaaggagaggcaacacaagcaag

SEQ ID NO: 687322 - DNA, 286 bp, Homo sapiens
gaaagagcaaaagagatcctaactggttccaggtctgggctgtttagacttatgatgctgaaggactaaaggacctgttcagggtccagcccagtgcctggctgacaaaggcttggtctaggaagagctgacgggagacaccaagagtcagtctttgggtgcaactaaacctgccccaagtcacttagattctgagaacctaaaggatgctcagaaataatctggcttacctacccacttagaaaaactgtggagttttcagatttttttctcagagagggagtct

SEQ ID NO: 687323 - DNA, 350 bp, Homo sapiens
tgacagatcatcaggcattagattcttgtaaggagtgcacaacatagatcccccacatgtgcagttctcagtagggttcgtgctcctatgagaatctaatactgctgctgatctgatagcaggcagagctcaggtggtaatacaagcgatggggagcagttgtaaatacggatgagagatggggagtggctggtgaatacagatgaagcttcacttgcttgcccaccactcactttctgctgtgcggtccagttcctgacaggccacagactcgtacgggggttggagacccctgtcttcaaggattaagaaatcatgggatagtgaaggagagtagggacaactcttgg

SEQ ID NO: 687324 - DNA, 356 bp, Homo sapiens
taggatcccgggtgacgtgctacgttgtatcccagcactttgggatcgaggcaggcagatcacctgaggtcgggagttcaagaccagcctggccaacatggtgaaacctcgtctctactaaaaatacaaaaattagccgggcgtggtggtgcccgcctgtaatcctagctactcgggaggctgaggcaggagaatcacttgaacccaggaggcagaggttgcagtaagccaagatcgcaccaccgcacttcagtctgggtgaccgagggagacgccatcaaaaaaaaaaaagggtaagcccggggtccccccaaaggccaggtaaaacccaaaagccaggggtaacccaaaagccc

SEQ ID NO: 687325 - DNA, 132 bp, Homo sapiens
gatctttctactgtgacaatccaggaaaatggaagacaacgtatctgggatggagatgttgtggcttcctaagctgttcatgggtcaaataccgggtttctgttctgttttctatttcttagaacatcatga

SEQ ID NO: 687326 - DNA, 434 bp, Homo sapiens
  misc_feature (164)..(164): n is a, c, g, or t
  misc_feature (198)..(198): n is a, c, g, or t
  misc_feature (294)..(294): n is a, c, g, or t
  misc_feature (333)..(333): n is a, c, g, or t
  misc_feature (376)..(376): n is a, c, g, or t
  misc_feature (413)..(413): n is a, c, g, or t
  misc_feature (421)..(421): n is a, c, g, or t
cttgccgggagctctaggcactgggaggctgtttcaggaaagtgagactcaagaggaagacagaaaaggttgtaacgtagaggaagtgagactggtgaattggtttgatttttttcacatctagatggctgtcataaagttttagcatgttccccctcacctcnccccacccctgccacttgaaacttctactaatcnagagaaacttccaagccaacggaatggtcagatctcacaggctgagaaattgttcccctccaagcatttcatgaaaaagctgcttctcattaaccntgcaaactctcacagcaatgtgaagagcttgacaagtcnttcaaaataaaaagtaacaacttagaaaccggcaaaaaaagancatgcctctcgcaaagggattctccttcatccctctncagagganggagaagaggaac

SEQ ID NO: 687327 - DNA, 643 bp, Homo sapiens
  misc_feature (408)..(408): n is a, c, g, or t
  misc_feature (417)..(418): n is a, c, g, or t
  misc_feature (424)..(424): n is a, c, g, or t
  misc_feature (463)..(463): n is a, c, g, or t
aaaagggggtccgttaaaacctccttttaatccttgcaaggacagttatctttaattatttcggtttggccaaagatttatccttttcttacttcttgtgttttcaatcacatttaaaacaaatcccaatgcactcaaatgatgttgtccccctgcagatggcctaaggcttcttcaggtgaatattcccttttatttgagaaggagggagctccagacattttatccccacacccccccgggggttaaagccccccaagagattattttttgtgtgggcccggggtgggggttcccaaaaaaaggtgtggttttacaaagggcaacttgctcccccacagtttggttttttttctctgcgggccagttgggcttcaaagtggaaaaaaaaattttcttttcccaagnggggggaannggggtnccccccccaacccttttcccccccttttttggccccccnaaaaccccgtttttataaattttaaggggtgtttcccttcctttttttcaagggaaccgaaaggaaaggaaaaatttttcccatttttcttcttttttgggaagggctttccctttccctttttaaggttctggggttcccaagaaccaaggatttttttggtaaagttttttttgggca

SEQ ID NO: 687328 - DNA, 518 bp, Homo sapiens
tcacgctttatacttcacccctaaacacatttaagggttggattaacatattattttctattaaggggtggaagtggatcagcagtaaaattcctgctacaactacagcgctagagtggagtagggctgagactggggttggaccttccatggcggaaggaggtcaggggtagaggccaaacttgagctgacctttcccgctgctgctaagacgaacggccaattaatggcagatcaggggtacggatttcggatacactgctcgttgcggttctcatgtattgtacagatgacgacggaactcatgctactagctacaaatgaagccacatatcgcccatgcggttatacagcaatcgcttggagggctgctgtattagcatctgctcagctgtgtcctcagccagttagtaaaaccagacataattcctacaccttctcatctgatagccagttgaaccaatgttgttggtggtacctagactccctatcgtggtgcggcacctaagtaaatattt

SEQ ID NO: 687329 - DNA, 352 bp, Homo sapiens
acagcccaaggggcccactgcccccccagaaaaggagctcttctgcaactgcagacccctgtgtgtacaaggagttccctcctgaggcttgtgggtgggcgggctcacactcggtgtgaatctcactcacctcaggcctactggcatggtgctgaatgctcagacccagggcccagcctgactggcccgctgggacaggaactctcagtcttctcttgccaccacctgacagtaggtacggatttaacatggcaaattctctgcctacctgtgtgttctgcacaaggctgcccagccaccagagttaacaagtcctgttctttccctgctaagcaggctccaaggtcgacgc

SEQ ID NO: 687330 - DNA, 687 bp, Homo sapiens
  misc_feature (515)..(515): n is a, c, g, or t
  misc_feature (580)..(581): n is a, c, g, or t
tatcaatagctgaatcgatcaagtggaagaaaggatatcagagattgaagattaactcaatgaaataaagtaagaagaccagattagagagaaaaaaaaaaaagagtgaaaagaaacaaataaagcctccaagaaatatggaactatgtgaaaagaccaaatctacgtttgattggtgtacctgaaagtgaccgggagaatggaaccaagttggaaaacactcttcaggatattatccaggagaagttccccaacctagcaaggcaggccagcaacattcaaattcaggaaaatacggagaacaccacaaagatattcctcgagaagagcagccccaagacacataattgccaattcatcaaggttgaaatgaaggaaaaaatcttaagggcagccagagagaaaggtcgggttacccacaaagggaagcccatcagactaacagtgaatctctttggcagaaaccctacaagccagaatagagtggggggctatattcaacattcttaaagaanagaatttgtcatcgagaatttcatattcaggccaacctagcttgataaactaagggataataaanntccttcagacaagcaactgctgagagatttttgtcacaacaagcccttgcttataagagcttcttggaggaagcacctctttggaacccttggtccttaccctgtg

SEQ ID NO: 687331 - DNA, 336 bp, Homo sapiens
ggtggtgacatcagcaaccgccagttcttgtccatcaacaagccccaattcttgcaaggtttgggagagattgggtctggttcgttcttcagtagaggtaaccgagggtaagtaaagtgttctatttttaccctctaggggggctgtgagggctggagatttcatgggcagagaagcactattggttagataatccaaaatctcctgtagtttagcggatggagaaaactgaatatcgtgaggaagcgggctacgagctgggcagttttcctttctttcggcttcagatgtgtatgtatacagcccatctacatcattaaacaccaagtaattact

SEQ ID NO: 687332 - DNA, 263 bp, Homo sapiens
gaatggcatgttggttgattgtatatattgtttgttgtgagttcttcgatcaatggctcatttagtgcgaaaagccggttagtgggggcaggcctcctacgtgagagagaaggtggatggaattaatggtgttagtcatgttagtttgtttcatggtgtgagatagtaataagggttgtggtgtgctggatgtttatgttagattaagtaggaatgcagggagtaagttagtgaggccattcaaccgcctccgtggggatcct

SEQ ID NO: 687333 - DNA, 183 bp, Homo sapiens
gccctcgggattgagcccgctcatcacgtgcttgacggtgccgtccttgcccgccgcgtcgattgcctgcagaacgatcagcaatgagcgttcagcttgggcgaagaaccgatcttggagattgaacagagtcgcggtcgcctcggccaattcggccagcccgccttgcttggcgagttcctt

SEQ ID NO: 687334 - DNA, 410 bp, Homo sapiens
gtcaccagtattgcccagagacagtgagtctacaatgtcgcatgatgcttagtctcagattctcatgatctcattgactgactgcactgtgaatctgtcaccctgactgacatgaccagtcaggagctccccggactacatatacattgaggctttgtcagcatcatccaaggttctaactcacctagagcctgtcagaatgcgccttaatcctacaccgacagcctggccaccattgcaacagtaccaggaggtcgatcttcctagtgagcatcgatacagacgtctgcagagctcatgaccacagaccagagctgacactcacgatgaactcctggagggcacggatgtgagccttacggataccacggaggctcagatccatcaaggcttgcaagctcatctattcc

SEQ ID NO: 687335 - DNA, 228 bp, Homo sapiens
  misc_feature (12)..(12): n is a, c, g, or t
  misc_feature (138)..(138): n is a, c, g, or t
aagaaaggcatncaaaacccacaagcagagagtggaggacttcaacagcacctggacacactcacggagcattacgacattccaaagtcagctggacgaatagccgcctgccccagtatgagcagcatcgagggttcncaaaggcacactggggttgtgtgtgtttctttggataatcctggaacatggctcacacaccttgcatcttctgctacagactgctttcga

SEQ ID NO: 687336 - DNA, 257 bp, Homo sapiens
tctcatatcttgtcgctcggcacacagcagaggttgagcaggagcttactgagttcctcccccgtcagatcagcagcagcattagattctcatagaagtgcgaaccatatggtgaactggtctgtgagggactctagagtgccatgttcctcaagagaatctaatgcctgatgatctgaggtggaacagttcatcctgaaaccattcccccatccacagaaaaattgtcttccactgaaactggtccgagcggagga

SEQ ID NO: 687337 - DNA, 523 bp, Homo sapiens
gtacacgtgatcctacagaagtggagctggatgatcagatagtgtactgcgacctagagcaatatctggtgatgaagacagggctacagagacctgtctagactctgtgatagaaacaagtgtctacacagttgtggtcccactcgtatatagtggttagaccaaaatggtggaaacagccttaaccccggatgccggctatcctgactaatttatgtcatagctgtttgctgagctctttttcttgagaggctctccattttgattcagaaagttagcatatttattaccaatgaatttgaaaccagggctttttttttttttgggggtgatgtaaaactaactcccggccaccaaattaattaaaatagtcacttggtaatcttaataaggtaatcgcttcttacttttatgtccatactctaggtatcaaaatcttccagttatcaggctcacctgaaagaggtatgctctcttaggaatacagtttctagcattaaacaattagacaaggggaaccccg

SEQ ID NO: 687338 - DNA, 407 bp, Homo sapiens
ggcatatacaagatgcccagtatgaacatgtgtattacacctctacagttccctttgtggatttgtcacacactctcacatcatgcgttctaagcagttgctcttgtcagtgtcactagtgatgttaattaatctgcatataccaagtgctcagaactttctaaatatggtcatcagtatgtgtcaccaacagagtgtcctgctacaaatgattatgcaaatcgcaaaaatagatacacttccactgatatgctttaatcatgtatccgggcactctcatcgtatggctcttcctcatctaagtacacagtgggctcctaactctccttcatcagctttgaccgcgttatgactcttgacgggcccgtagaatgtgcgctctgtggtcacgtgggacacctagccgt

SEQ ID NO: 687339 - DNA, 252 bp, Homo sapiens
cctgctcatatagctattggtgtcacatgacaatgctggcagtatgatcttgaaaaggccaaaatcgatcggggagagaactatcagtgccacagttgtgagaggcgctctcctgtgtatcatatttttctccaaaaagtacgggagcagagagggagacagaggagtcatcacagaccgaggaggtggatcacagcactatcctgaggagcgacatgtggttgaacgccatggacgggacacgaatgttca

SEQ ID NO: 687340 - DNA, 101 bp, Homo sapiens
tgcggcgcaagacccgcgcgggggggatgcgtgcatttatcagatcaaaaccgccggcgcccgccccccaggccggtggccggagacgggtgctgaccgtg

SEQ ID NO: 687341 - DNA, 372 bp, Homo sapiens
gcgtcgaccccgggcgatcaacaggcgttgcttctggcccgaggacaattgcacgcccatgggtccgagcaaggtattgaagccattgctcagtttcaggatgctttccagcaacccggcctgctcgacacagctctgcaaacccgtgccgtccagcgggtcgctgtccatcaggatgttctcgatcaccgtcccggcgatgatctcgtcgtgggccgtgacataggccacgctctggcggtacgagcgcaaaccgaaatgccgcatcgcctggccgttgatcctgaagcgcccggtgtccagggcatagaacccggcgagcactttcaggaaggtgctcttgccgcagcccgaaggggagatatcggcgat

SEQ ID NO: 687342 - DNA, 305 bp, Homo sapiens
aagttgatgctgactccagctttaccctgattagttcagtaaacatttccagctcgtgaagaaggacggtattcccatagcgttgtgataggttttaaagatgccacaggagaatcgccacttctagattggcacgaaatacctaccacttatagaggtgcatctttgatcttgagtgggtttgtactatgcagtaagatctgcatgaccagaagtggctcgaataacactttttctctgtccacgggtaggtcattcaaggggtgtccacattgtagtgggctgagatatcaacccaagtaccc

SEQ ID NO: 687343 - DNA, 491 bp, Homo sapiens
agcgcggagagccggactcccaggcggcggcagcagcggcggcggcggcgacgacggcgaagagtgagtgccaaggttcatatgggaaggactttggggtgagcatcttctctatttccagctggcttttctgattcaccccaccatttaaaacctggaggcactgggccacacaaagccttgctgattttcagaaagaagactcatcaaagatgtccagcaagacggcaagcaccaacagcatagcccaagccaggagaactgtgcagcagctgagattggaagcctccatcgaaagaataaaggtctcaaaagcatcagcagacctgatgtcatactgtgaggagcatgcccggagcgaccctctgctgatgggcataccgacctcagaaaacccgttcaaggataagaagacctgcatcatcttatagtggaccaggaagcgccccttgcctcttaacgcaaaccacagcagcaacctgaagggattc

SEQ ID NO: 687344 - DNA, 441 bp, Homo sapiens
taccacgaccgtgagtgtcacaggcctgacgagtttcagagtgtcgagagtaaaagataaggacgaagataaacacctgaaatagcgtataactcatgaatgagatagtgcatcttctgaggtcaatcaaaaggagaagaaatacaatttctcactttgcatttagtccaagagaaaaaatgctttctagcagaatgaaagagaacatgaaatgcttctttctcagtttattggttgaatgtgtatctatttgagtctggaaataactaatgtgtttgataattagtttagttggtggcttcatggaaactccctgataaactaaaagctgtcagggttatgtctatgttcattctatagaagaaatgcaaactatcactgtattttaatattggttattctctcatgaatagaaatttatgtagaagcaaacaaaatact

SEQ ID NO: 687345 - DNA, 576 bp, Homo sapiens
  misc_feature (81)..(81): n is a, c, g, or t
cagagttgtatttataaaagggttttaataaatggatacacttcaccaagggaactgaaaggcagaaagctgccacaagtnactatcagtacacacacacaaattttcctcaatcagaggctctgataagcagcgtaagggcgcaatcgttatcctgtaaccagcctttcgttggatcgtgattgggatatttggatgacttcattgctgttcatccacatttccatacacacaattgtgggcatccctccccagtggagatgcagccttcagattctcttgagctataagcctgagtcagagattggcttttagcttatcactttcaacgattctatctgagtgcagctgaaggatctcttcctgactgaatccatactctctaagcacttctacggtgtgctcccctacagaagggtcccttttggcagatgggacggcaggagttctggaaagcagaggtgcagggcgggggctcgggagctgctccccatcagtgatgaaggaggcccgttctctgttgtgctggtggtggagggcctcctcaaacgtcagcactggggtcacacacgcatc

SEQ ID NO: 687346 - DNA, 323 bp, Homo sapiens
ccgttgtcagtgcacacctgtggtcccagctactcgggaggctgaggtgggaggattgattgagcgcaggagtttgaggttgcagtgagctatgattgcagcactgcactccagcctgggcaactgagcaaggccttgtcaaaaaaaaaaataaaggaaaggaaagaggggagagagagagacacagagagagagagagaaaggttcaaactgttttcaaaatcatttgggtccaatctttctatcttcttattaaaaggctcctggattctgttcaggatgttaatgctgggcttgctgtccaccatgttcactgacaacgg

SEQ ID NO: 687347 - DNA, 197 bp, Homo sapiens
  misc_feature (1)..(1): n is a, c, g, or t
  misc_feature (10)..(10): n is a, c, g, or t
  misc_feature (26)..(26): n is a, c, g, or t
  misc_feature (70)..(70): n is a, c, g, or t
  misc_feature (166)..(166): n is a, c, g, or t
  misc_feature (175)..(175): n is a, c, g, or t
  misc_feature (193)..(193): n is a, c, g, or t
nttcggcacngcgggctccgggcctngaatagatggggtgcggggacggagacaaatgacggcctttggntcggaatacccacctttctggtaatgcagcccagcggtccccagcctcgttttccagccctcactcaaaattgagtcgctcttgttcgaacgcctntgacaagtntgtatctacgtgtcaggnccat

SEQ ID NO: 687348 - DNA, 194 bp, Homo sapiens
atcgtccccgtagtatcagacagcctggcaacgtggtaaaccccatctcgacacaagttaactgggcatggtggtgcgctggtagtcccagctactcgggaggctaaagtgagaggatggcttgaacccaggaggcggcaggttgcagtaagctgagatcgtgccacgtgtactctcagctatgggcaaccaga

SEQ ID NO: 687349 - DNA, 159 bp, Homo sapiens
agtggcatagtagtttgcaagactcatcagtaggcttcgtactacatcgacatgttctacgttgtagcccagttccactttttcctatcagtaggagctgtatttgccatcattggaggcttcattcactgttttcccctattctcaggctccatcctt

SEQ ID NO: 687350 - DNA, 404 bp, Homo sapiens
tggggagcccccgctccagggctcgctccaggccctttttcccaaaatgacttgctcgctgttacctgcttcccccgttttttttgaaaaaccccaaattagggtgggaaaagctttgtttttaaaagggtcatatttcctttttagggggtttgttgttttccctgttagtttttaggagcaggaagctcatgggggcttttgtagcccccctcaaaaggggttttttttttgagaatttgaagctgaacccccttttaattttcagaatgttttttttgaaaagggcccccaccccccaatggaaaactgtttttaaaaaatatgatgttttttgattgcttttgttttttattttccgggggttcaagttttaaaaaataaaattttttacccgaccccca

SEQ ID NO: 687351 - DNA, 1507 bp, Homo sapiens
  misc_feature (1)..(1): n is a, c, g, or t
nttcgcaggtttttttgtccgcatgtgtctcctcgcatagctactccatgaattgtgcgtttgtgtagcgacctctgttcgggtggtagtttctccttgtgcccgtgtgggttggggaaactcgagtgggagtgccccccgcgtgttgtgttccccgccccggccgaggcgttggccgcacagtgtgttcggtgttctcgcaagtatgccgcccctacgggctctgttgtttttgcgcgtgccccccgcagccgtttttggtgcccccccaacgtcccccgggggggtctctcatgtcgctccacagagcctcctaggatcatactccccgtgggcctagtcctgttgtggaccatcctcgtgttggcggccgctagtaaggggttgttctattccatcctccgactgcgcaacagcaaatgtagtgttttgcaaagttgtcctccccatcacggggaaactacacacttctgatgtggtgtggccgttgtgctcctgtgtgggcgtgagatcatcccccccccgctctcccccccttggttggtgcccccccgcttttatcgccctcgtagcccggcggtttttgtgccgcccccccccgcttggttttctccaacgcgggggggccccgcccacctcggtgtctcgcaacctgtaaatagggagagcgcttggtggatatggagagcccccacaatatggcgcgtgttaaaatatggattccccaccacacaacaccacatcatattactcacgcccaccgcgctcatcatatgttcttgttttctagaagattttgtggagatttcccccttcacaccaccacacatggtgtgtagaaatcaccaccgcgcccgtcgtgtgtcttcggtgggagaacactttcccgcccccgcgccttcttcgcgcgggggggcttataatatacagatttgtgtcccgccccccacacgcctctgtcacatttgggggcaccgcacacgcgccccggcgcccatctcttccacgcgagacccttgtgttctcaagccgccactttctctccgcatgcccacgctttttctccgcgccccactcgcttttccgcggcgccccaagggcccttgtcctcgccacactgtgttgatacaccgcgggcgagaggtgcgcactgtgaccgcaggatgtgtgaggatttttctccccgcgcgggctcccgaggaggccacacccctgaatgcacccttggttgtctccgaggtacccccgccacgtatcccacggaatcccaccacgcccgaaggaaggaagggccgaagttccgaaggaaggaaggcctgagaggaagagaggtggcctatgaggccttcacgtccctggggaaagcccgggagaaccacgtgtgtactctttatttcacctcccacgcctgtcctgtggcctgtccccctgtgtgcaccttgctgtttttccccgtccacatccctgctgtacagaccccccccctttaagccttttcatagtggta

SEQ ID NO: 687352 - DNA, 187 bp, Homo sapiens
gctgagtgtaaaggtagggcgcagtgtaatctcagcttactcgggatgctgagtgccgcgagaatcagcttgaacccaggagtcggaggttgtgttcagccagagattgcgccattgcactccagcctgggcaacaagagtgaaactccatctccaaaaaacaccaaaaaaacaactcaacaccaat

SEQ ID NO: 687353 - DNA, 168 bp, Homo sapiens
  misc_feature (151)..(151): n is a, c, g, or t
gatgtcgcgtgcagtatagtactacaagtacacattgctcttacatttcatgtaagtctacatgtagatatgatcgattaccattctagggggagagggaacacaggtgtattatcatcagctagatgtgctcactgtatgcactgttatntatattgcacgcacgcg

SEQ ID NO: 687354 - DNA, 203 bp, Homo sapiens
acgtgttgcactttcggcttcagtgactccatctcagacaacaaatgctgccgatgagagagctgctccttgagattgagacgtccaaattctggagaagtcagtgtcgcctgggcttgctcccaaaggcagcttgtaaactttttctacagcagttccctcatacggtataatcaaaattgtatttccttagaagcattcag

SEQ ID NO: 687355 - DNA, 397 bp, Homo sapiens
tgtgagaaatttactaaatgaactttcctgtcttttaatctttttcttattttttttttgagcggagtttcatgcttattgcccaagctggagtgcagtggtgcaatctcggctcattgcaacctctgcctcccacctcccgggttcaagcaattctcctgcctcagcctcccgagtagctgggattacaggcacccgtgggtcacacctggctaatttttttgtattttttttttcacttttttttttgagacggagtctcactctgtcacccaggctggagtgcaatggtgtgatcttggctcactgcaacctctgcctctcaggttcaagtgattctctgacctcagccaccacgcttggctattttttgtatttttaatagtgatagggtttc

SEQ ID NO: 687356 - DNA, 526 bp, Homo sapiens
gatcacctaaatgagccagagtcatgtggctaaagcccgtactccgcagtcactttgggtagagcatgattacactgagaccagtagttcacgatcaatctggtcaacatgatgagtccctgtctctactagaatacgaccggtatcttagagtgttgagggttgcaagcctttcgagctactcaggaggctagggcgggagaattgcttgaacttggggaggcggaggtcgcagtgagtggagatcgtgccactgcactccaggctgggcaacagagcaagaccctgtctcaaaaagaaaagaacagaaaagaaaagccaggtgcagtggctcacgcctgtaatcccagcacactttgggatgctgaggcggttggatcactggaagtcaggagttcaagaccagcctggtcaacatggtgaaaccctgtctctgctaaaaataccataattagctgggcatggtggcacacacctgtagtcccagctactcaggaggccaagacggacagatcacttgaggcca

SEQ ID NO: 687357 - DNA, 307 bp, Homo sapiens
tgggagactgaggaaggagaattgcttgaatctgggaggcggaggttgaggtggagctgagatcgcgccattgcactccagcctgggcaacaagagcgaaactccgtctcaaaaaaaaaaaaaaaaaaaccaaaaaaaacctacttttcaaatttactttgaaaaaaacagggaaaaaaaggggaaaaaggatgtgtttaaacctggaaaagggtcaaaaatcagaaagggtttccctgaagtttttaaaaaaataaaaaaggggtggaaccatttggaacattgtaaaatttcattcagaaacctg

SEQ ID NO: 687358 - DNA, 146 bp, Homo sapiens
taatctatcagctcaggcgctggcgtattttaaatataaaaatgggtgtatttacattttttttggtcaggtgatattgggtcttctgtggacattcggggtgatccgtgtctgcgctgtgtacaaggtgagatctgtgcgttctc

SEQ ID NO: 687359 - DNA, 1239 bp, Homo sapiens
agcggataatttggaatgtgggtggagggggatcatagttctccctgagtgagacttgcctgctcctctggcccctggtcctgtcctgttctccagcatggtgtgtctgaagctccctggaggctcctgcatggcagcgctgacagtgacactgatggtgctgagctccccactggctttggctggggacacccgaccacgtttcttgtggcaggataagtatgagtgtcatttcttcaacgggacggagcgggtgcggttcctggacagatacttctataaccaagaggagtacgtgcgcttcgacagcgacgtgggggagtaccgggcggtgacggagctggggcggcctgacgctgagtactggaacagccagaaggacatcctggaagacaggcgcgggccgcggtggacacctactgcagacacaactacggggttggtgagagcttcacagtgcagcggcgagttgagcctaaggtgactgtgtatccttcaaagacccagcccctgcagcaccacaacctcctggtctgctctgtgagtggtttctatccaggcagcattgaagtcaggtggttccggaacggccaggaagagaaggctggggtggtgtccacaggcctgatccagaatggagactggaccttccagaccctggtgatgctggaaacagttcctcgaagtggagaggtttacacctgccaagtggagcacccaagcgtgacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgcagatgaccacattcaagggggaaccttctgccccagctttgcatgatgaaaagctttcctgcttggctcttattcttccacaagagaggactttctcaggccctggttgctaccggttcagcaactctgcagaaaatgtccatccttgtggcttcctcagctcctgcccttggcctgaagtcccagcattgatggcagtgcctcatcttcaactttagtgctcccctttacctaaccctacggcctcccatgcatctgtactccccctgtgtgccacaaatgcactacgttattaaatttttctgaagcccagagttaaaaatcatctgtccac

SEQ ID NO: 687360 - DNA, 173 bp, Homo sapiens
gtcgacccagctactcaggaggttgagatgggaggatcactggagcctaggaagtcaaggcggcagtgagccactgcactccagcctgggtgacaggaatgagactgtgtctcaaaaataaaaaacaagttacagcttttgctttagaaaacttggaaagtacagaaatatat

SEQ ID NO: 687361 - DNA, 1149 bp, Homo sapiens
agcggataatttggaatgtgggtggagggggatcatagttctccctgagtgagacttgcctgctcctctggcccctggtcctgtcctgttctccagcatggtgtgtctgaagctccctggaggctcctgcatggcagcgctgacagtgacactgatggtgctgagctccccactggctttggctggggacacccgaccacgtttcttgtggcaggataagtatgagtgtcatttcttcaacgggacggagcgggtgcggttcctggacagatacttctataaccaagaggagtacgtgcgcttcgacagcgacgtgggggagtaccgggcggtgacggagctggggcggcctgacgctgagtactggaacagccagaaggacatcctggaagacaggcgcgggccgcggtggacacctactgcagacacaactacggggttggtgagagcttcacagtgcagcggcgaggcagcattgaagtcaggtggttccggaacggccaggaagagaaggctggggtggtgtccacaggcctgatccagaatggagactggaccttccagaccctggtgatgctggaaacagttcctcgaagtggagaggtttacacctgccaagtggagcacccaagcgtgacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgcagatgaccacattcaagggggaaccttctgccccagctttgcatgatgaaaagctttcctgcttggctcttattcttccacaagagaggactttctcaggccctggttgctaccggttcagcaactctgcagaaaatgtccatccttgtggcttcctcagctcctgcccttggcctgaagtcccagcattgatggcagtgcctcatcttcaactttagtgctcccctttacctaaccctacggcctcccatgcatctgtactccccctgtgtgccacaaatgcactacgttattaaatttttctgaagcccagagttaaaaatcatctgtccac

SEQ ID NO: 687362 - DNA, 769 bp, Homo sapiens
gtgtggaatgcgacatcaatggtctgcgcaggatgctggacgaactgacccttgccaggagctgacctggagatgcagattgacaggctgaaggaggatctgggctacctgaagaacgaaccacgacggaggagatgaatgccctgtagaggccatggtgggtggatgatgtcaatgtgagagatggacgctgcacctgcgcgtggaaccatgaagccgctattctgaacgagatgcgtgacctagtatgagaagcatggccatgagacagaactcgcaaggatgccgcagtgaatggttcttcgaccgaagacagaggagctgaaccgcgaggtgggctagccatagagcgagctggtgcagagcgtgccatagagcgagatctccggaggctccggctgcacctatggcagaagcctgcgagatctgacgctgctaggtcccaggctcagcatgaacagcatccctggagaacagcctggtaggagaccataaggtcagctactagccatgcagctggcaccagtatccagtgatgctgattggcatgcgtggcaggagcagtctggcccagctccgccttgcgagcatggatgccacgcagaaccagggagtacaagagtcctgctggtacgtgcaagacgcgggttggagcaggagatcgccacactacctgtcgtctgcatggagtggcgaggacgcccaacctcgtccgtcctcccagttcgtcctctggatcggcagtcatccagagatgtgaccctcctcc

SEQ ID NO: 687363 - DNA, 400 bp, Homo sapiens
aagaaggaaaaagatgcttcgggcgaactactccaccgtttgagccaacgacgccaggtgtttatttcctgtctttttccaaatcatacaaaagggggaggtatacatataaaaatgcagttacattgttgacagatttgatattttgccttcttcactgaatataatgggcttgtgttggtctcctgtccccttatatagctgcagaatttatattgggcaaaaaactctttcattgactgaggggtgaccataatcgtaaaataattcacgagtatgtatggattttatacgcttttaaagggatagtgctgggatatacattatttcccgggtaagatgttgaaagtgataaggtggaaatatatggcatatgtgtaacaacgggatgcgggccggg

SEQ ID NO: 687364 - DNA, 1336 bp, Homo sapiens
agcggggatcctcctccagctcctgcttggaggtctccagaataggctggaggcggggagggggtcccaaaagccttgggatcagaaggggttttcccgcctggtcccccagacagcccgttcgcctcaggaagacggaggatgagcctctgggctgcgcgtggtcggggttatggttgggatcagttaaggttccagtgcccgcaccccgcccaggagccccggatggcggcgtctctgtcagtgtcttcccaggaggccgcccctgtgaccggatccttcgtgtccccacagcatgtttcttgcagcaggataagtatgagtgtcatttcttcaacgggacggagcgggtgcggttcctggacagatacttctataaccaagaggagtacgtgcgcttcgacagcgacgtgggggagtaccgggcggtgacggagctggggcggcctgacgctgagtactggaacagccagaaggacatcctggaagacaggcgcgggccgcggtggacacctactgcagacacaactacggggttggtgagagcttcacagtgcagcggcgagttgagcctaaggtgactgtgtatccttcaaagacccagcccctgcagcaccacaacctcctggtctgctctgtgagtggtttctatccaggcagcattgaagtcaggtggttccggaacggccaggaagagaaggctggggtggtgtccacaggcctgatccagaatggagactggaccttccagaccctggtgatgctggaaacagttcctcgaagtggagaggtttacacctgccaagtggagcacccaagcgtgacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgcagatgaccacattcaagggggaaccttctgccccagctttgcatgatgaaaagctttcctgcttggctcttattcttccacaagagaggactttctcaggccctggttgctaccggttcagcaactctgcagaaaatgtccatccttgtggcttcctcagctcctgcccttggcctgaagtcccagcattgatggcagtgcctcatcttcaactttagtgctcccctttacctaaccctacggcctcccatgcatctgtactccccctgtgtgccacaaatgcactacgttattaaatttttctgaagcccagagttaaaaatcatctgtccac

SEQ ID NO: 687365 - DNA, 398 bp, Homo sapiens
gaaagtagagtcaggacttaaaatggagctgatgagcttgctctaaatatgttgactaacaccactttcacccctacacatcacatgccaatgattatgtcaccttcactccttttaaagaccccaagatgcacctagattaataacatgctctatgtccttaatacagagcaggctaattaaaaattgtatgctggctgacaatgaatacatgaagcagtcatcatattcaaaatcaggcaacttcacctgcagaaggagccaaataaaagctcagtggggaatgcaaaggcaatcattttgagccttttccacccaagcatgcaaacatatgcatgacacgttgtcatccacagtgcataaggtcctggggtcaagcaaggctcttgcacaggacg

SEQ ID NO: 687366 - DNA, 1218 bp, Homo sapiens
agcggataatttggaatgtgggtggagggggatcatagttctccctgagtgagacttgcctgctcctctggcccctggtcctgtcctgttctccagcatggtgtgtctgaagctccctggaggctcctgcatggcagcgctgacagtgacactgatggtgctgagctccccactggctttggctggggacacccgaccacgtttcttgtggcaggataagtatgagtgtcatttcttcaacgggacggagcgggtgcggttcctggacagatacttctataaccaagaggagtacgtgcgcttcgacagcgacgtgggggagtaccgggcggtgacggagctggggcggcctgacgctgagtactggaacagccagaaggacatcctggaagacaggcgcgggccgcggtggacacctactgcagacacaactacggggttggtgagagcttcacagtgcagcggcgagttgagcctaaggtgactgtgtatccttcaaagacccagcccctgcagcaccacaacctcctggtctgctctgtgagtggtttctatccaggcagcattgaagtcaggtggttccggaacggccaggaagagaaggctggggtggtgtccacaggcctgatccagaatggagactggaccttccagaccctggtgatgctggaaacagttcctcgaagtggagaggtttacacctgccaagtggagcacccaagcgtgacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgcagatgaccacattcaagggggaaccttctgccccagctttgcatgatgaaaagctttcctgcttggctcttattcttccacaagagaggactttctcaggccctggttgctaccggttcagcccttgtggcttcctcagctcctgcccttggcctgaagtcccagcattgatggcagtgcctcatcttcaactttagtgctcccctttacctaaccctacggcctcccatgcatctgtactccccctgtgtgccacaaatgcactacgttattaaatttttctgaagcccagagttaaaaatcatctgtccac

SEQ ID NO: 687367 - DNA, 243 bp, Homo sapiens
  misc_feature (149)..(149): n is a, c, g, or t
  misc_feature (173)..(173): n is a, c, g, or t
  misc_feature (192)..(192): n is a, c, g, or t
ctttctttctatggccttgttcttcatctgcaaaacaagagtgaattagaggcaagattcttttcacttctgggattgaaagaaccagcatttgtgaagtgtttatataggcactacagtgatacattcctgtttaaggattatgacanctgcttgtcctctctatctctctnggcgacttgatggcatttntgcttagcagattgtacatatgttttatacgtctttcttcacctcatatgt

SEQ ID NO: 687368 - DNA, 893 bp, Homo sapiens
  misc_feature (41)..(41): n is a, c, g, or t
  misc_feature (78)..(78): n is a, c, g, or t
  misc_feature (88)..(88): n is a, c, g, or t
  misc_feature (206)..(206): n is a, c, g, or t
  misc_feature (229)..(229): n is a, c, g, or t
  misc_feature (240)..(240): n is a, c, g, or t
  misc_feature (261)..(261): n is a, c, g, or t
  misc_feature (263)..(263): n is a, c, g, or t
  misc_feature (266)..(267): n is a, c, g, or t
  misc_feature (279)..(279): n is a, c, g, or t
  misc_feature (283)..(283): n is a, c, g, or t
  misc_feature (287)..(287): n is a, c, g, or t
  misc_feature (293)..(293): n is a, c, g, or t
  misc_feature (315)..(315): n is a, c, g, or t
  misc_feature (320)..(320): n is a, c, g, or t
  misc_feature (353)..(353): n is a, c, g, or t
  misc_feature (356)..(356): n is a, c, g, or t
  misc_feature (358)..(358): n is a, c, g, or t
  misc_feature (361)..(361): n is a, c, g, or t
  misc_feature (368)..(368): n is a, c, g, or t
  misc_feature (381)..(381): n is a, c, g, or t
  misc_feature (391)..(392): n is a, c, g, or t
  misc_feature (400)..(400): n is a, c, g, or t
  misc_feature (415)..(415): n is a, c, g, or t
  misc_feature (450)..(450): n is a, c, g, or t
  misc_feature (459)..(459): n is a, c, g, or t
  misc_feature (462)..(462): n is a, c, g, or t
  misc_feature (497)..(497): n is a, c, g, or t
  misc_feature (500)..(500): n is a, c, g, or t
  misc_feature (521)..(521): n is a, c, g, or t
  misc_feature (526)..(526): n is a, c, g, or t
  misc_feature (529)..(529): n is a, c, g, or t
  misc_feature (539)..(539): n is a, c, g, or t
  misc_feature (706)..(706): n is a, c, g, or t
  misc_feature (813)..(813): n is a, c, g, or t
  misc_feature (872)..(872): n is a, c, g, or t
ttaaaggaatccatataaaaagaaaagcaaatccattaganattgatataaacagttgattttatctggaaccaagantgtgaatganttggaagcctagatgtcctaacctgtttctttgcataaaatggccagtagatattttgaaatttgatgatggcaattatactttattactttacatagagctttgtttttagctaatnttttagagacagattacccaaanttacctaattnggttcccacttcattccttcncnaannccaaccctaaanccgngggnggccgnccgtggtggcccccgcctgtcntcccngccctccgggaggccgcggcggggggccccccnggncnggngtctgcnccccccccgcccnccatggcgannccccgtcnctccccccccccccncccccacccaggtgtggcgcgccccccgcctgccntccccgccnctnaggaggccgacgcacgcgagactcgcttgcccccnggngccggcggttgcgcgcgacgncccgnccncgctgccacngcctccagcctgggcaacagagcaagactctgtctccaaaaaaaaaaaggaaagcagaagggggcattttcctgtcttcaaaatacaacctcctgctaagactagcaagtcagcagaaactcattgcatttgggcttctggttactaaatgaattaagagacaccgngttccatccttagatgtccacatagatcccattgatcaaataatccagtcttgagtaacgtttcctgcggagtgattccgagaggattctacccaggaggacgaggnctatcaccaggaacaggacaccaaagagcagggaccgataagaagcatttttcaatggnaaggcgttctgattttctgga

SEQ ID NO: 687369 - DNA, 496 bp, Homo sapiens
ttaattaatacatataaagcacctgctacagtatctgggttcagtaagtactctgtaaatatttgcttgtgatagaaataacttttcttttaacccctgtggagaggtaggaggtagtgtcatcaatgactcagtgacagtgagagaaagggtgaggttgatggtaacttcttaccttggtagtagcagcagtctcacaaatgcctcctgaggaaaagggataactgggagctcattctttagggtcaaatagacccaaacaggaaatctttcctattgtgaatgaccttgcgcaagttatttcactaaaaagtctcaggtgactcagtgttaaaaagggaatagcagtatctacttaacaaaagtgttctaaggatgaaatgagatcctgaatgtaaagtggttccctctttacttttggagattgttgcaagggctcaccctaaggattaactggattcaaagctcattccttgactactgtcttgtactatct

SEQ ID NO: 687370 - DNA, 1255 bp, Homo sapiens
aacagcgaactgtttatcatgaatacagaatgtgggcaaactcgcttctgtgccggccgccagaaggtttgctgagggcaatcactccctggtgccgggctccttgaggttatgcactgggacatctagagcctattgtttgaggaatgcagtcttgcaagcctgctctggatcaagccacagactgaaacacccccgaagagcaagcacgtttcttggagcaggctaagtgtgagtgtcatatcttcaatgggatgaagcgggtgcagtacctgaacagatacatccataaacgggaggagaacctgcgcttcgacagcaacgtggaggagttccaggcagttacggaactggggcggcctgtcgcagagaactggaacagccagaagggcatcccggaggagaagcgggacaagatggacgactactgcagatacaattacggggttttttgagagcttcacagtgcagccgcgagtccatcctaaggtgactgtgtatcctgtatccttcaaagacccagcccctgcagcaccacaacctcctggtctgctctgtgagtggtttctatccaggcagcattgaagtcaggtggttccggaacggccaggaagagaaggctggggtggtgtccacaggcctgatccagaatggagactggaccttccagaccctggtgatgctggaaacagttcctcgaagtggagaggtttacacctgccaagtggagcacccaagcgtgacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgcagatgaccacattcaagggggaaccttctgccccagctttgcatgatgaaaagctttcctgcttggctcttattcttccacaagagaggactttctcaggccctggttgctaccggttcagcaactctgcagaaaatgtccatccttgtggcttcctcagctcctgcccttggcctgaagtcccagcattgatggcagtgcctcatcttcaactttagtgctcccctttacctaaccctacggcctcccatgcatctgtactccccctgtgtgccacaaatgcactacgttattaaatttttctgaagcccagagttaaaaatcatctgtccac

SEQ ID NO: 687371 - DNA, 159 bp, Homo sapiens
ttagaatgggagtccaacagagtatgtgctaatacactgcttcctataatagcatgtaatttgttaaaactccataaacatagaagtctagttaagtattttacattcatagacccgcaaaggcaatacaactgttacgttttaataagcgacattcta

SEQ ID NO: 687372 - DNA, 1224 bp, Homo sapiens
agcggataatttggaatgtgggtggagggggatcatagttctccctgagtgagacttgcctgctcctctggcccctggtcctgtcctgttctccagcatggtgtgtctgaagctccctggaggctcctgcatggcagcgctgacagtgacactgatggtgctgagctccccactggctttggctggggacacccgaccacgtttcttgtggcaggataagtatgagtgtcatttcttcaacgggacggagcgggtgcggttcctggacagatacttctataaccaagaggagtacgtgcgcttcgacagcgacgtgggggagtaccgggcggtgacggagctggggcggcctgacgctgagtactggaacagccagaaggacatcctggaagacaggcgcgggccgcggtggacacctactgcagacacaactacggggttggtgagagcttcacagtgcagcggcgagttgagcctaaggtgactgtgtatccttcaaagacccagcccctgcagcaccacaacctcctggtctgctctgtgagtggtttctatccaggcagcattgaagtcaggtggttccggaacggccaggaagagaaggctggggtggtgtccacaggcctgatccagaatggagactggaccttccagaccctggtgatgctggaaacagttcctcgaagtggagaggtttacacctgccaagtggagcacccaagcgtgacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaaatgcagatgaccacattcaaggaagaaccttctgtcccagctttgcagaatgaaaagctttcctgcttggcagttattcttccacaagagagggctttctcaggacctggttgctactggttcggcaactgcagaaaatgtcctcccttgtggcttcctcagctcctgcccttggcctgaagtcccagcattgatggcaggtcctaatcttcaacttatgtgttaccccatacataatcggttgttccaggggagggggaagctttcctctgtatttgttgccagtgaaattccaataaatgggatttgaaataaacaaaaaa

SEQ ID NO: 687373 - DNA, 159 bp, Homo sapiens
aaaaatgtttaaaacccgttttttaaaattttttcggttttgggcccccccctttccccccccggaaattttttaatttttttccccccattttaaaaaaaaaatgttttgggggggggggttttttttttttaaaaatttaagggcccccccccttta

SEQ ID NO: 687374 - DNA, 672 bp, Homo sapiens
  misc_feature (147)..(147): n is a, c, g, or t
  misc_feature (417)..(417): n is a, c, g, or t
ctcccaaatcgctgagctgctgtttaaaaaaaaaaaaaaggaaaaggaaaaagcatgacatggggtatcgatttttggtggtggaccaaaatcacacacattggaaacttgtaattccaacagagggggaaagctcagcagattctngggcttcagtcattcactaaatcaggcagggattggtgccaatgggagcacactatatcagaattaattcccctttaccaggggttccttaatgggcatcctaaaattcactggcacatcaacattcatctaatcccattcaatccagggtggaattcaaacatttatgtgatttacacagttattcacacagtgcacatggcctcagccgatttaattgggaaaaccgtggtttggggtgaaaaccatgtgtgtcttaacccccagaanaaagacgtcgtaggccaattcttccatatataaagagtataccatattttacacaacaaacttttaaaggggcttaatttatttatcaaatgtgttcaaaaagggttaattttaacattttatcttattgtgtctcaagaggccagcttttaaagagggggagaaattctttcagagaggtttaaaaaagtctagaggggccaggtgttttcgtgaagcccaaacagtgggaaataaattttcttaaattgtgga

SEQ ID NO: 687375 - DNA, 1752 bp, Homo sapiens
agcggataatttggaatgtgggtggagggggatcatagttctccctgagtgagacttgcctgctcctctggcccctggtcctgtcctgttctccagcatggtgtgtctgaagctccctggaggctcctgcatggcagcgctgacagtgacactgatggtgctgagctccccactggctttggctggggacacccgaccacgtttcttgtggcaggataagtatgagtgtcatttcttcaacgggacggagcgggtgcggttcctggacagatacttctataaccaagaggagtacgtgcgcttcgacagcgacgtgggggagtaccgggcggtgacggagctggggcggcctgacgctgagtactggaacagccagaaggacatcctggaagacaggcgcgggccgcggtggacacctactgcagacacaactacggggttggtgagagcttcacagtgcagcggcgaggcagcattgaagtcaggtggttccggaacggccaggaagagaaggctggggtggtgtccacaggcctgatccagaatggagactggaccttccagaccctggtgatgctggaaacagttcctcgaagtggagaggtttacacctgccaagtggagcacccaagcgtgacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaaatgcagatgaccacattcaaggaagaaccttctgtcccagctttgcagaatgaaaagctttcctgcttggcagttattcttccacaagagagggctttctcaggacctggttgctactggttcggcaactgcagaaaatgtcctcccttgtggcttcctcagctcctgcccttggcctgaagtcccagcattgatgacagcgcctcatcttcaacttttgtgctcccctttgcctaaaccgtatggcctcccgtgcatctgtactcaccctgtacgacaaacacattacattattaaatgtttctcaaagatggagttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttgggcccccttggcccaagccattttaaacctgaaaaattttattcatggcccccaaatttgggccaaattggccaaatccccctaaaggggggcgattaaaaattaaagggcccggtttttaaaaacgtggaactggaaaaaccctggggttacccaaataaaacccctttgaaaaaaacccctttttcccaagtgggataaaaacaaaaaagcccccaccaaacgcctttccaaaaaatttcccaacctaaatggcaaaggaaaattgaccgttaaaattttggaaaaaatcccggaaaaatttttgaaaacaacctaatttttaaacacaaaggccaaaattggaaaaacccctttaatattaaaaaaaattccccgaaaaaggttaaagggtttccacagttggaacacaagagccctcttttaaaaaccgggccttcaccctaaaaagcgaacccttataaagggcaaggcccattcgggcctcccct

SEQ ID NO: 687376 - DNA, 232 bp, Homo sapiens
cccccacaggggggttttttccccggggggggggggggggcccccctttttttttttccccttttttccccccccccccccccccccagggggtttttttttccacaatttattaggggggggttttcccccggtttttttccccaaaatttttttgggttttttttggggggttttccccccccccccccccggggggggtttcctttttttaaaaaccgcggggggggga

SEQ ID NO: 687377 - DNA, 318 bp, Homo sapiens
ataatcctgagtataccatcgatcggcgagtctgaatggtctatctttgatgaattgccggcgccggatgaaatatccaggacggttaggaattagaattgtctgctacatacaaaggctatgtgaggtgtttgaagagtatgcaatgaacgattttcggtctgtttgtcgtaggcagatagagcttgtaataattatgcctcatagggatagctacaagggaggggtaggctatgtgttttgtcagggggttgagaatgagtgtgaggcgtattataccatagccgcctcagttgtcagagtactgcgacaagtact

SEQ ID NO: 687378 - DNA, 1363 bp, Homo sapiens
  misc_feature (231)..(231): n is a, c, g, or t
cgacatgttaccaaggatgataaataggtgccaagtggagcaccagctgtgatgagtgccctcacagtggactggagtgagaagctttcgtgacctcataaagtgaaggcttatcttcagtcattgtgttatatattttacgtgcattagtcctcatataaacccaagaggtaaattagtataattatcgttcattgtaggtgacaaagttgagacacagaagaatcaaanaactcttccaggatcaaccagtaaaaggcagaccttggattcgaaccaggcaacctggctcaaatatcagttttaattactacactctgtactttccaagatttgtaaacagtttgacaatgcatgccgatttaaaactatgaagaaacaaacacaatttttcacaacacctctcaaatctaatgggtcctcactgtcaagattaaattccaggctgatgacactgtaaggtcacatggccagctgtgctataggcctggtcaaggccagagcctgggtttgcagagaagcagacacacagccaaaccaggagacttactctgtcttcctgactcattccctctacgttgtttttctcctagtccaacctaaggtgactgtatatccttcaaagacccagcccctgcagcaccacaacctcctggtctgctctgtgagtggtttctatccaggcagcattgaagtcaggtggttccggaacggccaggaagagaaggctggggtggtgtccacaggcctgatccagaatggagactggaccttccagaccctggtgatgctggaaacagttcctcgaagtggagaggtttacacctgccaagtggagcacccaagcgtgacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgcagatgaccacattcaagggggaaccttctgccccagctttgcatgatgaaaagctttcctgcttggctcttattcttccacaagagaggactttctcaggccctggttgctaccggttcagcaactctgcagaaaatgtccatccttgtggcttcctcagctcctgcccttggcctgaagtcccagcattgatggcagtgcctcatcttcaactttagtgctcccctttacctaaccctacggcctcccatgcatctgtactccccctgtgtgccacaaatgcactacgttattaaatttttctgaagcccagagttaaaaatcatctgtccac

SEQ ID NO: 687379 - DNA, 337 bp, Homo sapiens
  misc_feature (21)..(21): n is a, c, g, or t
  misc_feature (40)..(40): n is a, c, g, or t
gactctagagcatccccccgngagacgaccttgtcattgngatttttttaagttctgggattcatgtgcaggacatgcaggtttgttacatgggtaaacgtgtgccatggtggtttgctgcacctgtcaacccatcatctaggtattaagcccaacatgcattagctatttatcctgatgctctttctcccctcatccctgacaggccacagtgtgtgttgttccactccctgtgtccatgtgttctcattgttcagcccccacttagaagtgagaacatgtgcgatttgtgttttttgaccctgtgatattttgctgaggataatggctttcagct

SEQ ID NO: 687380 - DNA, 1966 bp, Homo sapiens
  misc_feature (231)..(231): n is a, c, g, or t
cgacatgttaccaaggatgataaataggtgccaagtggagcaccagctgtgatgagtgccctcacagtggactggagtgagaagctttcgtgacctcataaagtgaaggcttatcttcagtcattgtgttatatattttacgtgcattagtcctcatataaacccaagaggtaaattagtataattatcgttcattgtaggtgacaaagttgagacacagaagaatcaaanaactcttccaggatcaaccagtaaaaggcagaccttggattcgaaccaggcaacctggctcaaatatcagttttaattactacactctgtactttccaagatttgtaaacagtttgacaatgcatgccgatttaaaactatgaagaaacaaacacaatttttcacaacacctctcaaatctaatgggtcctcactgtcaagattaaattccaggctgatgacactgtaaggtcacatggccagctgtgctataggcctggtcaaggccagagcctgggtttgcagagaagcagacacacagccaaaccaggagacttactctgtcttcctgactcattccctctacgttgtttttctcctagtccaacctaaggtgactgtatatccttcaaagacccagcccctgcagcaccacaacctcctggtctgctctgtgagtggtttctatccaggcagcattgaagtcaggtggttccggaacggccaggaagagaaggctggggtggtgtccacaggcctgatccagaatggagactggaccttccagaccctggtgatgctggaaacagttcctcgaagtggagaggtttacacctgccaagtggagcacccaagcgtgacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaaatgcagatgaccacattcaaggaagaaccttctgtcccagctttgcagaatgaaaagctttcctgcttggcagttattcttccacaagagagggctttctcaggacctggttgctactggttcggcaactgcagaaaatgtcctcccttgtggcttcctcagctcctgcccttggcctgaagtcccagcattgatgacagcgcctcatcttcaacttttgtgctcccctttgcctaaaccgtatggcctcccgtgcatctgtactcaccctgtacgacaaacacattacattattaaatgtttctcaaagatggagttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttgggcccccttggcccaagccattttaaacctgaaaaattttattcatggcccccaaatttgggccaaattggccaaatccccctaaaggggggcgattaaaaattaaagggcccggtttttaaaaacgtggaactggaaaaaccctggggttacccaaataaaacccctttgaaaaaaacccctttttcccaagtgggataaaaacaaaaaagcccccaccaaacgcctttccaaaaaatttcccaacctaaatggcaaaggaaaattgaccgttaaaattttggaaaaaatcccggaaaaatttttgaaaacaacctaatttttaaacacaaaggccaaaattggaaaaacccctttaatattaaaaaaaattccccgaaaaaggttaaagggtttccacagttggaacacaagagccctcttttaaaaaccgggccttcaccctaaaaagcgaacccttataaagggcaaggcccattcgggcctcccct

SEQ ID NO: 687381 - DNA, 1838 bp, Homo sapiens
agcggataatttggaatgtgggtggagggggatcatagttctccctgagtgagacttgcctgctcctctggcccctggtcctgtcctgttctccagcatggtgtgtctgaagctccctggaggctcctgcatggcagcgctgacagtgacactgatggtgctgagctccccactggctttggctggggacacccgaccacgtttcttgtggcagcttaagtttgaatgtcatttcttcaatgggacggagcgggtgcggttgctggaaagatgcatctataaccaagaggagtacgtgcgcttcgacagcgacgtgggggagtaccgggcggtgacggagctggggcggcctgacgctgagtactggaacagccagaaggacatcctggaagacaggcgcgggccgcggtggacacctactgcagacacaactacggggttggtgagagcttcacagtgcagcggcgagtccatcctaaggtgactgtgtatccttcaaagacccagcccctgcagcaccacaacctcctggtctgctctgtgagtggtttctatccaggcagcattgaagtcaggtggttccggaacggccaggaagagaaggctggggtggtgtccacaggcctgatccagaatggagactggaccttccagaccctggtgatgctggaaacagttcctcgaagtggagaggtttacacctgccaagtggagcacccaagcgtgacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgcagatgaccacattcaagggggaaccttctgccccagctttgcatgatgaaaagctttcctgcttggctcttattcttccacaagagctttctcaggacctggttgctactggttcggcaactgcagaaaatgtcctcccttgtggcttcctcagctcctgcccttggcctgaagtcccagcattgatgacagcgcctcatcttcaacttttgtgctcccctttgcctaaaccgtatggcctcccgtgcatctgtactcaccctgtacgacaaacacattacattattaaatgtttctcaaagatggagttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttgggcccccttggcccaagccattttaaacctgaaaaattttattcatggcccccaaatttgggccaaattggccaaatccccctaaaggggggcgattaaaaattaaagggcccggtttttaaaaacgtggaactggaaaaaccctggggttacccaaataaaacccctttgaaaaaaacccctttttcccaagtgggataaaaacaaaaaagcccccaccaaacgcctttccaaaaaatttcccaacctaaatggcaaaggaaaattgaccgttaaaattttggaaaaaatcccggaaaaatttttgaaaacaacctaatttttaaacacaaaggccaaaattggaaaaacccctttaatattaaaaaaaattccccgaaaaaggttaaagggtttccacagttggaacacaagagccctcttttaaaaaccgggccttcaccctaaaaagcgaacccttataaagggcaaggcccattcgggcctcccct

SEQ ID NO: 687382 - DNA, 626 bp, Homo sapiens
cagtcgccatctaacgaccgctaggggggtcgactgctatagccaatcaaagcgatgcctaaatcaaaggaacttctttcttcaagctattctgccagcgattctgacagtgaggttgacaaaaagttaaagaggccaacgcaagttgctccacaagatcctgcaaagttttcagagggtggggagacttaaagagccctcccagaaaataacagagcaagtttatttatcttggtcccatgtttcagattacgcaatagagactcgttcgggtcctgatataaaaagataaacgaccacctcatataagcgattctcaacatagaccctcaatggcttataagtaaaacgccttgaccacttatgttttctaatttctaacacaccgccacaaaggtaacaccccctccttctcccgtactcgttcagagtcacactaccactaccttccttcttttcttcatcgcataagcatctctaccttctcgtaacacccacttaaatatatatcattcagtaatattatatctcttcaccttacaccccccccttcttgcacattcctctctacaattcactactttttcctacatcattcattttttccttcacatccaaattataat

SEQ ID NO: 687383 - DNA, 366 bp, Homo sapiens
  misc_feature (47)..(47): n is a, c, g, or t
  misc_feature (78)..(78): n is a, c, g, or t
tctaggtgtttgtaagccaggaggcccagagtgtctgactcctttgntatgctggggaatagcatgacttcagggttntgtggacccagatctgcagcaatccatatgtgagtttgatctgtcttccgtgattccatcacagatgtccaaccagacagtgaactatttccctcaagggaaaatctcaggccataaacaatgccagggtttttgcagatggaggaggtgacaggcagataagttccacggtggcactggcattgcttggtctagggtcagcacaagctctgagcatcctttgggtacaagtgtatcctttccagactttgtcaatgacattgctggcctttctcaagcaataacacc

SEQ ID NO: 687384 - DNA, 984 bp, Homo sapiens
cgttatggcaagaggattgtgccgcccacgccgcctgcattggtatggcttgggttgcagaaggacaacttcctgttgttgaagaagaacaacgtttgtgtggtttcgttccgctcccacgcataggtggttgttgtttgtcgctgccgccccccgccgcttgttgtatggtgaggagaaggagatggaatagagtattggaataggtgtgtttgacggacatacgacccaccccgggcgcccacagaagatttagtatagttggttgccacagcaatctggtaagagcacgcccccgcacacacttctcttttattagagggaagaccccagtctttttaagagagaacttcttttgggtggcgccgaacacgatgatgctatcagtgtgaggacggacaaccaccacgcctgtggggtaggaagagggcgctctctctctctatagacagggttgcgcacatgtttctggattcactcctcccacccctctgggataatagtggagggtgtgaatgagcgcacacacaacatcttatgtattagaaagagcggtctggaacaataccagtggaggacaacacacacaacaacaagcactgtctgactcacacttattatgtgtgcgcacccgtaatagcgctgcgcacccccagcctactcatgtggatatctcttgtacacataacaacacccacattggcgttatcacacatcttttatcaccacaaagatctcagagatctcctggtgctgccattgagagaaaccacataatttgttgtgcctcttgcctttattacacacaagttgctacaataaaaatttataaccaacctgcccccaaactcccaaggataatatacgttcctacaccctttccaaattttggggacccgttttgggcccccaaaaggcccccccccggggtcccaaacagggttccttggaatttccccccgcttttttttttaaaacccctta

SEQ ID NO: 687385 - DNA, 353 bp, Homo sapiens
gtcacgccgtgtcacaacacacacaagctcacaaagagctaagacactacacacatctccacagcacacaggcacatctcaaaagggtctgtccagtagttccaggcgagggaagggtgatggcctaagccaccagctccagctttcttttctttcttttttttttttgggagcgggagtttggcccttgttctcccaatgggtatatacaattttcagagcctctggtatatgggaaggcggaaagggcccagacttgggaatagtgtctgggttacactgtttgggtttggattttttttgggtttggatttttttaaacctaaggctatataaggttggggaacttgggc

SEQ ID NO: 687386 - DNA, 1744 bp, Homo sapiens
gtttttgcaaatcacaaattctacaatcatatgatacgtatatgacctatcatagatactgggaatttaggtttgcagagctgcacgatggtggctattgggccaaatctatcttgaacacttcttaaatttggatcaaagaatttcaggaggggagaaaacacttcctttaaattgaatggcttcatttaaaaaaaaatccagagatttaggcctaaagtcaaatttcaccttcttacaaacaaaaaatcaaaggtctagcaatcttcaattcagcagttccatattgacagagcacaatttccatattcatagactacagccctacagggagtaagacatccatggatgtcagcaagaaattcacatataattacttgcaaaataagttggtttatcaaataacatatcttggattgatttatgtcattcttcctcctggaatatttttgccctttatccttcaaggcataaagtcttgaaggtacatctaagtataataccactttatcagaaattcaattcaacacatctctacaagaagtaagataaataaataaataaattagcctggcgtggtggtgtgcctgtagtcccagctacttgggagggctgaagccaggggattgctgggcccaggtgttcaaggttatagtgaactatgatcttaccactacacttcagcttgggtgatgaagtgagacccctgtctctaaaaacaaacaaaggaacatttcataacgtgaaaattatataaaatttgaattttaatgtccataaataaaatgttattggaacacagccacactgacttgtttatatattgtctatagctgttttacacattacaagggcagagttgagtagttatgacagagactacatggcccacaaagctgagaatatttactatctagcgcatgttatgaaaaattctgctgaccccagctttaggaaagatcatgtctactaggaggaacagtgactctggaccacaataaacatgattttttttcccattaatattccatttagctttaggcaagtcatttaagctctctgagccactgaattctctactgttatatgggaatgatatctataatataggatttttgatgcaaagataagcagtattttttcattgcagcagtggcaatgcaataaatgttatttgatattattattgcatattgtttacttagcattgcatcaaacttttaattacctctgactgaggaatcataatttatgggaagcagtctactatgggattttattcactatagcctcctatatacatggcctgaaaaataggatggaattgtcgttatcttcatggtagttgtgaatactggtacctgtgttcagttatctggtttgagcaaataaatgcaagtattaagtctgagacaaaaggttcctattaatctgtggaaggtagtaacttcaaaaagagggggaaaagggggaatcagtataatgcccactggatcagttctcattgagagacaattctccagcaagtatttactttctaccccttcttcaaataattactcaccaaagcaatatcaatgggaaactcaacaaaataagcagcaaagagctttcaaaaaccccatgaggcagaaaaaaaacattagattcttttatactgttatttattttctcctataatagaaataatggccatagcactgagtattctcatttgtttggctgcataatcaagcaaaaaaaa

SEQ ID NO: 687387 - DNA, 281 bp, Homo sapiens
ctctcagcagtcagaggctttgcttgcctctgtgcagatttttaattttcttttttgggccctaggctgggttggggacctcctacagcttcattctttcaccattaaatagtgggcctttttcagtattttccctcttccccttttataaattatgctaaagccacaaagtcacatttttggggatcatagataggttgggggttccatgataaggcatctgttgtgatgggttccattgatgtgggatttcccttactttgcttgtattctcagtttct

SEQ ID NO: 687388 - DNA, 934 bp, Homo sapiens
  misc_feature (136)..(136): n is a, c, g, or t
gaggatctactatcgttatctccatgcgtatgcttcggatcgtcggggcctggttgatcacactagttgtataacacgtctagctaggcgcgatacttcggaagagtagtggcatagcatattatggttacacttntgtgtgatacgatcatcgtgcgagtgactgacgtgctcatagggattcaaatgtgtacctgtaaccaacatcagatatccgctcatatcctgtactggtcctctgtctattactatggtctcactcaagatgcgataatacggatcgtcatatgtaggttatagtcgctcgacatactttaactattgccaatgcgggactgactattccatccagtgtgtctccatccgaggtcgtgtataagcatcgttaccatgcaagttatgtgggcatagtgtttcacttagtctcgagagtcaggactggtttgaggatttgtaagtgggtttgtgaggatcgcggaattgaaagatacgtagctctgtcaacgtttgctgttgaagatagtaatgtggggctgggatggggtatctctagtgtcaatcccatgcacattgtgggaggccgatggcgggtgggatcagctgaggtcgaggcatcttggaagaccagagctggacggacatggtgaaaccagtgtctcttcccaaatggatgatttcgcagcttttgtagaagaatttgctgccaaggctgacgcataaaggaagaccttgctttagccgattgatgggtagccccaagcgtggctggctggaatgtcgaagctgccgtgtacggccttattaccttcaaatagaaaccagggatctaagcctagccgtggagaatttgagcacagaaaaatggacgctcgggggcctactgcagcttgttaacactatccagaggggtacagcgaccacctggggaaacaac

SEQ ID NO: 687389 - DNA, 706 bp, Homo sapiens
atggcacatgcagcgcaagtaggtctacaaggacgctacttcccctatcatagaagagcttatcacctttcatgatcacgccctcataatcattttccttatctgctttcctagtcctgtatgcccttttcctaacgaactcacaacgaataatctaagctaatacataaactatctcacgacgctcacggaaatagaaaccgtctgaactatcctgcccgccatcatcctagtcctcatcgccctcccatccctacgcaatccctttacgataacagtacgtaggtcaacgatccctccctttaccatcaaatcagattgtgccacgcaatgtgtactgaacctacgatgttacaccgactacggctggactaatcttcaagctcctacattacttcccccattattctctagaagcatggctgacctgcgactccttgacgtttgacaatcgagtagtactcccggattgaatgccccctattcgtataataattacatcacaagactgtcttgctactcatgtagctgtccccgcattaggcttagaaacagatgcagatgcccggacgtctaaagcaaaccactttcaccgctacagcgaccgggggtatactacggtcaatgctctgaaatctgtggagcataccacaagtttcatgcccatcgtcctagaattaattccctaaaatctttgaagtagggc

SEQ ID NO: 687390 - DNA, 183 bp, Homo sapiens
  misc_feature (178)..(178): n is a, c, g, or t
ggcacgagctcaagtgatctccaagtgaccctcctgcctcagcctcctgagtaccctcctggggactgcgggtgcgtgctaccatacccggctaatttttgtatttttttggtggagacagggtttcgccgtgttggttaggctggtctcgagctcctgacctcgtgatccgcccgcntcggc

SEQ ID NO: 687391 - DNA, 572 bp, Homo sapiens
acagctcttagatcaatctatacggagctcttactagtttggtgaaaatgaaaaagaaaatgtgcatgccaaggagttcctctcagcacaagacaacaagagagctcatgaattaatagaggcagaaggaatagaagatataaaaaaagaggacatcgaaagtcaggaaattgaagcacaagaaggtgaaaatgcatcacctttctcaccagcccaggatggtgaggaagaagaaacatgagaaaggtatagcaggtgcaggtgatggtacacaagaatgtcatctcaacacctcttccttcagaagggagcctagctgaggctgcatcacacagctcatgaagcagcatgggcagctcatacgactgtgaaagaagctgaggatgcacaccatctcggtcacaatccaggctgaagatgccatcacgtctgaatttggatggtgatgacctcctagaagcaggtaaaaatgtgaaaattacagatactgaagcaagtaagccaaaggatgggcaggcagccattgcacagagcccggaagaaggcaagacaggataatgagatgaatggaa

SEQ ID NO: 687392 - DNA, 684 bp, Homo sapiens
caattccattgccagacgtacaacaactatctgatcttagacaaacctgagaaaaacaagcaagggggaaaggattccctatttaataaatggtgctgggaaaacgggctagccatatgtagaaagctgaaacgggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagacaaaatagacaaatgggatctaattaaactaaagagcttctgcacagcaaaagaaactaccatcagagtgaacaggcaaccgacaaaaggggagaaaattttcgcaacctactcatctgacaaagggctaatatccagaatctacaatgaactcaaacaaatttacaagaaaaaaacaaacaaccccatcaaaaagggggcgaaggatatgaacagacacttctcaaaagaagactttatgcagccaaaaaacacatgaaaaaatgctaacatcactggccatcagagaatgcaatcaaaacactagagatatcatctcacacagtagaaggcgacatcaaagcggaacaggggacgtgaatgatgggtacgagccgat

SEQ ID NO: 687393 - DNA, 245 bp, Homo sapiens
gggttagtgatctgtctttcttggcattttaaaataatatataggcaggcacagtagctcacacctgtaattccaacacttggggaggccaaggcaggcagatcacttgaggtcaggagttcaaccagcccggccaatgtggtgaaatcccatctctactaaaaatacaaaaattagccaggtgtggtggtgtgtgtctgtaatgcatataattgtgtgtgcctcagctacatgggaggctgagg

SEQ ID NO: 687394 - DNA, 877 bp, Homo sapiens
ggctggcgcgtcgaggggagaggcagctgccgggatggacgtgtcctcatgatccggcgccataaagaccacgcatcttcacgtgcctgccgaatggtagtacagctacggtgtatcgacacctgaaggcgcatcgtccgatgggcaatcctctaagcggcctccgtgagcgagcagtcggctgtcacaaggcatgagccaactctatggattgagtgcgcaatgatactgtgcgacgcaggttgtaggtttacacgcagtcgaaaccaagaaactggtcaccaggcgcccagtctacatgtggggctggcctttccgggccagatgacacctgtgtgaggccctgtgtgctttcgaagccggtattttccagctccgccagagtcttgcccggagtgtgatgaatgccccaggactcgggaagcagtgccaattgaacaagcctgtgcaagtgagacctccgcaagagggcccattttccccccaataacaacgagattttgggagtcacataagacacaaccaaattacattattataaaaattctttgtggtgaggtggtttcggtcttagggaaaaatacttttttttaaagcccattctctgtttgggagcgcgagggtggccactaattgtgttagtcgtgtgcatttgtggcctatgggctgtgcctcagaagagaaatctcgggcgtctaggtacagatggggctgggggtgtttctcacactaatttgaaaaaaaagcgcgcggggggaacacccgaagtgttctgaaacaacttcccacagagggagtccaggagggggcaccacagcggggctcttacacacgggagtcccagagggacgcgagatttcattaacgcggcggtgtg

SEQ ID NO: 687395 - DNA, 590 bp, Homo sapiens
gagctccgcctttgcctccaaggctttgctggcttgtgcggcatcctgctccgtctgcaggttgtgcttccggtgcggaggtcagggacaagatggtgccaccggtgcaggtctctccgctcatcaagctcggccgctactccgccctgttcctcggtgtggcctacggagccacgcgctacaattacctaaaacctcgggcagaagaggagaggaggatagcagcagaagagaagaagaagcaggatgaactgaaacggattgccagagaattggcagaagatgacagcatattaaagtgagtgaccctgcgacccactctttggaccagcagcggatgaataaagcttcctgtgttgtgtgaaaaaaaaaaaaaaaaaaaaaaaaaaaaaaaaaaaacaaaaaaaaacaaaaaacattagtgtggcggggcccgcccggcgcgcccacgcgagaaagagttttacaaacacaccaccggtggggggcggggcggcgcgccacaaggtgtaggaacacgggggacaaagggggtcccagaaggaaaaccgggggaccaaaagggggggggtatcccacccaaaaaaggc

SEQ ID NO: 687396 - DNA, 580 bp, Homo sapiens
tgattgtggaaagatgagacattgagataactagttggaatttgtttttgtgagctgtgtaaagaactaaattgattttctccccagatgaatcagagttatgtaaaaagtgaaatcattaaaaatgtatgtacaggccgggcgtggtgactcacgcctgtaatcccagcactttgggaggccaaggcaggcggaccacaaggtcaggaggtcgagaccatcctggctaacacggtgaaaccccatctctactttatatatacacactgaggcaggagagtggcctgaacccactacgtagagcttgcagcgagccaacatcgttccactgcactccagcctgggcaacagaccgagattccatttcatagcaaataccaacatgtgcgtacacaatccctatgaaaccaccattcgaatatgccccaactacttcgatccactgggaaggcgccgtctgatgaacattgaccttcaatcccatgtggagatggcttattccgggcttaccttcactcggattccctacattatttccttgccatccagtcccacgccatacttcctccttgctttttcg

SEQ ID NO: 687397 - DNA, 135 bp, Homo sapiens
ctgtgtgctcagcaagaattcccggatgttgtcacctgtgctgggctccctagactcctccccaaagccctgcgtgtccttctttttcagcttaaagttcagcaccgccccggcattcatcagcaacgtgtggat

SEQ ID NO: 687398 - DNA, 357 bp, Homo sapiens
gagctccgcctttgcctccaaggctttgctggcttgtgcggcatcctgctccgtctgcaggttgtgcttccggtgcggaggtcagggacaagatggtgccaccggtgcaggtctctccgctcatcaagctcggccgctactccgccctgttcctcggtgtggcctacggagccacgcgctacaattacctaaaacctcgggcagaagaggagaggaggatagcagcagaagagaagaagaagcaggatgaactgaaacggattgccagagaattggcagaagatgacagcatattaaagtgagtgaccctgcgacccactctttggaccagcagcggatgaataaagcttcctgtgt

SEQ ID NO: 687399 - DNA, 163 bp, Homo sapiens
gggacctccattcaaggtcaagttcacagttaggcgaccacagccgctttgtcaactgtgtgcgattctctcctgatgggaacagatttgccacagccagtgctgacggccagatatacatctataacgggaagactggggagaaggtgttcggttgagcgga

SEQ ID NO: 687400 - DNA, 611 bp, Homo sapiens
aatcccagcatttaaggaggtgggaaaattgcttgagcccaggagttcaagaccagcctgggcaacatagggagaccctgtctctacaacacataatttaaaaaaattagctgggtatgttggtatgcacctgtggtccctgctactaggtgtgtggtatgcacctgtggtccctgctactacagaggctgaggtaggaggattatttgagcccaggaggttgaggttacagtgagcaataattatgccttgcacactctagtctaggcaacagcatgagaccctgtcccaaaaaaaaaaaaaaaaaagaacacaaaaaaattttttggggacgcgacagcgggcccacgggaaaacggtatttacaaaacaacaagcggtggaggggcgggcggacccccaataaggaaagaaccactgtgaacaaaaggtgcgcaccacagaaaacaccgcggtcagacaaacaagggggggggtgatacccacacacataaaaaaagggcgcggggaacacacgacacgatgaagaaaacaaccaggagaggagcagcaggggccacaagggccatcacaaaggaggtcacgagaccgaaaaaaatggcgcacgtggt

SEQ ID NO: 687401 - DNA, 398 bp, Homo sapiens
  misc_feature (363)..(363): n is a, c, g, or t
  misc_feature (383)..(383): n is a, c, g, or t
gagctccgcctttgcctccaaggctttgctggcttgtgcggcatcctgctccgtctgcaggttgtgcttccggtgcggaggtcagggacaagatggtgccaccggtgcaggtctctccgctcatcaagctcggccgctactccgccctgttcctcggtgtggcctacggagccacgcgctacaattacctaaaacctcgggcagaagaggagaggaggatagcagcagaagagaagaagaagcaggatgaactgaaacggattgccagagaattggcagaagatgacagcatattaaagtgagtgaccctgcgacccactctttggaccagcagcggatgaataaagcttcctgtgtgtggtnaaaaaaaagactatattacngaatctttcctttgt

SEQ ID NO: 687402 - DNA, 738 bp, Homo sapiens
tggaatcttgatgatcagttggctccctgtcaccattgatgctgctggtacctccaatggtgtccgggttacaggctatgccatctatgctgatgggcagaagattatggaggtggcttcccccacagcaggcagtgtgctggtggaggtgtcccagctgcagctgttgcaggcctgccatgaggtgactgtacgcactatgtcaccccatggcgagtccagtgactccatcccggcccccgttgccccagccctggcttctgcctgccagccagccaggatgtcctgtctctcaccacgaccaagcccagaggtcagaacaccccttgcttcagtctccccaggcttggggataccagctttcccctccggcatcctgtcccccatggaactcaagatttctctgcaagtctttccatagagatgtccaaaggaccccaggaggaacctccagtcccttgctctcaggaagaggctggggcagctgtgcggagcatctcagaagagaagagggctatcgagccaactctgggccaggaaggccctgagcctgtggctccttccctggctaagcaggaagtggagtgcacttcaggagatgctggccctgtaccttgtccacccaaggagagctgacccagaagaagccaagtattgaaggctgccatgggggagatctggactccggggctgaaactttgatctgggaaagaaatttgtgacttggagtcacctggg

SEQ ID NO: 687403 - DNA, 1162 bp, Homo sapiens
gcccattggacccccgtggctggctgcagggcccacacctggtgttagacctcgcacagtggacgctgctgccacagtaataaagctgtgcctacacgcttctgaaactggtgtagtgaacaacctcagttctgtgaaaggctggacgcagcaggaccagaatctccgtggacatctgtctggaggagcaattttactgctgacattttaaatgaaacaaatttaattgatttccaagggtgtccatcagcgcttccttcactgccttgatcatgtcggggtcaccacctgctgggggtttgtcctgcagaccctgactcaacgacggctgaataatgtacacaagacacagatcttatgcttgtcagtcctgctgagcaatccaggccacttacagactccaagaagagtcctgtcagccacggctctgacttgttggacctcccggcatttatttagcacacatttactgacagaagtctcaggctggacaacactcttattgtagaacatacaaatggacattactaacgcacattgaggcctataatgccaacatcaaatatcccaccaatgcacacactagaaggaagctatctgtgcataaatgcttagtaggtgtatggattcatctcactgactgaacactgagtgaagatcaccaggttggaactctttctggcacgaatcttgcacagacactcttcttgagacccactgacggccacagtggcacactgacatttaccgtgctcacatagaacacacctaactgtgacaatgctcggacggtggcacactcctcctcgcatggacccactgttgaccacacggtgtacaccatacagacgcaacccacggacgtaccacatattttgtgggcgcatacagtcgcctcacggagaaacagtagaaccaggacataaaagtacgaagactagtttggtcacatgcagtggcgactagctagctcaagtagtatagataatgtggcatcaccgacattagcaccgccatcgtgacaaatcatacacacgttagacgcctgcaggctgattacgaccccatcgtcgaggtgcgtagctgaacaccagaccaagctgcctcatgcgtacatgacgaacatcacatcgtgcctccaccgatcgcgcccgccagacac

SEQ ID NO: 687404 - DNA, 654 bp, Homo sapiens
gagctccgcctttgcctccaaggctttgctggcttgtgcggcatcctgctccgtctgcaggttgtgcttccggtgcggaggtcagggacaagatggtgccaccggtgcaggtctctccgctcatcaagattacctaaaacctcgggcagaagaggagaggaggatagcagcagaagagaagaagaagcaggatgaactgaaacggattgccagagaattggcagaagatgacagcatattaaagtgagtgaccctgcgacccactctttggaccagcagcggatgaataaagcttcctgtgttgtgtgaaaaaaaaaaaaaaaaaaaaaaaaaaaaaactttttgggcgcggccttgggcccttggaaaaggttttctataaacccattcgcggtggggcgcgcggggggcccaaggtggggaaagtgtgagaactggggccaaaaggcgggtgcccaaaggggaacccggggcacatgagaaaaggggcgggggttctctccaccatttaaaaaaccgccgggggggaaaccggaggggtccttggaacaacttccagagaggggggtccggaggggccaataacggggagctcttatcaccggggggcccaaggggaggctggatactaaattagccggccgggggggggaa

SEQ ID NO: 687405 - DNA, 204 bp, Homo sapiens
tgaagtttaatagcagcacaacacacacaatatcttcacctcctagcacacatctgcccttgttgaagaacctaccagctactacagcagcccgggcgcggttgcagcaacacactttcctgagagctccacaacctcaggccgtagtgaggaatcaacagcatccccaggcagcaatgtgctattgaaacttctaaaactagg

SEQ ID NO: 687406 - DNA, 288 bp, Homo sapiens
gctgtattccagctcgctgccgccggccctcagcgccagcggccactgcgccaggcccgccggtatcgcgcccatcggctcctgcagctgcagcatcagctgcttgcggcccagcttcttcatcagcgtcgccttgtcttccaccaggatcagctcgcccttgctgatcacgccgatacggtcggccatttcctcggcttcctcgatatagtgcgtggtcaggatgatggtcacgccacgctcgcgcaggccgcgcaccagcgcccacatgtcgcggcgcagctccgc

SEQ ID NO: 687407 - DNA, 436 bp, Homo sapiens
  misc_feature (402)..(402): n is a, c, g, or t
  misc_feature (404)..(404): n is a, c, g, or t
  misc_feature (406)..(407): n is a, c, g, or t
  misc_feature (410)..(410): n is a, c, g, or t
  misc_feature (412)..(413): n is a, c, g, or t
ccccgcccccatgatcctcgccccgtgaccctcgcccggcgaccggacccccacccctcctgcgacctctgcccagcgaccccgccccccctcctcccgcgacccccgtcccgcgagccccgtttcgcgccgcctctgaccaacctctttcgcagctcggccgctactccgccctgttcctcggtgtggcctacggagccacgcgctacaattacctaaaacctcgggcagaagaggagaggaggatagcagcagaagagaagaagaagcaggatgaactgaaacggattgccagagaattggcagaagatgacagcatattaaagtgagtgaccctgcgacccactctttggaccagcagcggatgaataaagcttcctgtgttgtgtgataaaaaaaaanantnnacncnnccgcgaatttagtagtagtaggc

SEQ ID NO: 687408 - DNA, 486 bp, Homo sapiens
gaaatgcaaaactgtataatctctgttataggggaatttggcaattttacatttaaatttgccttgtgacccagcaatcctgctatattattcctttcatattgctataaaaaaatctgaggctgggtaatttataaagaaaggaggtattttttttcatggttcttcaggctgtatacaagcagggctgttagcatctgctcagcttctgatgaggcccaggaagcttttggtcttggtggaagagaagaggagccagcatattacatgacgagaggaagcaagagagataccaggctcttttaagcaaccagttctcatgtgaacgcattgctactgagaaagtgccaaaccattcacgagggatccactacctagacccaaacacctccccctaggccccgtctccaacagcggggatcatatttcaacatgagacttcgaggagacaaatatccaaaccatatcgcccacgtttaggaatgt

SEQ ID NO: 687409 - DNA, 761 bp, Homo sapiens
gtaccatatgcgacaagattcagaacctagagtgcagggtacatgtttatctctgttacatgaacttacagtgtgctttgagcactgggatcttttagccaagatccatacaaaaagaataggatgtgttccagcatttattaccttactttgctataagtaagagtgaagataggccgggtgtgatggctcatgccagtaatcccagcactttgggctgaagcaggcagatattttgagcccaggaccagcctgggcaacatggtgaaagctcatctctatgaaacaaatttgaatatacatatatatatatatgtatatttaaaaagtgaactataatttgaggcacagaagaatattcttaaaaccttttgtattatacaatagaaacatacaaggttccatcttttattaaatgcttgtgctaaacatgcatagtggcatcaatcagacaaagtgaacaacatttcaacaacaggcacagcagacaacttcagccctttctaagctcgatagcatgttccattaacttttagatcaaagatccttatagcactgaaagaatgtagccttctgcattaatggtaacacggtctagcaagtttccgtgtccactgaggctaccgccactcgctatattaaaccttcctgctatggtacggatatggtcaggtcctcaacaaaaactcatgctggaggcctggagtccccagtcacgataggggatcggcaggtggtgcctctaagaggtgatcaggtca

SEQ ID NO: 687410 - DNA, 952 bp, Homo sapiens
  misc_feature (18)..(18): n is a, c, g, or t
  misc_feature (79)..(79): n is a, c, g, or t
  misc_feature (82)..(82): n is a, c, g, or t
  misc_feature (90)..(90): n is a, c, g, or t
  misc_feature (94)..(94): n is a, c, g, or t
  misc_feature (109)..(109): n is a, c, g, or t
  misc_feature (120)..(120): n is a, c, g, or t
  misc_feature (143)..(143): n is a, c, g, or t
  misc_feature (165)..(165): n is a, c, g, or t
  misc_feature (170)..(171): n is a, c, g, or t
  misc_feature (182)..(182): n is a, c, g, or t
  misc_feature (186)..(186): n is a, c, g, or t
  misc_feature (189)..(189): n is a, c, g, or t
  misc_feature (206)..(206): n is a, c, g, or t
  misc_feature (332)..(332): n is a, c, g, or t
  misc_feature (340)..(340): n is a, c, g, or t
  misc_feature (372)..(372): n is a, c, g, or t
  misc_feature (381)..(381): n is a, c, g, or t
  misc_feature (447)..(447): n is a, c, g, or t
  misc_feature (465)..(465): n is a, c, g, or t
  misc_feature (467)..(467): n is a, c, g, or t
  misc_feature (506)..(506): n is a, c, g, or t
  misc_feature (519)..(519): n is a, c, g, or t
  misc_feature (523)..(523): n is a, c, g, or t
  misc_feature (571)..(571): n is a, c, g, or t
  misc_feature (613)..(613): n is a, c, g, or t
  misc_feature (754)..(754): n is a, c, g, or t
  misc_feature (759)..(759): n is a, c, g, or t
  misc_feature (763)..(763): n is a, c, g, or t
  misc_feature (772)..(774): n is a, c, g, or t
  misc_feature (776)..(776): n is a, c, g, or t
  misc_feature (778)..(785): n is a, c, g, or t
  misc_feature (789)..(789): n is a, c, g, or t
  misc_feature (820)..(820): n is a, c, g, or t
acatgcagggttacggtngagggcagaataaagaagggctgcagaacgtggaagacgaaattcagtaaaacataagccnacnagagaaancatntctgaccaccccccncctccccatcncaccctttggaaactccccaatntaactgagaaccacccaatctnacttnnacattgggtcncagnatntaggtacctgccctgtnggttttttttttttttttttaaacagttttcaaaagttctaaaaggcaagagtgaatttctgtggatttgactggtcccagcttttaggttctttaacacactgacaggactacatagaggctttntcagcatnactttgtcgtctccgtgccaggtgtggcaagntcaccattngcaaatgggaatgacatttgaaagccattagacttataggtgatgcaagcatctaagagagaggtnaatcacactatagaggcntnagtggtatcagttttcatttttctaattgtttaaactgngttttataccagngttngcaagtaattgggtgttagcttagagatggttaaaggtggtttggggnagggacttcgttgtaatggttttgctgtaaaaaatgtttccnactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaantcttntgtntcttctccnnncncnnnnnnnnaccnccttcccctcactcctcccctccttcgtcgntcaacctcttttgttcagtatgtgtaacttgaagctaatttgtactactggatatctgactggagccacagatacagaatctgtattgttcttactgaaatacagcatggaattaacattaaacttaaataa

SEQ ID NO: 687411 - DNA, 1231 bp, Homo sapiens
agcggataatttggaatgtgggtggagggggatcatagttctccctgagtgagacttgcctgctcctctggcccctggtcctgtcctgttctccagcatggtgtgtctgaagctccctggaggctcctgcatggcagcgctgacagtgacactgatggtgctgagctccccactggctttggctggggacacccgaccacgtttcttgtggcaggataagtatgagtgtcatttcttcaacgggacggagcgggtgcggttcctggacagatacttctataaccaagaggagtacgtgcgcttcgacagcgacgtgggggagtaccgggcggtgacggagctggggcggcctgacgctgagtactggaacagccagaaggacatcctggaagacaggcgcgggccgcggtggacaactctgcagaaaatgtccatccttgtggcttcctcagctcctgcccttggcctgaagtcccagcattgatgacagcgcctcatcttcaacttttgtgctcccctttgcctaaaccgtatggcctcccgtgcatctgtactcaccctgtacgacaaacacattacattattaaatgtttctcaaagatggagttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttgggcccccttggcccaagccattttaaacctgaaaaattttattcatggcccccaaatttgggccaaattggccaaatccccctaaaggggggcgattaaaaattaaagggcccggtttttaaaaacgtggaactggaaaaaccctggggttacccaaataaaacccctttgaaaaaaacccctttttcccaagtgggataaaaacaaaaaagcccccaccaaacgcctttccaaaaaatttcccaacctaaatggcaaaggaaaattgaccgttaaaattttggaaaaaatcccggaaaaatttttgaaaacaacctaatttttaaacacaaaggccaaaattggaaaaacccctttaatattaaaaaaaattccccgaaaaaggttaaagggtttccacagttggaacacaagagccctcttttaaaaaccgggccttcaccctaaaaagcgaacccttataaagggcaaggcccattcgggcctcccct

SEQ ID NO: 687412 - DNA, 411 bp, Homo sapiens
  misc_feature (53)..(53): n is a, c, g, or t
tgggtttggactaaaaattttattttaaaagtataaaggatggaggcccgaantttggcatttttaatttaggtttgttttatttaagtttaatgttaattccatgctggtaacagttcaacaatccgtggctgctcattcttgcctactttactctcccactgaagcaggttagcgttgaactcggccgctactccgccctgttcctcggtgtggcctacggagccacgcgctacaattacctaaaacctcgggcagaagaggagaggaggatagcagcagaagagaagaagaagcaggatgaactgaaacggattgccagagaattggcagaagatgacagcatattaaagtgagtgaccctgcgacccactctttggaccagcagcggatgaataaagcttcctgtgt

SEQ ID NO: 687413 - DNA, 771 bp, Homo sapiens
atacaagagaacgcattgccactgatgcttgctgagcccccacagaacttaattgcccaagtctcaggtctggtactggtaaaacagtctgccttcgttgctggccatgcttagccacatgtagaacctgcacaacaatactaccccctagtgtctatgtctctccccaactgtttgagctcgccctccaacccaggaaagagtgtattcgtagactaaatgtgcgcgaaattcttaccctgaactgaatgctagcttatgctcgtgtcgaggcgaataaatagggacagacggccagactgcactcagtgacgcagattgtcattggccacccctggctactgtgcttggcactggtgctccaccgctcgaagttctttgatccccaagtcaaagtcgaaggtgtttggttcttggcttgccgtgctgatgtcatgatcgccactcagggcccacctaaggatcagagacatccgcatccagaggctgctgccctaggaactgccagatgctgcttggcatccgccaccttggaatcactctgtgtggaagtcagcccacgaaagtggtcccagacccacaacgtggtccacctgcatgcgtgaggcatagaccctggcactccatcaagcagtactatgtcctgtgcagcagcagagacgagaagtcctggcctgtgtcacctctacggggccgtccccctgctcaagcctgatctctgcctactcgcgacgtagttggtggctgagactctcaagatgcccccgtggt

SEQ ID NO: 687414 - DNA, 804 bp, Homo sapiens
  misc_feature (53)..(53): n is a, c, g, or t
  misc_feature (110)..(110): n is a, c, g, or t
  misc_feature (193)..(193): n is a, c, g, or t
  misc_feature (212)..(212): n is a, c, g, or t
  misc_feature (214)..(214): n is a, c, g, or t
  misc_feature (216)..(216): n is a, c, g, or t
  misc_feature (218)..(218): n is a, c, g, or t
  misc_feature (272)..(272): n is a, c, g, or t
  misc_feature (320)..(320): n is a, c, g, or t
  misc_feature (406)..(406): n is a, c, g, or t
  misc_feature (426)..(426): n is a, c, g, or t
  misc_feature (435)..(435): n is a, c, g, or t
  misc_feature (449)..(449): n is a, c, g, or t
  misc_feature (485)..(485): n is a, c, g, or t
  misc_feature (493)..(493): n is a, c, g, or t
  misc_feature (511)..(511): n is a, c, g, or t
  misc_feature (559)..(559): n is a, c, g, or t
  misc_feature (561)..(561): n is a, c, g, or t
  misc_feature (573)..(573): n is a, c, g, or t
  misc_feature (588)..(588): n is a, c, g, or t
  misc_feature (599)..(599): n is a, c, g, or t
  misc_feature (607)..(608): n is a, c, g, or t
  misc_feature (629)..(630): n is a, c, g, or t
  misc_feature (634)..(634): n is a, c, g, or t
  misc_feature (656)..(656): n is a, c, g, or t
  misc_feature (669)..(669): n is a, c, g, or t
  misc_feature (687)..(687): n is a, c, g, or t
  misc_feature (691)..(691): n is a, c, g, or t
  misc_feature (694)..(694): n is a, c, g, or t
  misc_feature (696)..(697): n is a, c, g, or t
  misc_feature (723)..(723): n is a, c, g, or t
  misc_feature (743)..(743): n is a, c, g, or t
  misc_feature (775)..(775): n is a, c, g, or t
tgggtttggactaaaaattttattttaaaagtataaaggatggaggcccgaantttggcatttttaatttaggtttgttttatttaagtttaatgttaattccatgctgngtttcagtaagaacaatacagattctgtatctggggctccagtcagatatccagtagtacaaattagcttcaagttacacatnctgaacaaaagaggttgancnancnaaggaggggaggagtgaggggaaggagggagggggagggggaaggagaagaaanaaaagaattgaacaggcatgcaggcttttccataccaccttcaacgcnaacctgcttcagtgggagagtaaagtaggcaagaatgagccgccacggattgttgaactgttaccagcaccatgcttttcagcaanatttcagcggagttggaaanattttttanagcaaaaccattanaacgaagtccccccccaaaccacctttaaccatctnaagcaaanacccaattacttgcaaanactggtataaaacacagtttaaacaattagaaaaatgaaaactgaaancnctaatgcctctntagtgtgattaaccnctctcttagangcttgcannacctataagtttaaaggcttnnaaangtaatttccatttgctaatggngatcttgccacanctggcacggagacgacanagtnatncnnaaaaagcctctttgttgtcctgttantgttttaaagaacctaaaanctgggaccagttaaatccacagaaattcactnttgcctttaagaacttttgaaaactgttt

SEQ ID NO: 687415 - DNA, 515 bp, Homo sapiens
aatcggccggtacctgctacctggcgtatggaaaagtgctgggagaaacttggggagttgatttagaaacaattaggctttggcttgtgttaaaaatctgtggatcatttagattttcgattgttgctgtccccatgtctcctgttgcccatactatagatggtgttaaattgttagacacttccatgaatgtacttcatacatgtaaaacttcgtagatgcatgactcatggctctgggtggtctagctaaactagtcttttacgtcatacgtgtaaaactttgtagatgcaataactcatggctctgggtagtctagctaagctagtctttccactcaaagagcacgatacttaagctttctcctggtgagtcatgaattgtcatcagggaatttctcactgtttggcttaattcgattaggaactgctactggtgatagtttagtccttatttagttttagtctaagagaaccttactgacgttactataaatctaaaaaaaaagtcgacgc

SEQ ID NO: 687416 - DNA, 626 bp, Homo sapiens
agcggataatttggaatgtgggtggagggggatcatagttctccctgagtgagacttgcctgctcctctggcccctggtcctgtcctgttctccagcatggtgtgtctgaagctccctggaggctcctgcatggcagcgctgacagtgacactgatggtgctgagctccccactggctttggctggggacacccgaccacgtttcttgtggcaggataagtatgagtgtcatttcttcaacgggacggagcgggtgcggttcctggacagatacttctataaccaagaggagtacgtgcgcttcgacagcgacgtgggggagtaccgggcggtgacggagctggggcggcctgacgctgagtactggaacagccagaaggacatcctggaagacaggcgcgggccgcggtggacaactctgcagaaaatgtccatccttgtggcttcctcagctcctgcccttggcctgaagtcccagcattgatggcagtgcctcatcttcaactttagtgctcccctttacctaaccctacggcctcccatgcatctgtactccccctgtgtgccacaaatgcactacgttattaaatttttctgaagcccagagttaaaaatcatctgtccac

SEQ ID NO: 687417 - DNA, 972 bp, Homo sapiens
ttttttttagaaaggcgtttttgatgagaaaggaaatttcctggtccctccggagaaatccatcaacaaaattggccacgctctgcacgcccacgaccccgtcttcaagagcttcacacactccttcaaggtgcagaccttggccagaagtctgggcctccagatgcccgtggtggtgcagagcatgtacatctttaagcaacctcactttggcggtgaagtctcccctcatcaggacgcctccttcctgtacacggagcccctgggccgggtgctgggcgtgtggatcgcagtggaggatgccacgctggagaacggctgtctctggttcatccctggctcccacaccagtggtgtgtcaagaaggatggtccgggcccctgttggctcagcgcctggtaccagcttccttgggtcagagccagcccgggataacagcctctttgtgcccaccccagtgcagagaggggccctggtcctcatccatggagaagtggtacacaagagcaagcagaacctctctgaccgctcgcgccaggcctacactttccacctcatggaggcctctggcaccacctggagcccggagaactggctccagccaacagctgaactgccctttccccaactgtacacctaaaggctctcgcagggcaggagccctcgcccctcccgggtgaagctgtgggctgtaaacaccagtgccttgctcagcctcctggttgcaacagggaggtcttgtctcccctcctgggctttcctcctgccctgtgggcagcagcctaggctgggtcaggggcttccctaagatcttcacctctctgcctccctactgccccaacatagccttgaggaggcttctcagccaccaaagggttctggccccttctcactctcctctcctctcagatggaactctggttattatggtgttagttatcgaataaaaacgacttcagaatgcaaaaaaca

SEQ ID NO: 687418 - DNA, 372 bp, Homo sapiens
  misc_feature (34)..(34): n is a, c, g, or t
  misc_feature (110)..(110): n is a, c, g, or t
  misc_feature (338)..(338): n is a, c, g, or t
  misc_feature (340)..(340): n is a, c, g, or t
  misc_feature (342)..(343): n is a, c, g, or t
  misc_feature (346)..(346): n is a, c, g, or t
  misc_feature (348)..(349): n is a, c, g, or t
ttgtgttgataatagggtggagtagtggttgagnttgatgagtggagagacttgtattggtggtaccattttgtccttgacttctgcactggaagcacaacttgtagacntgttctttggtgtggcttatggagccacgtgctacaattacctaaaacctcgggcagaagaggagaggaggatagcagcagaagagaagaagaagcaggatgaactgaaacggattgccagagaattggcagaagatgacagcatattaaagtgagtgaccctgcgacccactctttggaccagcagcggatgaataaagcttcctgtgttgtgtgataaaaaaaaanantnnacncnnccgcgaatttagtagtagtaggc

SEQ ID NO: 687419 - DNA, 109 bp, Homo sapiens
caggggggcacagaaaacaataggttatgttactaaatgcatagaaaaaaaagtggggaagaatactctcaaacgagtaactttataccagcaaaagaacggagtatta

SEQ ID NO: 687420 - DNA, 829 bp, Homo sapiens
tcgcagcagtcctggaccctgacttcggacttggagaagaaacgccgaggagtgaacgtggagttaggtgtgttagcagcttgtgcgcgctgggagccggccacccctgtgtctccgtgacttacacttcccagtgagtgcctctgctgctgctgacttggaatgttgcttgcgatgccatataatgaatgtgctgattgctgtgcactcctgcctgcatctgcttctgtgtgtgctgtgcagtttgcacatgcctgtgcattgtacgtgccattcatgtgtgcatgagtgtcatatacttgcactactcacctagctgacaccctctgtgagactgcgtgcatgcatccctggctggccattggtgtatgctgcatgatgtgctgtgtgattccctgtgcagactcacctgagcacatcaacttatctggtaccacagctatgttgtgcttacatgtgtgtgattgactgtcccttgtcaagcattgtttaattgttgcattcttgctccaatgtgtatgcccacttttcagcatgtgagatttggacgccccatgtgtcctagcttcttcttgatgccctcatccattcagtgtgtctaaatgtgacgtgctgttgatccatgacactggttgtcctgggactgtgttctacctttgtccttgccctgcttgcttgggtgtcccttgtgtgctcctatgttgcatccttcttcactactctacttggattccgctactgtctgtggtggctttgcctggaattggcagcatcttacattgttcaactgtgcccccagctgcttctgtttgctggcgatggtggtcac

SEQ ID NO: 687421 - DNA, 1199 bp, Homo sapiens
  misc_feature (9)..(9): n is a, c, g, or t
ggagagccnactaaggctaatggaattacactggatcctgtgacagacacttcaggcttcatgggtcacatggtctgtttctgctcctttctgccctggttggtgtgggttgtggtgttagagaaatctcaggtgggagatctggggctgggacattgtgttggaggacagatttgcttcaataacttttaagtgtatatcttttcctctttttcccaggacactctggacttcagccaacaggattcctgagctgaaatgcagatgaccacattcaaggaagaaccttctgtcccagctttgcagaatgaaaagctttcctgcttggcagttattcttccacaagagagggctttctcaggacctggttgctactggttcggcaactgcagaaaatgtcctcccttgtggcttcctcagctcctgcccttggcctgaagtcccagcattgatgacagcgcctcatcttcaacttttgtgctcccctttgcctaaaccgtatggcctcccgtgcatctgtactcaccctgtacgacaaacacattacattattaaatgtttctcaaagatggagttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttgggcccccttggcccaagccattttaaacctgaaaaattttattcatggcccccaaatttgggccaaattggccaaatccccctaaaggggggcgattaaaaattaaagggcccggtttttaaaaacgtggaactggaaaaaccctggggttacccaaataaaacccctttgaaaaaaacccctttttcccaagtgggataaaaacaaaaaagcccccaccaaacgcctttccaaaaaatttcccaacctaaatggcaaaggaaaattgaccgttaaaattttggaaaaaatcccggaaaaatttttgaaaacaacctaatttttaaacacaaaggccaaaattggaaaaacccctttaatattaaaaaaaattccccgaaaaaggttaaagggtttccacagttggaacacaagagccctcttttaaaaaccgggccttcaccctaaaaagcgaacccttataaagggcaaggcccattcgggcctcccct

SEQ ID NO: 687422 - DNA, 833 bp, Homo sapiens
ttttttttagaaaggcgtttttgatgagaaaggaaatttcctggtccctccggagaaatccatcaacaaaattggccacgctctgcacgcccacgaccccgtcttcaagagcttcacacactccttcaaggtgcagaccttggccagaagtctgggcctccagatgcccgtggtggtgcagagcatgtacatctttaagtctcccctcatcaggacgcctccttcctgtacacggagcccctgggccgggtgctgggcgtgtggatcgcagtggaggatgccacgctggagaacggctgtctctggttcatccctggctcccacaccagggccctggtcctcatccatggagaagtggtacacaagagcaagcagaacctctctgaccgctcgcgccaggcctacactttccacctcatggaggcctctggcaccacctggagcccggagaactggctccagccaacagctgaactgccctttccccaactgtacacctaaaggctctcgcagggcaggagccctcgcccctcccgggtgaagctgtgggctgtaaacaccagtgccttgctcagcctcctggttgcaacagggaggtcttgtctcccctcctgggctttcctcctgccctgtgggcagcagcctaggctgggtcaggggcttccctaagatcttcacctctctgcctccctactgccccaacatagccttgaggaggcttctcagccaccaaagggttctggccccttctcactctcctctcctctcagatggaactctggttattatggtgttagttatcgaataaaaacgacttcagaatgcaaaaaaca

SEQ ID NO: 687423 - DNA, 305 bp, Homo sapiens
  misc_feature (46)..(46): n is a, c, g, or t
  misc_feature (292)..(292): n is a, c, g, or t
gttcaatttctacactgcattaacataaagagcgggaacagcaggngcgtctggtttacagcgtcgctgaagataccttgacctgtggactcagttccttttgtacagcatttccagtgaattttattctcctgcattccgccaaacagattacctaaaacctcgggcagaagaggagaggaggatagcagcagaagagaagaagaagcaggatgaactgaaacggattgccagagaattggcagaaggtacgagtgacactggctcttatagattgtccctcccaggtttntgtagaaattgaa

SEQ ID NO: 687424 - DNA, 201 bp, Homo sapiens
aggtaggtaccggttgttgaaggactagagaagcgatacaaagaactagtagctgagcgagcagttacagatgctgcgtctgagggctttgcgtcctgagcctccgttgctgcccttgccccagctcagtcgtccctccaggtagcaaagagctggttgtaagaatcgatggagccatgcttggtgatcttgattgcgtca

SEQ ID NO: 687425 - DNA, 1288 bp, Homo sapiens
  misc_feature (331)..(331): n is a, c, g, or t
  misc_feature (896)..(896): n is a, c, g, or t
cgggggggagtcggaatcaggtaatacctgttaatcctcttttagaaacagattcagttttcatagaatgatggcagaggtgataaggcatgagacagaaatagcaggaaagactgggatccaaattcctgatcaggcaatttataccaaaactcctcctctccacttaggcctgtgctctgcaggagtattggttcagggagacttaggaacttgtttttcttcttcctgcagtgctctcatctgagtccttgaaagagaggaaaagaagctgttagtggaaccaggtctgaaaacaacactttcctctctctctgcaggactcgtgagntgaagtgcagatgaccacattcaagggggaaccttctgccccagctttgcatgatgaaaagctttcctgcttggctcttattcttccacaagagaggactttctcaggccctggttgctaccggttcagcaactctgcagaaaatgtccatccttgtggcttcctcagctcctgcccttggcctgaagtcccagcattgatggcagtgcctcatcttcaactttagtgctcccctttacctaaccctacggcctcccatgcatctgtactccccctgtgtgccacaaatgcactacgttattaaatttttctgaagcccagagttaaaaatcatctgtccacctggctccaaagacaaaaaataaaaagaaaagaaaaagggaagattatttcctaatagcaaaaaaaaaaaaaaaaaaaaaaaaaaaaaaaaaaaaaacaaaaagaaaagaggggggcggcgccgccaccagagaatatacccccccgggggggggccccacagtttacagccgcgtaccccgcagttcttctctgggaccacaagggggcccccctataggangagagggcgctattatatataacaacaggagcggccggggcgccggttgttaaacaaccggtcccggagacggggcaaacacggctgccaacggggggaccacttcgggggggagggagaacccctaaaaccgccgggggggtgcggaccaccaatagggggggcacaacactacttccctaacaggagagatttttagaaggccctccaggagggggcaaacataataaacaccaatctgaaaagcggggttctcagcgggggtcgaaaaacacaagagggggaaatatctgctgaggcgtgttaaaaaaaaattgtgggcaccaacgcgggagaatgtatatgtgcagaacaaattttttccccgggagtggtagtattataataatcag

SEQ ID NO: 687426 - DNA, 951 bp, Homo sapiens
ttttttttagaaaggcgtttttgatgagaaaggaaatttcctggtccctccggagaaatccatcaacaaaattggccacgctctgcacgcccacgaccccgtcttcaagagcttcacacactccttcaaggtgcagaccttggccagaagtctgggcctccagatgcccgtggtggtgcagagcatgtacatctttaagcaacctcactttggcggtgaagtctcccctcatcaggacgcctccttcctgtacacggagcccctgggccgggtgctgggcgtgtggatcgcagtggaggatgccacgctggagaacggctgtctctggttcatccctggctcccacaccagggccctggtcctcatccatggagaagtggtacacaagagcaagcagaacctctctgaccgctcgcgccaggcctacactttccacctcatggaggcctctggcaccacctggagcccggagaactggtaggtgacagggtgggtgtgtgtgcccgacagtcccctggaggctgggaacagtgaccctgcacctcaaggttgtttctcctctatcctctgcaggctccagccaacagctgaactgccctttccccaactgtacacctaaaggctctcgcagggcaggagccctcgcccctcccgggtgaagctgtgggctgtaaacaccagtgccttgctcagcctcctggttgcaacagggaggtcttgtctcccctcctgggctttcctcctgccctgtgggcagcagcctaggctgggtcaggggcttccctaagatcttcacctctctgcctccctactgccccaacatagccttgaggaggcttctcagccaccaaagggttctggccccttctcactctcctctcctctcagatggaactctggttattatggtgttagttatcgaataaaaacgacttcagaatgcaaaaaaca

SEQ ID NO: 687427 - DNA, 302 bp, Homo sapiens
  misc_feature (50)..(50): n is a, c, g, or t
ttttttttggcccccttcccaaggcctaaagttttggacccaaggaaaantgaaggagaccgcttttcgggttaagaatggaacccccaacttttaacccaacaattatttaaagcaatgctgatgaatccctgtttttagaccccttcattttgaggggaggagttccccagattgtttctatacaaatataaatcttaaaaagttgttcaactattttattatcctagattatatcaaagtatttgtcgggggtagaaaaaaaaaacagctctgcaggcttaataaaaatgccaggctga

SEQ ID NO: 687428 - DNA, 853 bp, Homo sapiens
  misc_feature (391)..(391): n is a, c, g, or t
  misc_feature (440)..(440): n is a, c, g, or t
  misc_feature (443)..(443): n is a, c, g, or t
  misc_feature (445)..(445): n is a, c, g, or t
  misc_feature (448)..(448): n is a, c, g, or t
  misc_feature (476)..(476): n is a, c, g, or t
  misc_feature (483)..(483): n is a, c, g, or t
  misc_feature (508)..(508): n is a, c, g, or t
  misc_feature (543)..(543): n is a, c, g, or t
  misc_feature (573)..(573): n is a, c, g, or t
  misc_feature (596)..(596): n is a, c, g, or t
  misc_feature (604)..(604): n is a, c, g, or t
  misc_feature (606)..(607): n is a, c, g, or t
  misc_feature (618)..(618): n is a, c, g, or t
  misc_feature (624)..(624): n is a, c, g, or t
  misc_feature (630)..(630): n is a, c, g, or t
  misc_feature (634)..(635): n is a, c, g, or t
  misc_feature (638)..(638): n is a, c, g, or t
  misc_feature (642)..(642): n is a, c, g, or t
  misc_feature (645)..(645): n is a, c, g, or t
  misc_feature (653)..(653): n is a, c, g, or t
  misc_feature (655)..(655): n is a, c, g, or t
  misc_feature (663)..(664): n is a, c, g, or t
  misc_feature (674)..(674): n is a, c, g, or t
  misc_feature (679)..(679): n is a, c, g, or t
  misc_feature (681)..(681): n is a, c, g, or t
  misc_feature (684)..(684): n is a, c, g, or t
  misc_feature (698)..(698): n is a, c, g, or t
  misc_feature (706)..(706): n is a, c, g, or t
  misc_feature (745)..(745): n is a, c, g, or t
  misc_feature (774)..(774): n is a, c, g, or t
  misc_feature (786)..(786): n is a, c, g, or t
  misc_feature (840)..(840): n is a, c, g, or t
agcggataatttggaatgtgggtggagggggatcatagttctccctgagtgagacttgcctgctcctctggcccctggtcctgtcctgttctccagcatggtgtgtctgaagctccctggaggctcctgcatggcagcgctgacagtgacactgatggtgctgagctccccactggctttggctggggacacccgaccacgtttcttgtggcaggataagtatgagtgtcatttcttcaacgggacggagcgggtgcggttcctggacagatacttctataaccaagaggagtacgtgcgcttcgacagcgacgtgggggagtaccgggcggtgacggagctggggcggcctgacgctgagtactggaacagccagaaggacatcctggangagagcgggcagtgccggacaggatgtgcagacacaactacgagctggncgngnccntgaccctgcagcgccgagtccagcctanggtgaangtttccccctccaagaaggggcccntgcagcaccacaacctgcttgtctgccacgtgacngatttctacccaggcagcattcaatccganggttcctgatggacaggaggaancagtgggntnngtccaccaacntgatcngtatgnagannggncttncanatctggtnangcggaaannaccccccagnagganangtntaccctgccaatgnagcacacnagctggacagtctgtcacgtggatggaaggcacatctgnttctgcccggagtaagacttgacgggagngggggctcatgnggggctcatcatctgtggattggcatttcatgcacaggaggagcaagttcaagnggtctgcatcggg

SEQ ID NO: 687429 - DNA, 1073 bp, Homo sapiens
ttttttttagaaaggcgtttttgatgagaaaggaaatttcctggtccctccggagaaatccatcaacaaaattggccacgctctgcacgcccacgaccccgtcttcaagagcttcacacactccttcaaggtgcagaccttggccagaagtctgggcctccagatgcccgtggtggtgcagagcatgtacatctttaagcaacctcactttggcggtgaagtctcccctcatcaggacgcctccttcctgtacacggagcccctgggccgggtgctgggcgtgtggatcgcagtggaggatgccacgctggagaacggctgtctctggttcatccctggctcccacaccagtgaggaaccctgtctcttctgcccacttgggactccccaccccctagggagagggaccttgagaaaggaggagtttaaggctctccatcttggcctgcaggtggtgtgtcaagaaggatggtccgggcccctgttggctcagcgcctggtaccagcttccttgggtcagagccagcccgggataacagcctctttgtgcccaccccagtgcagagaggggccctggtcctcatccatggagaagtggtacacaagagcaagcagaacctctctgaccgctcgcgccaggcctacactttccacctcatggaggcctctggcaccacctggagcccggagaactggctccagccaacagctgaactgccctttccccaactgtacacctaaaggctctcgcagggcaggagccctcgcccctcccgggtgaagctgtgggctgtaaacaccagtgccttgctcagcctcctggttgcaacagggaggtcttgtctcccctcctgggctttcctcctgccctgtgggcagcagcctaggctgggtcaggggcttccctaagatcttcacctctctgcctccctactgccccaacatagccttgaggaggcttctcagccaccaaagggttctggccccttctcactctcctctcctctcagatggaactctggttattatggtgttagttatcgaataaaaacgacttcagaatgcaaaaaaca

SEQ ID NO: 687430 - DNA, 769 bp, Homo sapiens
  misc_feature (273)..(273): n is a, c, g, or t
  misc_feature (294)..(294): n is a, c, g, or t
gccggcgccgagatctgctagtagagcgggcccgctcgagagaagtggggccgagatcgcgccgtcccagcccgcccgccggcgtctgcgctgctccggcgcccttacccctgctggcccttgcaaggcgcgaccgtgcggccatgcatgcccctggggctgagtgcctgccccatggcaaagcctggcggtccctggcgacgacgtgctgcatggagaacttccgtaaggtgcgctccgaagaggctgccagcggtggtgctgggggccgangggaggcggccctgggctccnggccccttcgcagacctggcgccgtggcgctgcggtgcacattgcgggtcaaggaaaggcagcaagatcctggaacctgatggccttcgccaccggccagcattggctgcagccagccacgctgcgcccatcgtcttcagcggcttgcgtgcctgggccaccaccaagaaccgtcacgtgcgcctgagatcctcaagcgccgcctggcgggcctgcaccaggtcacgcggctgcgctaccggagcgtacgcgaggtgtggcagagcctcccgcctgggcccacgcagggtcagacgcctggcgagccaggcgcatagtctcagcgtacattaaggaacgtgcccggcctcgccatcctactttccaaggacgcgcatggatccgcgacagcccggataccagccccccgaattccccaatcctggtccctcgtccccgcaagaacggccaacgtccaagaagagctaggggaagc

SEQ ID NO: 687431 - DNA, 630 bp, Homo sapiens
ttcagtgtacccgattgccagttgtaccctagccgtgagtcgataactggctcctggtgcttccagaccctggtgatgctggaaacagttcctcgaagtggagaggtttacacctgccaagtggagcacccaagcgtgacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgcagatgaccacattcaagggggaaccttctgccccagctttgcatgatgaaaagctttcctgcttggctcttattcttccacaagagaggactttctcaggccctggttgctaccggttcagcccttgtggcttcctcagctcctgcccttggcctgaagtcccagcattgatggcagtgcctcatcttcaactttagtgctcccctttacctaaccctacggcctcccatgcatctgtactccccctgtgtgccacaaatgcactacgttattaaatttttctgaagcccagagttaaaaatcatctgtccac

SEQ ID NO: 687432 - DNA, 675 bp, Homo sapiens
aacgatcccttagctggagaacggctgtctctcgtcatcgttgctccacaccagtggtgtgtcaagaaggatggtccgggcccctgttggctcagcgcctggtaccagcttccttgggtcagagccagcccgggataacagcctctttgtgcccaccccagtgcagagaggggccctggtcctcatccatggagaagtggtacacaagagcaagcagaacctctctgaccgctcgcgccaggcctacactttccacctcatggaggcctctggcaccacctggagcccggagaactggctccagccaacagctgaactgccctttccccaactgtacacctaaaggctctcgcagggcaggagccctcgcccctcccgggtgaagctgtgggctgtaaacaccagtgccttgctcagcctcctggttgcaacagggaggtcttgtctcccctcctgggctttcctcctgccctgtgggcagcagcctaggctgggtcaggggcttccctaagatcttcacctctctgcctccctactgccccaacatagccttgaggaggcttctcagccaccaaagggttctggccccttctcactctcctctcctctcagatggaactctggttattatggtgttagttatcgaataaaaacgacttcagaatgcaaaaaaca

SEQ ID NO: 687433 - DNA, 607 bp, Homo sapiens
  misc_feature (185)..(185): n is a, c, g, or t
  misc_feature (194)..(194): n is a, c, g, or t
  misc_feature (210)..(210): n is a, c, g, or t
  misc_feature (213)..(213): n is a, c, g, or t
  misc_feature (215)..(215): n is a, c, g, or t
  misc_feature (217)..(217): n is a, c, g, or t
  misc_feature (220)..(221): n is a, c, g, or t
  misc_feature (228)..(228): n is a, c, g, or t
  misc_feature (235)..(235): n is a, c, g, or t
  misc_feature (238)..(238): n is a, c, g, or t
  misc_feature (246)..(246): n is a, c, g, or t
  misc_feature (261)..(261): n is a, c, g, or t
  misc_feature (263)..(263): n is a, c, g, or t
  misc_feature (267)..(267): n is a, c, g, or t
  misc_feature (273)..(273): n is a, c, g, or t
  misc_feature (275)..(275): n is a, c, g, or t
  misc_feature (281)..(282): n is a, c, g, or t
  misc_feature (286)..(288): n is a, c, g, or t
  misc_feature (291)..(291): n is a, c, g, or t
  misc_feature (293)..(293): n is a, c, g, or t
  misc_feature (298)..(299): n is a, c, g, or t
  misc_feature (311)..(311): n is a, c, g, or t
  misc_feature (314)..(314): n is a, c, g, or t
  misc_feature (316)..(316): n is a, c, g, or t
  misc_feature (326)..(327): n is a, c, g, or t
  misc_feature (344)..(344): n is a, c, g, or t
  misc_feature (356)..(356): n is a, c, g, or t
  misc_feature (372)..(372): n is a, c, g, or t
  misc_feature (382)..(382): n is a, c, g, or t
  misc_feature (397)..(397): n is a, c, g, or t
  misc_feature (420)..(420): n is a, c, g, or t
  misc_feature (430)..(430): n is a, c, g, or t
  misc_feature (436)..(437): n is a, c, g, or t
  misc_feature (440)..(440): n is a, c, g, or t
  misc_feature (456)..(456): n is a, c, g, or t
  misc_feature (458)..(458): n is a, c, g, or t
  misc_feature (467)..(467): n is a, c, g, or t
  misc_feature (483)..(483): n is a, c, g, or t
  misc_feature (513)..(513): n is a, c, g, or t
  misc_feature (515)..(515): n is a, c, g, or t
  misc_feature (534)..(534): n is a, c, g, or t
  misc_feature (537)..(537): n is a, c, g, or t
  misc_feature (544)..(544): n is a, c, g, or t
  misc_feature (575)..(575): n is a, c, g, or t
gccggcgccgagatctgctagtagagcgggcccgctcgagagaagtggggccgagatcgcgccgtcccagcccgcccgccggcgtctgcgctgctccggcgcccttacccctgctggcccttgcaaggcgcgaccgtgcggccatgcatgcccctggggctgagtgcctgccccatggcaaaggngggggtggnggggaggagggggganggngnanttnngtaaggnggggtcngangagggggnagggggtgggggggngngggngggggngngggctnngggnnnttngnagagnngggggggggggnggngnacatgggggnnaaggaagggaggaaganggggaaggtganggggttggggaggggnaggatggcgnagcagcgaggggggngatggtgttgagggggtggggcngggggaggancaaaanngtnaggtggggggagatgntnaaggggggngctgggggggtggagnaggtgaggggggtgcggtaggggagggtangngggtgtgggagaggctggnggntgggggnaggcgagggtgagaggggtggggaggggggnggtagtgtgagggtagttaagaaggtgggggg

SEQ ID NO: 687434 - DNA, 1169 bp, Homo sapiens
  misc_feature (548)..(548): n is a, c, g, or t
agcggataatttggaatgtgggtggagggggatcatagttctccctgagtgagacttgcctgctcctctggcccctggtcctgtcctgttctccagcatggtgtgtctgaagctccctggaggctcctgcatggcagcgctgacagtgacactgatggtgctgagctccccactggctttggctggggacacccgaccacgtttcttgtggcaggataagtatgagtgtcatttcttcaacgggacggagcgggtgcggttcctggacagatacttctttaaccatggtaggtacgctccgtgcgcttcgtacaggcgacgctggtgggagatacctgggcggtgacgtgatgctgcgtggctggccgtgcatcgcgtgtaggtacctggatacagccaatatagggaccatcctaggaatgatcaggcgtcgcctgcggtctggatcatccttacctgcagtactagcgagacctactcgggcttgcgtcgcaagagcattacacaggtgctaagcgtggcagagattcaatccctaaaggctgacntgtatatcccttctaatgggacccagactcactggcaggaccatcgataaggtaccctgagtcatgactcgtgtgatgtggatttcataatcgcatggctagcattgacatgtcaggtggattccctgaaacggacagtgacagagaaggcatgggatgtgtgttccaccaggccctgatcctagacatgggatgactgtgatgcattcctagaccccttgggtgactgctggaaacaagttccctcgagaggttggaagagggttaacacccttggcaagttggatgccacccaagcgttgacaagacctcatcacaagtggaaatggaggagcacgggtctgaaaatctgcacacgcagccaaaggatggctcgaagatggagacacaggggcgcctttggtgcctgagggccctgagttctttcaccttggaaggaccggagcctggatccatctaacattaagtgaattcacgaaaagggaacctccttgggaatttcaggccaaacagagattcctgtagatgaaaatgcgacaattgaacaaactttacaggaaaaaactaactgcccagtattgcgtgatttataggcttcctagctaaggaattatcttcaca

SEQ ID NO: 687435 - DNA, 793 bp, Homo sapiens
ggagagaactagtttcgagtttttatgttttttttttttggccctaaaggggttaaagggggtcccaatcgggtaaacacgggccctttttcaaaattttaagggaaataatctctaggagcgcatggggcattaaaccgtggggattggcctcccacagaatactcagaagacatttgccacgatcgattataccccgaggacggtgttcgcggataacaagtgtggattgggtatacaacacgttaccggaaaatggcaaatcgtgtataatacacacccatagagtggtggagacacaagcacctcagagaagagtgacagaaagagactactgcgagaccctgcaacaatatatataagtcaccaaagagtaggggagctatcacaaaaagcgcgagaaagatcacatcaccccgcaagagtgtcacacacgcggccacacagagagagacaccgagaagagtgaccgacagcaggaagcataaacccgatcacacagacgaacatcctaacgccgatgggaagccgacgaacaaagaaccaactcctggacaaaagaagcgcacagaaaacaacccaagcagagctagatacgaaagaccagcccccgaaccaccgcacgaaaccaccccgcaacggcgaaaaaccaccacagacacaaaagaaaagacacacaaagaagaaaacagaccaaccaactagaggcagcagaagcacacacaacacagaaccgacgcacacacagaagcaaaagaggagcaacacagacgaggagacgatgaagaacaaa

SEQ ID NO: 687436 - DNA, 253 bp, Homo sapiens
tgtatttgggcacagaaatttcccattgtatttcccccacacaggcacagcctccctcatcatcagcatcccccaccagagtggtatgtttgttacagttgatgagccgacattgacacatcatcacctaaagtccatagtttacactagggttctctcttggtgttgtacatgctgtgggattggacaaatgtataatgacatgtattcactattatggtgtcatacagaataatttctgtgcccatttcaa

SEQ ID NO: 687437 - DNA, 852 bp, Homo sapiens
ttttttttttaactccatctttgagaaacatttaataatgtaatgtgtttgtcctcccttgtggcttcctcagctcctgcccttggcctgaagtcccagcattgatgacagcgcctcatcttcaacttttgtgctcccctttgcctaaaccgtatggcctcccgtgcatctgtactcaccctgtacgacaaacacattacattattaaatgtttctcaaagatggagttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttgggcccccttggcccaagccattttaaacctgaaaaattttattcatggcccccaaatttgggccaaattggccaaatccccctaaaggggggcgattaaaaattaaagggcccggtttttaaaaacgtggaactggaaaaaccctggggttacccaaataaaacccctttgaaaaaaacccctttttcccaagtgggataaaaacaaaaaagcccccaccaaacgcctttccaaaaaatttcccaacctaaatggcaaaggaaaattgaccgttaaaattttggaaaaaatcccggaaaaatttttgaaaacaacctaatttttaaacacaaaggccaaaattggaaaaacccctttaatattaaaaaaaattccccgaaaaaggttaaagggtttccacagttggaacacaagagccctcttttaaaaaccgggccttcaccctaaaaagcgaacccttataaagggcaaggcccattcgggcctcccct

SEQ ID NO: 687438 - DNA, 234 bp, Homo sapiens
tactcgtccgcgggtctctaaaggtacaccggtgcaatctgctcataatcgctcacggactcacgtcctcatcactatcctgcctagcaaactcaaactacgaacgcactcacagtggcttcataatcctctctcagggacttcaaactctactcccactaatagcttggtgataacttctagcaagcctcgctaacctcgcctattttacaccaaccccgccgttaggccgat

SEQ ID NO: 687439 - DNA, 308 bp, Homo sapiens
ccactcgtcatgtgagaagaagcaggccggatgtcagaaggggtgccttgggtaaccctctgagactacagaagtgaacagggtggctattccctagtatttatttggctattagccatttatgatttattaattgattgagtatttgattcggtaagtatttggttattggttcatttgtccgggagagtaatattggttgaaagagggattagctattaagaagggattatggaatgcgggttggctttgccgttgaggaaaatactttgattggcagtcttcttgtgggaaacggagggggttta

SEQ ID NO: 687440 - DNA, 121 bp, Homo sapiens
tgttcggtgctgggctgtgaacacgaccgcatctcgctgtgaggaatctttcccggaatctttctctgcagaatgaaattgccaaagaaactctccctgatttggtttccatcattcctga

SEQ ID NO: 687441 - DNA, 138 bp, Homo sapiens
ctctcaccggatccttatactcgagggtactatcttgacggcatcagcagggatgtgtgtcgatgtcaacgagtgcagcgctaccccggcctgctgttgtggccacaatgtgcgagaacacgctgggctcttacctct

SEQ ID NO: 687442 - DNA, 581 bp, Homo sapiens
tcagaggatccggtgttccgttgtctatatatcagtttggtaccagcatcatgcgtgtttggttactgcagcctgtagtatagctgaagttgggtagtgtgatgcctccagcttagttctctggcttaggattgtcttggttatgtgggctcttttttggttacatatgaaatttgaagtagttttttctaattctgtgaaggaaagtcaatggtagcttgatggtgatagcaatgaatctataaattaccttgggaagtatggccattttcacaatattaattcttcctatccatgagcatggaatgttcttccattggtttgtgtcctctcttatttccttgagcagtggtttgtagttctccttgaagaggtccttcacatcccttgtaagctgtattcctaggtattctattctctttgaagcaattgtgaatgggagttcactcattatttgggtctctgtctattattggtgtataggaatacttgtgatttttgtacatcgattttgtatcctgagacttggctaaagttgcttatcaacttaaagagatttggggctgagacaaagggaaaca

SEQ ID NO: 687443 - DNA, 486 bp, Homo sapiens
ccagtgcatccgctatctctttccccttctgtacccagggtatagacggggcccattctccttcagagatgcaatgtgtcgtggcttttagcagtggtaagagacttcctgtaacaatgcatctcatatttgtgaatgactattaaagaaaacaacaatgtgcaatcaacgtcctcggccacattgtgaactttgggggatgctcgctccaaccgactgctgtcaccttcaccgtaccagtttttaaatcctgagtcaagccaaaaaaacccaaaaaaaccaagacaaaacaaaaaaaagaattaaggccatgccaatctcatctggtatcctgacgcaaataaggtatggtacaagaagggttgtaccgcaactaagtcatagtccgcctagaagcttttgcggtgaacgatggagggcccgaactcgtaaataccccctgattgaagatccacatctgatgaaaggtgaacagcaagcccagga

SEQ ID NO: 687444 - DNA, 192 bp, Homo sapiens
accagaagacttcttgtccaatgctttgatgacacccaccgcaaatgtacggtctcatatcacgaacagcaaagcgaaccacaggtgaatcgtctgagaagctctccacacacatgggcttgccaggaaccatatcaacaatggcagcatcaccagacttcaaaaatatagggccatctaccagctattgac

SEQ ID NO: 687445 - DNA, 923 bp, Homo sapiens
atcgcaacattgtggaaggccaaggtgggcggatcatctgagggcccaggagttcgagaccagtctggacagcatggtgaaaccctgtctctatctatgaaatacgaagaaatcatgcctggcatggtggtgcggtgcctgtagtcccagcctactcagtggctgagtgcaggacgaattgcttggagacccgtgtgggcagaaggttgcagtgagccgagatcggccctgttgtagtcacaagcctgggtgacagagggagatatccggctcaggaaccaatgtcaggtctgccagttgtcccataaaattaatggtataagagcgcacgccaaaaacgcctgtaagtttacatggcactccatttttccataatttattaacctgcatcagagtgttttgtacagggccttctgcactattggtaatatcctcttcaacggtttcctacaatgtagggccacaacaataatttctcctcagtggaggcttttccatgattgttctgctcctgggaccagctaatcggttacaaagggggcgggatattaggattgccccctctagtatttcacacaaacgttctggctcttagaggtggaataccagaagagagcaccctagcggcaaggtcgtgcacgactatacgatgacggagtgtctttcacggatctcggagaaggcctactgattccgcttacatgtaggcgaaggcttcaaaaatctgtatacctgtgtatcatgcgactttggacgaaggtgttcagcaggggagggtgcgggcctggcggcgacacaaacgagtccccaagaagtgtggtgggcgcggcattggctccatgattggcggttccttgtgctattcccgacccgtgttacggtgactctgtcatgttcataagcttataattgggagactatca

SEQ ID NO: 687446 - DNA, 263 bp, Homo sapiens
  misc_feature (208)..(208): n is a, c, g, or t
gatagctgattctagaggatcccagaagggcgacgtcattccgactgcaggttcgagtcggggctcaggtgatcttgcccacctcagcctcctgagtagtggggactacaggcgcgcgcgagcactccgggttaatttttatattttttataagaggcggggtctctctatattaccctggcgtggtctcgaaattccgtgggctcanagcagcccatccgtgcttcggacctcccaagagtgctgggcgttacagtgcagta

SEQ ID NO: 687447 - DNA, 151 bp, Homo sapiens
  misc_feature (12)..(12): n is a, c, g, or t
  misc_feature (35)..(35): n is a, c, g, or t
  misc_feature (80)..(80): n is a, c, g, or t
  misc_feature (104)..(104): n is a, c, g, or t
  misc_feature (130)..(130): n is a, c, g, or t
gttttcaggccnggtctggcttggtcttcccccgnaagaaatggccggggagctccaggggacccaggcgccgtcgcttnagcgactgggctgaccagccaggncagcggggtaaacccgaacaattctncgcgaggtagggaggccatgg

SEQ ID NO: 687448 - DNA, 485 bp, Homo sapiens
  misc_feature (50)..(50): n is a, c, g, or t
atggtgatcatcataatacaacttcaaaaggatttcaggctgagtgttgngtgtcacgcctatacacccagcactttggaaggctgaggaaggaggatcgcttgaggcccaggagtttgagacttagcctaggcaacacagtgaggccttatctcaacaacaaccacaaaatctaaaaattagctgggtgtggtggtgcatgcctgtgatcctggctacttcagaggctgaggtggaaggatcacttgaggccaggagtttgaggctgcagtgagttatgatggcactgctgcactccagcctgcgggacagagtgagaccctgtctgaaagaaagagagaaagaaagaaagaaagagagagaaagaaagaaagaaagaaagggaaagatggaaggaaggaaggaaaaagaaagagaaagagagagagagagaaagaaaaagaaagaaaagtaagaaagaaaaaagaaaaagaaagaaaagtaag

SEQ ID NO: 687449 - DNA, 362 bp, Homo sapiens
ccaaaaagaaatattgaatttttatttttgaagtttttgttttttaaaaggttgggggtgttcaccccctcagggacccccattacgcatctaatttcagctcatattgtcaggcaaagtattttcccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgta

SEQ ID NO: 687450 - DNA, 5367 bp, Homo sapiens
  misc_feature (229)..(229): n is a, c, g, or t
ttagaggatctcaaacaccgcaatctagaggaacgtttctgatcttcgccaacggtactacctgcgcaagtcaacctggacgggtccaactacacgttacttaagcagggcctgaacaacgccgttgccttggattttgactaccgagagcagatgatctactggacagatgtgaccacccagggcagcatgatccgaaggatgcaccttaacgggagcaatgtgcagntcctacaccgtacaggcctcagcaaccccgatgggctggctgtggactgggtgggtggcaacctgtactggtgcgacaaaggccgggacaccatcgaggtgtccaagctcaatggggcctatcggacggtgctggtcagctctggcctccgtgagcccagggctctggtggtggatgtgcagaatgggtacctgtactggacagactggggtgaccattcactgatcggccgcatcggcatggatgggtccagccgcagcgtcatcgtggacaccaagatcacatggcccaatggcctgacgctggactatgtcactgagcgcatctactgggccgacgcccgcgaggactacattgaatttgccagcctggatggctccaatcgccacgttgtgctgagccaggacatcccgcacatctttgcactgaccctgtttgaggactacgtctactggaccgactgggaaacaaagtccattaaccgagcccacaagaccacaggcaccaacaaaacgctcctcatcagcacgctgcaccggcccatggacctgcatgtcttccatgccctgcgccagccagacgtgcccaatcacccctgcaaggtcaacaatggtggctgcagcaacctgtgcctgctgtcccccgggggagggcacaaatgtgcctgccccaccaacttctacctgggcagcgatgggcgcacctgtgtgtccaactgcacggctagccagtttgtatgcaagaacgacaagtgcatccccttctggtggaagtgtgacaccgaggacgactgcggggaccactcagacgagcccccggactgccctgagttcaagtgccggcccggacagttccagtgctccacaggtatctgcacaaaccctgccttcatctgcgatggcgacaatgactgccaggacaacagtgacgaggccaactgtgacatccacgtctgcttgcccagtcagttcaaatgcaccaacaccaaccgctgtattcccggcatcttccgctgcaatgggcaggacaactgcggagatggggaggatgagagggactgccccgaggtgacctgcgcccccaaccagttccagtgctccattaccaaacggtgcatcccccgggtctgggtctgcgaccgggacaatgactgtgtggatggcagtgatgagcccgccaactgcacccagatgacctgtggtgtggacgagttccgctgcaaggattcgggccgctgcatcccagcgcgttggaagtgtgacggagaggatgactgtggggatggctcggatgagcccaaggaagagtgtgatgaacgcacctgtgagccataccagttccgctgcaagaacaaccgctgcgtgcccggccgctggcagtgcgactacgacaacgattgcggtgacaactccgatgaagagagctgcacccctcggccctgctccgagagtgagttctcctgtgccaacggccgctgcatcgcggggcgctggaaatgcgatggagaccacgactgcgcggacggctcggacgagaaagactgcaccccccgctgtgacatggaccagttccagtgcaagagcggccactgcatccccctgcgctggcgctgtgacgcagacgccgactgcatggacggcagcgacgaggaggcctgcggcactggcgtgcggacctgccccctggacgagttccagtgcaacaacaccttgtgcaagccgctggcctggaagtgcgatggcgaggatgactgtggggacaactcagatgagaaccccgaggagtgtgcccggttcgtgtgccctcccaaccggcccttccgttgcaagaatgaccgcgtctgtctgtggatcgggcgccaatgcgatggcacggacaactgtggggatgggactgatgaagaggactgtgagccccccacagcccacaccacccactgcaaagacaagaaggagtttctgtgccggaaccagcgctgcctctcctcctccctgcgctgcaacatgttcgatgactgcggggacggctctgacgaggaggactgcagcatcgaccccaagctgaccagctgcgccaccaatgccagcatctgtggggacgaggcacgctgcgtgcgcaccgagaaagcggcctactgtgcctgccgctcgggcttccacaccgtgcccggccagcccggatgccaagacatcaacgagtgcctgcgcttcggcacctgctcccagctctgcaacaacaccaagggcggccacctctgcagctgcgctcggaacttcatgaagacgcacaacacctgcaaggccgaaggctctgagtaccaggtcctgtacatcgctgatgacaatgagatccgcagcctgttccccggccacccccattcggcttacgagcaggcattccagggtgacgagagtgtccgcattgatgctatggatgtccatgtcaaggctggccgtgtctattggaccaactggcacacgggcaccatctcctaccgcagcctgccacctgctgcgcctcctaccacttccaaccgccaccggcgacagattgaccggggtgtcacccacctcaacatttcagggctgaagatgcccagaggcatcgccatcgactgggtggccggaaacgtgtactggaccgactcgggccgagatgtgattgaggtggcgcagatgaagggcgagaaccgcaagacgctcatctcgggcatgattgacgagccccacgccattgtggtggacccactgagggggaccatgtactggtcagactggggcaaccaccccaagattgagacggcagcgatggatgggacgcttcgggagacactggtgcaggacaacattcagtggcccacaggcctggccgtggattatcacaatgagcggctgtactgggcagacgccaagctttcagtcatcggcagcatccggctcaatggcacggaccccattgtggctgctgacagcaaacgaggcctaagtcaccccttcagcatcgacgtctttgaggattacatctatggtgtcacctacatcaataatcgtgtcttcaagatccataagtttggccacagccccttggtcaacctgacagggggcctgagccacgcctctgacgtggtcctttaccatcagcacaagcagcccgaagtgaccaacccatgtgaccgcaagaaatgcgagtggctctgcctgctgagccccagtgggcctgtctgcacctgtcccaatgggaagcggctggacaacggcacatgcgtgcctgtgccctctccaacgccccccccagatgctccccggcctggaacctgtaacctgcagtgcttcaacggtggcagctgtttcctcaatgcacggaggcagcccaagtgccgctgccaaccccgctacacgggtgacaagtgtgaactggaccagtgctgggagcactgtcgcaatgggggcacctgtgctgcctccccctctggcatgcccacgtgccggtgccccacgggcttcacgggccccaaatgcacccagcaggtgtgtgcgggctactgtgccaacaacagcacctgcactgtcaaccagggcaaccagccccagtgccgatgcctacccggcttcctgggcgaccgctgccagtaccggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaactgcacggatggccgggtggcccccagctgtctgacctgcgtcggccactgcagcaatggcggctcctgtaccatgaacagcaaaatgatgcctgagtgccagtgcccaccccacatgacagggccccggtgtgaggagcacgtcttcagccagcagcagccaggacatatagcctccatcctaatccctctgctgttgctgctgctgctggttctggtggccggagtggtattctggtataagcggcgagtccaaggggctaagggcttccagcaccaacggatgaccaacggggccatgaacgtggagattggaaaccccacctacaagatgtacgaaggcggagagcctgatgatgtgggaggcctactggacgctgactttgccctggaccctgacaagcccaccaacttcaccaaccccgtgtatgccacactctacatggggggccatggcagtcgccactccctggccagcacggacgagaagcgagaactcctgggccggggccctgaggacgagataggggaccccttggcatagggccctgccccgtcggactgcccccagaaagcctcctgccccctgccggtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgta

SEQ ID NO: 687451 - DNA, 300 bp, Homo sapiens
attgtttcaacttacaactatcacttgcatggataattgatgggggagggagattagagtcttccggccctttttgattttgaattttacacagataacgtggggaataaccgtcggtctagtggctaagtatgggtggagaacaccgcgttccggcttaacctccccctagcttaatctaacgactgtcaaccagttgtttccattccccttaacgggtatatgtccgggaatggatgcacttatgacacgaaaatataaccgtggtacggactgtgggatatctaatgatgtccttac

SEQ ID NO: 687452 - DNA, 5749 bp, Homo sapiens
  misc_feature (229)..(229): n is a, c, g, or t
ttagaggatctcaaacaccgcaatctagaggaacgtttctgatcttcgccaacggtactacctgcgcaagtcaacctggacgggtccaactacacgttacttaagcagggcctgaacaacgccgttgccttggattttgactaccgagagcagatgatctactggacagatgtgaccacccagggcagcatgatccgaaggatgcaccttaacgggagcaatgtgcagntcctacaccgtacaggcctcagcaaccccgatgggctggctgtggactgggtgggtggcaacctgtactggtgcgacaaaggccgggacaccatcgaggtgtccaagctcaatggggcctatcggacggtgctggtcagctctggcctccgtgagcccagggctctggtggtggatgtgcagaatgggtacctgtactggacagactggggtgaccattcactgatcggccgcatcggcatggatgggtccagccgcagcgtcatcgtggacaccaagatcacatggcccaatggcctgacgctggactatgtcactgagcgcatctactgggccgacgcccgcgaggactacattgaatttgccagcctggatggctccaatcgccacgttgtgctgagccaggacatcccgcacatctttgcactgaccctgtttgaggactacgtctactggaccgactgggaaacaaagtccattaaccgagcccacaagaccacaggcaccaacaaaacgctcctcatcagcacgctgcaccggcccatggacctgcatgtcttccatgccctgcgccagccagacgtgcccaatcacccctgcaaggtcaacaatggtggctgcagcaacctgtgcctgctgtcccccgggggagggcacaaatgtgcctgccccaccaacttctacctgggcagcgatgggcgcacctgtgtgtccaactgcacggctagccagtttgtatgcaagaacgacaagtgcatccccttctggtggaagtgtgacaccgaggacgactgcggggaccactcagacgagcccccggactgccctgagttcaagtgccggcccggacagttccagtgctccacaggtatctgcacaaaccctgccttcatctgcgatggcgacaatgactgccaggacaacagtgacgaggccaactgtgacatccacgtctgcttgcccagtcagttcaaatgcaccaacaccaaccgctgtattcccggcatcttccgctgcaatgggcaggacaactgcggagatggggaggatgagagggactgccccgaggtgacctgcgcccccaaccagttccagtgctccattaccaaacggtgcatcccccgggtctgggtctgcgaccgggacaatgactgtgtggatggcagtgatgagcccgccaactgcacccagatgacctgtggtgtggacgagttccgctgcaaggattcgggccgctgcatcccagcgcgttggaagtgtgacggagaggatgactgtggggatggctcggatgagcccaaggaagagtgtgatgaacgcacctgtgagccataccagttccgctgcaagaacaaccgctgcgtgcccggccgctggcagtgcgactacgacaacgattgcggtgacaactccgatgaagagagctgcacccctcggccctgctccgagagtgagttctcctgtgccaacggccgctgcatcgcggggcgctggaaatgcgatggagaccacgactgcgcggacggctcggacgagaaagactgcaccccccgctgtgacatggaccagttccagtgcaagagcggccactgcatccccctgcgctggcgctgtgacgcagacgccgactgcatggacggcagcgacgaggaggcctgcggcactggcgtgcggacctgccccctggacgagttccagtgcaacaacaccttgtgcaagccgctggcctggaagtgcgatggcgaggatgactgtggggacaactcagatgagaaccccgaggagtgtgcccggttcgtgtgccctcccaaccggcccttccgttgcaagaatgaccgcgtctgtctgtggatcgggcgccaatgcgatggcacggacaactgtggggatgggactgatgaagaggactgtgagccccccacagcccacaccacccactgcaaagacaagaaggagtttctgtgccggaaccagcgctgcctctcctcctccctgcgctgcaacatgttcgatgactgcggggacggctctgacgaggaggactgcagcatcgaccccaagctgaccagctgcgccaccaatgccagcatctgtggggacgaggcacgctgcgtgcgcaccgagaaagcggcctactgtgcctgccgctcgggcttccacaccgtgcccggccagcccggatgccaagacatcaacgagtgcctgcgcttcggcacctgctcccagctctgcaacaacaccaagggcggccacctctgcagctgcgctcggaacttcatgaagacgcacaacacctgcaaggccgaaggctctgagtaccaggtcctgtacatcgctgatgacaatgagatccgcagcctgttccccggccacccccattcggcttacgagcaggcattccagggtgacgagagtgtccgcattgatgctatggatgtccatgtcaaggctggccgtgtctattggaccaactggcacacgggcaccatctcctaccgcagcctgccacctgctgcgcctcctaccacttccaaccgccaccggcgacagattgaccggggtgtcacccacctcaacatttcagggctgaagatgcccagaggcatcgccatcgactgggtggccggaaacgtgtactggaccgactcgggccgagatgtgattgaggtggcgcagatgaagggcgagaaccgcaagacgctcatctcgggcatgattgacgagccccacgccattgtggtggacccactgagggggaccatgtactggtcagactggggcaaccaccccaagattgagacggcagcgatggatgggacgcttcgggagacactggtgcaggacaacattcagtggcccacaggcctggccgtggattatcacaatgagcggctgtactgggcagacgccaagctttcagtcatcggcagcatccggctcaatggcacggaccccattgtggctgctgacagcaaacgaggcctaagtcaccccttcagcatcgacgtctttgaggattacatctatggtgtcacctacatcaataatcgtgtcttcaagatccataagtttggccacagccccttggtcaacctgacagggggcctgagccacgcctctgacgtggtcctttaccatcagcacaagcagcccgaagtgaccaacccatgtgaccgcaagaaatgcgagtggctctgcctgctgagccccagtgggcctgtctgcacctgtcccaatgggaagcggctggacaacggcacatgcgtgcctgtgccctctccaacgccccccccagatgctccccggcctggaacctgtaacctgcagtgcttcaacggtggcagctgtttcctcaatgcacggaggcagcccaagtgccgctgccaaccccgctacacgggtgacaagtgtgaactggaccagtgctgggagcactgtcgcaatgggggcacctgtgctgcctccccctctggcatgcccacgtgccggtgccccacgggcttcacgggccccaaatgcacccagcaggtgtgtgcgggctactgtgccaacaacagcacctgcactgtcaaccagggcaaccagccccagtgccgatgcctacccggcttcctgggcgaccgctgccagtaccggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaactgcacggatggccgggtggcccccagctgtctgacctgcgtcggccactgcagcaatggcggctcctgtaccatgaacagcaaaatgatgcctgagtgccagtgcccaccccacatgacagggccccggtgtgaggagcacgtcttcagccagcagcagccaggacatatagcctccatcctaatccctctgctgttgctgctgctgctggttctggtggccggagtggtattctggtataagcggcgagtccaaggggctaagggcttccagcaccaacggatgaccaacggggccatgaacgtggagattggaaaccccacctacaagatgtacgaaggcggagagcctgatgatgtgggaggcctactggacgctgactttgccctggaccctgacaagcccaccaacttcaccaaccccgtgtatgccacactctacatggggggccatggcagtcgccactccctggccagcacggacgagaagcgagaactcctgggccggggccctgaggacgagataggggaccccttggcatagggccctgccccgtcggactgcccccagaaagcctcctgccccctgccggtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgtaaaaaaaaaaagaaaaaaaggccaaaaaaaaaaaaaaaaaaaaaaaaaaaaaaaaaaaaaaaaaaaggggggggggtaagaagaatactcacagggggggcgccaaacgcactagacgaggaccaccgaggttgtttatggataccaagagggggccccatataggggagcagcatataaaatacagcaacggacacatggcacgcgggtattaaaaaacacggcaccgagtagcgcgacaaacagcggctaaccaggggagaacccttgggagcaggacaaccacaattcggggggtggagggacacatacttgggggcacagacaccccacgacaatcaaaaggccgagccgaaaatataaaagctatcaggcgggtcaag

SEQ ID NO: 687453 - DNA, 383 bp, Homo sapiens
  misc_feature (68)..(68): n is a, c, g, or t
  misc_feature (105)..(105): n is a, c, g, or t
  misc_feature (107)..(107): n is a, c, g, or t
  misc_feature (134)..(134): n is a, c, g, or t
  misc_feature (150)..(150): n is a, c, g, or t
  misc_feature (193)..(193): n is a, c, g, or t
  misc_feature (243)..(243): n is a, c, g, or t
  misc_feature (288)..(288): n is a, c, g, or t
tatctagagcgatccgttcaccgacgggtgggaggggaataggctaggtggggtgcaccctctagtgntgtgagagcagtggccagagcagcaccgcaggttgcncnacctagctggtaggatctcatccaganacacagctgctctggngacgtaaagtcgaagctgagctcttctgcagctgcggatgcanacttgtagggcgtggccggtcgcggctgtggagtacttgagcatgcaggngtaccaggccaggctcaggccatagtggcagacgcagggcttccngcggtcccccacctgcctgcagcgaggcagctccgcctgctctgaggccttgggcagagcctcgaacacagaactgtccaccccgtcgggtggag

SEQ ID NO: 687454 - DNA, 997 bp, Homo sapiens
gcctacgtgatgtttatgcagatgagttcatcttccttccaggaagacacactaaaggacttcgaagaaggctgttacctgctttgtaaatagtgaagccatacaagtgatctactaaaagacatccgtagttacagagaaaggaaatactgtgttaggaatttttagtaggactcgttgtaaaccttttgtggaaaggctatcagataatttgcaaggtaccttttgagtgaagaagaggagcacttcagtgaggaacagtacttggctgcagtcaggaaaatacacaagtcatgcttctcgatcaatggtacctctcgaatgtcgactgatgtacttagtcttctgactgtgcagaaccaacgccttagcagtcctgtgtgaggctcggagtccctggagaagacgacagactataatagactaacctggtgtcatctaagtgctgcaatgaaaccgtgcgcagcaaggccttagagtgagcatcgtgaaatgcctttggcttgataaggactacacaatgtaggcaaaaccgagacaacccgtccacatgggagttcatttatctgaccaacatgtaggtcctggaagagctttcgggaccagggtctagttacttcttcagtcggatagggaactacgatgtacgagaggaacaccgtgggggatgcgcttggaagcgaaaagagaaagcattccgtcgtcaatacctccccttgaggacctcgtgagggaacctacgtgtgaccggccagacgtggacatgcatgacttgcgaatcagtttcggcacaagccaattcacggttttagactcgtgtccctcggaagcaccaggtggggttcaacccaaggggcaattaagcgtattcctagaagcacctacaagtggtgctagttgttaaaaacctaacatttttcaggcacgggatggctggggacacaagtcacacggctgaggctcaaattggcccaaagaagttccctgggttaccaaa

SEQ ID NO: 687455 - DNA, 5953 bp, Homo sapiens
  misc_feature (229)..(229): n is a, c, g, or t
ttagaggatctcaaacaccgcaatctagaggaacgtttctgatcttcgccaacggtactacctgcgcaagtcaacctggacgggtccaactacacgttacttaagcagggcctgaacaacgccgttgccttggattttgactaccgagagcagatgatctactggacagatgtgaccacccagggcagcatgatccgaaggatgcaccttaacgggagcaatgtgcagntcctacaccgtacaggcctcagcaaccccgatgggctggctgtggactgggtgggtggcaacctgtactggtgcgacaaaggccgggacaccatcgaggtgtccaagctcaatggggcctatcggacggtgctggtcagctctggcctccgtgagcccagggctctggtggtggatgtgcagaatgggtacctgtactggacagactggggtgaccattcactgatcggccgcatcggcatggatgggtccagccgcagcgtcatcgtggacaccaagatcacatggcccaatggcctgacgctggactatgtcactgagcgcatctactgggccgacgcccgcgaggactacattgaatttgccagcctggatggctccaatcgccacgttgtgctgagccaggacatcccgcacatctttgcactgaccctgtttgaggactacgtctactggaccgactgggaaacaaagtccattaaccgagcccacaagaccacaggcaccaacaaaacgctcctcatcagcacgctgcaccggcccatggacctgcatgtcttccatgccctgcgccagccagacgtgcccaatcacccctgcaaggtcaacaatggtggctgcagcaacctgtgcctgctgtcccccgggggagggcacaaatgtgcctgccccaccaacttctacctgggcagcgatgggcgcacctgtgtgtccaactgcacggctagccagtttgtatgcaagaacgacaagtgcatccccttctggtggaagtgtgacaccgaggacgactgcggggaccactcagacgagcccccggactgccctgagttcaagtgccggcccggacagttccagtgctccacaggtatctgcacaaaccctgccttcatctgcgatggcgacaatgactgccaggacaacagtgacgaggccaactgtgacatccacgtctgcttgcccagtcagttcaaatgcaccaacaccaaccgctgtattcccggcatcttccgctgcaatgggcaggacaactgcggagatggggaggatgagagggactgccccgaggtgacctgcgcccccaaccagttccagtgctccattaccaaacggtgcatcccccgggtctgggtctgcgaccgggacaatgactgtgtggatggcagtgatgagcccgccaactgcacccagatgacctgtggtgtggacgagttccgctgcaaggattcgggccgctgcatcccagcgcgttggaagtgtgacggagaggatgactgtggggatggctcggatgagcccaaggaagagtgtgatgaacgcacctgtgagccataccagttccgctgcaagaacaaccgctgcgtgcccggccgctggcagtgcgactacgacaacgattgcggtgacaactccgatgaagagagctgcacccctcggccctgctccgagagtgagttctcctgtgccaacggccgctgcatcgcggggcgctggaaatgcgatggagaccacgactgcgcggacggctcggacgagaaagactgcaccccccgctgtgacatggaccagttccagtgcaagagcggccactgcatccccctgcgctggcgctgtgacgcagacgccgactgcatggacggcagcgacgaggaggcctgcggcactggcgtgcggacctgccccctggacgagttccagtgcaacaacaccttgtgcaagccgctggcctggaagtgcgatggcgaggatgactgtggggacaactcagatgagaaccccgaggagtgtgcccggttcgtgtgccctcccaaccggcccttccgttgcaagaatgaccgcgtctgtctgtggatcgggcgccaatgcgatggcacggacaactgtggggatgggactgatgaagaggactgtgagccccccacagcccacaccacccactgcaaagacaagaaggagtttctgtgccggaaccagcgctgcctctcctcctccctgcgctgcaacatgttcgatgactgcggggacggctctgacgaggaggactgcagcatcgaccccaagctgaccagctgcgccaccaatgccagcatctgtggggacgaggcacgctgcgtgcgcaccgagaaagcggcctactgtgcctgccgctcgggcttccacaccgtgcccggccagcccggatgccaagacatcaacgagtgcctgcgcttcggcacctgctcccagctctgcaacaacaccaagggcggccacctctgcagctgcgctcggaacttcatgaagacgcacaacacctgcaaggccgaaggctctgagtaccaggtcctgtacatcgctgatgacaatgagatccgcagcctgttccccggccacccccattcggcttacgagcaggcattccagggtgacgagagtgtccgcattgatgctatggatgtccatgtcaaggctggccgtgtctattggaccaactggcacacgggcaccatctcctaccgcagcctgccacctgctgcgcctcctaccacttccaaccgccaccggcgacagattgaccggggtgtcacccacctcaacatttcagggctgaagatgcccagaggcatcgccatcgactgggtggccggaaacgtgtactggaccgactcgggccgagatgtgattgaggtggcgcagatgaagggcgagaaccgcaagacgctcatctcgggcatgattgacgagccccacgccattgtggtggacccactgagggggaccatgtactggtcagactggggcaaccaccccaagattgagacggcagcgatggatgggacgcttcgggagacactggtgcaggacaacattcagtggcccacaggcctggccgtggattatcacaatgagcggctgtactgggcagacgccaagctttcagtcatcggcagcatccggctcaatggcacggaccccattgtggctgctgacagcaaacgaggcctaagtcaccccttcagcatcgacgtctttgaggattacatctatggtgtcacctacatcaataatcgtgtcttcaagatccataagtttggccacagccccttggtcaacctgacagggggcctgagccacgcctctgacgtggtcctttaccatcagcacaagcagcccgaagtgaccaacccatgtgaccgcaagaaatgcgagtggctctgcctgctgagccccagtgggcctgtctgcacctgtcccaatgggaagcggctggacaacggcacatgcgtgcctgtgccctctccaacgccccccccagatgctccccggcctggaacctgtaacctgcagtgcttcaacggtggcagctgtttcctcaatgcacggaggcagcccaagtgccgctgccaaccccgctacacgggtgacaagtgtgaactggaccagtgctgggagcactgtcgcaatgggggcacctgtgctgcctccccctctggcatgcccacgtgccggtgccccacgggcttcacgggccccaaatgcacccagcaggtgtgtgcgggctactgtgccaacaacagcacctgcactgtcaaccagggcaaccagccccagtgccgatgcctacccggcttcctgggcgaccgctgccagtaccggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaactgcacggatggccgggtggcccccagctgtctgacctgcgtcggccactgcagcaatggcggctcctgtaccatgaacagcaaaatgatgcctgagtgccagtgcccaccccacatgacagggccccggtgtgaggagcacgtcttcagccagcagcagccaggacatatagcctccatcctaatccctctgctgttgctgctgctgctggttctggtggccggagtggtattctggtataagcggcgagtccaaggggctaagggcttccagcaccaacggatgaccaacggggccatgaacgtggagattggaaaccccacctacaagatgtacgaaggcggagagcctgatgatgtgggaggcctactggacgctgactttgccctggaccctgacaagcccaccaacttcaccaaccccgtgtatgccacactctacatggggggccatggcagtcgccactccctggccagcacggacgagaagcgagaactcctgggccggggccctgaggacgagataggggaccccttggcatagggccctgccccgtcggactgcccccagaaagcctcctgccccctgccggtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgtaaaaaaaaaaagaaaaaaaggccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttttggcccctttggcccaaggctttttaaatttggaaaagtttttttattgggcccaaattggggcctatttggccaaattccccttaaggggggcgttttaaaaataaatggcccgggtttaaaaaacgtggattttgaaaaaccctggggttccccaatttaaagcccttggaaaaaaacccctttttcacaagtgggtttaatccaaaaaggccccaccctatacgcttttccaaaaatttgccacccttaatgggaaagggaaaatttaagccataaaattttgtaaaaaacccggtaaaatttttgtaaaacaacttattttttaaccaaaggccaaatttggaaaaactcttttaatctaaaaaatattccccaaaagcggttaagtttctcccattttgaaaaaggccccctttttaaaaacggggctccaacctaaaggggaa

SEQ ID NO: 687456 - DNA, 965 bp, Homo sapiens
agcgcggagcacctgcgcgcgaggttgacaacttcgctcgcagttggttcgcagtttactgcgtcacctaccgagattatccgcccatgcgcgcgttggcattagtgtgagtcgtcagactcaaggcaaaggtgggatatcatggcatctatgctggggttggacaccgaggaacagtaagagattatccagactttatcccatcagtggatgctgaggctattcagaaagcaatgcagaggaatcggaggtgatgagaaaatgctcatcagcattctgactgagaggtcaatatgcgcagagggatgctgaatgttaaggaatatcggagcagcatatggaaaggagcgtgaaagatagacttggaagggtgatctctactggccgagttttgagccatctcagtggtggccctaggtgagtccaccagcagttcttgtgatgcaaagcatgtaaagaaagatccatgaagggccgcgggaaccgaatcgaagatgccgtgatttgaaatgttaattacggaggacgagcaggcaactggaaggatatctgtcaagccctattatacgagtatacaagaagagtctgtggagagtgacattagtttccgaatacattttgttgacttccggaaaagtcgtgagattgggagaaagggggaaagaggatgaaaagtctcgacaggtgggatgaagcgttttgggccaacaaagatggcgcagaatttcctattaaaggtgggtgagaacacgatggggcacggattgaaggacaaagttcctggaggattccgggtggttaagggaggtttgccttcaaattgaaacttagtcattcgggggaactccggcaatattggccacaggggcttgtggggcaaggttaaggggaagattatcgggggattggaaaactatgtggggccaagacaatggtgttggaaaacgcaggagtttagcgaagat

SEQ ID NO: 687457 - DNA, 386 bp, Homo sapiens
attcgcttgtgatcagaggatcccaacctacagcgctgtgaggttggagctgtatcaatgatgtcccccccagtatatcagcaccgggatcataccgggcaaacggtgtggatgcttatagaccggccctgagctatcccggggctctaatgaatcctgggccactggtaaataactggcaagaacaataagttccccagccctccggccttaatcttcatgatggaggtctcctacaatgccatcaggacgggtctggtaaggctcctcggtgaggagctcaagtcactggttagacttcctacctagggagggtggggcagaagagtcagcaatcggcgtgggcttggtcacctacaataaggcgctgtaggtggggtaccgag

SEQ ID NO: 687458 - DNA, 3308 bp, Homo sapiens
gagccactgttatctatggggttgccgtgggaggaggaggcgggcgagaatacccaggcctaaagcctctgccctcctcagagccccccacagcccacaccacccactgcaaagacaagaaggagtttctgtgccggaaccagcgctgcctctcctcctccctgcgctgcaacatgttcgatgactgcggggacggctctgacgaggaggactgcagcatcgaccccaagctgaccagctgcgccaccaatgccagcatctgtggggacgaggcacgctgcgtgcgcaccgagaaagcggcctactgtgcctgccgctcgggcttccacaccgtgcccggccagcccggatgccaagacatcaacgagtgcctgcgcttcggcacctgctcccagctctgcaacaacaccaagggcggccacctctgcagctgcgctcggaacttcatgaagacgcacaacacctgcaaggccgaaggctctgagtaccaggtcctgtacatcgctgatgacaatgagatccgcagcctgttccccggccacccccattcggcttacgagcaggcattccagggtgacgagagtgtccgcattgatgctatggatgtccatgtcaaggctggccgtgtctattggaccaactggcacacgggcaccatctcctaccgcagcctgccacctgctgcgcctcctaccacttccaaccgccaccggcgacagattgaccggggtgtcacccacctcaacatttcagggctgaagatgcccagaggcatcgccatcgactgggtggccggaaacgtgtactggaccgactcgggccgagatgtgattgaggtggcgcagatgaagggcgagaaccgcaagacgctcatctcgggcatgattgacgagccccacgccattgtggtggacccactgagggggaccatgtactggtcagactggggcaaccaccccaagattgagacggcagcgatggatgggacgcttcgggagacactggtgcaggacaacattcagtggcccacaggcctggccgtggattatcacaatgagcggctgtactgggcagacgccaagctttcagtcatcggcagcatccggctcaatggcacggaccccattgtggctgctgacagcaaacgaggcctaagtcaccccttcagcatcgacgtctttgaggattacatctatggtgtcacctacatcaataatcgtgtcttcaagatccataagtttggccacagccccttggtcaacctgacagggggcctgagccacgcctctgacgtggtcctttaccatcagcacaagcagcccgaagtgaccaacccatgtgaccgcaagaaatgcgagtggctctgcctgctgagccccagtgggcctgtctgcacctgtcccaatgggaagcggctggacaacggcacatgcgtgcctgtgccctctccaacgccccccccagatgctccccggcctggaacctgtaacctgcagtgcttcaacggtggcagctgtttcctcaatgcacggaggcagcccaagtgccgctgccaaccccgctacacgggtgacaagtgtgaactggaccagtgctgggagcactgtcgcaatgggggcacctgtgctgcctccccctctggcatgcccacgtgccggtgccccacgggcttcacgggccccaaatgcacccagcaggtgtgtgcgggctactgtgccaacaacagcacctgcactgtcaaccagggcaaccagccccagtgccgatgcctacccggcttcctgggcgaccgctgccagtaccggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaactgcacggatggccgggtggcccccagctgtctgacctgcgtcggccactgcagcaatggcggctcctgtaccatgaacagcaaaatgatgcctgagtgccagtgcccaccccacatgacagggccccggtgtgaggagcacgtcttcagccagcagcagccaggacatatagcctccatcctaatccctctgctgttgctgctgctgctggttctggtggccggagtggtattctggtataagcggcgagtccaaggggctaagggcttccagcaccaacggatgaccaacggggccatgaacgtggagattggaaaccccacctacaagatgtacgaaggcggagagcctgatgatgtgggaggcctactggacgctgactttgccctggaccctgacaagcccaccaacttcaccaaccccgtgtatgccacactctacatggggggccatggcagtcgccactccctggccagcacggacgagaagcgagaactcctgggccggggccctgaggacgagataggggaccccttggcatagggccctgccccgtcggactgcccccagaaagcctcctgccccctgccggtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgta

SEQ ID NO: 687459 - DNA, 3127 bp, Homo sapiens
agccttccataaatatttattataattaaaagaccgtagccataccccccccccccagacccttcacccagaaatagagagattggaattgtaaacaccgtatcccgttgagaccgcggcctactgtgcctgccgctcgggcttccacaccgtgcccggccagcccggatgccaagacatcaacgagtgcctgcgcttcggcacctgctcccagctctgcaacaacaccaagggcggccacctctgcagctgcgctcggaacttcatgaagacgcacaacacctgcaaggccgaaggctctgagtaccaggtcctgtacatcgctgatgacaatgagatccgcagcctgttccccggccacccccattcggcttacgagcaggcattccagggtgacgagagtgtccgcattgatgctatggatgtccatgtcaaggctggccgtgtctattggaccaactggcacacgggcaccatctcctaccgcagcctgccacctgctgcgcctcctaccacttccaaccgccaccggcgacagattgaccggggtgtcacccacctcaacatttcagggctgaagatgcccagaggcatcgccatcgactgggtggccggaaacgtgtactggaccgactcgggccgagatgtgattgaggtggcgcagatgaagggcgagaaccgcaagacgctcatctcgggcatgattgacgagccccacgccattgtggtggacccactgagggggaccatgtactggtcagactggggcaaccaccccaagattgagacggcagcgatggatgggacgcttcgggagacactggtgcaggacaacattcagtggcccacaggcctggccgtggattatcacaatgagcggctgtactgggcagacgccaagctttcagtcatcggcagcatccggctcaatggcacggaccccattgtggctgctgacagcaaacgaggcctaagtcaccccttcagcatcgacgtctttgaggattacatctatggtgtcacctacatcaataatcgtgtcttcaagatccataagtttggccacagccccttggtcaacctgacagggggcctgagccacgcctctgacgtggtcctttaccatcagcacaagcagcccgaagtgaccaacccatgtgaccgcaagaaatgcgagtggctctgcctgctgagccccagtgggcctgtctgcacctgtcccaatgggaagcggctggacaacggcacatgcgtgcctgtgccctctccaacgccccccccagatgctccccggcctggaacctgtaacctgcagtgcttcaacggtggcagctgtttcctcaatgcacggaggcagcccaagtgccgctgccaaccccgctacacgggtgacaagtgtgaactggaccagtgctgggagcactgtcgcaatgggggcacctgtgctgcctccccctctggcatgcccacgtgccggtgccccacgggcttcacgggccccaaatgcacccagcaggtgtgtgcgggctactgtgccaacaacagcacctgcactgtcaaccagggcaaccagccccagtgccgatgcctacccggcttcctgggcgaccgctgccagtaccggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaactgcacggatggccgggtggcccccagctgtctgacctgcgtcggccactgcagcaatggcggctcctgtaccatgaacagcaaaatgatgcctgagtgccagtgcccaccccacatgacagggccccggtgtgaggagcacgtcttcagccagcagcagccaggacatatagcctccatcctaatccctctgctgttgctgctgctgctggttctggtggccggagtggtattctggtataagcggcgagtccaaggggctaagggcttccagcaccaacggatgaccaacggggccatgaacgtggagattggaaaccccacctacaagatgtacgaaggcggagagcctgatgatgtgggaggcctactggacgctgactttgccctggaccctgacaagcccaccaacttcaccaaccccgtgtatgccacactctacatggggggccatggcagtcgccactccctggccagcacggacgagaagcgagaactcctgggccggggccctgaggacgagataggggaccccttggcatagggccctgccccgtcggactgcccccagaaagcctcctgccccctgccggtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgta

SEQ ID NO: 687460 - DNA, 1578 bp, Homo sapiens
aaaaagaaaaaataaaactctcattattggtggtgggctaatcataatccagcggtatttaaggcacataaaggaccaaaaaaaaaaaaaaggaattccaaaggacccaaactttttttaaacctaacaaaatatcctccttgggagagtatggcacagtgtgggccttattatcatctctgtgggccaataagtggtaacgcgtaagttgggcccacggtaaacaatttccatttgaagaatatccactgggggaccacgacaaccctgtgtgtaccccgctatacgggcatcacccgggagaatagcaaagagtcagcaaccccctagggagggactaaaagggcgatagagaccacacacccaatgtacaaggacagggcacaaccggcgacacctaataaaaaagcgaccagtgagaaagaggcacccccaatacataggggacataactagacacatcgggggaaggtcacagaaattggggccacgaaactatcaaagttaccaccaaggtggggtagaacacaggcgccaaatgtgacactacaaaagagatccccaaagacaagagccctgggaaacacggggggaacacatcggggagaacaacaatcggcccccaatatagtagaacaaccacagagaagagatggggaacaaaggcgtgaaacaaacgagcgtcccacccaaaaaaatacacccaaaggagaagaagaacaaaggggaggcaaacacacaaatgacacaaaacaactcactaacgaccgtacaacaacaacatacagtgcggaagccacccacaatacaacggggtcaaacccccatacaaaaccgtcgcaacggcctacaacaacgtgggcccatagggaaaagatgaaggcaaaccataagagattcggttggacaaacgaatactacaagaacaatttagggcacagccaaacacaatgggggcgacagaacaaagatatataccaaaggacgccaacaccaacaaagaaccccggtgtattacaacacatcacagaacgaagaactagcacacagacggggacaagattacacaacacaagtgaatagaaccagaacgaaaaacagaggcaaccattgcgacgacacagcccatagaactaagcacatgaaacaggtgaaaaccggaataaaaacacacacaataggtgaacagcaactaggaacctcaaaagaaacaatcgccgcgggcaccacacataagcacacaacaggacgaggccagaggaccctgataggaacaggattgacaacaacggcaagaaaaaaccgggacaacagtgctgagaaagaaaagaaagcaagacaaaagaaaaaaggggggcacacaaacagaccagaaaagatgaacgcgcaaggcaaatcaagcacaaacaggaggaagaagagacatcacgtctcgtggaacagaggacgcccaagacacagaacgagcacgcgactagtccagcacgaaaaacaacaaccagccaacaaagcagcacgagaagcaagagacagaacgaagcaaagcagcaagcaggcaagactgacgaagccagagca

SEQ ID NO: 687461 - DNA, 5121 bp, Homo sapiens
  misc_feature (229)..(229): n is a, c, g, or t
ttagaggatctcaaacaccgcaatctagaggaacgtttctgatcttcgccaacggtactacctgcgcaagtcaacctggacgggtccaactacacgttacttaagcagggcctgaacaacgccgttgccttggattttgactaccgagagcagatgatctactggacagatgtgaccacccagggcagcatgatccgaaggatgcaccttaacgggagcaatgtgcagntcctacaccgtacaggcctcagcaaccccgatgggctggctgtggactgggtgggtggcaacctgtactggtgcgacaaaggccgggacaccatcgaggtgtccaagctcaatggggcctatcggacggtgctggtcagctctggcctccgtgagcccagggctctggtggtggatgtgcagaatgggtacctgtactggacagactggggtgaccattcactgatcggccgcatcggcatggatgggtccagccgcagcgtcatcgtggacaccaagatcacatggcccaatggcctgacgctggactatgtcactgagcgcatctactgggccgacgcccgcgaggactacattgaatttgccagcctggatggctccaatcgccacgttgtgctgagccaggacatcccgcacatctttgcactgaccctgtttgaggactacgtctactggaccgactgggaaacaaagtccattaaccgagcccacaagaccacaggcaccaacaaaacgctcctcatcagcacgctgcaccggcccatggacctgcatgtcttccatgccctgcgccagccagacgtgcccaatcacccctgcaaggtcaacaatggtggctgcagcaacctgtgcctgctgtcccccgggggagggcacaaatgtgcctgccccaccaacttctacctgggcagcgatgggcgcacctgtgtgtccaactgcacggctagccagtttgtatgcaagaacgacaagtgcatccccttctggtggaagtgtgacaccgaggacgactgcggggaccactcagacgagcccccggactgccctgagttcaagtgccggcccggacagttccagtgctccacaggtatctgcacaaaccctgccttcatctgcgatggcgacaatgactgccaggacaacagtgacgaggccaactgtgacatccacgtctgcttgcccagtcagttcaaatgcaccaacaccaaccgctgtattcccggcatcttccgctgcaatgggcaggacaactgcggagatggggaggatgagagggactgccccgaggtgacctgcgcccccaaccagttccagtgctccattaccaaacggtgcatcccccgggtctgggtctgcgaccgggacaatgactgtgtggatggcagtgatgagcccgccaactgcacccagatgacctgtggtgtggacgagttccgctgcaaggattcgggccgctgcatcccagcgcgttggaagtgtgacggagaggatgactgtggggatggctcggatgagcccaaggaagagtgtgatgaacgcacctgtgagccataccagttccgctgcaagaacaaccgctgcgtgcccggccgctggcagtgcgactacgacaacgattgcggtgacaactccgatgaagagagctgcacccctcggccctgctccgagagtgagttctcctgtgccaacggccgctgcatcgcggggcgctggaaatgcgatggagaccacgactgcgcggacggctcggacgagaaagactgcaccccccgctgtgacatggaccagttccagtgcaagagcggccactgcatccccctgcgctggcgctgtgacgcagacgccgactgcatggacggcagcgacgaggaggcctgcggcactggcgtgcggacctgccccctggacgagttccagtgcaacaacaccttgtgcaagccgctggcctggaagtgcgatggcgaggatgactgtggggacaactcagatgagaaccccgaggagtgtgcccggttcgtgtgccctcccaaccggcccttccgttgcaagaatgaccgcgtctgtctgtggatcgggcgccaatgcgatggcacggacaactgtggggatgggactgatgaagaggactgtgagccccccacagcccacaccacccactgcaaagacaagaaggagtttctgtgccggaaccagcgctgcctctcctcctccctgcgctgcaacatgttcgatgactgcggggacggctctgacgaggaggactgcagcatcgaccccaagctgaccagctgcgccaccaatgccagcatctgtggggacgaggcacgctgcgtgcgcaccgagaaagcggcctactgtgcctgccgctcgggcttccacaccgtgcccggccagcccggatgccaagacatcaacgagtgcctgcgcttcggcacctgctcccagctctgcaacaacaccaagggcggccacctctgcagctgcgctcggaacttcatgaagacgcacaacacctgcaaggccgaaggctctgagtaccaggtcctgtacatcgctgatgacaatgagatccgcagcctgttccccggccacccccattcggcttacgagcaggcattccagggtgacgagagtgtccgcattgatgctatggatgtccatgtcaaggctggccgtgtctattggaccaactggcacacgggcaccatctcctaccgcagcctgccacctgctgcgcctcctaccacttccaaccgccaccggcgacagattgaccggggtgtcacccacctcaacatttcagggctgaagatgcccagaggcatcgccatcgactgggtggccggaaacgtgtactggaccgactcgggccgagatgtgattgaggtggcgcagatgaagggcgagaaccgcaagacgctcatctcgggcatgattgacgagccccacgccattgtggtggacccactgagggggaccatgtactggtcagactggggcaaccaccccaagattgagacggcagcgatggatgggacgcttcgggagacactggtgcaggacaacattcagtggcccacaggcctggccgtggattatcacaatgagcggctgtactgggcagacgccaagctttcagtcatcggcagcatccggctcaatggcacggaccccattgtggctgctgacagcaaacgaggcctaagtcaccccttcagcatcgacgtctttgaggattacatctatggtgtcacctacatcaataatcgtgtcttcaagatccataagtttggccacagccccttggtcaacctgacagggggcctgagccacgcctctgacgtggtcctttaccatcagcacaagcagcccgaagtgaccaacccatgtgaccgcaagaaatgcgagtggctctgcctgctgagccccagtgggcctgtctgcacctgtcccaatgggaagcggctggacaacggcacatgcgtgcctgtgccctctccaacgccccccccagatgctccccggcctggaacctgtaacctgcagtgcttcaacggtggcagctgtttcctcaatgcacggaggcagcccaagtgccgctgccaaccccgctacacgggtgacaagtgtgaactggaccagtgctgggagcactgtcgcaatgggggcacctgtgctgcctccccctctggcatgcccacgtgccggtgccccacgggcttcacgggccccaaatgcacccagcaggtgtgtgcgggctactgtgccaacaacagcacctgcactgtcaaccagggcaaccagccccagtgccgatgcctacccggcttcctgggcgaccgctgccagtaccggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaactgcacggatggccgggtggcccccagctgtctgacctgcgtcggccactgcagcaatggcggctcctgtaccatgaacagcaagatgtacgaaggcggagagcctgatgatgtgggaggcctactggacgctgactttgccctggaccctgacaagcccaccaacttcaccaaccccgtgtatgccacactctacatggggggccatggcagtcgccactccctggccagcacggacgagaagcgagaactcctgggccggggccctgaggacgagataggggaccccttggcatagggccctgccccgtcggactgcccccagaaagcctcctgccccctgccggtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgta

SEQ ID NO: 687462 - DNA, 2324 bp, Homo sapiens
gaggagcattgacgcctacagctcttcacgttcgactcgagactatgcgactcacggccgtgacactgcgcacaggcatctcaccgaatttgttgtgactagcttgacaggcacagatcgatgtgtccatcaatgtcatcgcccgtttcatggtatcagaccgtcgtttggatcgattcacgatgctcatatgagtcgtaccactcataaataatcatgaatcgtggtgtttgactacaatatccgagtaatgtgtatggcacggacccttggtcaacctgacagggggcctgagccacgcctctgacgtggtcctttaccatcagcacaagcagcccgaagtgaccaacccatgtgaccgcaagaaatgcgagtggctctgcctgctgagccccagtgggcctgtctgcacctgtcccaatgggaagcggctggacaacggcacatgcgtgcctgtgccctctccaacgccccccccagatgctccccggcctggaacctgtaacctgcagtgcttcaacggtggcagctgtttcctcaatgcacggaggcagcccaagtgccgctgccaaccccgctacacgggtgacaagtgtgaactggaccagtgctgggagcactgtcgcaatgggggcacctgtgctgcctccccctctggcatgcccacgtgccggtgccccacgggcttcacgggccccaaatgcacccagcaggtgtgtgcgggctactgtgccaacaacagcacctgcactgtcaaccagggcaaccagccccagtgccgatgcctacccggcttcctgggcgaccgctgccagtaccggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaactgcacggatggccgggtggcccccagctgtctgacctgcgtcggccactgcagcaatggcggctcctgtaccatgaacagcaaaatgatgcctgagtgccagtgcccaccccacatgacagggccccggtgtgaggagcacgtcttcagccagcagcagccaggacatatagcctccatcctaatccctctgctgttgctgctgctgctggttctggtggccggagtggtattctggtataagcggcgagtccaaggggctaagggcttccagcaccaacggatgaccaacggggccatgaacgtggagattggaaaccccacctacaagatgtacgaaggcggagagcctgatgatgtgggaggcctactggacgctgactttgccctggaccctgacaagcccaccaacttcaccaaccccgtgtatgccacactctacatggggggccatggcagtcgccactccctggccagcacggacgagaagcgagaactcctgggccggggccctgaggacgagataggggaccccttggcatagggccctgccccgtcggactgcccccagaaagcctcctgccccctgccggtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgta

SEQ ID NO: 687463 - DNA, 386 bp, Homo sapiens
actatggtgcccacctcacaatcccacgtcttcacccccaatatcacgatgggatcggactcaggacagggacgcatgtgtgttttgaataggagccctaactgtagttacttctttcacagcagggacggatgagacaataggcagctgtggagaccatgaggttgagggaggtggggtatctcgctgctctgaccttaggtagagtcctccacagaagcatcaaagtggactggcacatatgggctcccttcacaggccacaatgatgtgtctctccttcgggctggtccggtatgcacagttggggtacctggagccgtttgtcaggcggcagtctgtgatgtgcatgctggagttgctcttgtagcagttgccctgcccgtt

SEQ ID NO: 687464 - DNA, 112 bp, Homo sapiens
cccaacccccattttaattggcaccctttttttttcatgggttggcaaaaacatttttttaacttttttctatttgactggggggtgaattaaaattgtcccatttgcttta

SEQ ID NO: 687465 - DNA, 261 bp, Homo sapiens
agtatatgctccataccccaatgtgttacgtgcaaacatcctccaaaactgtgtatgtgaattagctataaccttcagccctgaattcaccttcatttgaccccatcagttacagggccttacatatacatttccactgacctgatcaatgtatgcaatgctatttaagaagtgatatgtgatttactggaaagctcgtatgagagaagtcaaaggaatgccaactgcacatcaaaggacatcttcaggcaattcaggatc

SEQ ID NO: 687466 - DNA, 2321 bp, Homo sapiens
agttgaagtgtcgaaggggctgtgccgatggcgtactatacggtggtgtgggagcgagggagggtgtggagttgggtagaggggcatgaggcccgtaagcttttagtgatcggattggatcacggaggaatggcatggatcagcgatcgtggattgttgaggcaggttcgatggccataagtcagctttcaggtatcgacgttgttggatgattagatttatagtgtgtcataaaatatagtgtaatccgtatgtggctgtcacccttggtcaacctgacagggggcctgagccacgcctctgacgtggtcctttaccatcagcacaagcagcccgaagtgaccaacccatgtgaccgcaagaaatgcgagtggctctgcctgctgagccccagtgggcctgtctgcacctgtcccaatgggaagcggctggacaacggcacatgcgtgcctgtgccctctccaacgccccccccagatgctccccggcctggaacctgtaacctgcagtgcttcaacggtggcagctgtttcctcaatgcacggaggcagcccaagtgccgctgccaaccccgctacacgggtgacaagtgtgaactggaccagtgctgggagcactgtcgcaatgggggcacctgtgctgcctccccctctggcatgcccacgtgccggtgccccacgggcttcacgggccccaaatgcacccagcaggtgtgtgcgggctactgtgccaacaacagcacctgcactgtcaaccagggcaaccagccccagtgccgatgcctacccggcttcctgggcgaccgctgccagtaccggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaactgcacggatggccgggtggcccccagctgtctgacctgcgtcggccactgcagcaatggcggctcctgtaccatgaacagcaaaatgatgcctgagtgccagtgcccaccccacatgacagggccccggtgtgaggagcacgtcttcagccagcagcagccaggacatatagcctccatcctaatccctctgctgttgctgctgctgctggttctggtggccggagtggtattctggtataagcggcgagtccaaggggctaagggcttccagcaccaacggatgaccaacggggccatgaacgtggagattggaaaccccacctacaagatgtacgaaggcggagagcctgatgatgtgggaggcctactggacgctgactttgccctggaccctgacaagcccaccaacttcaccaaccccgtgtatgccacactctacatggggggccatggcagtcgccactccctggccagcacggacgagaagcgagaactcctgggccggggccctgaggacgagataggggaccccttggcatagggccctgccccgtcggactgcccccagaaagcctcctgccccctgccggtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgta

SEQ ID NO: 687467 - DNA, 2034 bp, Homo sapiens
gcactcaggcatcattttgctgttcatggtacaggagccgccattgctgcagtggccaacccatgtgaccgcaagaaatgcgagtggctctgcctgctgagccccagtgggcctgtctgcacctgtcccaatgggaagcggctggacaacggcacatgcgtgcctgtgccctctccaacgccccccccagatgctccccggcctggaacctgtaacctgcagtgcttcaacggtggcagctgtttcctcaatgcacggaggcagcccaagtgccgctgccaaccccgctacacgggtgacaagtgtgaactggaccagtgctgggagcactgtcgcaatgggggcacctgtgctgcctccccctctggcatgcccacgtgccggtgccccacgggcttcacgggccccaaatgcacccagcaggtgtgtgcgggctactgtgccaacaacagcacctgcactgtcaaccagggcaaccagccccagtgccgatgcctacccggcttcctgggcgaccgctgccagtaccggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaactgcacggatggccgggtggcccccagctgtctgacctgcgtcggccactgcagcaatggcggctcctgtaccatgaacagcaaaatgatgcctgagtgccagtgcccaccccacatgacagggccccggtgtgaggagcacgtcttcagccagcagcagccaggacatatagcctccatcctaatccctctgctgttgctgctgctgctggttctggtggccggagtggtattctggtataagcggcgagtccaaggggctaagggcttccagcaccaacggatgaccaacggggccatgaacgtggagattggaaaccccacctacaagatgtacgaaggcggagagcctgatgatgtgggaggcctactggacgctgactttgccctggaccctgacaagcccaccaacttcaccaaccccgtgtatgccacactctacatggggggccatggcagtcgccactccctggccagcacggacgagaagcgagaactcctgggccggggccctgaggacgagataggggaccccttggcatagggccctgccccgtcggactgcccccagaaagcctcctgccccctgccggtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgta

SEQ ID NO: 687468 - DNA, 211 bp, Homo sapiens
  misc_feature (123)..(123): n is a, c, g, or t
agacaaaacagatacacaagcaggttaagcgctaaagcatcactaggcaagtagcattcaaacatgtgatgtgggtagagaaaggagtacctggcatgcatgtacctgctatagtttgactgnaatccgttgatgtttaatcttggtcttgtcatgggtccgctcataacgaccaagcgctgtggtgcaggtactggtagatcagtctgcg

SEQ ID NO: 687469 - DNA, 1592 bp, Homo sapiens
acaccggttggtggggggccacatcacattcgtccagactcgagctgtcgatgacgagttcggtggtgatccccaaacaacaccgcgggtgctttcgtccgtcaggaaaatggtggtgtggaccacgcacttctggtcggcgtggtgtagtgagatgattcgttgtcttcttgcgtggggtgaccacccaacgtgatctcatcaactggtggtagcctcccctcttcctgtctcggccagctgtgtctgtttttttgtgttgttgtctcccgtgctgaattcacccagccctcctgtctgggtgggtagattttgtcttctccccccccttcctttcggcaggcgggggaagaacccacaacagacgggctgctgcctgtcgtcggtgtggggacggatcctcctcgtccgcgacccttcgtctggcgtccatcatccccgtcggcggactctgttggtagctcagctccgggtcgcctgcctccaaccaggcggcccgcctactttcgtccgtccaacctacgtggggggagggggccaccacaacctatcggtgctagcattcgttccgtccccctcggtgtggtgtgccgcagatcgtccgtcccttccgttcgttcgttggtggaacaactagcggtaaagtcttggttgtcggcccccaccgacgaggaccgccgcgggggcgaccaccccacgcgccccacggaggaggaggcggacgccacacgcggccccccacgaggcctcaacagaagagaagcgacgacacctacgtgttgtggggtgccgcaaggagcctcaacgacgacaccaggagagtcgttgtggggcacacacaaacacatggcgcgtctgtggcctcatcgtgtggtgatgacagccccgggggagccactctccgtcgcgggagccgcctcctcgtggagcgacactcgtgggcccacatggtctgtcccacctcgtgagtagtgtcccgcgcgcacactcacacaccctcgtgtgcgtgtgtgcctcgggtgtctcatcgcgccacaagcgcactctccccccgagagagaggagaccccctcgagagagagccctctgcgggagagagacacgtctgttggagagagcacaccaccaactaggcgtcgtcgcccgacgcctctggcgcggcgcgcgcgacgcctctcgagataagagagagccccctctgtctgtgcgctctgtgtctgtgcggtgtcacacctgtggaacacacccacacactgtctccggcgcacctctcgcctcccgagagcgcgcaccagcgcccgtgtgtctgtgaggtgttgtgtgtctgtctctgtgagaggcccgcagaggccccccgagaggagagctcgcctcggctctctccgcgagggcgctgacgcggcacgccgccttgagggaccctcgctgccctcacccctggagagcggcacctcttcacgcgcggtgcacccacggagccctccccggcccccccttttttgtgacattcccgtggcacacacactggagactcccccgggcccgccccccccccccccccctgggaaaccccttaaggccccctgcccctt

SEQ ID NO: 687470 - DNA, 408 bp, Homo sapiens
  misc_feature (62)..(62): n is a, c, g, or t
caaatgcctgactaaatcttaagaacctgaattaacatagtagtttacgaaggactaagganctatgttggtagatggtatactctttgtttgattggaagatctatggtgacaagggaaggatttaacatagaaatggcattatttattcgatgcaaagctgagtgcaaacatcattatatctctgaatcttttgcagatgttcatgttatttagtagcggtattaacctcattggtagctgaactctagggaggtttattggtgaagcctcacagtcctctgtggtctgcactgctagagactcaacattgtggcatggaaatgcattgacacatcctatgccatgactttaatttcctgatttgtaatctcttattttatcattaataaaatgcatttttgaact

SEQ ID NO: 687471 - DNA, 100 bp, Homo sapiens
tgctggaccgcaagcactctttcttcagccaagctggagtgatcttcctgtttgtttcaggataatgtctaatcctaccattccatttgatcactgagaa

SEQ ID NO: 687472 - DNA, 1840 bp, Homo sapiens
agcattctcagaagatgatttcttggtatcaaaatgtgcagtttctacaacagtttagatcaccaccaccattttcttcttttttaaaaataaataactgctcccatttcaggcagtgcaaaccttcatctgctggagaccagaggtacaaggagatcagggggttgcagcaccgctagcggcttgcaagatcggggagttgggagggcgagagaggaggaggtgcagctttgatgctgggacctccctgagtggggctgatgaatgtatattcattagcaccatggctcacttcccaggaagactgatcaggagcccttcagggacaattttgttctcaagattcacaccttaggaacacatttttatcacctcaaaattttgatccatcacccctctctccacctatatttttacaaataccattcagacttaaattaagctgaagaaactagcctttggtaacatagggtgtcattggttttcagggatgtaaccaattccagaaatacattcttttgcctggcatgaagactttgaaacacgggccgcttattttcagagttcctgttttgggacgtgacttggctacttgttacttccaggtggttaccacacggcgggggtcatgcctttccctcccccaagatgataatagatttaatagactcaaagaagttgttcagaatcaaagaagaaaaagtctggcttaaacatagtaacttctgtgtgccaggttaatgacaaccaaaagctctctatttaccattattgccaaacttcatcagttgcccatcctgcaccaaaatcctgtgcgtgtttaaattcacgttgtcaccaaagaggtgcacagatcaacaacctggatgacgcaggtgttctccagggaaaccagaccaagtcaagtctccaggtaacttttttgaagtcttttttttaaggcgcgcaggtaccaagcaacagaatagagtaacctgaacgttcttactctcccaggcatggcccacgtggtgcttcaggtagaaatgtgcttcaccctcctggtggggggcgaggacacagcccactgcatgcagcatggtagagagctggggcgaatatctccatgtctttggaggatgtcagctggccgctttcagggcagagtcgggtgggcgttggtgccaccttaggaaggagagcgatgcgtgggtctggccagagctctggagccaatgccgggctgcctgagagcagaggaaatgcatggcccatgtgcatttctgagtattttaaactcgttcaggcgcgcgggcagccttcatgatgatgtagctcgcagagaagagcaggagcagaattagccctttcttcaggccatcttgcctcaaagggtacacatgtttggcggttaagatgaaactaacccttatgtttcatcctggccccatgatgtacacatcttagccatgtagtggccttggggggccacagagatttcctttgaggagcatggtagagtccacagccatggctgaagtcagtggacaccgaggggacaggactgcaggccaccaggggcctctgcccagagggaggcagagaggatggcggccacgggtgctctcctggcatcctcatggggtgatgccaggccgggcacttcaaaacaggctcagccgactgggagatcctttgtactttgcacagttcacacacacaaacacacacaccctatcccaagtgtttttgttagacacaaatgtcagcgtgtgattttggaagacttgtcagtgatgacaaaccatgatgcctgtgtttctgagtctttaaataaaaatgaacatggagaaaaaaaaaa

SEQ ID NO: 687473 - DNA, 1003 bp, Homo sapiens
gacccctggtgtccagagcccccacccctcccgcaacaagcagctgatgccccagtgattctctatacatttttcacctcggccaatatgtccaggaaaactgcttacttctcttttcttgcctggagcttcattgttcacccttacgttgcaatataggaattaatgctacaagaataacaagtaaagcttacctgaaaagtgcataggtttggggggccaaattgggttaattcttaacaattcttcccaactggtggggaaaaaccgagcaagagctatcaaacactctacaaatctctccgtggttacgcgaagtgcagatctgaacttataagatgtttatgtgagaccagtggtttcaacaatgggattgtgttacgaattatccctttaactgaaaccctcagttttactgtttacattattaggaaaacagggatatcttttgaatctaaaaatttgatgtacagcatgtgatgttgaagtttacatgtaaagtcacagtataggtgaaataacgtatgtcatattttgacgacgtatcctgcagccatgtttttaccgtgagtgtaaaagtcaaagtacatggtagatagtctttcacaataacaggaaacaggattcatgttcctccaaatgtacatttatcaaagctaatggatgattttagtaaaaagagattcggcccagtcaggtttatgacagtcatggcctaatgtggctgatggttaaagcaagtataaatttccaactagatcacgtattctacaaatctcctgcatttacaaaagtgcttgagttaactatagacttgtaaagaaggtacccataatgacggccaaagcagtccttgaacaccggttaaaaagaaagactgcgggcctaccgaaagaacacaagaaatcgacaaaaatacgcaagaaaagccagccagacatccgacaaagaggaccaaacagaccgatgcacaacaagcgcacacaagcacaagacactaacg

SEQ ID NO: 687474 - DNA, 137 bp, Homo sapiens
ctagatttccccaggcggtactacaggcggtacttttgccgggactactggcgggactactggcgggactactggcgggactactggccgggactactggcgggactactggtcgggactactggcgggactactgg

SEQ ID NO: 687475 - DNA, 104 bp, Homo sapiens
gtcatctgtacagctgataggaacacgcaagcaacgctgaaaattttgcttacctgacttgatgctaaagtggtcatagtgctacgacttgacttgggcgtgtg

SEQ ID NO: 687476 - DNA, 924 bp, Homo sapiens
ctcgcccgccgaattgacacgaggcggcagagctgccgccattttgcgggaagaggaggctctgtacctgcattaactgattcgctagcctagactctaggcaactatccgagctccactccccacaacatactcaaagcgaacggagagaaccgggacccccctgcggggacccggcaactgactctgacaggatggacatcctgactgacctttgcaacactagctgactccgagcgccactgcatgcgcaagccctccccctactacacacacacacgaacccagcgcactgcacgcacacaacacgcgcaaacgcaagctcacacacaacggcacttactccatagacaactaccaccacgacagccacccagcagacagctgcgcacactgcagcaccccacgctgcgcacacgccagccacacaatcgcgcgcgaacgcaccacacgccaaactccgctcagatcggacgcactcgcgcgcatcggcctactacgcaccggagcacgcaaacatacgctccggccacgccccgcaacacgctcacaaggcgctccgcgacagctgctcagctcccaccaacgccaacagcacgcaaacgacatagcgcacgcacctccgcccgcacccacctgcgcctacaccatgcaagcatccagaccagaaaacgactccgcgagacaccccacctccagcctcccgctcgccacgcgcactccgactagcttgaccacatccaccaagcgcaagcttcccactccccaaccctctcccccaccactgggcctacaccacacggcactacttgcgcaccacccacgctaccaccgaacgcatctcctcccactcctcacgcacccacaacaccacgcccccacgcctccacgcggcaacgccccacgccctgcactacactactg

SEQ ID NO: 687477 - DNA, 933 bp, Homo sapiens
tcaagcttgttatcatgtaaattctgtacaaagaatagttatttttctctttttgtgtggtggttctgtgtgtgttattgatgtttattttttaattcctttcccccaggccctctctattatgagactgtgcccgccggtttcaagatcacggaaattggtggcaacaagacacagatggggtacctgggcacagcggcgaacttctcttccgtttgcggttttctgcctaattgtgcaactgaggaacataattctatttttcacgatgaggaaatgcgtagctttgtacagacggctgattcaagttacatgtaacagcctccaaagggctgtctccattctgtccccttcccataaaagaagtgggggtgtcgagaagaccagggaagggacccttgcctcagccctccccctggactcaccttgcctcccagacaatcgtgcccaggttgttaaccctcggattgtgcttcaactaaggggacctagactccctctcccacaggagccccagaccccagaagtggtttgcaattaatcaagatatgtgtcgagtcctctttcttttcacgtccctcatcttcattgaaacaaatcatatgctttacacaaagctgggggtgcatgaatattatggatacttacctacccctgcaagttgagaaccaaggagttaagggatgtgggcgggtaactcacatgcaatgtacttgttgaagagaggtgacggggggtcggattaacattgggcacattggacacacagccctgtcccgcttatggacgtatagcacgaaaatcaaagaaaacgggggtaagaacggagacaagaccagctgcaaagactatcgacacacaggaaagaaggagcagggagaacaggacggaacaaacagaaaacgcaggtggctatcatgaaaaacgaaaata

SEQ ID NO: 687478 - DNA, 128 bp, Homo sapiens
tgaactacagggggtcccatctatatacacaggattcctgccacactggatgcagagcatcgacggcttcatcgcagtgtctagtctgcttcagctgtggtaccttcggctagtggggggtcgagctc

SEQ ID NO: 687479 - DNA, 418 bp, Homo sapiens
  misc_feature (61)..(61): n is a, c, g, or t
  misc_feature (65)..(65): n is a, c, g, or t
  misc_feature (207)..(207): n is a, c, g, or t
cggattggcgaccatttcaactgaagggcagtcaaaacatcagctgaggccgggcatggtngcgnacgcgcctctagtcccagctactcagtaggctgaggcagaagaattgccaggaggcaattgaacttgggaggcggaggttgcagtgaaccaagatcacaccatgcactccagcctggatgacagaacaagactccatctcanaaaacaaaaacaactctatgtggctaagtactgcattctccccagtactatcatttcctcccaaaagtggaggaaacccaggtataaagggctatgtagcttttgatcccttacataaatgggattataggcgtgagccattgcgcccggcagaacaccgtcgcttcgacggtgttctgtagctaggagaaagtggtacatatttcttttt

SEQ ID NO: 687480 - DNA, 400 bp, Homo sapiens
gcgtcgaccaaaaacaaacaaacaaaaaaaaacacactagctgatgccaggtgctgtggctcatacctgtaatcccagcactttgggaggccaaggcaggtggatcacgagatcaggagttcgagaccaacctgaccaacatggtgaaaccgtgtctctactaaaaattcaaaaaaattagctgggcgtggtggtgcgcacctgtaatcccagcactttgggagtgtatggcatgatcacaactcactgcagccttgacttcccaggctcaagctatcctctcacttcagcctccccagtagctgagactacagatgcgtgccaccacacctggctaattttttttttttttttttgagatggagtctctccctgttacccagtgagccgagattgtgcc

SEQ ID NO: 687481 - DNA, 137 bp, Homo sapiens
aattcccggttttttgctggccaagtctgccttgttacccgcgagtgcaatgacgatattggggctggcctgcctctgtagctcgttcacccagttcttggcccgtgcaaatgtatctgtgttggagatgtcataga

SEQ ID NO: 687482 - DNA, 103 bp, Homo sapiens
  misc_feature (50)..(50): n is a, c, g, or t
  misc_feature (61)..(62): n is a, c, g, or t
  misc_feature (71)..(71): n is a, c, g, or t
gaacaaatgaccttttatttcatacagagacgagcagaaggcaagctagngtgcagaaacnntccatgacngcaggccagtcacaaactcggtcgggaggaag

SEQ ID NO: 687483 - DNA, 370 bp, Homo sapiens
gtttgagtattttttttaagcaagattcttgcccagtcgccaggctgaagtccagtggtgcgttctgggctctctgcaacgtccgcttcgtgggtccaagcgattcttatgcgccagcttctcgagcatctgagaccacaggcatgtgccaccatgcccagtttaccctttttggtatttttagtagaaatggggtttcccacatgttagaagggtctcgatctcctgaccctcgtgatccgccggcctcggcctccaaagtgctggattcagtgtagcggcacgcgcggctcggaaagggcttttgagacacacacacacacacacacacacacacacacacacacacgcggtacagagagctctgggg

SEQ ID NO: 687484 - DNA, 237 bp, Homo sapiens
aagaggctgatcccgtcagagcaggacaggttacacccaaggctgccggccagtgtctaaccgtctctagatccgatcctggtatagcttctaccaaatagttatgtgtctgtgtgacagtgtgtgtgaaatggagttctgctgtgattgcccaggttgagtcttgaactcctgggctcaagcgactctcccaccttggcctcccatgcgtggatcgccagggagatcctctagagt

SEQ ID NO: 687485 - DNA, 789 bp, Homo sapiens
  misc_feature (41)..(41): n is a, c, g, or t
acacaaaaacacaaaagaaaatatcggctaggtacgagccnggttgagtgtcttgtgctttctcaccatagttcgtactacttgtaaatacatttttctattttctattttttgtattttttttttgtgacatttggtttcatgggtgtgctgtatatttccatgccctcactcctttaagaaaaaaaaaaaggaaaaaagcaacacaatcctgtccttgctgttgtgattatagtctgggttaacctggtggtgacaaccggggtgttgggggacacatggtcaaatggcccctactgagatggggccctaaatctccagtaactgggggaacagaaccagctggctggtgtcctggagagcctgggccctgtcgctgtggtctctgctgcaacgcccagatttctggggagtaactagtggttaggtctgctgacctttacctaagcagcccctgcctgggtaagaagggtgcccatggttcagaggcaaagagaagcctgcggttgggcatgaggatgcctgacaacaaaggctgggagaagggccctgagttccagcctctccccaagggtccccgccccagtgggctgcctctgtcttgacctggtggtaatgaattagtggtgctgtgtcactggtgggcttgaagtcacggggggatcgagctcacagggggcacccatcctgtttgtcaacagagtctgaagcagcagggtgtggatcctctgttgttgtcatcaattcctgctgaggggtcacaggggtacggttcataaatgactccta

SEQ ID NO: 687486 - DNA, 194 bp, Homo sapiens
cctctgaagtgggctcacagtcatagccttgaatacggaatctaggtcaccacaaaggcaaagacaatgctctttatgataccgttgtatacgcttcgttggcggtactgggccttgacttcattttgaccgccttgatgtttggagatttctgatgcaaaaccgcactgtggaaatcggtgtcggccttttct

SEQ ID NO: 687487 - DNA, 560 bp, Homo sapiens
cctccgcgagcaagaggccgctcccgagaccgaggccgaggggcacgggcactaggtccggacccgcgtacccctttcccggacgcctgcgtccccacaaagacctcgtgcttctagcaagactcccgcatggattattctcgctgtggtcacgaggccgttcctatagcgctctagttggcccagactgagaactctggcatctggctgctcggagctggaacctcagggaggtctgctgcaacaggtgcgaccctgaccgctccatgctcgcgggcgcggggaggcgtggcctcccccgggccggccacctctgttggctgctgtgcgctttcaccttaaaactctgcgaggcagaggctccggtgcgcgaggagaagctatcaggtgggtgattgcccgagaaccctgtacctctatggcttgtttctaatgtctttttagtatacccagaacacagaaaaataaggtgccacatggaatgagggcaagcactgtgttgggaagctagatgggcagagcctttgagagaaatgttttttgaatggtcttcggctggc

SEQ ID NO: 687488 - DNA, 174 bp, Homo sapiens
cctgtaaggcagcttacagattcgctatgatcaaccaggcaacagcaggttggaaaatctgcctccagtagcagccagcatagaacagcttttggaagaggcagtggagttgaaggaccagccaatttttactaagaaccagggttactcctcagtgacattttacggaatgct

SEQ ID NO: 687489 - DNA, 507 bp, Homo sapiens
gtctagaggatcacccagtcttggggggactttgaatcagcacccctctgcatcgtctccctggtagcagaaaggcaggacaggcgccgagtgtgtggggcggacttagttacgctcctcgcccagggacctggtggggctgaggggctcgctcggggtgcatgactgacctgcacgtcgccgtgtccacagagttgcgctagctgccgctggtggaggaggtgcaggacgctcggcgcggtcactctggtgcacggatgattgcgccgttcctatggcgtgccttctcgtcctcatcgtagcgctcgccgtcttcctccaacggcccgttccggggttcctcctcgtcctcactctggtgcgggctgcattgtcgttactgcgaccctgcgggtggcccgaggctggccgtgggtagcggtacccctgggccgcatccgcctcgttgggctcgtaggtgaagtgctctggaaaggccttggacagcgccatgtggcgcgcagacat

SEQ ID NO: 687490 - DNA, 378 bp, Homo sapiens
  misc_feature (36)..(36): n is a, c, g, or t
  misc_feature (93)..(93): n is a, c, g, or t
  misc_feature (115)..(115): n is a, c, g, or t
  misc_feature (119)..(119): n is a, c, g, or t
  misc_feature (131)..(132): n is a, c, g, or t
  misc_feature (348)..(348): n is a, c, g, or t
gagctcatactggagaccagccatgtaagtgtactncatgtgggaaagcattctcctttatacattaaagagtccacactggtgagaaacccnccaaatgtgctcaatgtgccgnagcnttcagcaggaanncagaactcattatacatccgataattcatactggggagaaaccgtatgaatgtacagaatgtgggaaaacattctctcgcaagtcacaactcatcatacatcagagaacccacactgggagagaaaccctataaatgtaccaaatgtggaaaatccttctgttcagcagtcacatgcttcattgggacatcagagaattcacacgggagaacaacnttatggtatgtttcttgaatgtggggaaag

SEQ ID NO: 687491 - DNA, 1465 bp, Homo sapiens
ggccgacctgatgagcgggacctcgctgctgtaacctgctgcttcaccgtacgcaggatcgtgccaggtggagcaggcacaagcaagatgacgccccgtgtgaacctggagcgagtcggtgttctggtgcaaccaacgcgtgcgttcaggtcaacggagtcccagactgatggcacagacgtgatccttcgtccgtccctgtgtggattatctcccaatcgaggcccgtgatcgatcgcatactcttctatccgtcgcagtacggactggtcttcgaggaggagccggacggagacctcatcgggggacctggacgtgtcatccgatcgcagacagagttgagcgtacattgtcctagagtggcctgtagcctggctggcgggcagaggctggatggtgcttacccggcgtgtcaggagtgctgcgtgggtcggacacaggatgcagaggaaagttccccgaggtagtggtcctaaactgactctcgggacgtcgtgaggctacgacgtgacgggcgctccgaagactggcctgtccgtcagtcgggaggggccaaggtgtgccttggcgggctagactcaagacgtatacctgcgagacatgaaagtaagacgacagtgggggccaaagccattaaagagaggatgggacataccttgggggacagaaccccagcaatggaggggcacatgaatgcaagggagacaggccaaagactcggtaagaggcagcaaaataaaggtcctgtagtggaacgtgttatgcggagtggcaatcagggggtgtacccgagagagagacttagaacaggggtcccacagtagcaacagacgtaccgtcgatggggaactttcgaaaccagaccaaagccaaagtgtgtccaataccacataggtcaggttgagcctctagctagggggcccaccctatctttggccgcccgccaataggaaagttgcaatcaccggttggggccttgggagcatgatggtaattgaatcgtcctatgttgggaggttaccacctgttgcgcaagcgcagacaacaagggaggccatcagccctggtgacacaattacacctgagtggctcacacacagtctttgagatggagtttggggacggacaatggcagcgaaaacgaaaaacaaaacgagatgaaggcaagctagcagatcaatcacctaggggaccgatggtacatcagcaagttggattcaacacgtactcatagacacaacggagtacctccccgaggccagaacacaagcggaggacaactacagagcgttacaacgaggataggagacacgaggtacatagtggcaggacaccagcaatggtacgcggacagcaaaggcgggaccctgcggcacggtaacacggaaccagaagcacgaaccgacaagagccggggggcagacagtacattacccacagaaggagaggagacactaccaaagga

SEQ ID NO: 687492 - DNA, 1806 bp, Homo sapiens
  misc_feature (446)..(446): n is a, c, g, or t
  misc_feature (1730)..(1730): n is a, c, g, or t
ggcgggggcccaggcacagcatgagatagacaggtttaacgagtctccagacgaacaaactctggtactttataggcccaggaagtcggagagcttggggtcttgaggatatagatgaacggggagagagaaagcttgaaggagaatgtcctacacaagaggactcaagtctagccatgagaagctaacaggtcgtgatcagcttgtggtggcaagtggagctagagtgtgacagcctacaagaggctaccatcttctggcacaagagagaaagcgcatagaagcgatagggagacaccgcgacggacatagtccaggagcagagcgcatagggcatcccagaccctagcgcctatgagatcaagcatcacacgccgatgtaactcggtggcttggaaagatgggattgcgcgaaggggaattggtctaccgagctatggagacgngaaccccggtaggtggcctggtacctgcaattcaactcgagaatcgattccagcctaagcgatatcgcttgggggccggccataacgaggagcttttggagcgcctttcttcctaggtttggcacaaattctcattgccaacccagaagtatacattagcctcaagggaactaaaggtcactttggggagtcgttaagttgcgccgtaccgggccgtttaggaaagctcgcgaaacgattacgagaagacgagataaccacaaggcgaccacgatatactcgaaaaacaagaaggttccaggcgggcccctttatcggaaactgtgggccctattccgaggcgagaggaacgtgtccttggggggccgcgttggtttcaggccgggctctggtccagtggtgaaggggccctcttggccatgtggaaacaatttgggattaggcctataccctcgttcgagagtttggccgcttggaaacaagatcgtccttccattaccggttcaattttgaacactgttaaacccttgtgtttggccccattgagcacttccctagtcaggcccttttgccttgtcaacccctggtggggccacggcgaaagtcttgggcaacggcatagggggtactacaacctgggggcaatgtggaggccagaggcaaagggggctagaagtcaggcccgaggggcagctcagttcagcccaggcaggttgggggggggcaagaggtggcccacaaggtcacccaagatccccagggacccctggaaacgtgaaccctttgggtgaacatcgcactgggggaagtggcccttggtgtcagaccacagacgggagcagtagccggccagagtgttcacacggggggggcccagaagcgggaggggacccccaagagggaaggccgccaacagggaaaggccccgcaaggaaccctgagaggacacaggaaccagggtgtgccagagcccgccgcgggggggtgtgggggcgcctaccacgacgaaaacggacgggtggtccaagcggaggcccagcgggccatctccacacgggagcggggggaggggggaccgaaaggggcgccccccgagtggagagctatgcaggacccccacgaggacgcggcaaaggggtacccattcacctccacgggttgcagacaagcaggagacccgggtctacgaaaacacaggcggcctcgagggctggctcggaaacgagacacctgggtagtatcgaatgagggagaccggaaggagacgaagacccagtggaagcngtcggagtcaaagagacgggacgacgaagacagacagagagacgagcgagggcacgacacgaagcatcctcagcga

SEQ ID NO: 687493 - DNA, 106 bp, Homo sapiens
  misc_feature (99)..(99): n is a, c, g, or t
  misc_feature (105)..(105): n is a, c, g, or t
cctgacaccaatttcgcccacatgtatgcgggaagaggcctgagactagaagtcgttgccctgtccatctcccggccacaggcttcattcccagatttntcttgnt

SEQ ID NO: 687494 - DNA, 384 bp, Homo sapiens
tatgtatgtatatatatacatacatacacacacagtggaaaattataatcctgggagtgtgacgacatggatgaacctggagcacataatgttaagtgaaataggccaggcacagaaagataaatactacaggatcttacttatatgtgcaatataaaaaagttgaactcatagtagagaatagaatggtgattaccacgggctagacggggagagggaaagttggggaaatgttagtcaaagcatataaaatttcagacaggaagaataagttcaagagatctgttgtacaacatggtgactatagttaataacgatgtactatatacttgaaaattgctaagagtaggttttaagtgttcttactacataaaaaaatgaagt

SEQ ID NO: 687495 - DNA, 1808 bp, Homo sapiens
  misc_feature (1223)..(1223): n is a, c, g, or t
tacaaaaaaaaatagtgggattttattcccccttttataaaatccccaaaagataagtgtgtgccttgggtggcccctttctgtgaatttattagcttacattttcatttatgtgcccccttcttgtgctctcccttctccattttggcgctacgtgcggtgtcattctctgtgtgtgtcctcgcggcgtggtgcccctctaccaggaggttctccatatagtggggtgtgtgacacgaggggtttatatcttatatatattgtgtgtggtctcatgtgaaatattgtgagagagtttcacaactcactactcttgtggcatataaaaaatatgtggtcccacaccgtggaaatgtggggggttcacaactctttgtgtggccccctcagaaggatatcttgctttatgacaccaaaactccctcttattgtgtggagagggtgggtctccttgtgggctattaagagatatgtgtgagaagagaggcttttcacaccggggtatctgtgtgtggctcctctgtgctattaaaaactgctgtgtttatttcaagaccccagagtataaggagagctcctcacattatcctctatggggtagaaatatatcccgcgggtctatcacaaagtatctgtgggagaatcccccgaaagaaggaattttttgttgtgcgaaagaaatcttttctgagaaaaagctgttcttcacaccaaatctctcttttaaaacacagtggtcgcaaaagagtatatattccctatatataatacacatacgagggacgtatcgaaggaatcgttctccctgcgggttgtttctcccacaacatctataacctactacagaatctttttaaaacaagaaaactattatttctgggcgaacccggcggtgattcactgaagagtagtagtcacaaacaccacggcccttgtgtttaaatatgccccccaagcggacacttgatatgtaggggggggggcgaccacaagaaaagaagcagaggagggtagggaagaaccacaccacccaggagagatggtcctcgtagagggaagatacatatgttgggagaaacgcccaaacatcgccggcggtcgtaagaaacacgagcggaggtgtgaacaaaaaccccgcacgacgaccacatcaatctgctatataggagaaacagcaacaacaacacacagaggggcgcggggcagcgaacccactccaagangaacgatctatcccccccgctgaggagagggaggggccccgacaagaaagaaagaacagcgagtatcaaccgcacacagaggtgcatcgtctggtatcaacaagacagaggggtgtcaccccaaccaaaagtgagaggcaacggaatcaaaataaaagagcgaaaacaacagacagggcgcacgcactgccgatttaacacaccaagcgtccgaatcggcggggcgaaaaacacactgagcccacctgagacaacaatgtggggaggaagacaccacaaacacctggagggagggagacaaagaagtggggacaacccaaccacaaaagaaagatatcgacgcacggaggaagacaaaaaaaccacagagagaagacgtagatactaaagaaccaacacacgatgagatgaacaacaagcaaacgagaaagattgtgaaaactcacacgcagaccggaagcaaagagccactagaggcgggcgaggaggacggtgagtaagcagcgcacgtcagaccgacgactgaagcgtcactacgaccgagactagacagacacggaacgaagatagcgacaactacagaat

SEQ ID NO: 687496 - DNA, 150 bp, Homo sapiens
gtcacgattgtgtatgggcactgtacggcgctttactcgtaagtgtatgtgcatcatgaccctcatgactcactactggttacatgtcatatgatcacctggaatctggcccgagagagacggagtgctatggatcctccctttcggggg

SEQ ID NO: 687497 - DNA, 225 bp, Homo sapiens
gaaatttcaacaccacatgttctcactcacgcagaagctaaaaaaaaaagttgatcttatagaagtaaaaagtagaacagaggatactgcaggctgaaaagggtagggagaaaggaggaatagtaagagatttgttaatggatacaaaattacagctaggtaggagtaataagttctagtgttctatagtaccgtagatgactatagttaacaatactatattat

SEQ ID NO: 687498 - DNA, 411 bp, Homo sapiens
ttctataataatcattgcttatactggcttacagtgatttactggattaacaaaagctttttaatcagaactgggattggatctaataagaagactagaggcatgaccatttaggtaatctaaaaaatggatagaattttaaaaaattaatttcagggggcctttaaggtataaagggaaggaggctaaccaaattttaaaatcttggcacaaaaaaggataccggattttgcataatggtttattattaacctctctatgatcttttcgcttatcatttcagataagaccagttcccattcctggagaggtagatgaccatgaagatgttgaggatgtggaacttcagagtctgggttcgcgatatcaactgttggactcacttccccttgggttaccagtgcgtcttgt

SEQ ID NO: 687499 - DNA, 348 bp, Homo sapiens
tatgaggatccccgcacagctcgggtattttggttgggactgtaggctgctcataaatccttactgtcgtcactggtaagcaccctgacccgtttgattctatacccaatcaagaatagacccttcacacaggaaatgtgaacaattgttatatatgaacactcaaatcttttactgtaacgaaaccaagaaacttgtttagaatgtgataggcagctaaaactgttatgcccactgtgctcaatttgaagcagaattcagtgaaaaattatttttccacattgaaacactttgcagacacaaatatctatgaaaagatgctttgtcagccaccgtgcttatctcaat

SEQ ID NO: 687500 - DNA, 200 bp, Homo sapiens
gagacacttacggaatgggagcaattttgtatctacccctccacaagatctatatccagaacttacagaaacttaaacaatttaccagaaaaaaacatccccttaaaagtcagcaaaggatatgaacagacacttctcaaaagaagacatttatgttgggcccagaaaatattgaaaaaactccaacatcactgatccat

SEQ ID NO: 687501 - DNA, 250 bp, Homo sapiens
catacatatgagactgagcggatcaaagttttactacaagtctttatgatctttcaattaaatacactccaagacatcgagtttggcagatattgcgcccgccgttttgctcttcttatctttgtatccagccaagcctgaaaagtctctagacatttgcttgaaatttgatgagagcttgcacaggccgactgaaggatgccggacatgattctctgctttctggttcaacaaaaaaaaaaagttccag

SEQ ID NO: 687502 - DNA, 109 bp, Homo sapiens
caactgtcattttatttttacgttgttacattttgtgagttgtgtgattgaggtggagtaaattacagcctatgtagaagtagagagttataggaacggtagatggggc

SEQ ID NO: 687503 - DNA, 133 bp, Homo sapiens
gacgtagccacctgtaactcccagctcaccagtccaaacagggtgcagggtgtctggccctgaagaacctgagtggagtggaatgtgcactggttgtgccactcatgctcgagcgtggcgcacgtgcccctta

SEQ ID NO: 687504 - DNA, 106 bp, Homo sapiens
cgcgtggccgcctggtctagcatagggcagccgaccaatgggactttgagacaccaaggcagtatcatgagcaggaagaaacacctgacatgatggcagcccgcat

SEQ ID NO: 687505 - DNA, 212 bp, Homo sapiens
attcgcggccgcgtcgacggggcctcaccttgttacagctttcaatggcagcatagaaggcctgtattttcatatgacacatggccatgttgaggtgagaggcctgtcgaagggcctgtgctttctgtgctttcttattggaaaaactagactcatattccagccaagacacgcatcttattatactgtagtaaagcttgcttgtatttacc

SEQ ID NO: 687506 - DNA, 354 bp, Homo sapiens
  misc_feature (77)..(77): n is a, c, g, or t
atcaggtcacagggggtgcgtgacgcggcgatcattgccttgctgtacggcacaggcatgcgcccgccggagtcggncgacatcgacctcgaccaggtcgactttcaagcgcgcagcttgcaggtggtgggcaaggacaaccaccagttggtcaagtacgcaccgccgtgggcgttcgagaagatgcaagcctgtcttgacctgcgccgccaggacctgtctgccggggcggaagatgacccgtttctgttcaactcgatccggcgtgggaggcacattacccgagcgcgaattaccaagcgtgcgatttactatattttcccgcagcgctgtgcgctggttggggtttatatt

SEQ ID NO: 687507 - DNA, 441 bp, Homo sapiens
agtcagtccccccggcccccctcccagtccctgttggctttcggtagctttcgcatgcagttttattaacacccgtttagaaacgatgctttagtggcctaacccagggtcaaatacagctctttttagcaaaatcaggcagctttgccccctcggtaggggccccgattagttttctaacagccaaaggtccatttagcagggtgccgggaggagtttagcccccggaggtgggctcctggtgacgggtgtccaaaaaacggtttccttgggagcttttgcccccgtgggcctttcagccccccccgtgtggccgcccgggggtgggtcaaccatgtcccccccccaggtccttcattccccccccccccccccccagtggaattgtttaagtgtggggagtttgtgctcgggacaataaagcttgtggcgggtcccgga

SEQ ID NO: 687508 - DNA, 314 bp, Homo sapiens
atccagctgttgggcttttgagaacccaaaccaactgagggcagaagggatcccccacgcagacagctgctctaccaaaatgtggccagactgcctctccaagtggatccccaatccattcctcctcgcttgggcggcacctcccagccggggcctctagctacccactctggatatctcaggctgacagagatttgacatctccctgggaatggcgtgccctgatggaggcgtgggccgccatatttgaggtatgggcaacttagccatcccagcctttgggctttaaggagtcccagcaagcaagtggcagg

SEQ ID NO: 687509 - DNA, 258 bp, Homo sapiens
gttaaaccgtgctatactctgtgtttcctgacgtttgttccagtctcttctgtctctgggaagctcactggcatgatgctgtttggtttcagagcttcatgtgggttctctttttttttatctctctctgtctctcttttcatttcaacggcgatcatcctttcccggaggaagtatcttcagtgtcttagggaggtcacagcctgtcgtgcaatcaataattaaagtacaacagaaggtagtgcagttctcgctgtg

SEQ ID NO: 687510 - DNA, 209 bp, Homo sapiens
tcccttttacccagtaatgaggggcagggaagggaattgggaggcacccgtttagtcctccctgccctgcccactgcttggatggggggatgccacccctcatccttcacccagttttggcctttgggtccccccacccagccccccgtgtcagaacaatttttgttttgtacaatgggcctttttacaataaaccctcctgctcccca

SEQ ID NO: 687511 - DNA, 131 bp, Homo sapiens
cgacgcgaactctaatgaggttgcacacaggtgttatgatcatctgaagaattctccaggactggaggaaatgcttccacatggcttacttgcatacctgctggcaagagtcagttctctggctggtggat

SEQ ID NO: 687512 - DNA, 244 bp, Homo sapiens
tttttgggacaatgcctctgtcccaattctgagtaacagttgtggttcttgccactaccagagttctgtagcaaagatgagcatgtgatcagggtgaaaaattctgattggcttcttgatgcctgactttatgggatcaaattcaagttgcacgatgacattcagtgcccttgtggtatcatatgtcgcaagacgcagggcctgcttcaccacagccacaataaagtcctttcaagccctgcta

SEQ ID NO: 687513 - DNA, 370 bp, Homo sapiens
gaaggcatgtgaagacaggcggaaatggagtgatgtgttccttgaaaatggaaccaagcaacatcaaggagagaggcctggaagagattctccctcacagcccccagaaggaactggctctgtggacaccttttcagacttctggcctcctgagctacagagaatcgattcctgttcttttaagccctcccatttgtggtagtttgtcacagcggccacaggaagcgaatgccctgagctctgcagtgcaactctggcatctgactgggcctctgagccgggatggggtgaaaagttttagctacaggatgattttgatgcaaagatttagacacaaatgccaggcaacccagaagaggagagtgctgcg

SEQ ID NO: 687514 - DNA, 1213 bp, Homo sapiens
cggcgcgcgaaccagttgcggcgcagggctcgctcctgaggcttccagtgatccaccgatcttcgcgtgactggaggcgtcgtcacaaagatggcgctcgttgactaggcttccagagtgtccatgtgccctacgatctgctgcgcctctgaggcgggagtccgggcgacacatacggtcgtgcagctgcggggtcatgggcgttgcgtggcctgcctgtgtggaggtctgtgctgttgttcgcgtatcctcttcgctgcctgcagtcgtgtgtatcggctcctgactcatggattctggattacaccgtcttggtgctaagcacaatctgagggggagggatcaactccagatgtcctcatggctcatcacaggagcccttcctgtctttgttgcagttacatctcagatccagtacctatgtgctcgtacaaccccatctgtcaatgcggagggagcacggacgtttgttggcatattaagggcagttatccctttgaaaagaccgaatgaagttagcaacgcccttactatagggctaggtgggtcaaggtctgagtatgtgattcgggaccggacggccaagtgggaacaccaagaggaatggtttccccattgtaggcgttgatcccccgaaaagccgccaatgcaaggaagagataacgcacttgcggggggttggtcccttttcttggtgcgttgaagaacaattgttaccgggttagccggaatagttgctcgcattgcggcgatcgtgtgccagttgccttgcaggaaactatgacaggcacaagaatggcatagcactccaagggggccctggttgggggtttgataaaccgaaacttctcttgttgggccaagactttgacgacttccacttattgcctagaagtaccaggatgacttgggggttcctcaaggcaacctcccagtaaacaggtaagttcgcctaggttggaaaaggcgctaggcttcggataattaccttacgaaattgagaggaaccacagctttgtgacggttgcacttggggcgggaagcccagaggaaagcccccgttgttaacgttggtgtgggcaattcaagtagccattgtgacggcatgggttggacccccgttgaaccacgttggaacaggcttggtttaagccattaaggacagggcttggattccgattagaataagatctcccgtttagaaacccaattt

SEQ ID NO: 687515 - DNA, 529 bp, Homo sapiens
taagggaggtgaatgtgattggtaagcagggtgccagcatgctgtatagagacagaaacaatttcttaggacttgcacccatatccatccaaaaaaaaaaaaggcgtgattagcccatccccattttatgggttctgaagcatttattgaccataggtttagtttatattttccacgggcgcctagtttgaccagcgctaaaagctcgatccatggagtatgtagctacaactgtaacaaacctgacatatgtccttgacctttcatacaatcgtgaccacaatccagtggctggattcaccactctccttgggtttatacaacgctgaaggacaggagactgaatagtactacgaacgtggctcccaacttttctggaatttccaactgccctattgttgtacccaccccaaacaccaaggggggaaaaacaaacccacacagaacgggggaggagaaaaaatatcctttttacacgccaccaaaaaaaaaataacacaaaacaaaacaaaacagcaactccttctta

SEQ ID NO: 687516 - DNA, 174 bp, Homo sapiens
ggtcaagcctctatgccatcgcgtctctctagagcatcttctacatgaagtgacatacttaactgatagttaaaaggaagtttccagaaaagaagttaacatgctaactcttgaagtcacaccacggcgacaactctgtagtgaatcgagcactattgacacatgcacagagga

SEQ ID NO: 687517 - DNA, 139 bp, Homo sapiens
agacgctccacccaaggatgatgagatggaaacagatagcaggagaagaaagaagtccctaagtgtggatttctcccttggaatgagaaagtcctgtccctgctggccctggttaagcagggtacaggactttctcatt

SEQ ID NO: 687518 - DNA, 1299 bp, Homo sapiens
gcagggccagtaggcagccatggctgcccagccggaatggactatggtcttgaataccccgacgttccgacaaggacatgtggcagacggcggacgtggccacgttgtgttcaagccaagtccgggcacctgtaagatccgcaagacggtaaggcccgggaatgccaaggtctgcgccgcatcgcctccgtggaccccgacgttcgggtcaccgatccagggccacatcggtatgctgctagtccacaacggttacgggtgaccgacaacagtaagggtagcggctgaccaggactgctgtgtttctagcacttggtacggagctctagtggtgggccagggcaattcagacaaggcacagtgtcgtgcgccggtgatcgcaagttcgagagctagcttgtcaatggtggaattcgcagactgggaatgtggctgtgaaaactagatcgtacccactgtgactggtcgctctttgctaatagaacccataactgttggctagggcggagccatgataccgcggagagtaaccgtgcttcccagagacattcattcctttcggtatactccctcatgtgcatatggccccttacggtacgccctccatacgaaacgtgggaggaccacgtttgcttgcctttggagagaaaatcttggaaaagctatgggcacaaccccaatgtgcttggaccctgggaccctgtgtccatttgccgctggtcccgggaacacgggtgctaactaaccagaacaggggacacgaaaagggcctccggaaggtccagtacaacttgagcgcgacacggaggaaatggacactttttccacaaaatgccctttcggctaaggtccttcccggtagatttgggcccctgttggcccgagaacgcccctgggcatcctttctgggcattaactgggggcgaagaaaagaggcccacatgtgaaatgcccccctgagacagaccaccactgcagatttgtttgttcgacaacaccctgagcagcacaacacttaaagacggcgccctttcccttaggggtgctgaacctgttgggtggacgattccaaacacactgaccaaaccacactctaacagagacacctcctgcgagggagagagatcacaaaatgagacgccgcgagagtggccgagaagaacacacaagtgctgatcaggagcaactttgggcgccacagttggcgccaaatcaacgcatagtgtctcctccggcagaccccaggacgttattctttttggtgtcacaccagctgtgtggcagcacatctagccgcgg

SEQ ID NO: 687519 - DNA, 662 bp, Homo sapiens
  misc_feature (15)..(15): n is a, c, g, or t
  misc_feature (65)..(65): n is a, c, g, or t
  misc_feature (68)..(70): n is a, c, g, or t
  misc_feature (73)..(73): n is a, c, g, or t
  misc_feature (109)..(110): n is a, c, g, or t
  misc_feature (112)..(112): n is a, c, g, or t
  misc_feature (114)..(115): n is a, c, g, or t
  misc_feature (140)..(140): n is a, c, g, or t
  misc_feature (143)..(143): n is a, c, g, or t
  misc_feature (147)..(147): n is a, c, g, or t
  misc_feature (162)..(164): n is a, c, g, or t
  misc_feature (169)..(169): n is a, c, g, or t
  misc_feature (173)..(174): n is a, c, g, or t
  misc_feature (178)..(178): n is a, c, g, or t
  misc_feature (180)..(180): n is a, c, g, or t
  misc_feature (182)..(182): n is a, c, g, or t
  misc_feature (186)..(186): n is a, c, g, or t
  misc_feature (190)..(190): n is a, c, g, or t
  misc_feature (192)..(192): n is a, c, g, or t
  misc_feature (198)..(198): n is a, c, g, or t
  misc_feature (200)..(201): n is a, c, g, or t
  misc_feature (239)..(239): n is a, c, g, or t
  misc_feature (267)..(267): n is a, c, g, or t
  misc_feature (518)..(518): n is a, c, g, or t
  misc_feature (537)..(537): n is a, c, g, or t
  misc_feature (546)..(546): n is a, c, g, or t
  misc_feature (655)..(655): n is a, c, g, or t
atcaccacaagaagntttaattaggaaatcaaaactttaaactttccctaaacatgaacatcaantgnnnatngcggaatatacaagtcacccgtcatccttcaaactnncngnnaaactactctctcttatttcatttnggntttnctagggagtattttnnnaggcncttnnaaangngnggcngggngnttgggngnncagaaatgcaattacttacatacaatatgatgagaagngtttcatgatatacaaattgacataggncaagttattaacatagtacaagtttttactgtgtagaaaaaataaacttacagtgaataaataaacagctttctatatcaagttatgtatggggtataaaaagtagttactatatatatatacatatacatatatatataaatgtgcatgttctagagtataaatatactatatacttaaatatttcacgtggcagaacattatttcatctggtttcagttttgtacattaaaatacatctggcagttggngtctcccctgatctctggngacccaggnatcctcttcccattccaagggtagacgctccagcagaatcccgcctctccatccatggatgtcccacactgtctgctgtgataaaatccattcttgttgcagtttgganggaaaaa

SEQ ID NO: 687520 - DNA, 982 bp, Homo sapiens
  misc_feature (54)..(54): n is a, c, g, or t
  misc_feature (247)..(247): n is a, c, g, or t
  misc_feature (352)..(352): n is a, c, g, or t
  misc_feature (384)..(384): n is a, c, g, or t
  misc_feature (386)..(386): n is a, c, g, or t
  misc_feature (404)..(404): n is a, c, g, or t
  misc_feature (419)..(419): n is a, c, g, or t
  misc_feature (429)..(429): n is a, c, g, or t
  misc_feature (436)..(436): n is a, c, g, or t
gggggacgtgcttggcagcgggacgcaccatttcagttgtgttcttggttcatntcgtgtctcggcgatgtttcctagagtctcgacgttcctacctcttcgccccctttcccgccaccctttgtcctctggaagcccggagacatcagcggctgcgattatgctactcactgttcggcacggaacagtcaggtaccgcagttcagcgctgttggcccggacaaaaaataacatccaaagatatttnggcactaacagtggtgatctgtagcaaggaaagataagcagtctgttcgaactgaggagacttccaaggagacttcagagagccaagacagtgacaagggaaacntacgacacaaaagacttgtacaggcattattnangggcatgacacgttgaanttaagcacagtacantgtacgaacnaataaangccccccaaaagaagaccacttaacacagttgggaagcttacactttggcaggcttcgaagagctacagaatatgctccaaagaagagaattggagccctgagtcctgagcttggtggcagctgcatctgctgtgggcagattctctccctttggataggcaacacagccaaggtcagagctgctgagccagctccagcagcactgacggacgacgtcacgcggcacagagagactgcatcatcgatctcaccttagtttcacgtacacctacttctcccatctcgccagttgcccgatctgcttaacgtcacgagtccgtcacgaccagaagcctgtccggaatcctcagcttggccgtacaggtactgacgacacgtgattcttggctccgtggagacacacctgagtgccttttacccacgggacacaatactttctccgggcaccaacgcacttaatactctgtggaatggatggctggtcactacatagaaagcctggaaaactaggatacaatcaccctgtccttgtggcctgtcgcatc

SEQ ID NO: 687521 - DNA, 295 bp, Homo sapiens
atgtaggcataaatttacctccttgatattctgcgtagaaaattttaaatgatcgactttagcattccatatcatggtatcttaattattaagcccaaattggcatgtaattcctgcttaaagattaactctttaattatcaatgtcatgtgagaggcagaagagaaaatgaagcttattggtgtatacagaagtcccatgtgggcaagtgtttgcttttctaacattttctttttaaaaaattatttttattgggatattgacaagttataattgtatgtatttatggggatac

SEQ ID NO: 687522 - DNA, 853 bp, Homo sapiens
  misc_feature (502)..(502): n is a, c, g, or t
gttgtccttcgagcgtcccggctgtaccaaatggagcctgaagagttcggcgcagattactggggtctccacagctgagcgcaggttggtcatgatcattagggttcctgctcggcatggcggcgacgctgatcctggagcctgcgggccgctgctgctgggacgaaccggtgctaatcgccgtgcgcggcctagccccggagcagccggatcacgcatgccgccgcggtccctggccgcgaactacgcaatgggcgcgcattttccagtgcccacgcgtcgctacctgggccgactactcttggcggagctggtaccctggtatcgcgcgccctgcgcttgggcggcagcttcgtcggggcttgtagcccatggggcgtgctctgggtccgtttagggaggccccggaagtaaaatccgttttgagtcgacgcgtcctgggatttggaaaggccgccggaacggtattccgcatatctggcttcacctattgggacccccntttggcgaaggtcataggggaagtgcttgcccttgggggtaatttgggccacaaacggaatacccacccaggaagacccccctggtggaggcggtggccctgcgctttggttggctcgcgagggaaccggtccgttggcaatcggggaatgtcaggcctattatccttgtttccagttcccgccggtcctcgggcgaggggtattcgccttggggccagggcctgggaaagaccccagggggggtttggccgcgggtcttggtctttggcggagcgcccccgggtcgggtttgccaggaggggggcgaaccgggccgtctgtttccccttggcccctgttgcccagggaac

SEQ ID NO: 687523 - DNA, 706 bp, Homo sapiens
ggaaggtctccatagaaggttcccccagcaaagtagggaggggtactccccgagaggagtcgaggtgccggagcctgctgcctcgccgacgctgggaggagccccgtgtcccgcacgcgcttgccaagggtggctgcgcgtgcggcgggagtagaggcgcctgcgcacaggaagtgactgttccccgccgcagcaaaccaggccatccgctggccttttagattgccgactcaggtggatttcagtgtgttctctggatggcaggccttaagagaagagtcccactgcacagtctcagatacttcatctccatggctggctgatgttgtgacacgcactcttggggaggggttgaggccctaatggaaaggaaaccaggtcgtccaaggggtgggaaacaatttgttggcgaggttcagagaggaaaatttttacacaagactagaagtcttagcatccaaagtgctcaagtggagtcagtgtgacaagcggcatgtagcccaaatctgagaggctctcttgtacttcatccatcctattatacacctctcctgtcatcaatggttaccgaaataagtccaccttctctgtgaaccgaggtccagatggcaatccacagactgtggggttctacctgggaacttggagagatgggacccgtgtctgtgtgcagtctaatcatctgaaaaacattcctgagaaacaa

SEQ ID NO: 687524 - DNA, 152 bp, Homo sapiens
ctgtcacggaaggctgagggatggggcggtgggacccaggccatcaggagcgtggtgcaccgagttctcaaagaccttgtctgcctggccttcctgtctggcctccaggtggcaccagatctccacccagtgcgtgatcacccctctcccca

SEQ ID NO: 687525 - DNA, 430 bp, Homo sapiens
cccacggctcctccttatgactccattcaaatctacggttatgaaggcaggggctcagtggccgggtccctgagctccctagagtcggccaccacagattcagacttggactatgattatctacagaactggggacctcgttttaagaaactagcagatttgtatggttccaaagacacttttgatgacgattcttaacaataacgatacaaattgggccttaagaactgtgtcgggcgttctcagaaatctggaggatgttaaaacgggtatttttttaatccagggaagggctcatttaaacaggccaagttttaccaggggggtacctttaaataaaactgcgaggccttcaaagggttaataactgggaattccctttcttaccaaaaggccaattatgaagttggttatcaacctccctaggaaa

SEQ ID NO: 687526 - DNA, 114 bp, Homo sapiens
gttcaagtgattctcctgtctctactgaaagtacaaaagttggctgggcttggtggtgtgtgcttttagtcccagctacccaggaggatgaggcaggagaatcgctggaatccg

SEQ ID NO: 687527 - DNA, 524 bp, Homo sapiens
  misc_feature (68)..(68): n is a, c, g, or t
  misc_feature (72)..(72): n is a, c, g, or t
  misc_feature (129)..(129): n is a, c, g, or t
  misc_feature (205)..(205): n is a, c, g, or t
  misc_feature (219)..(219): n is a, c, g, or t
  misc_feature (247)..(247): n is a, c, g, or t
  misc_feature (274)..(274): n is a, c, g, or t
  misc_feature (499)..(499): n is a, c, g, or t
  misc_feature (504)..(504): n is a, c, g, or t
gcagccggttttcgaggcgggcgccgagcggatccgcggcggaggttgagggacccccctcccccggncacngcctccgctgagtctgccccctccccatccgcagggctcttccgtgggcggcggctntcgagggcttggagttcgcagacggccgcaggagtcggagccgcagggaccatcggacctgggggccccaccggancgtggacgaggggncggcggacaggggccccggactccgtcnggcagcacatccccgatcccagcgcangagagccaccccaggaaaagccccggcatggacgaggtcatggctgccgactgccccttacaagcctgtccacacagcaccgtctccattcatgggggccccgagttgcagccttcagacccagagcctggcctggagccctggaatggaggccctggtgcaggccccaggcagatacagcagcagcacgcaacagtgagagactggggatgggacactggccanatgancagtccatctccggacagcg

SEQ ID NO: 687528 - DNA, 664 bp, Homo sapiens
tagtacgggtataccaagggttgtatcgaggctagtaaaagcacagttgtaagagagattccttcttctttggtccagtttcccttatgggagtccttaaaagccctctggtcatcggaggcaggatcatgtggtgcgattcttggcagtcagcagtctgtggagcttttgcaggtggatttgccgctgcagtcaccacccctctagacgtggcaaagacaagaattatgctggcaaaggctggctccagcacatgctgatgggaatcgtagctctctgtcctgcatggggtctaggcggtcaacaggggctggcaggattattcgcaggtgtcttccctcagaatggcagccatcagtctgggaggtttcgatctttcgtgggggcttagtgaccgaatcgcacagcttgctgattggaagttggcagaaagtagtccttgaagcatgagactaagcacatcaccgtccactatctgtacaagagtaggggcactgacagtgacaaacccttttccgctgagcagctgtctgaacatataggccccagtgactgaagaccatgttgtgctcaagatagccggcatggagattgtgccatgccgtggtaataggctggctggtatgaagtcattggcctgtatgccagagagctaagagaatat

SEQ ID NO: 687529 - DNA, 117 bp, Homo sapiens
caaatacagtgcaagtcggtagagatagcgcagaaacatagcttataggcatagaggccaagcaatcaaatagtccacaaactcattcttcacacaaacatttaaaacactatgcag

SEQ ID NO: 687530 - DNA, 535 bp, Homo sapiens
ctagggtggtactggaggtaacgtgtgtcatacagctgctgcaggcagaaggggcttacttggtcaccgagtatctgtcattgtcatcactatatcatgaaagcacagttctcagttaggtacacaatgacctacattcagccaaaaagggcagtgctagtgtaaacagtatgaaacatgaaaccaacggtgcatagctgacctcagtgacaacatagcgaatgagtgaaatgtcagctgtccagcttctccgagacacgtttcggatgtaactgaccacaggaagtacataacctcgactcagcaggtgaaccatcctgtccagcagtgtcttcttcaactcaagctgctccatcacgtccagctgggagtgctcagtctcaaaaagcttaacaagcagctgcaggacctgggggtgcaggagctggtggcaggtgctgatctcatccagcaacgccaggtgggccaggcgtatggtcagtctgcagctgaaagtaccttggttctgatacagtccaatccacccacttcagca

SEQ ID NO: 687531 - DNA, 142 bp, Homo sapiens
aggcatggacaggtcgtagaaggcctagcccgggggacatataaactcccgcgatctggcggtagtagcgcagagggttggagctgttgattcggggtgcctcccagccactcactgtcccgtccacacctgtctgcgctcc

SEQ ID NO: 687532 - DNA, 457 bp, Homo sapiens
  misc_feature (2)..(2): n is a, c, g, or t
  misc_feature (4)..(4): n is a, c, g, or t
  misc_feature (272)..(272): n is a, c, g, or t
  misc_feature (299)..(299): n is a, c, g, or t
  misc_feature (302)..(302): n is a, c, g, or t
  misc_feature (311)..(311): n is a, c, g, or t
  misc_feature (320)..(320): n is a, c, g, or t
  misc_feature (344)..(344): n is a, c, g, or t
  misc_feature (358)..(358): n is a, c, g, or t
  misc_feature (364)..(364): n is a, c, g, or t
  misc_feature (367)..(367): n is a, c, g, or t
  misc_feature (402)..(402): n is a, c, g, or t
tncnggaaatcctccaaggactcttgtcagctgtgttggaggccaaagccagcttagtgggacttccgcgtctctccctagtcttatcccctttggatgatggaagaaacttcatgaaccagccctttctcagagccagtgatgtgagtgtatcagaatgccagggagggcaccagccctgatccacagacctcggaaagatgcccctgttcctttgttgcgggtggtttgggtaaggcagagccctctgctgagaatgtagtattgttttncccctctccctcctgctttcttttggnggntccttgggntaaaaaganatggaagtggttcacagttttctnatactgtgaatgtngggaanatntccgtggcctacacctctccaggtacccttttccnacaacagaaggaggggctcagctaagtgctccccctagctcccatctcaggagac

SEQ ID NO: 687533 - DNA, 172 bp, Homo sapiens
agtctcgaagcttttatccaaataggaatgggagggcaagacagtgactgcggataggtaggcgtggggacgtggcttgggagttaggaaccccaacctggtttcatgaccgctctctacacctcgtctagacctctgtatccctctatctgtcttatgcatcctcttccat

SEQ ID NO: 687534 - DNA, 129 bp, Homo sapiens
ccctttttttttggggggggggggggggggggcccccccccccttttttccctccccccccggggttttcctaaaaaaaggggggtttgggtttttggggggggcccccctttttttttccccccccca

SEQ ID NO: 687535 - DNA, 347 bp, Homo sapiens
gctacttggtgccaaaaatcatgttgtttgggatggaaatgcctgcctcttgtctgtgtgtgttggacttatatgtctaaatggatgagcctggcatgaacaccagtgggcctgggtcatttggacaatctcctccccccccccaatcccctgcaactttgctgttcccccattacccttggcagggggtggtggggggcagggaccccctgaggcaatgaaaaatgtagaataaaaatgagtgcccccccctaacctagtttgagtttttatgtgtaaagatcataaaacgttgtaagttttttaaaacccataagctctcaataaacgttagcttatcattgtca

SEQ ID NO: 687536 - DNA, 190 bp, Homo sapiens
tcgcagtactagggaggctgaggaggagaatcacttgaactcaggaggcggaggttgcactagagccgagatcgtgcgcactgcgatcccacaggccaaagatccctgtgcagctccgatattatatcgcatcctatgtgagacaaggtgagagccgaggggtaccgatgctcggatattcgtatatcag

SEQ ID NO: 687537 - DNA, 157 bp, Homo sapiens
acatctacagatccccgggatgtcacagaattcttccctccactccatccctccctcccgtccttcccctcttcttctttccttccatcaaaagattattctaattcatagctaaaattcagtgtgctttgtctagatgctgtgactaggtatgcca

SEQ ID NO: 687538 - DNA, 130 bp, Homo sapiens
  misc_feature (94)..(94): n is a, c, g, or t
atgtgcacgttaggttcacttgtgtgtctacgtggtctcacgtgtgggtgtgtgtgtgtatgtaccctgcaggtggaatagtgtcctttccagngcgggtgcccgcctggtactgagctgccagaatagg

SEQ ID NO: 687539 - DNA, 432 bp, Homo sapiens
tcgccggtccgcacggggcttcgcgttgctgggactactggtgtgcgcatcacacccggctaatttttatatttctggtagagacagagttccaccatgttggccaggctggtctctaactcctggactcaagtgatccacccgcctcagcctcccaaaagtgctggaattacaggtgtgagccactgcgcccagccctgttcctgtctttatgtagatccacagttccgacctatgtgattttcgtctctgaagaacttctttaaacatctttacccaagtcagacctacgtggcaactctaaagccccaagcgataatgaacagcgatcagtcttattccttctaggaatcactagtatatagctcacacctcatatcctccctactatgcaaagaaggactcataccatcgctgtacataatagcaaca

SEQ ID NO: 687540 - DNA, 395 bp, Homo sapiens
cgcgtcgacccagtcagttcacctttggcaaaaccccctggttcgttatagttgtcacctgaccagattccacgtgcccgttgcggacagcccacagtgtgaaggtcgccgacccgcgtcccagtgtttctagtttctagtcgcaacttcccggtggcccccttcactaatgccgaaaccacttctaaaggcggattcatacttacgccatgctgacagcggtcgaggtgacagcgccaagcgaagatcaaaagctaaaatagggtgagttaattatttttctcaaacttttgaagaatctgtcgcaacacgtttaaacaggtggggcattggaaacccaatcctgatctgaacgtatacgtctgtacatagacgtcgagatcaaacgtcgacgc

SEQ ID NO: 687541 - DNA, 94 bp, Homo sapiens
catttttttattaaggtgacttttacagttttttttttctttaaatgagacacctgcactccagcctgtgggcgacaagagtgaaactgtctca

SEQ ID NO: 687542 - DNA, 1270 bp, Homo sapiens
ggaacaccaagtaggcccgtatggctgcagcagacgtgtggagcggtgagagtgggaggagggaagggcaaggagagtacggggccagtcatgcagggcctctgtgggctgcagtgaggatttgagcttcgacccccatgggaggtgggatgccatgtgcagggctgcgtggagagcaggacgggacatggacctgactcattggtgcccctctgtgtgggcagctttgcgggcaagacagagcgggtgtgcgacggctggcaacttgagtgaccagtgtcctgggtaactaactttgactggcgggcctggcccaagtgcaacggcgtacactacgacgcgcgggggcaacacgctgcgactcggactacgcgcgggacacgaatcttcctgcgcgctccacccacaagcagaaaacctattggcctgacggacttgcgcatgtttgacaggatgcggcttgacacacgcgcccccttttaccttcttgggccgtggcccacgggtgcgcagctgccttgctggggcttacaaccaggctggccaagcccgctccttgggaaccttcccgttggcggtgcccccctggggctttccctcgcatctcccccatgccttttgggccccacttctccttggggcgcttggctggcggaccccctctggtgcccccccaagttcccccgtctggcccaccgaactcacctggtgcgcccccggggaccgcgtttctccccccaccaagccatcacctgacgcaaacctggaggtccagcaccaagaactgcccacccgtggtatggacccctaccgcccacaggccctgcagagacactccaacgcatcgacgacggcaaaccagacgcgccccgggcgccaaaccccacctgagcgcagacacggagggcacacccccctctcgcttaaaaaccatcgttcaatacggcaccacgctcacgtcccaccactcattcctcgcaaacacgaacgcacccagagatccctctcccgacgcgcctccactagcaacaaaccccatccgtccaagcagctccaccacaattatccacgccactataccaccagcaccattcccctctgcacccaattcaacacccaataccaaacccatgccactcacccccaattaacaaccctccaaaaacaccctgatcccacccaccacgttctgacacgacactactcaagaccccacactccactcaaaaccacccaaaagcaccactcactacactcaaccaccaccccc

SEQ ID NO: 687543 - DNA, 328 bp, Homo sapiens
tccttcatcatactaccccctctctaccaaaaatacaaaaaattagctggcgatggtggcatgaacacgtggtcctagctactagggaccgacctgagtctgggaggtcgagtctgcagtgggctgagattgtgccactcatgccaagcctgggtgacagagaccctgtctcagaaaaaagatgcatacgtacatatattgatgacatggctttctaaaattttctttaaattattaccactttaagctgtgagatggaagtttcttactatttgatggataagtcttagtatcactttcttgtaataggtaggtattatgcaggacg

SEQ ID NO: 687544 - DNA, 634 bp, Homo sapiens
  misc_feature (179)..(179): n is a, c, g, or t
cttttgccagctctataccgatcccccacaggaaagttacaccagctatcacagtcctggtcgccaccactgtaatctgatgatcgatatccagaaagacactgcggtggaaggtgaggagattgaagtcaactgcactgctatggcgcagccacagccagactcacagactatcaggntggttcgaacagggaatcacagagctaaaaggcaaatcggaggtggcaagagtggtcagacatgtacactgtgaccagtcagctgatgctgaaggtgcacaaggaggacgatggggtcccagtgatctgccaggtggagcactcctgcgggtcactggaaacctgcagacccagcgggtatctagagagtacaggtataagcctcaagtgcacatgtcagactgacttatcctcgtagcaaggcttaagcccgggaaggggacgcgctatgagttaacgatgtgaagccagtcgggaagccccagcctgtgatggtagacttgcggtgagaagtcgatgattgaaattgcctcaacacgccgtactggtctgggcccaagctgctcatcaactaacctaaacgaaaccagatcatggtacataccgtctgttgaagcttcaacacatagtgggga

SEQ ID NO: 687545 - DNA, 84 bp, Homo sapiens
ctagaagattcagcaaagtacttttgtgctcttggggaaagggactgggggatgcggagctcctgggacacccgacagatgttt

SEQ ID NO: 687546 - DNA, 139 bp, Homo sapiens
cgttcaaataaaatccacacactatcaaactatgatcaagatgagccagtggataaaattaccataaatataccgtactctctctgaagacagctacaagacatcttaggttttgcaaaagtatacatatgtttgctca

SEQ ID NO: 687547 - DNA, 206 bp, Homo sapiens
tcgctctacgaggatcccctccataatgtgtgcaccaatcatataataatgctcactttattttttttttggaaacaggtctcacttggtcacttaggcgggagtacaggggcatgatcaaggttcagggcagcctcaacctcccaggctcccatctcagccccccaagtagctggaattacgggtgtgcacaccacttggcccaa

SEQ ID NO: 687548 - DNA, 134 bp, Homo sapiens
cacaatcatagcatttattacacgatttacatctgatcctcacgcaattttcttcctcaccaataaagaactaataggacagcatattagaagcaacatacattcttttattcttgcatcgctataaagaagta

SEQ ID NO: 687549 - DNA, 437 bp, Homo sapiens
gctcggtttcctccactagtgcaggcgtcagcctcgaagcagtagaagaaactcaccggattaaaagccaggccccaactgcgggcctgggtcagcaggcagatagcgccctggggcgtatgccccagggccttgccgacttcctggcgcacggcatcgctcaggctcatgccgtggcgtgtgaattcacgcaggtaatcctgctggcggaaaccgaagggcgccaggcgccccgtgccggccagcggcgagagccccagtacttcatcctcttcactgaggtccaggtacaacaggccgatgcggtagcgaaaggcgtgggccttgggcgtaaaccggcgatgggcgatccagccgctgtagagggcgctgttcacagggtttccccaaacgcctgggccacgcgcagagcgctgaccacgccgtcttcgtgaaag

SEQ ID NO: 687550 - DNA, 446 bp, Homo sapiens
  misc_feature (347)..(347): n is a, c, g, or t
  misc_feature (356)..(356): n is a, c, g, or t
  misc_feature (401)..(401): n is a, c, g, or t
  misc_feature (442)..(442): n is a, c, g, or t
agaccacttggctccctggctttacccttttccaggggagtgaatggttctgtctcactggcattccaagtgcaactggattatgaaaaaaaactactcagtgtctgcccaaatggctgcccagttttgtgttggaaacccaggaccctggtggtgtaggcactggagggaatctcctgatctgcgggttgtgaagacagtgggaaaagctcagtatctgggccagagtgcatggtacagtccctaatgacttcccttggctaggagagggagttccctgacgccttgcacttcctggggtgaggtaacaccctaaccctgttttggcttcaccctccttgggctgncatccactnttccaaccagtcccagttgagatgaaccagggttaccttcagttnggaaatggcagaatttacccacctttttggcattgattttnaatg

SEQ ID NO: 687551 - DNA, 174 bp, Homo sapiens
tatgctatacaccgtccccagtcagaaatcacggacttcatgtccttctctggggattccataaatttggataactgctcttcctctagcagtgccaggtcgtctgctggggtctgcatccgtaccaggagtcaaacaatttaaagtaaacaaggctaaatgtggtggtatcag

SEQ ID NO: 687552 - DNA, 416 bp, Homo sapiens
  misc_feature (26)..(26): n is a, c, g, or t
ctcataaaattaggaataatcattanagtaaaaaagaatgtgctttaagaactaagcctaagcctcagaccttgtctaagcttaatgtaaattaagatttcctgggctgtttcagtcacctgcaggccagagtagactaagatttatgtaactaaccaattaatgcagatgttccgactttcacattaggcagtcacattaaagtaaacccttttgatccaatctttccttcactaaatctcaaaaggcccctaaagtgatctctacccacatatccatttcactattaatacaatttgcatttaacctacatttatgcaaggtatatttcagaataagtctttcataaaatgtataaacattaaataagtagcaaaagtggtcagactaaaatacatgtaacacaaatagacaaa

SEQ ID NO: 687553 - DNA, 860 bp, Homo sapiens
tggcggtgctggtggtggctgctgctggagaccctggtccagacgcctgtgctgtgcctgcctgtgcacacaatggcgctttctagctccctcccccgaagcgcacatgccctgcctccttcctgctggctgcctgcaagtgtgcagtgcttgctctgccctacctgtgactgctgctcctgtgatgactgctcattgctgtgtgtccttgtgacacctgtgtgtcctgctgtgctgtagtgtgtgactgacatgactgtgatgggctgaactgccattctgttgtaggcctggtcctgctgatgccatctgtactggggctggcaagtcctcgtcccctgtgcttgtgccctccctttctcctgtggggcagttctgccagccctgcttcccgttgggcttgaggacggaacgcggggttcggtctgcctccctttgccccttgtgacccggtctgctacggaagctcagggtttgtgacggtttgctgtgcatgtctggccactagcttgacgttgtgaagaccagaaaattgttcagctacaatgttgttgccaatgagtgaagcactggaaaagttctccagggggcccgaggccatgctggtgctcgccaatattaaagcattctaattctatggtttccaacaagaatggttcctacacttaaacggcctggaacaagctgtgaccatacaaggtacaacacttgaaaattcattataacatggccaatgcaagacctgttctctattcaactttgaaacagtaccctatcttacccgattgtccctggaaagtaagtgaaacttaccccttttgtgcacaccgaggacaagatggctgagagtgccattcgag

SEQ ID NO: 687554 - DNA, 621 bp, Homo sapiens
ttctgcgagcgtgtcggtgccccctgcccggggcctcctgaagaggcggctgctcagacagcactactgattattctagcagatggacgatctgatgaaataccagtgcaacaagactcacagatttagtatgtgcttgtattcacgcaagtgaagaaacagtcgtcatacaatgctgcctagtcgtatagtgttggcattcgccattcgcagtctggaccgacgaagagcccgatggtaacttctgctgtgtaatggagacacggaatgtggccccttcaggagaggtatttgcgaagctcttcatcttgtgagctgacaggttctggatcctgtgaacaaccatgctgaaactgtggtaataagatctcctaatggacataagtgagctatccaaagatcagagtgacagttacccgaggatcagcacacgcagagtcctgccttccgtttggagtatggtccagttggatgatgttccatgtacacttgacaagaatgcatattctgcatgttgttgggtagaagtgacgcatagaattgtcgagttatcactgttgaagctcagaaggctgtaatagaagaccaggtgggcgtcgccataggaaaggtaatccagag

SEQ ID NO: 687555 - DNA, 134 bp, Homo sapiens
taaactgaattttttttaaaaatccctttcccccccaggtttgcctttgtttgctgaaatttccccttttttagttatatatatgtgtgtgtgtgtgtgtaatttctccccataaatttttaattccaaaggta

SEQ ID NO: 687556 - DNA, 212 bp, Homo sapiens
aaacgacccgaagactgcaggtcagggttaagatatagggagaaacagaatgcaaaactgtgttatgattacagttgtttagaaacatgtctgcttacaggcaggccctggaagggaagattaaaaacagttgatttgcttcagtgatgggattaggagtgattaaagcaacatttctgttatggttttacagtgtggtcttcgggtcgttt

SEQ ID NO: 687557 - DNA, 853 bp, Homo sapiens
aagactttgggaggccgaggcgcactgatcacccaaggtcagaagttcgagaacagcctggccaacattggcgaaaccccatctctactaaaaatacaaaccattagctggctgcggtggcctttctaccagcttttgtctcaaaaaaaaaaaaaaaaaaagggtactttgggttatcttttaacctttcctctttccccatataatttataacagtgtggcccatatacatattcggggttacctcgtggagcatacttcttcgtggccccatttcctccttcctctcttaatcttcgagtttcctctcctataggcgggtcagaagccattctgtggaaagtgaaaaacatttatagggccggggcaataggggggtccaatggcctggataattcccaggaccactttgggagaggcgctggaggcgcaggcgcggagactcagctgagaagggccaagggagtttcagagaacccaccctgggggccaaacatgtgggtgaaaacccccaattcctcttactataaaatattccaacaaaatttattccccagaaccatgtggggggccacatgtggccttctatacttccccagcattaacgtgggggaaagcgcctggaaggcccagggagaaaactcgtttggaaaacccttaagagaggggcaagcggttgttggccacgtggaggcccagataatttggagcgcacacttgggagaactcataagccgtgggggcagaccagactcttggacgaacttttgggctctttaaaaaaaacctttcaattttccactttacacctggaaaccttggcacctcataatatcacacacacacacagggg

SEQ ID NO: 687558 - DNA, 347 bp, Homo sapiens
cagtatgctagaggatctgtgtcaggcactgaagtctggtgcactggtagctaggctttgggaagtctaggcattgagcgggcaggctcatgggtagagcaggtgtgtccaggagtcttctcccctagaagtggggtctgaagggtggtacctgggcatagtaaggaaccaggacagtggctggggacagaatgtggtcacagtcatggtttcactctcagaaatattctgggcctatgggttaaggcgtcgtgactgagcaagggaagtgcccgtggtggttatttacaaagggtgggccatataaaaggcatttgaaatatggagtaggctatcagttgctgagc

SEQ ID NO: 687559 - DNA, 272 bp, Homo sapiens
tttgagacagagtctaccttgtcgcccaggctggagtgcagtggcgcgatctcggctcatttccatttcagtcttagtgtgtgtgtgtgtgtgtgtgtgtgtgtgtgtgtgtgtgtgtgtgtgtgtgtgtgtgtgtgtgtatttttttagagacagtctcgctttgttgcccaagctgttctctaactcctagactcaaggggtcccctgccccagcctcccaactagctgggaccacaggcagacaccactgtaccgattttatttatatt

SEQ ID NO: 687560 - DNA, 197 bp, Homo sapiens
gggtggaaactcgcggggtgtgagccaccggcaaccggcccctataatattgttaagaggtgtagccacgcacggtgggcagcgcgtgtctgtagtcccagctacttgggcagttgtggcaggaggattatttgagcccaggagttcgcggctgcagtgagctatgattgtgctattgcactccagtctgggcaaca

SEQ ID NO: 687561 - DNA, 255 bp, Homo sapiens
gttttcctgaggccttcccagccatgctgaacttaaagtaaattaaacctttttctttataaattactcagtctctggtggttctttatagcagtgttgaaaataggactaatgaagttcccattaatgaattttgcttttgttgcaattgcttttgacatcttagtcatgaaatccttgcctgttctaaggccaggatggtattgcctaggttgtcttccagggttttgctaattttgtgttttgcatttaggt

SEQ ID NO: 687562 - DNA, 207 bp, Homo sapiens
gggtggccggggagtgagtagacactcggaggtgtcttgagattatcatccgctgagggtggaaggggagtgagcagacactcaggaggtgtctggagattatcatccgctgagggtggaaggggagtgagcacacacgtcgggaggtgtcttgagattatcatccgattccaccctcagcggatgatactctcaagacaccttgtt

SEQ ID NO: 687563 - DNA, 107 bp, Homo sapiens
tcagcgtgatgggtatctttatttattaagctttattttctgtagaagcaaggtttgctatgctgtccaggctggtctcgaactcctggcctcaagtgatcttcctg

SEQ ID NO: 687564 - DNA, 415 bp, Homo sapiens
aagggaaaccaaaagggcaaggtgcccatttccttcttagaactgctccattaagtaggtgggctatgaaaaggttgcccatcatgaccttggatttatatacaattaactctaataaagcagggtaaggattttccatgttaatgtgtttagagactgaaaaaaccagccatcaaaaactggcctttttgcccataaaggtgcatgggaaaaatttccttacagaatttatggtaaagccttcaagccaaaaaagttttcctacaaaaatctccttttaatgagggttccctaataagcaggttttacctttgagcccccacttaaaacagaactggtttttactggatttttcattaacagccagcctttttttttatggaaaataaatctattgtggattggaaaaaaaaaa

SEQ ID NO: 687565 - DNA, 1071 bp, Homo sapiens
  misc_feature (36)..(36): n is a, c, g, or t
  misc_feature (51)..(51): n is a, c, g, or t
  misc_feature (54)..(54): n is a, c, g, or t
  misc_feature (163)..(164): n is a, c, g, or t
  misc_feature (221)..(221): n is a, c, g, or t
cgcgtcactgcttcggatgcacgggtgtacgcaaancatcattgatacccnttnggatggctatgaaacagcccgctatgggacaggggtctttggccagaatgagtacctacgctatcaggaggccctgagtgagctggccactgcggttaaagcacgaatnngagctctcagcgacatcaccagtcagcagccaaagacctaactcagtcccctgaggnctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcgggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgccttaataaattttttaataaaatgaccttttttcaaat

SEQ ID NO: 687566 - DNA, 1117 bp, Homo sapiens
  misc_feature (36)..(36): n is a, c, g, or t
  misc_feature (51)..(51): n is a, c, g, or t
  misc_feature (54)..(54): n is a, c, g, or t
  misc_feature (163)..(164): n is a, c, g, or t
  misc_feature (221)..(221): n is a, c, g, or t
  misc_feature (768)..(768): n is a, c, g, or t
cgcgtcactgcttcggatgcacgggtgtacgcaaancatcattgatacccnttnggatggctatgaaacagcccgctatgggacaggggtctttggccagaatgagtacctacgctatcaggaggccctgagtgagctggccactgcggttaaagcacgaatnngagctctcagcgacatcaccagtcagcagccaaagacctaactcagtcccctgaggnctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcgggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcntcttagagttgattgatggaaaaagcaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgccttaataaattttttaataaaatgaccttttttcaaat

SEQ ID NO: 687567 - DNA, 441 bp, Homo sapiens
tgctgaggtgggcggatcatgagagtcaggagttcaaggccaagctggtgaacgttgtggaaccctgtctctactaaaaatacaaaagaattagccaggcgtggtggcgggcaacttttattccctgctactcaggaggctgagtcaggagaatcgcatgaacccgggaggcggaggttgcagtgagccaagattgcgccactgcattccagcccgggcgacagtgtgagactccatctcaaaaagaaaaagagaaataactcaattgttggtgtgtgtctaatgctggagtctgttttgtgccattgatctatttgtctgtctttatcccagtatcacactatcttgattactgtgggttaataaactataggtaagtcttgaaatcagggtaagatctcaaacttggttttgtcttttcaaaattgctttagctattct

SEQ ID NO: 687568 - DNA, 196 bp, Homo sapiens
taaacccaacaatttttttattaggaagtcacccctggggcccaaaggaaaaaaagggaccggggacaccccaacgaggctggggcgggggccccccccggatttcccaaccccgggggcggaatttcctccactccaaatgctggccaagggcccaaaactgccgtatcccctgccaaggggggggctaaaagct

SEQ ID NO: 687569 - DNA, 220 bp, Homo sapiens
ctggggctgtatgaatgcgggcgatacctgaggacgccatccctgtaggagagtggcgattgaggacgaagacgaggcgctgacaagcgcatctcgatctgctcctctgacaaacgaattgcctgtgaggaagagttctccgattctgaagaggagggagaggggggccgcaaggaactcttccaaccttcaataaaagccaaggagagtcaaagacaga

SEQ ID NO: 687570 - DNA, 759 bp, Homo sapiens
  misc_feature (482)..(482): n is a, c, g, or t
agcggggcagtccctgacagccgtggcgccgcgagtcttctcctctacctcactgaccgaggcagatgctagatcagttatggtcagaaccttgtgcttgctggcatgctaggttactcttctgctggtctcaccatgtgatgtgatccttgggtcctcgtgtcggagaatgcgctccgaagtccatggtaggactggaatcgactggtgggcatgccgagtacccgggggcatgtggtcatgtctccttgagaaggctaagcacagacttagcccatcttctagggtccgggtgagatggctctgagttgtgctaagctcttccatggactggatggggcttggcgtggctagctgcttccatggctcgtgctgcgctcgcgtgcgtgtcagcccacctatggctgagtgggcctggctgcgtacctggcctcccatggctcgcgctgtgccttggggtggtccccgggtacgcgcatggnccaccccgatgaggtccagcttgtgttgaaccatagccacgcacgtgaacatgctccaaaaaaaacttggaaaccattggagagcaacaatgtggctctccgggttggcattgcccacgcaaaagaccttaggcgggcgcgcaaggtagggctgagagccggaagggcacatttggggcccgagcgttcacagggtcggcttggcgggggaccaagggtgtcccggattcgaaaggccaacgttgccccttatttccattgacagattcttcccggg

SEQ ID NO: 687571 - DNA, 413 bp, Homo sapiens
tctacatgggccaccgccaggttgttactccaaagggatctaaggaaactctacgctgtgttctataggcatctaggctacaaacccaggaagtgttatccctggtgtcccacccgatttaagtatacagctctacgacatgggcagttatagttggacccgttccccaccagccttaccagggccccacaatttgtcatggctaagagaaggcgagcagatggaggagagagcagagacagaggagggacagagagagagagcatgggaggacagcagagagcagcaaagagggagtccaaagagaaaacaacagagaaagatagaaatagtacaaaacagtgtgccctattcctttaaaagccagggtcaatctaaaacctagtaattgataattgaaggtcttctccatg

SEQ ID NO: 687572 - DNA, 703 bp, Homo sapiens
ggatgccattagacactttctaaaaacagatatttagatgttttttcatatacaagaatcggatggaaatctaaaattaactcaaagcaattaaagtttctgtttaaacggagtgtcttgccatgccattcttttactgaatacacttttcaaattaattttttttttttttgggtcgggagctttggggaaaagcttgtaaatctcactaaggtgttgaaaaaaaattcccaaatgtccgtggctctctggaatttggttccccagaaagtagataaggaatggctgagagatgggagagacttaacacgtacccagttccagatagcggtggtgacctctaggaatggtcctccggtatcagacatctcttcaaacggttcaatttcatagatgtgaaattttccaaaaggtttcggaatcttcattagcctaatccctcagcaattggtccaatttttacctaactctgcaaaccaccttataacttcggatttcctttggtacttgaacccagagggcttcatgattggcacaacattaaaattccttagaggatcctttacagagtattcggcaccgatggtcgtggagtgtatctctattagactcatttttttatacgcacacaagtgtggtccgaaagccatatccatcgagcggaaataggctaaatgtgttatcacagagtttgtatcctaca

SEQ ID NO: 687573 - DNA, 618 bp, Homo sapiens
tgtctggattcccgtcgtaacttaaagggaaattttcacaatgtcctggagcccttgatgtcctgcaaatgaaggaggaggatgtccttaagttccttgcagcaggaaccacacgttacgggtgggctaccccaacgtcctatgcacattccacgatggaacacgtacactctataaacaggaaaagtgactggcactctatactcactaacatcctcacagacggaccctggcgcagcaacgccttcctaggctggggccagcgcctcgcttgcaacatttggttagcacaatctggacaaaagcccctgactagatgttacagatgctatatatacctagccacggcacattactaggaccaagacacgggggcatgttggccttgccaacacaggcatatattagggcattgggccataggaccccaaccactggtagaaaggaacacaaacattcccaaatttaggcttgtgcacgacatatacagctaccttgtgtaagcgctatcgacctgaaagcaccagaagtaccccagcggcaacggcccatttcccccgagggcaaggacccacacgcggcaccttataccattttgggatggggagtttaaacctt

SEQ ID NO: 687574 - DNA, 767 bp, Homo sapiens
gggaaggcatgacccactcaagtcacatgcactatcatatatgtaagaacccagacccatgacccctaacaggggacctcgtcagccctcctattgacctcgggcctatcgatgtgatttctacttccactccataacgctcctgcatactaggccttactaaccgagcatagctaacgcatataccaatgatgggcgcgatgtgaacacggagagaagcaaggatactcgaagggccaagccatcactatcacgctgtgccaagagagtggtccgttcgatacgggataatcctattgtattacctcataacacttttgttcttcgctggagttacctgagcctcttgaaccagcttctagggtgtaagtactcatatgactgcaactataggagaaggggagatgtgttactcaaacaaggacttaattacacgggtacatctcactggaagagttgctagctcgttaatgaatctagttcggtagtttagcgtcggtagtgcagagatgtagtaagctcggtatgaatggctaaagaaatggggtctgaatcaggaagaagcaagtgggaatatctaggattatattaaagtgggggtgtataaaaaataatagtgggtgtcttaatatttaatggttcttcaaaatgaagtcagacttacttgtcgagtcttgacatttgaagagaaaatcgaggaggtcatacgggtcttaacatttattggtaagtcggatggcttccacggaactacaaagtatttgtgg

SEQ ID NO: 687575 - DNA, 132 bp, Homo sapiens
cccccccccccccggggggggggttgtttttgtccccccccctgggcccccccccgggggggggggccccccccccccccccccagggggggggccggggggccaaaaaaatccctttttttttccccccca

SEQ ID NO: 687576 - DNA, 682 bp, Homo sapiens
gaggctaactctttcacgcccggttggattttttgggggaagccgccactttgctttaatgaggggtgggtaagcatgaaagggtacatgtccttcctccacccctccccaaaggggctacatcctttacgctttaccccgcctgcggatgcctctgctctgggctcaaaagtggggcccggcgccctggctgatcccagtgaacaggcagtttctccctgcacaggggcctcaccgggcgtggaagtgttccttgcaccatgattggtcctcagttccatccacgcacattcaagcttggagcccctctgtgtggagtctttcctggatctgtcgcaaccgatgctgttgtgccaccatttcccgcctttggcgcttcacgtggcctgttagggcccataggatgtggttttgcttgtcaacgtgagcctttaaggacctaaattctcggtagggagggcccagccaggcgctccttaaatggacttctaaccggtgaacgcttgcccgtaacaccctttgtgcctgggcccacctccccaacacctagattgtggctttggctgcactttcaaaaatccctctccatctaattttcaacaaagtttgcccaaaattctggggtgaatcccgggcccggtgacctcctggcccaggagttttatttgccgggcataagacc

SEQ ID NO: 687577 - DNA, 792 bp, Homo sapiens
cacattctttgaactgtagttgtcattttagtttatttttcaaaaacttttgcagtacctttttggtctgtcttgtgtgtgccttgcagtgaacagtctggatttggacagtggtctgtctgttagttcagtttctcaagcctttgtcacactaataggattggatttatgtatgtccagcttgggaattattacaggaattaaaaacaactttttagagtgctttcctgagctctctttctatttgttcccccttctactttttgcttccctgtggctgctgtttctatcctccagccagagagctagtgtttattttctccattgtgttacacacttgtgcagctgcaagcaccatatccagggctcaatggtaggaggtagagaagaaaagcaaaagggattggcctcatcctcttacaacgatagttccattgaatagagagaaaggttttcctgcctcagagtgttggctgcactaggcttttgttactgtagtctggccctgttaccatgggattgcttgcatgtggggatacaggagaattcagaaaagaaaaaaagattgctatttctacattctccctgagcattacgacttcccttgccattgctcaagttaaaagctaaggcttcttctggaagctggctctgtgggcgggatcggggagataaccacaggagaaaaagtaccactgttgatatggaggtatatcaaattctgggtctaaacctatttcacaatgcctgtaacttacaagaactgacagatggctgtccatgattcgtccg

SEQ ID NO: 687578 - DNA, 140 bp, Homo sapiens
cagtacggttgtggctttagactcaacaagccgtatcttcaccagtgttctatctggttcccctaaattaataaaatgtttttccccaggatttgggttgagggtgggctgtggctggtcgttttccacatccgtacggg

SEQ ID NO: 687579 - DNA, 777 bp, Homo sapiens
atgacccaccaatcacatgcctatcgatatagtaaaacccagcccatgacccctaagaggggccctctcagcccgtcctaatgacctccggctagccatgtgatttcattccatccataacgctcctcatactaggcctagctaaccaaagactaaccatataccaatgatggcgcgatgtaacacgatgaaagcacttaccaaggccatcaaacaccagctgtccaaaaaggccttcgatccgggagaatcctatttattacctcagaagttggttcttgcgcagggatgtttcggagccttttaccagctccagcgtaggcccttaggcccgccaatatggatgggcactgggccccatacaagggatcaccgcgttagatcccctagaagtcccattcgtaaacaccatcggtattacatcgcgatcaggagtatcacctcagttgagctcgccagagtctagtagaaaactaagcgaaggcaaataatccgaagcatgctaatagaatttcactggtcgtctataataccctcgtgaaatgacctgcagaagtagttctgaagtctccctttctaacatttccgaagggaatactacggctcaagattaggagtaagccagaggattacaacggaggttaaccgtaattatgggggcaaatttcctcaatatgaggtgtagcggcaaataatatacactttacttcaaaacttggtggggtttgaagcgcagctggaaggcttggggaagtggcgcactttgagtcaatatgg

SEQ ID NO: 687580 - DNA, 479 bp, Homo sapiens
agcggggcggagcccagccgcggggggacggtccgggctcccgctcccgagcgcgtcgcggcgcgtggcccagccgagcttgagacacccgcctgccggtcgcatcgcgatgtcggtgccgggtgagaacagttccacaaagccgagccagtcatatgtagtgaagacactaagtggtgctgaaggaactatgctagacgatgattttctgtgagatggaataggacaatgggatgttaccaataaagttgtgcgggaaattctttcaaaagggcactgaagtatcttcagccaaatccagagctaagctaggaatgctgaacattgtgtcgaagatcctgagggcaggtgaatgaccacaggatacccgcatgacaggaaggcttgctgggggactgtatgctgaaatacgggcaggggagctcggggaagactccacctttggcaatgcattgattagaagctggtgaatccatgaa

SEQ ID NO: 687581 - DNA, 943 bp, Homo sapiens
  misc_feature (44)..(44): n is a, c, g, or t
  misc_feature (135)..(135): n is a, c, g, or t
  misc_feature (170)..(170): n is a, c, g, or t
  misc_feature (180)..(180): n is a, c, g, or t
  misc_feature (197)..(197): n is a, c, g, or t
  misc_feature (202)..(203): n is a, c, g, or t
  misc_feature (211)..(211): n is a, c, g, or t
  misc_feature (283)..(283): n is a, c, g, or t
  misc_feature (905)..(905): n is a, c, g, or t
  misc_feature (911)..(912): n is a, c, g, or t
tcttcaagtgacctgtactgcttggggactattggagaaaaaangtggagtcctacttgtttaaaaaatatgtatctaagaatgttctagggcactctgggaacctataaaggcaggtatttcgggccctcctcntcaggaatcttcctgaagacatggcccagtcgaangcccaggatngcttttgctgcggcccngtggnntaggaggnacagagagacagggagagtcagcctccacattcagaggcatcacaagtaatggcacaattcttcggatgacngcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaactaagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttccnatgtanntataaatagtaaataaagtttttacccatta

SEQ ID NO: 687582 - DNA, 593 bp, Homo sapiens
  misc_feature (13)..(13): n is a, c, g, or t
  misc_feature (555)..(555): n is a, c, g, or t
  misc_feature (561)..(562): n is a, c, g, or t
atttctcatgcancaacaactaaaagaaaccacacatagcacacatatcaaaaaaaagaatagtaatatcagaacaggaaggaggaatggcttgctggggagcccatccaggacactgggagcacatagagattcacccatgtttgttgaactaagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttccnatgtanntataaatagtaaataaagtttttacccatta

SEQ ID NO: 687583 - DNA, 333 bp, Homo sapiens
ttatgggatcatcacctggcattatgaaggtgctcacttgagcagaggggctccagggccaggctgagtgaagcacctcaagattaagagccaccagcctgagaggctgctgctttggagacctcataaagcaccagtaataagtcaaagtgaacttttaactcaagatttgatgcactgagcttggatttgatctatgatgagactcgatctgcttttaaagactagttgacttaagcccgaaagaactgagacctgtcttatgagaattaatataggctttcacaatattgcctcatttccctctgaactattaactcttgagtttctggt

SEQ ID NO: 687584 - DNA, 380 bp, Homo sapiens
  misc_feature (62)..(62): n is a, c, g, or t
  misc_feature (80)..(80): n is a, c, g, or t
  misc_feature (182)..(182): n is a, c, g, or t
  misc_feature (185)..(185): n is a, c, g, or t
  misc_feature (233)..(233): n is a, c, g, or t
caaagaacgcacaaacagtcgcaacaaaacctctccgaagggcttcaaactcaaccccaacnaaaagctatatgaggacntcaagcaagcctcgcaaacctcgccaacccccccacaataaacatactgggagaactctctgtgcaagtaaccacgttatcctgatcaaagatcactctccnacnaacaggactcaacaactaagtcacaggcgtatactccctctacaaatngaccacaacacaatggggctcactcacccaccaccccccacacaaaaaaccctcattcacaaaaaaaaacaccctcatgttcatacacctatcccccattctcctcctatccctcaaccccgacatcattaccgggttttcctctta

SEQ ID NO: 687585 - DNA, 117 bp, Homo sapiens
ttaggtcgcgttcaccacccagtcttaaaatcccagattgtacagccacacgcaaagagaatgtgcatgcaggcgctggtccatacagccatgcaggtctctgtcactcagactgac

SEQ ID NO: 687586 - DNA, 465 bp, Homo sapiens
tttgcctaagtgagtggaaatgttttcctttcatttactggaaacaaaagtgatgccgcatcagcagataggctacgaaataaaacattaaaaaaaaaaagatgatgcctagttaatggaaacaaggcacacgacaggagactccattagggcatgaattttgcaataaaaaactgtattgggagccgggctcagtggctctcacctgtaaccccagcacttggggaggccgaggcgggtggatcacttgaggtcgggagttggagaccattctggccaacatggtgaaacagcatctctactaaaaatacaaaaattagccaggtatggtggtgcatgactgtaatcccagctactcaggaggctgaggctgaaaaatcacttgaacctgggaggcggaggttgcagtgagccgagatcgtgctactgcactccagcctgagcgacagagcaagactctgtctc

SEQ ID NO: 687587 - DNA, 106 bp, Homo sapiens
cactcggacctcctaaacatttgtccatgtacgcttcaaaacagcgttaactgagttatcaatgtagcagtacttaaatgatacaattcttgaagcagtttcaatg

SEQ ID NO: 687588 - DNA, 100 bp, Homo sapiens
cgctaggaggggatatactgcctgacagctggcagcatgacccaaaggaacaatgggcctgttacacactagcaccttttccagaaagactgcatgtgct

SEQ ID NO: 687589 - DNA, 236 bp, Homo sapiens
tccgattgtgacattcagttgtccttaaccactcacatctccacaacagttgccctcgcaggtcacaccaagcttgagctctaagtgaccgagtccccatccatcttatccagctgcccttcctctttctagtccatctctctacaatctcccctccccacctctcattcctccttgcactgcacttcatttctcattagaagcaggtgtcagggcgaagtgcaggcaaacaagca

SEQ ID NO: 687590 - DNA, 424 bp, Homo sapiens
agggaaaaaagagacaataacccctaaagggaagtgaaagatagatgggagaatttttcaagatgggagagatttaggtacatttattcctaattttattagagtcataaagctgtaactgatgcattgaagtcctggagaggatggcaagggatgatatccacagcacaggtggaagaaaagctaggggtggaaagataagagatttccagatatgagacaagaggttgagggaattcacattgggtgaccatgaatccttacctggaaggaagcccattggtgggcaggggagttggggacagtgggaaatgttcagagctgcagatatgaacagtgagtgagcttgatataccatacgatatttgctagatgacgctgaagttgaggataataaaattatactggcattctttggtatggc

SEQ ID NO: 687591 - DNA, 337 bp, Homo sapiens
  misc_feature (56)..(56): n is a, c, g, or t
  misc_feature (58)..(58): n is a, c, g, or t
  misc_feature (65)..(65): n is a, c, g, or t
  misc_feature (68)..(68): n is a, c, g, or t
  misc_feature (216)..(216): n is a, c, g, or t
aacgtataagttgtgttctctgtcaccgtcataaggtcgtttttcccagcgtagtntngcgccanatncaatcacgtcattccaactaatgcgttgcccgtagccgagttgggtgacgacatccgtgccataatgtttttgccaggaggcaccaacacctgcgctgaatatttgctcccagctattttcatagcttcgccataacaaatggcttgnctcaaatgccggaacaatatcgaacgtttttatagggttgtagtatggggtatcgtgttctgtattttgttcgtaatacagactgggtaggaaatcgacaatcaaatatggtgaagaccag

SEQ ID NO: 687592 - DNA, 130 bp, Homo sapiens
attattttgtaggttatcggtattagaagcttaggaaattatatgctatttttatagttttatgctattattattattaatcatccattcatgtgcattaagcagcattgattaatatttagattttcag

SEQ ID NO: 687593 - DNA, 1027 bp, Homo sapiens
  misc_feature (2)..(2): n is a, c, g, or t
  misc_feature (82)..(82): n is a, c, g, or t
  misc_feature (272)..(272): n is a, c, g, or t
  misc_feature (277)..(277): n is a, c, g, or t
  misc_feature (282)..(282): n is a, c, g, or t
  misc_feature (286)..(286): n is a, c, g, or t
  misc_feature (424)..(424): n is a, c, g, or t
  misc_feature (715)..(715): n is a, c, g, or t
  misc_feature (719)..(721): n is a, c, g, or t
  misc_feature (724)..(724): n is a, c, g, or t
  misc_feature (854)..(854): n is a, c, g, or t
  misc_feature (879)..(879): n is a, c, g, or t
  misc_feature (1015)..(1015): n is a, c, g, or t
tnctggaaaggtgaaattaaagacaaaatggacattcctctacataataaaggcagtttacaaaaagcccacagccaacatnaatttagatggagagaaactcaaaacaattctattaaagtcaggagcaagacaaggctatctattttctccacacctattcaatatagtccttgaagtcttagttgaagcaataagacaactgaagaaaattgaggggatacaaattggaaaaaaaaaagaagttaaagtagttttattttgcaaatganatganagtanacanaagtgaccctaaaatttctaccaagaaacttctacagctgataaacactttccaaaacaagtagctggttataatattaactgataaacagagaaagaagtcagggaaacaacacctttcacaactgcctcaagtaanacaaaatgtcttagagtaactctaaccaagcaagtgaaagacttgtatgataaagactttaagacattgaagaaagaaattgaggaagatgtcagaagacgaaaagctctcccatgctcatggatcagtaggattagcgtagtagaaattgccgttctaccaaaagcaatctacagattcaatgcaatccccaccaaaatccaacacaattctttacagatcttgaaagggcaattttcagcttcatatggaagtacaaaaaattcagcatagctaaaacaatcttaaatnatannnganctattggaggtatcatcattcccaggctcaagttgtactatagagttatagcaatacaaacagcatagtattggtacaaagacagacacactgatcaatggaatcaattgatgacccagacatatatganggcaatctaaatgaaatttccaaanaatggagagacagagtcccaacaaaatgaagcttgcagtactgggaatgggttacatctaaggagttgttagacaaaggggtccatgggcatccccacacaacccaggatgttaccgagacgatagattgctctcntaagttgacagt

SEQ ID NO: 687594 - DNA, 714 bp, Homo sapiens
  misc_feature (2)..(2): n is a, c, g, or t
  misc_feature (169)..(169): n is a, c, g, or t
  misc_feature (392)..(392): n is a, c, g, or t
  misc_feature (397)..(397): n is a, c, g, or t
  misc_feature (402)..(402): n is a, c, g, or t
  misc_feature (407)..(410): n is a, c, g, or t
  misc_feature (497)..(497): n is a, c, g, or t
  misc_feature (500)..(500): n is a, c, g, or t
  misc_feature (577)..(577): n is a, c, g, or t
  misc_feature (595)..(595): n is a, c, g, or t
  misc_feature (599)..(599): n is a, c, g, or t
  misc_feature (636)..(636): n is a, c, g, or t
  misc_feature (654)..(654): n is a, c, g, or t
  misc_feature (702)..(702): n is a, c, g, or t
gnagaggaaggctggcaccagccacccaatcccgagaccccacctccaggccaagtacatgcccctgggactggctcagtcccagcaccaccctgcaggctccaacaaggtggcgttttgtcccctttcactcaatccagcgtcatcctcaggcctctagcggcctcancctcaacgggcccgggacactgaacaggtagggatggcagagcccagctgcggcccaagctgggcagagcgggccctcaggcagggcaggtttccaagggagggcccgggaggacggcctggtgtggggtaggggctcagcgccagcgggcgctgggtgagggccggggaggggactccctggagatgaagggagccccaggggtacagcgagctcggctgcnaagcntgggnggggnnnncgcgagatgcacgaaacagatctgtgcgtgctggatcagctctacccccaccaaacagatggagagacagacaggcaggcagcattnctnaacccagggaggggaaaaccacagaacaaaacagcaagtcgggcttgggccgccggcttccagggcgcccaggacantgggcgggcgaatctctnggtntatgtgggaggggccgctgggccaggggcctcctgcnctgggactctcctctgtntctgtgctggcgcgcggacgccttgggaactagaggcgggcagcctcngcgaaccaaccc

SEQ ID NO: 687595 - DNA, 348 bp, Homo sapiens
gcgctcaatggaattctcgttccaggatgggagacagccccaccatcgtgaaagagtagccggcttcagtgcctgccttggggtgaggaagacacctctgccccagtggattagcaagtgtggcaggcttaacatgtccaggttctccccaataacatcgtccaggtcggttttaaaatccccaggcagggggagagtgacatggggagtgacttcttaatgggtaagaagctgcttactccgtgagatatcgtagatgctcgaggactgggtagaggtgcctgtactaaatgccattaaataaggataccccagactgctcgtcatgaacacttaggatcgaccgga

SEQ ID NO: 687596 - DNA, 424 bp, Homo sapiens
ctgtaggaattcggcacgaggccacctctactctacttttgtggagccctatgacagacacctattgtcaaactctgtggctgttggcacattagatgctataggtgtgtggtggaacaccactttcttctactatggaagggacaggagcccactgggtggtgctggagccatgcttcccacaggtggagagggctaccggtatgggccagagagtgaattatctcaagctttcgcaactacaccgaattctctgtatgaaatgggccggtatgaaccggagcagtatgtggaccgagcccgggactcaaccttttaaaaactggaagtgagagaagggtgggaatgggtaaaagaatccatttaattcccttggagccatgctctatgaggcttgagacacctgtgctctccggaccggttc

SEQ ID NO: 687597 - DNA, 290 bp, Homo sapiens
  misc_feature (108)..(108): n is a, c, g, or t
  misc_feature (280)..(280): n is a, c, g, or t
tcctggaagtgcggattgaagtagccccggcgccaacccacctggtctttctccgacttcgagatctgcccgtggtcgagatcgtggtagatgatgcggtctttcggnccgccgaggttgtcgtacaggaaatcgaccgccgtgctgtcgaccgttccatcgccggtgctgtacaccacgtagctcggcaccgtcacgctgtggtagagcgcggccaggcgctggctgtcggtggcatcgaacgccacgagcggcagccggtcatactccggattgctgngcgtaagctt

SEQ ID NO: 687598 - DNA, 111 bp, Homo sapiens
tacattttctgtgtgtgtgtcgttgttgtgtgtgtgttgttcgtgcttacttctctttccaggactctatactatactttacaggcagttcctcatccttgggagcaattc

SEQ ID NO: 687599 - DNA, 107 bp, Homo sapiens
tgctgcccacctacgtggttctggcgctcgtcgtcgtcgcgctgagaaagtggtctgcctcgtgcagcgcataaagggcccgcgcccgtccgcggcgcgagtccgca

SEQ ID NO: 687600 - DNA, 361 bp, Homo sapiens
gctcgtgggcaacggtgcactttcttcggtcgtccgaatccggttcatccgacaccagccgcctcaccatgccgcccaagttcgaccccaacgaggtcaaagtcgtgtacctgaggtgcaccggagcgaggtcggcgcacatccgccttggcccgaagatcggtactttggtctgtctacgaagaaagttggcgatgacattgccaaggctaccggtgactggaagggtctcagaattacagtgaaactgaccatccagaacagacaggcccagatcgaggtggtgccttctgaactcagccctgaatcatcaagccctcaaggagacaccgggagacaggagaagcagaagaaaataaaa

SEQ ID NO: 687601 - DNA, 105 bp, Homo sapiens
aaaaaattgattttgattttattttttttctggaaaactccaaagggggttttcccctttcaattcctgggatttaagccaaaaaaagttgcccctggtttttca

SEQ ID NO: 687602 - DNA, 535 bp, Homo sapiens
cgctggctgtcgtcccgcattcgccgatggagcggccgcccggttcccggggtgcgccctcctcgtgtcccgcgccctccttgggctcgctgggacgtctcctccctcccggctcgcggccccgtccgagagtcggcccactgcatctagagagcaatctagtcgctcaatgaattgttgagcaatgatgagctgtcagtgggtgaccagacagtgaacacgctactgaggaagcgctgaagagtcatccttgagacgccagtacagaaagtacgcgaatccgtgtgacagaatcgcagcagagatagcagtctactgcatgaggccataacgccatatgatccactcttacacgtcatccgatggggatggcagagccgatccgatatagtgagaaaccggatagagcctggacactcggcgaggaggagaaggctcacaaaggatgacacgcggtgaacctgaacactatgaccgtggcaccttcgaccaaaatagaaacaaagacaaatctaagaggaacacaagggaaatg

SEQ ID NO: 687603 - DNA, 866 bp, Homo sapiens
ggcagcagcatgagtaatagcagacagaccaacagtgagcaaggatacaacgaaaccccccacacagaaaaaaaaaaaaagaaaaacagaaatagaatcccaaattggcacacacagtccatgggcccatttaattcaagggcccaaaagcccaactctcttctgggggtctctaaggcttcactggttttcaacacaaggtccccccctacctcaggatttggaaatcttacaaaggagcaaaacctgggctcataaaaatagtaattaattaattggtcacctggtggtcaatcagtttcagaagatgcgtaaaataatatctctttattcaatcttttactaaaatagtctttaaaatgcttacactatgagtggcagagcttcagccttccacttatcttcttccaccaaaataccatgaattaacttctggtcctattaaccactatttcattctgattaaacactaaaggagattataataatatacaaacaagaaatatattctaagggactctgcaaggtccgggaagaaagaatggttctggacagatgtgatacctagctttcaatgtggtggtgaaaattctactgggtggagatctctctagagtccagacttagaggggcctgggcaagaacgttaaggggagggcagatttctaaccaattagggattccgtgggaaagaatttctttatggacaatggtgtgggcaaatggggagaggcctcctaagggagtctttaggcaattcaatgaattaccaactatgtgtttctacaagggagaagaaaaacccagggtgcgccaatgggagaaaagtcggttaaccttcaggagatggggggggggagtttacc

SEQ ID NO: 687604 - DNA, 210 bp, Homo sapiens
ttaaaaaaagagtttcgcaggagctttaagttaaaaaaaggcccaagggggaccaaactttcccctcttgaagaaatccccaaagttagttctctaaaagtgcaatattgtttaatcttaaaactgggcactttggaagaactttttacagaagcctcaatgatgatccctttgaattgcttgtgatttcaaaaataaagcagtgaagca

SEQ ID NO: 687605 - DNA, 176 bp, Homo sapiens
tcccccgctatcatcggccccccccggagattgtgcctgccacccttacgccgtagcctgtccagagtactggcagcgcctcgtgctctaataggtctggatcggtgagcgatcctgcgagtactcacacagaggggagagctgacagaggatacctacagagcggagtgttgtgc

SEQ ID NO: 687606 - DNA, 355 bp, Homo sapiens
  misc_feature (11)..(11): n is a, c, g, or t
cgctgtgcttngagctcttcaacgggattggcagtagccgtgccctgagcacaggcagaactgtgtgatcccggagtgtgaacctgaagttcaaaggactgggcaagctctgtactgtgttggtttttcccccccaaaatgggtcctaaggagggtaaagtgacttgtttcaaagatagttggagcacagtgggtctctcacggatctcggcctgaggctgtggaggagaaggtctggacagaccctcagggccgggtgtgttttcccaccagccgaagagagccaggatggacgttcctcggacggacggttcacctgcttgggaatgttcctgggctgtgagatccactcttc

SEQ ID NO: 687607 - DNA, 136 bp, Homo sapiens
  misc_feature (44)..(44): n is a, c, g, or t
  misc_feature (63)..(63): n is a, c, g, or t
  misc_feature (100)..(100): n is a, c, g, or t
  misc_feature (111)..(111): n is a, c, g, or t
gcttattcttctttgaagaaactgacccgatcagtgccagaagncattgtattcaaagaagantaagcaagaaagaaaagaaggaaggaagagaggtagncagatacaagntgaaatcctgtcaaaaaatggaagg

SEQ ID NO: 687608 - DNA, 106 bp, Homo sapiens
ctcataagtgcctcttctatatctactaactatcatagctgggagtgagaggagcgactttaactgagactgaggagatgagacagcttactccacgataaagatg

SEQ ID NO: 687609 - DNA, 411 bp, Homo sapiens
  misc_feature (49)..(49): n is a, c, g, or t
  misc_feature (93)..(93): n is a, c, g, or t
  misc_feature (131)..(131): n is a, c, g, or t
  misc_feature (144)..(144): n is a, c, g, or t
  misc_feature (162)..(162): n is a, c, g, or t
  misc_feature (185)..(185): n is a, c, g, or t
  misc_feature (206)..(206): n is a, c, g, or t
  misc_feature (224)..(224): n is a, c, g, or t
  misc_feature (240)..(240): n is a, c, g, or t
  misc_feature (373)..(373): n is a, c, g, or t
  misc_feature (396)..(396): n is a, c, g, or t
  misc_feature (409)..(409): n is a, c, g, or t
accaacaatattttgaaaatagtagctgatttttttgcaagttttaaanagccacataccctattacagagagtcaaagcctgcacaacagangaggttcaggagatgctgatgcaaattaccagtttgcnttcactgattgcnttcttgctgccaattaanactgtaggtttgcagggtgactntcgttcctacagttacgtgtntggaatctccagtaaagntgaacctgactgggantcacttatttttttggctaggcttatacctcgcatgtgtcacaacgttaacagagttgtttatatatttggcccaccagttaaaggaacctcctacagatgttactcccacttttcttgacaacaggggtgcncagtactttacgccaagctggantttgagggcccanaa

SEQ ID NO: 687610 - DNA, 795 bp, Homo sapiens
  misc_feature (35)..(35): n is a, c, g, or t
  misc_feature (65)..(65): n is a, c, g, or t
  misc_feature (91)..(91): n is a, c, g, or t
  misc_feature (110)..(110): n is a, c, g, or t
  misc_feature (118)..(118): n is a, c, g, or t
  misc_feature (136)..(136): n is a, c, g, or t
  misc_feature (159)..(159): n is a, c, g, or t
  misc_feature (171)..(171): n is a, c, g, or t
  misc_feature (177)..(177): n is a, c, g, or t
  misc_feature (179)..(179): n is a, c, g, or t
  misc_feature (192)..(192): n is a, c, g, or t
  misc_feature (213)..(213): n is a, c, g, or t
  misc_feature (216)..(216): n is a, c, g, or t
  misc_feature (220)..(220): n is a, c, g, or t
  misc_feature (356)..(356): n is a, c, g, or t
  misc_feature (638)..(638): n is a, c, g, or t
  misc_feature (664)..(664): n is a, c, g, or t
  misc_feature (710)..(710): n is a, c, g, or t
  misc_feature (777)..(777): n is a, c, g, or t
ggagggggagaggaaacaagagaagaggaggggcnagagggcaaggggccggggcgggggcagcnaggcgggggagggggaaggggaaggncacggggggacgggggggngggcgggngggaggggcgggcgggcngggggggcgagggccggccaggnggcgggcgcggngggggngnacgagggcgagangcacggggacggggggcaagnggncgangcggcagagcccagcgcggaacggggggaccgaggcgagccggccacggcgcagcgagagagccggccaccaagagggagcgggaacgggccgcagcggcagagcccaggaggagagaggccgcaggaacgagganggggagggcagaggcagcgcagagcggggagagagggggacaggggcccggggaagggggaccagagagggcgggagaagcgccggcaccgccacgacggcagggacagcagggcacgcaggcgggagcgcgggaacgggagcccgaaggacagaggggggagggggccggaaagagggcggcgggggagcgcgaagaggcggacagggacagcgggcacggcgggccccgcgacaggggccgggacgagaagccagaggaaaagcagcgccggccgcaggnacgagggccgcgggagagaggcacangccccgggcggacacgggcagcgccgcgcaggccaggggcgccggncacgaggggcgggacgggaggaggaggggcgcacagcccggccgggcccgcgcgcacacagacgganagggcgggaggggcgcgg

SEQ ID NO: 687611 - DNA, 117 bp, Homo sapiens
tgtagataaggtatccatgcagaaagaattgtaagaaagaggaatgggaagaagctagaacgattctgccaagccctatggagcacacctattctagcttcagccatgtgagatgaa

SEQ ID NO: 687612 - DNA, 257 bp, Homo sapiens
agcctcttcaactaagctaagaaaagtcctggggctatgtctcgttggccatgtgaagagtcccctggaaatggaagtctatgtgctctgctcctaagatcactataaggacagagattaggtttgcctcaccctggacctgcatatgagctactacatttgcataaaccatgacctaaattagtgaatttagcatattgtctggatggcaaccacctgggaggtttgtgagctcccttccctgcagcacaccgtca

SEQ ID NO: 687613 - DNA, 2737 bp, Homo sapiens
  misc_feature (41)..(43): n is a, c, g, or t
  misc_feature (46)..(46): n is a, c, g, or t
  misc_feature (54)..(55): n is a, c, g, or t
tgctggtactggccgggattttgggatcgcgccgagcgccnnnccngccccggnnccctccgccgccgccggcccggacatggccgccaacatgtacagggtcggagactacgtctactttgagaactcctccagcaacccatacctgatccggagaatcgaggagctcaacaagacggccaatgggaacgtggaggccaaagtggtgtgcttctaccggaggcgggacatctccagcaccctcatcgccctggccgacaagcacgcaaccctgtcagtctgctataaggccggaccgggggcggacaacggcgaggaaggggaaatagaagaggaaatggagaatccggaaatggtggacctgcccgagaaactaaagcaccagctgcggcatcgggagctgttcctctcccggcagctggagtctctgcccgccacgcacatcaggggcaagtgcagcgtcaccctgctcaacgagaccgagtcgctcaagtcctacctggagcgggaggatttcttcttctattctctagtctacgacccacagcagaagaccctgctggcagataaaggagagattcgagtaggaaaccggtaccaggcagacatcaccgacttgttaaaagaaggcgaggaggatggccgagaccagtccaggttggagacccaggtgtgggaggcgcacaacccactcacagacaagcagatcgaccagttcctggtggtggcccgctctgtgggcaccttcgcacgggccctggactgcagcagctccgtccgacagcccagcctgcacatgagcgccgcagctgcctcccgagacatcaccctgttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttctcccgtggaagtcgctgaccagcatcattgagtactactacatgtggaagaccaccgacagatacgtgcagcagaaacgcttgaaagcagctgaagctgagagcaagttaaagcaagtttatattcccaactataacaagccaaatccgaaccaaatcagcgtcaacaacgtcaaggccggtgtggtgaacggcacgggggcgccgggccagagccctggggctggccgggcctgcgagagctgttacaccacacagtcttaccagtggtattcttggggtccccctaacatgcagtgtcgtctctgcgcatcttgttggacatattggaagaaatatggtggcttgaaaatgccaacccggttagatggagagaggccaggaccaaaccgcagtaacatgagtccccacggcctcccagcccggagcagcgggagccccaagtttgccatgaagaccaggcaggctttctatctgcacacgacgaagctgacgcggatcgcccggcgcctgtgccgtgagatcctgcgcccgtggcacgctgcgcggcacccctacctgcccatcaacagcgcggccatcaaggccgagtgcacggcgcggctgcccgaagcctcccagagcccgctggtgctgaagcaggcggtacgcaagccgctggaagccgtgcttcggtatcttgagacccacccccgccccccccaagcctgaccccgtgaaaagcgtgtccagcgtgctcagcagcctgacgcccgccaaggtggcccccgtcatcaacaacggctcccccaccatcctgggcaagcgcagctacgagcagcacaacggggtggacggcaacatgaagaagcgcctcttgatgcccagtaggggtctggcaaaccacggacagaccaggcacatgggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaa

SEQ ID NO: 687614 - DNA, 209 bp, Homo sapiens
  misc_feature (25)..(25): n is a, c, g, or t
  misc_feature (36)..(36): n is a, c, g, or t
  misc_feature (44)..(44): n is a, c, g, or t
  misc_feature (63)..(64): n is a, c, g, or t
  misc_feature (110)..(111): n is a, c, g, or t
  misc_feature (116)..(116): n is a, c, g, or t
  misc_feature (127)..(127): n is a, c, g, or t
  misc_feature (134)..(134): n is a, c, g, or t
  misc_feature (164)..(166): n is a, c, g, or t
  misc_feature (168)..(168): n is a, c, g, or t
  misc_feature (194)..(194): n is a, c, g, or t
  misc_feature (199)..(199): n is a, c, g, or t
  misc_feature (202)..(202): n is a, c, g, or t
gcttccactgaatgagtctcttttnattctcttggnaatctctnccagttaactacttccgtnntaggtgatgaaatgggtaaggctccacacttcagatgttggcactnntatgngcatggtcttnccctttnttgcaactcaaaatcagaacctttgattcnnntnatattccagtcccagaggtagtctcnctgtngangttaatt

SEQ ID NO: 687615 - DNA, 3130 bp, Homo sapiens
  misc_feature (41)..(43): n is a, c, g, or t
  misc_feature (46)..(46): n is a, c, g, or t
  misc_feature (54)..(55): n is a, c, g, or t
tgctggtactggccgggattttgggatcgcgccgagcgccnnnccngccccggnnccctccgccgccgccggcccggacatggccgccaacatgtacagggtcggagactacgtctactttgagaactcctccagcaacccatacctgatccggagaatcgaggagctcaacaagacggccaatgggaacgtggaggccaaagtggtgtgcttctaccggaggcgggacatctccagcaccctcatcgccctggccgacaagcacgcaaccctgtcagtctgctataaggccggaccgggggcggacaacggcgaggaaggggaaatagaagaggaaatggagaatccggaaatggtggacctgcccgagaaactaaagcaccagctgcggcatcgggagctgttcctctcccggcagctggagtctctgcccgccacgcacatcaggggcaagtgcagcgtcaccctgctcaacgagaccgagtcgctcaagtcctacctggagcgggaggatttcttcttctattctctagtctacgacccacagcagaagaccctgctggcagataaaggagagattcgagtaggaaaccggtaccaggcagacatcaccgacttgttaaaagaaggcgaggaggatggccgagaccagtccaggttggagacccaggtgtgggaggcgcacaacccactcacagacaagcagatcgaccagttcctggtggtggcccgctctgtgggcaccttcgcacgggccctggactgcagcagctccgtccgacagcccagcctgcacatgagcgccgcagctgcctcccgagacatcaccctgttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttctcccgtggaagtcgctgaccagcatcattgagtactactacatgtggaagaccaccgacagatacgtgcagcagaaacgcttgaaagcagctgaagctgagagcaagttaaagcaagtttatattcccaactataacaagccaaatccgaaccaaatcagcgtcaacaacgtcaaggccggtgtggtgaacggcacgggggcgccgggccagagccctggggctggccgggcctgcgagagctgttacaccacacagtcttaccagtggtattcttggggtccccctaacatgcagtgtcgtctctgcgcatcttgttggacatattggaagaaatatggtggcttgaaaatgccaacccggttagatggagagaggccaggaccaaaccgcagtaacatgagtccccacggcctcccagcccggagcagcgggagccccaagtttgccatgaagaccaggcaggctttctatctgcacacgacgaagctgacgcggatcgcccggcgcctgtgccgtgagatcctgcgcccgtggcacgctgcgcggcacccctacctgcccatcaacagcgcggccatcaaggccgagtgcacggcgcggctgcccgaagcctcccagagcccgctggtgctgaagcaggcggtacgcaagccgctggaagccgtgcttcggtatcttgagacccacccccgccccccccaagcctgaccccgtgaaaagcgtgtccagcgtgctcagcagcctgacgcccgccaaggtggcccccgtcatcaacaacggctcccccaccatcctgggcaagcgcagctacgagcagcacaacggggtggacggcaacatgaagaagcgcctcttgatgcccagtaggggtctggcaaaccacggacagaccaggcacatgggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaaaccaaaaactgtgttggggcgccggggccccctggaaaggtttcgagaacaccattcgctgtgggcagcccggaggcccccaacaggcacacgtggaaacttggccacaaatgcggcgcgtcctccaaagggaaaaccccgggaccaatgagacataggcgcacgggaaattcttcacaccccatattaataaaaaaccgccccgcggggggtacaaccacgtcagacgtgttttttctaggaaaacaatttcccacaatattgtgcacaccaagaaaagggactaacaacggggagcggctctcatatcaacaacgcggagagtgcccaaaaagcgagaagcgccccggaattcaaaattatacgccccgtccttcctgcgtggtggtgccg

SEQ ID NO: 687616 - DNA, 148 bp, Homo sapiens
gaaggccaagagtactaccaagctaggagagtaggacagtagcccaccaagctagccagaaaggccaaagacagccaaggtaccagagtagagacagtagacgaaagcaaggtacatagaacatagagtcctaggtagtagacagagc

SEQ ID NO: 687617 - DNA, 2873 bp, Homo sapiens
cccctcaagccgcggtgtactccagcggcccctgtggcctctccatccgcggcggatctcagaggtgtggacaagcagcctactagggctagagatggacagcaggaaactgtccccccgggggaagaagctggagtcgcacctctcccaagagcacaggcggccccactgggcctgatagcagcctggggccagcccagtatccagagcagcgttcagcagggactgcagactcaggactggactacgtctactttgagaactcctccagcaacccatacctgatccggagaatcgaggagctcaacaagacggccaatgggaacgtggaggccaaagtggtgtgcttctaccggaggcgggacatctccagcaccctcatcgccctggccgacaagcacgcaaccctgtcagtctgctataaggccggaccgggggcggacaacggcgaggaaggggaaatagaagaggaaatggagaatccggaaatggtggacctgcccgagaaactaaagcaccagctgcggcatcgggagctgttcctctcccggcagctggagtctctgcccgccacgcacatcaggggcaagtgcagcgtcaccctgctcaacgagaccgagtcgctcaagtcctacctggagcgggaggatttcttcttctattctctagtctacgacccacagcagaagaccctgctggcagataaaggagagattcgagtaggaaaccggtaccaggcagacatcaccgacttgttaaaagaaggcgaggaggatggccgagaccagtccaggttggagacccaggtgtgggaggcgcacaacccactcacagacaagcagatcgaccagttcctggtggtggcccgctctgtgggcaccttcgcacgggccctggactgcagcagctccgtccgacagcccagcctgcacatgagcgccgcagctgcctcccgagacatcaccctgttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttctcccgtggaagtcgctgaccagcatcattgagtactactacatgtggaagaccaccgacagatacgtgcagcagaaacgcttgaaagcagctgaagctgagagcaagttaaagcaagtttatattcccaactataacaagccaaatccgaaccaaatcagcgtcaacaacgtcaaggccggtgtggtgaacggcacgggggcgccgggccagagccctggggctggccgggcctgcgagagctgttacaccacacagtcttaccagtggtattcttggggtccccctaacatgcagtgtcgtctctgcgcatcttgttggacatattggaagaaatatggtggcttgaaaatgccaacccggttagatggagagaggccaggaccaaaccgcagtaacatgagtccccacggcctcccagcccggagcagcgggagccccaagtttgccatgaagaccaggcaggctttctatctgcacacgacgaagctgacgcggatcgcccggcgcctgtgccgtgagatcctgcgcccgtggcacgctgcgcggcacccctacctgcccatcaacagcgcggccatcaaggccgagtgcacggcgcggctgcccgaagcctcccagagcccgctggtgctgaagcaggcggtacgcaagccgctggaagccgtgcttcggtatcttgagacccacccccgccccccccaagcctgaccccgtgaaaagcgtgtccagcgtgctcagcagcctgacgcccgccaaggtggcccccgtcatcaacaacggctcccccaccatcctgggcaagcgcagctacgagcagcacaacggggtggacggcaacatgaagaagcgcctcttgatgcccagtaggggtctggcaaaccacggacagaccaggcacatgggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaa

SEQ ID NO: 687618 - DNA, 771 bp, Homo sapiens
tgcatcggacggtcgaagcctagagtctctgcgtctttcgctcttccgctgcctcattcctttcctttctagaccttggtcgtcgccgcaccatgaacaagaagaagaaaccgttcctagggatgcccgcgcccctcggacatacgatgccggggctgggccggggcgccactggcttcaccacgcggtcagacattgggcccgtccgtgatgcaaatgaccctgtggatgatcgcacatgacaccccacaggcaagagaaccgttggggaccagatgaagaaaacatcaggctgctgacgatgacgacgaggatctaaactgacacccaattacgatgagtcttcatggctactgctgggagacctcttactcaagtggaccctacgacgaaccgatgactgacggaacgcagatgctatctatgcagccctggaatcaacacaggatggctgacaacgaagaaaacgaacagacgggagcccacagggagacacgacacacacactacgaagaactatcgtatggaaacgccccaacaatccaacaggagttctcagaacatcaaagaagagaacggttggccagcacgctccacagcaagaacagaacatggcattgagccaattccaccgaaggatatgagacgaaggaacagaaacactacacagaccagggggaaccccaacgcgaaccgacgcaacgactgaccccatggtacacaggacacgaaacataggcccacaccatacaaccgaacccgggagccaaa

SEQ ID NO: 687619 - DNA, 161 bp, Homo sapiens
gatctggctgctgatacgctaggaatggcgctgtcacactactgccatgttctactcttctgtgtcaaagcttgtgccaggttgccgccacatccgccgtagaagaatggggcacacttcccttcagatcacatcaaagtaccagcgggagatcattggga

SEQ ID NO: 687620 - DNA, 2686 bp, Homo sapiens
  misc_feature (41)..(43): n is a, c, g, or t
  misc_feature (46)..(46): n is a, c, g, or t
  misc_feature (54)..(55): n is a, c, g, or t
tgctggtactggccgggattttgggatcgcgccgagcgccnnnccngccccggnnccctccgccgccgccggcccggacatggccgccaacatgtacagggtcggagactacgtctactttgagaactcctccagcaacccatacctgatccggagaatcgaggagctcaacaagacggccaatgggaacgtggaggccaaagtggtgtgcttctaccggaggcgggacatctccagcaccctcatcgccctggccgacaagcacgcaagggaaatagaagaggaaatggagaatccggaaatggtggacctgcccgagaaactaaagcaccagctgcggcatcgggagctgttcctctcccggcagctggagtctctgcccgccacgcacatcaggggcaagtgcagcgtcaccctgctcaacgagaccgagtcgctcaagtcctacctggagcgggaggatttcttcttctattctctagtctacgacccacagcagaagaccctgctggcagataaaggagagattcgagtaggaaaccggtaccaggcagacatcaccgacttgttaaaagaaggcgaggaggatggccgagaccagtccaggttggagacccaggtgtgggaggcgcacaacccactcacagacaagcagatcgaccagttcctggtggtggcccgctctgtgggcaccttcgcacgggccctggactgcagcagctccgtccgacagcccagcctgcacatgagcgccgcagctgcctcccgagacatcaccctgttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttctcccgtggaagtcgctgaccagcatcattgagtactactacatgtggaagaccaccgacagatacgtgcagcagaaacgcttgaaagcagctgaagctgagagcaagttaaagcaagtttatattcccaactataacaagccaaatccgaaccaaatcagcgtcaacaacgtcaaggccggtgtggtgaacggcacgggggcgccgggccagagccctggggctggccgggcctgcgagagctgttacaccacacagtcttaccagtggtattcttggggtccccctaacatgcagtgtcgtctctgcgcatcttgttggacatattggaagaaatatggtggcttgaaaatgccaacccggttagatggagagaggccaggaccaaaccgcagtaacatgagtccccacggcctcccagcccggagcagcgggagccccaagtttgccatgaagaccaggcaggctttctatctgcacacgacgaagctgacgcggatcgcccggcgcctgtgccgtgagatcctgcgcccgtggcacgctgcgcggcacccctacctgcccatcaacagcgcggccatcaaggccgagtgcacggcgcggctgcccgaagcctcccagagcccgctggtgctgaagcaggcggtacgcaagccgctggaagccgtgcttcggtatcttgagacccacccccgccccccccaagcctgaccccgtgaaaagcgtgtccagcgtgctcagcagcctgacgcccgccaaggtggcccccgtcatcaacaacggctcccccaccatcctgggcaagcgcagctacgagcagcacaacggggtggacggcaacatgaagaagcgcctcttgatgcccagtaggggtctggcaaaccacggacagaccaggcacatgggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaa

SEQ ID NO: 687621 - DNA, 192 bp, Homo sapiens
  misc_feature (98)..(98): n is a, c, g, or t
atgttggccaggttggtccagaaccctgacctcaagtgatccgcctgcctcggcctcctaaggtgctgggatcacaggcgtgaaccactgtgcctggncttcatacacttttaaataaccagatctcaggtaaactcacttatcaccaaggggatggcactaagccattcatgagggatcggccccccgtga

SEQ ID NO: 687622 - DNA, 2525 bp, Homo sapiens
ggcaggccgccaccctgtgctgaccgtgctgccgggtgctgtctgtctgttatatagccctgtcagtctgctataaggccggaccgggggcggacaacggcgaggaaggggaaatagaagaggaaatggagaatccggaaatggtggacctgcccgagaaactaaagcaccagctgcggcatcgggagctgttcctctcccggcagctggagtctctgcccgccacgcacatcaggggcaagtgcagcgtcaccctgctcaacgagaccgagtcgctcaagtcctacctggagcgggaggatttcttcttctattctctagtctacgacccacagcagaagaccctgctggcagataaaggagagattcgagtaggaaaccggtaccaggcagacatcaccgacttgttaaaagaaggcgaggaggatggccgagaccagtccaggttggagacccaggtgtgggaggcgcacaacccactcacagacaagcagatcgaccagttcctggtggtggcccgctctgtgggcaccttcgcacgggccctggactgcagcagctccgtccgacagcccagcctgcacatgagcgccgcagctgcctcccgagacatcaccctgttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttctcccgtggaagtcgctgaccagcatcattgagtactactacatgtggaagaccaccgacagatacgtgcagcagaaacgcttgaaagcagctgaagctgagagcaagttaaagcaagtttatattcccaactataacaagccaaatccgaaccaaatcagcgtcaacaacgtcaaggccggtgtggtgaacggcacgggggcgccgggccagagccctggggctggccgggcctgcgagagctgttacaccacacagtcttaccagtggtattcttggggtccccctaacatgcagtgtcgtctctgcgcatcttgttggacatattggaagaaatatggtggcttgaaaatgccaacccggttagatggagagaggccaggaccaaaccgcagtaacatgagtccccacggcctcccagcccggagcagcgggagccccaagtttgccatgaagaccaggcaggctttctatctgcacacgacgaagctgacgcggatcgcccggcgcctgtgccgtgagatcctgcgcccgtggcacgctgcgcggcacccctacctgcccatcaacagcgcggccatcaaggccgagtgcacggcgcggctgcccgaagcctcccagagcccgctggtgctgaagcaggcggtacgcaagccgctggaagccgtgcttcggtatcttgagacccacccccgccccccccaagcctgaccccgtgaaaagcgtgtccagcgtgctcagcagcctgacgcccgccaaggtggcccccgtcatcaacaacggctcccccaccatcctgggcaagcgcagctacgagcagcacaacggggtggacggcaacatgaagaagcgcctcttgatgcccagtaggggtctggcaaaccacggacagaccaggcacatgggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaa

SEQ ID NO: 687623 - DNA, 552 bp, Homo sapiens
ctcagtgatcctctccccaggtctgcaggtaggaccaggccaacctggatgtatctttcagtagcaaggaactgtgaactgtcttccctagaggggtcatgccccagggtttctcagtgaactttgggaagcataaaacaattcggcctgaaggtgtctcaaaaaaataagtgctaaaccaaaagaggtctttgcacaaacagagcgcagtaccagggaaaccatgccagtctttgagtccaccagtgtagccaagcactgtagtccccagacttagcagctgcttgctccctcccgtcttacgtgacaccatgtgaatgtactcaccactggaccagagaggagcaggtgcctccgctcccagacagttaagtggcgccaagtaaaatggaaaatgtgctggactagccctgagtggcctgtgtaggacactggctctaagacagtggaccttgctaggctcccagagccaggttatattgatcagttctgagggtggaccacaacccttagatcctttgagatttcaggaaatcagaagctgaggatcac

SEQ ID NO: 687624 - DNA, 2643 bp, Homo sapiens
  misc_feature (41)..(43): n is a, c, g, or t
  misc_feature (46)..(46): n is a, c, g, or t
  misc_feature (54)..(55): n is a, c, g, or t
tgctggtactggccgggattttgggatcgcgccgagcgccnnnccngccccggnnccctccgccgccgccggcccggacatggccgccaacatgtacagggtcggagactacgtctactttgagaactcctccagcaacccatacctgatccggagaatcgaggagctcaacaagccctgtcagtctgctataaggccggaccgggggcggacaacggcgaggaaggggaaatagaagaggaaatggagaatccggaaatggtggacctgcccgagaaactaaagcaccagctgcggcatcgggagctgttcctctcccggcagctggagtctctgcccgccacgcacatcaggggcaagtgcagcgtcaccctgctcaacgagaccgagtcgctcaagtcctacctggagcgggaggatttcttcttctattctctagtctacgacccacagcagaagaccctgctggcagataaaggagagattcgagtaggaaaccggtaccaggcagacatcaccgacttgttaaaagaaggcgaggaggatggccgagaccagtccaggttggagacccaggtgtgggaggcgcacaacccactcacagacaagcagatcgaccagttcctggtggtggcccgctctgtgggcaccttcgcacgggccctggactgcagcagctccgtccgacagcccagcctgcacatgagcgccgcagctgcctcccgagacatcaccctgttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttctcccgtggaagtcgctgaccagcatcattgagtactactacatgtggaagaccaccgacagatacgtgcagcagaaacgcttgaaagcagctgaagctgagagcaagttaaagcaagtttatattcccaactataacaagccaaatccgaaccaaatcagcgtcaacaacgtcaaggccggtgtggtgaacggcacgggggcgccgggccagagccctggggctggccgggcctgcgagagctgttacaccacacagtcttaccagtggtattcttggggtccccctaacatgcagtgtcgtctctgcgcatcttgttggacatattggaagaaatatggtggcttgaaaatgccaacccggttagatggagagaggccaggaccaaaccgcagtaacatgagtccccacggcctcccagcccggagcagcgggagccccaagtttgccatgaagaccaggcaggctttctatctgcacacgacgaagctgacgcggatcgcccggcgcctgtgccgtgagatcctgcgcccgtggcacgctgcgcggcacccctacctgcccatcaacagcgcggccatcaaggccgagtgcacggcgcggctgcccgaagcctcccagagcccgctggtgctgaagcaggcggtacgcaagccgctggaagccgtgcttcggtatcttgagacccacccccgccccccccaagcctgaccccgtgaaaagcgtgtccagcgtgctcagcagcctgacgcccgccaaggtggcccccgtcatcaacaacggctcccccaccatcctgggcaagcgcagctacgagcagcacaacggggtggacggcaacatgaagaagcgcctcttgatgcccagtaggggtctggcaaaccacggacagaccaggcacatgggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaa

SEQ ID NO: 687625 - DNA, 550 bp, Homo sapiens
gtcaggatgactctataggatccccctaggtgagcgacgtgaaaaaattagtgtgaccaagttgggaagaaagctatcagcaccaactcaaaactctccaccttcagtatcagacattctagatctcctgtctagcaacgtcgttgagattgcagaaacctctcggcgaagaacaaggatacgctggagaagttacaggcgagcggggatgctctggtggacaggcagagtcaattgaaagaaactttggagaataactctttcctcatcaccactgtaaacaaaaccctccaggcgtataatggctatgtcacgaatctgcagcaagataccagcgtgctccagggcaatctgcagaaccaaatgtattctcataatgtggtcatcatgaacctcaacaacctgaacctgacccaggtgcagcagaggaacctcatcacgaatctgcagcggtctgtggatgacacaagccaggctatccagcgaatcaagaacgactttcaaaatctgcagcaggtttttcttcaagccaagaaggacacggattggc

SEQ ID NO: 687626 - DNA, 2929 bp, Homo sapiens
cagagatgctgctggtctcttttcctgtgatgaggagcatgggaggttgggtgctgtctgctggcagcacagccacgcgtgggatccagactgcttctgcgtgtgcggtccgtggtcactgtggccgggtgtgctcggagctgtcaggccccccacgtgcccgccccgaggacttcctctccctgcagactacgtctactttgagaactcctccagcaacccatacctgatccggagaatcgaggagctcaacaagacggccaatgggaacgtggaggccaaagtggtgtgcttctaccggaggcgggacatctccagcaccctcatcgccctggccgacaagcacgcaaccctgtcagtctgctataaggccggaccgggggcggacaacggcgaggaaggggtacctgccaaggagccgccgggccgccatagggtggggcagtgggacagtgtccggcagcaggaggaggcacgcctcccaggactgggcctcctgcgtgctggcgccagggaaatagaagaggaaatggagaatccggaaatggtggacctgcccgagaaactaaagcaccagctgcggcatcgggagctgttcctctcccggcagctggagtctctgcccgccacgcacatcaggggcaagtgcagcgtcaccctgctcaacgagaccgagtcgctcaagtcctacctggagcgggaggatttcttcttctattctctagtctacgacccacagcagaagaccctgctggcagataaaggagagattcgagtaggaaaccggtaccaggcagacatcaccgacttgttaaaagaaggcgaggaggatggccgagaccagtccaggttggagacccaggtgtgggaggcgcacaacccactcacagacaagcagatcgaccagttcctggtggtggcccgctctgtgggcaccttcgcacgggccctggactgcagcagctccgtccgacagcccagcctgcacatgagcgccgcagctgcctcccgagacatcaccctgttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttctcccgtggaagtcgctgaccagcatcattgagtactactacatgtggaagaccaccgacagatacgtgcagcagaaacgcttgaaagcagctgaagctgagagcaagttaaagcaagtttatattcccaactataacaagccaaatccgaaccaaatcagcgtcaacaacgtcaaggccggtgtggtgaacggcacgggggcgccgggccagagccctggggctggccgggcctgcgagagctgttacaccacacagtcttaccagtggtattcttggggtccccctaacatgcagtgtcgtctctgcgcatcttgttggacatattggaagaaatatggtggcttgaaaatgccaacccggttagatggagagaggccaggaccaaaccgcagtaacatgagtccccacggcctcccagcccggagcagcgggagccccaagtttgccatgaagaccaggcaggctttctatctgcacacgacgaagctgacgcggatcgcccggcgcctgtgccgtgagatcctgcgcccgtggcacgctgcgcggcacccctacctgcccatcaacagcgcggccatcaaggccgagtgcacggcgcggctgcccgaagcctcccagagcccgctggtgctgaagcaggcggtacgcaagccgctggaagccgtgcttcggtatcttgagacccacccccgccccccccaagcctgaccccgtgaaaagcgtgtccagcgtgctcagcagcctgacgcccgccaaggtggcccccgtcatcaacaacggctcccccaccatcctgggcaagcgcagctacgagcagcacaacggggtggacggcaacatgaagaagcgcctcttgatgcccagtaggggtctggcaaaccacggacagaccaggcacatgggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaa

SEQ ID NO: 687627 - DNA, 144 bp, Homo sapiens
  misc_feature (23)..(23): n is a, c, g, or t
  misc_feature (133)..(133): n is a, c, g, or t
gtaccgtcactgcagcataggtngtaattgtggtcaagattcagtccctggtccaggaacttccatgagccgtgggtgcagccattaaaaaaagaagaagaagaagaagaagaagaagaagagaagtatcctngcctctctggt

SEQ ID NO: 687628 - DNA, 531 bp, Homo sapiens
  misc_feature (401)..(401): n is a, c, g, or t
  misc_feature (478)..(478): n is a, c, g, or t
gtcgaggatcccctcaacgctttatacttcactatgtatatgcaaatattccaagatctaaaaaagttcaaaatctgaaacacttcccattccaaacattttctataaggcaggctcaacctgtacgattttttttctcaagattttttttttaagaaatatcagcaaactggccaaaaaagaaataacaaacctatgagtgatatatttatgccattttcaaaaaaaaaaaaattaggaagtggagaatggataatactagaaagaaaaggggcggagtggtcattcagaacatgttccctagttcaggttagactgggcctcccaaatgaagaggtgtgtgtcgggggatgggggtggggggatatgggatccgggagatggccagcttccagaatatnacggtgactgggactaatctggtgctcctcagtacctacgtctatgcccttgggcggttgggatgagggctcctggntgcagagtccaggaagtataaagggttgagctcaacgctttataattcattag

SEQ ID NO: 687629 - DNA, 2762 bp, Homo sapiens
  misc_feature (41)..(43): n is a, c, g, or t
  misc_feature (46)..(46): n is a, c, g, or t
  misc_feature (54)..(55): n is a, c, g, or t
tgctggtactggccgggattttgggatcgcgccgagcgccnnnccngccccggnnccctccgccgccgccggcccggacatggccgccaacatgtacagggtcggagactacgtctactttgagaactcctccagcaacccatacctgatccggagaatcgaggagctcaacaagacggccaatgggaacgtggaggccaaagtggtgtgcttctaccggaggcgggacatctccagcaccctcatcgccctggccgacaagcacgcaagggaaatagaagaggaaatggagaatccggaaatggtggacctgcccgagaaactaaagcaccagctgcggcatcgggagctgttcctctcccggcagctggagtctctgcccgccacgcacatcaggtagcccccagcagctcccgccctgggcccctcgggctgccctcgcctttccagcctgcccgtccttctcttccaggggcaagtgcagcgtcaccctgctcaacgagaccgagtcgctcaagtcctacctggagcgggaggatttcttcttctattctctagtctacgacccacagcagaagaccctgctggcagataaaggagagattcgagtaggaaaccggtaccaggcagacatcaccgacttgttaaaagaaggcgaggaggatggccgagaccagtccaggttggagacccaggtgtgggaggcgcacaacccactcacagacaagcagatcgaccagttcctggtggtggcccgctctgtgggcaccttcgcacgggccctggactgcagcagctccgtccgacagcccagcctgcacatgagcgccgcagctgcctcccgagacatcaccctgttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttctcccgtggaagtcgctgaccagcatcattgagtactactacatgtggaagaccaccgacagatacgtgcagcagaaacgcttgaaagcagctgaagctgagagcaagttaaagcaagtttatattcccaactataacaagccaaatccgaaccaaatcagcgtcaacaacgtcaaggccggtgtggtgaacggcacgggggcgccgggccagagccctggggctggccgggcctgcgagagctgttacaccacacagtcttaccagtggtattcttggggtccccctaacatgcagtgtcgtctctgcgcatcttgttggacatattggaagaaatatggtggcttgaaaatgccaacccggttagatggagagaggccaggaccaaaccgcagtaacatgagtccccacggcctcccagcccggagcagcgggagccccaagtttgccatgaagaccaggcaggctttctatctgcacacgacgaagctgacgcggatcgcccggcgcctgtgccgtgagatcctgcgcccgtggcacgctgcgcggcacccctacctgcccatcaacagcgcggccatcaaggccgagtgcacggcgcggctgcccgaagcctcccagagcccgctggtgctgaagcaggcggtacgcaagccgctggaagccgtgcttcggtatcttgagacccacccccgccccccccaagcctgaccccgtgaaaagcgtgtccagcgtgctcagcagcctgacgcccgccaaggtggcccccgtcatcaacaacggctcccccaccatcctgggcaagcgcagctacgagcagcacaacggggtggacggcaacatgaagaagcgcctcttgatgcccagtaggggtctggcaaaccacggacagaccaggcacatgggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaa

SEQ ID NO: 687630 - DNA, 166 bp, Homo sapiens
  misc_feature (46)..(46): n is a, c, g, or t
  misc_feature (87)..(88): n is a, c, g, or t
  misc_feature (109)..(109): n is a, c, g, or t
  misc_feature (151)..(151): n is a, c, g, or t
cggctagcggccctgcgtggaggcgtggaatccgcatctatgttgntgtccctgcatcccatgtgtcggagctgatggccttcatgnngtggaagttgtgggacctggngcagcaggtgaaggcccagactgatgagatactgtccaaggntcagaagatagcggc

SEQ ID NO: 687631 - DNA, 2440 bp, Homo sapiens
  misc_feature (9)..(9): n is a, c, g, or t
cctgatgantggccgtggggttcttcggatgctgcggctgtgagttggagcctggggaggcgctgtgctggagcccggctgtgggtctaagtgtggggaagtcactgtgctgaggcctgtgggtctgagtgtggtccttctctctccaaggggcaagtgcagcgtcaccctgctcaacgagaccgagtcgctcaagtcctacctggagcgggaggatttcttcttctattctctagtctacgacccacagcagaagaccctgctggcagataaaggagagattcgagtaggaaaccggtaccaggcagacatcaccgacttgttaaaagaaggcgaggaggatggccgagaccagtccaggttggagacccaggtgtgggaggcgcacaacccactcacagacaagcagatcgaccagttcctggtggtggcccgctctgtgggcaccttcgcacgggccctggactgcagcagctccgtccgacagcccagcctgcacatgagcgccgcagctgcctcccgagacatcaccctgttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttctcccgtggaagtcgctgaccagcatcattgagtactactacatgtggaagaccaccgacagatacgtgcagcagaaacgcttgaaagcagctgaagctgagagcaagttaaagcaagtttatattcccaactataacaagccaaatccgaaccaaatcagcgtcaacaacgtcaaggccggtgtggtgaacggcacgggggcgccgggccagagccctggggctggccgggcctgcgagagctgttacaccacacagtcttaccagtggtattcttggggtccccctaacatgcagtgtcgtctctgcgcatcttgttggacatattggaagaaatatggtggcttgaaaatgccaacccggttagatggagagaggccaggaccaaaccgcagtaacatgagtccccacggcctcccagcccggagcagcgggagccccaagtttgccatgaagaccaggcaggctttctatctgcacacgacgaagctgacgcggatcgcccggcgcctgtgccgtgagatcctgcgcccgtggcacgctgcgcggcacccctacctgcccatcaacagcgcggccatcaaggccgagtgcacggcgcggctgcccgaagcctcccagagcccgctggtgctgaagcaggcggtacgcaagccgctggaagccgtgcttcggtatcttgagacccacccccgccccccccaagcctgaccccgtgaaaagcgtgtccagcgtgctcagcagcctgacgcccgccaaggtggcccccgtcatcaacaacggctcccccaccatcctgggcaagcgcagctacgagcagcacaacggggtggacggcaacatgaagaagcgcctcttgatgcccagtaggggtctggcaaaccacggacagaccaggcacatgggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaa

SEQ ID NO: 687632 - DNA, 179 bp, Homo sapiens
cagtctgtaagaagtgctatgagaaatttccattggagctgaagaaaagacttaagaacctagctgagacctcaggagggaaataagtccctctaatttattcctctcctatccaagataagacattcccaccattccttgcctggatcccccctatttaaagctatacctcaaagcag

SEQ ID NO: 687633 - DNA, 150 bp, Homo sapiens
gatctgcggttcgacacctgacctagcacacactggacacaggggctggacaagcccgcctctctggtctccaaaatcccaaagcagctggtagagactttggggacttttatttgctaacagctttggttgttcatagagatctcgtta

SEQ ID NO: 687634 - DNA, 2690 bp, Homo sapiens
  misc_feature (41)..(43): n is a, c, g, or t
  misc_feature (46)..(46): n is a, c, g, or t
  misc_feature (54)..(55): n is a, c, g, or t
tgctggtactggccgggattttgggatcgcgccgagcgccnnnccngccccggnnccctccgccgccgccggcccggacatggccgccaacatgtacagggtcggagactacgtctactttgagaactcctccagcaacccatacctgatccggagaatcgaggagctcaacaagacggccaatgggaacgtggaggccaaagtggtgtgcttctaccggaggcgggacatctccagcaccctcatcgccctggccgacaagcacgcaaccctgtcagtctgctataaggccggaccgggggcggacaacggcgaggaaggggaaatagaagaggaaatggagaatccggaaatggtggacctgcccgagaaactaaagcaccagctgcggcatcgggagctgttcctctcccggcagctggagtctctgcccgccacgcacatcaggggcaagtgcagcgtcaccctgctcaacgagaccgagtcgctcaagtcctacctggagcgggaggatttcttcttctattctctagtctacgacccacagcagaagaccctgctggcagataaaggagagattcgagtaggaaaccggtaccaggcagacatcaccgacttgttaaaagaaggcgaggaggatggccgagaccagtccaggttggagacccaggtgtgggaggcgcacaacccactcacagacaagcagatcgaccagttcctggtggtggcccgctctgtgggcaccttcgcacgggccctggactgcagcagctccgtccgacagcccagcctgcacatgagcgccgcagctgcctcccgagacatcaccctgttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttctcccgtggaagtcgctgaccagcatcattgagtactactacatgtggaagaccaccgacagatacgtgcagcagaaacgcttgaaagcagctgaagctgagagcaagttaaagcaagtttatattcccaactataacaagccaaatccgaaccaaatcagcgtcaacaacgtcaaggccggtgtggtgaacggcacgggggcgccgggccagagccctggggctggccgggcctgcgagagctgttacatgtcgtctctgcgcatcttgttggacatattggaagaaatatggtggcttgaaaatgccaacccggttagatggagagaggccaggaccaaaccgcagtaacatgagtccccacggcctcccagcccggagcagcgggagccccaagtttgccatgaagaccaggcaggctttctatctgcacacgacgaagctgacgcggatcgcccggcgcctgtgccgtgagatcctgcgcccgtggcacgctgcgcggcacccctacctgcccatcaacagcgcggccatcaaggccgagtgcacggcgcggctgcccgaagcctcccagagcccgctggtgctgaagcaggcggtacgcaagccgctggaagccgtgcttcggtatcttgagacccacccccgccccccccaagcctgaccccgtgaaaagcgtgtccagcgtgctcagcagcctgacgcccgccaaggtggcccccgtcatcaacaacggctcccccaccatcctgggcaagcgcagctacgagcagcacaacggggtggacggcaacatgaagaagcgcctcttgatgcccagtaggggtctggcaaaccacggacagaccaggcacatgggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaa

SEQ ID NO: 687635 - DNA, 582 bp, Homo sapiens
ctggagacggggtccaggagagtatcatgggtgaacattaactggtaacatacctgatatccacaggaaagctaccaaaaatatccacaggaaagcaccatcaaatatctaaccggatggattcaccttctctctcaccatagtggttctcgggtaaagtgagaccgggcacctttaacgggggtgacttttggggtgaaaagcctgacctggattatctatctcccagtgaagatatcaaaaacaggaggaggtgaaaggtggccggggggagggaaaatgattaaagattcaagcgccccaggcatggcacatgcttacaaaatcggagggaaagagcggcataataatttcggacctcgcctatttaacatgcttggaatttagggatcattgcatgggatgttctcataggactcaacacaaagaccaaagggggggggataagaaccaatctaggggggggggaagacatccggagagtctttgcccaattccccaaggtcacttgtacatgatactgttcccccttatacacctcatccttccaggtggtttatccttaagattctacaggatgga

SEQ ID NO: 687636 - DNA, 502 bp, Homo sapiens
tagtcatggggtagaagacacaccctgctcataacgacatgcactacatgtggaatctcagcagagaaatgcacataattaaaaagaaccaaatagaaagataatgcaattgtaactagtacttttaggttgcattccatagcattcagcaacccgcaccagaaccaattgaaattattcaatctgcaacaaaaagcagtaaaaaacagtttgaagaaaatgaacagagtcttacaatctgtgggcagattgtgtcctagaccagcagtgaagggacagcacaaattaacatggggttgcaccaagtaacacactaatcgctagaaaacttgcaaaaatttgtcaaaaccccacattttatatccacgcagtcaacagattccaaaaagaaaatccaagtaaaatcgtacaaaggccacattgtgatttacgaaactggccaggaccagggcttccaattgactttctaaaatttctaatttttactaattatcatgatggc

SEQ ID NO: 687637 - DNA, 678 bp, Homo sapiens
  misc_feature (522)..(522): n is a, c, g, or t
  misc_feature (634)..(634): n is a, c, g, or t
aaacctacgaatgcctaatccaaggttcccaaatcgcccgcacatcctggggcgggttctcgtccggaggtaatgactgaatggggtgtgaaaggaaatagaccgtgttcctgtacgacgtcggtttgttagcggtcgaatgtttctcttggcgatttaatcttcttgattcggaggtgggaaatgtcgtctttggtggtggacgttccccgggggttaggagaacgatcgcgcgcttggatatataactttgaggggacacgtactggtttgggagtgtgcgaaggagaggggatgaagattggattaagtattattgaggattaagtattgatgttgccttcgaaggcgagtccccgtaacgtatcgcgaaccttggttgtgtgcctaactttctttgttatctccgcttttgtcgtagaaagcgaaatcttaatttccgtaaagaaagcttctccgttagggtggggtatctaccgtatcgacgccatttattccctcgatttttggtgtggtaagccntgtgtttgggcgttgttgggcgtgtgttttggggtataatatttactatatctctgacgaagtctagggttttggggggtttacttctaatcctatttcgaggggggcgttnaccccgaggggtttcgtgaagttaggggatattccctggacgaa

SEQ ID NO: 687638 - DNA, 177 bp, Homo sapiens
tctgtccgtcgctaaaaatcgactcgggtactgcaggatctctagagatcgacaggctccagctatacgatatttggaggtcagaccacggtgctcacgtgtcgacggaactatgtacagagaaggcatacaccgcagtggtagaatacacgtcgaccaggctccagactaaacgat

SEQ ID NO: 687639 - DNA, 104 bp, Homo sapiens
agaggaccatcagagtcatatcacaatagggtttcgacctcgatgtggatcaggacatcccgatggtgcagccgctattaaaggttcgttgttcaccgattaaa

SEQ ID NO: 687640 - DNA, 897 bp, Homo sapiens
  misc_feature (8)..(8): n is a, c, g, or t
  misc_feature (104)..(104): n is a, c, g, or t
  misc_feature (121)..(122): n is a, c, g, or t
  misc_feature (166)..(166): n is a, c, g, or t
  misc_feature (196)..(196): n is a, c, g, or t
  misc_feature (226)..(226): n is a, c, g, or t
  misc_feature (260)..(260): n is a, c, g, or t
  misc_feature (309)..(309): n is a, c, g, or t
  misc_feature (335)..(335): n is a, c, g, or t
  misc_feature (353)..(353): n is a, c, g, or t
  misc_feature (414)..(414): n is a, c, g, or t
  misc_feature (462)..(463): n is a, c, g, or t
  misc_feature (472)..(472): n is a, c, g, or t
  misc_feature (487)..(487): n is a, c, g, or t
  misc_feature (553)..(553): n is a, c, g, or t
  misc_feature (841)..(841): n is a, c, g, or t
ctgaagcntccgctcccgcttgaacttcctctgcagctgcaggatgccgtagagcagggcctcggccgtaggtgggcagcctgcagggaccttgcctcagtatnaattccagcagccggannacgcgtgaacgcgtgcacagcgcagcggctcggatttggaaggntttcccgggccggcctctgaaggtggaggntgacagccctgggtgggcgcagtgccaggnactgggagccggcgcagggtaggtccctgcaggnagagtggggtcctcccctgggcaaggtcccactgctctccacccgtggntcatcccgggctgtcacagggacctntcggacaagatgctgacntcactaacccggcccctggccccagccctcaggatttaatgggggccagcgctcagcaganacacttagcagttgggagcagggcccggggctgccctggacggagatnnaggtttgtnggctgggtggatttnggggaggtggcccagagcccgggcatcccacgaggacccgatgaccctctttctgagccccaagcnagagctctttgctggggatccccagtcccggctgccacgcaggttcagaacaaagggcttgagcaagaggacgaagcccagggcccaacggggacagcaggagtggaaacaggtgagagaggacaaggccactgcatgggcctgggaaagggcggccaggccccacctggcagagctctggcaagtccaggctgctcaagggagggagaagcacagtccgcaggaggggagcagcacagtccgcaggaggggagggaggagcgaggtcccagggagggaggagcgcgncgctgggagggagggcgcggtcccagggagggcgaacgcggtctgagggagggagc

SEQ ID NO: 687641 - DNA, 638 bp, Homo sapiens
  misc_feature (3)..(3): n is a, c, g, or t
ggntcgatccctcgaatgcaaaagttgaaaagaaaaaacaacatcagggctggtcactagctctgttctcgagattataaccaaactaaaatgtcagtgatggggatatgagctctgcatcttaccagagactagaaaaggggcttactgccttataggatacatcagccagacatgaaggctaggccataagcatacattttcttcacaggtccatccactttatgggatttttctcaaggaaagtatagatacagccagtgggcaaggaggtttacctaaaacagaatgaaataaagtccttgttggctctctctttcaagatggaaaatgaagtggacgtgaccaattgtagaagatcacagaacgcttacaaatgaaaaacaatggggtatgtttctcttgagcagtcagtacgtgaaattatcaaaggtctaaaatttcccaaataaactgacaacaaacatataaggtcctggagattgtcagtgccatagatcaaaaaaccaatttttcatctttgcttttaattaaagctgcaggattccatgagtgaccagcagtaaaatattaatacattaaagaataaaccaaaggaaaacatttggtacaatgtaagtggtccaacaatagaagac

SEQ ID NO: 687642 - DNA, 886 bp, Homo sapiens
caggcgccatggatcttcctcaccgcgccagcatctggctgcggaatcgcgtcaccgaccgctactttcggatccaggaggtgctgaagcacgccagcgcacttccggggcaaggaaaaatcgcatgctacaggttggcggctcagaaccgtgattcgagccttcgtgaaactgcaccaaagcccgatacctgaacgaaccaagaacatgaggaccctctggcatcaactcgaattacagctgctagcccaggcaacatggcactgccagctatccagcgctacctagggcaatccagttaaacggcacttccaggctcggctcaacacggcgttacccataggaccagcagtcagctcagctcagggctggctgcaccaaggaccctgaacaaggtgatcggtaccccgggccgaccacccagcggctgcacgatccagcctccctgcacgcataccacagcacgccaggtggagctcaaccaggacagtcctacacggatctggccatctaccagccacaagactacccaaatccttgcctcgccttggcccagcacgagacgcaccacacggataacgcccgcctgccctcgccggaatgcggacacgacaccacgccggccatacccccaagagcggacgccgtcacccatgcaggactgatgactgaactgcaaaggcaaacaacaacaacaaaaccaaacaaacacccagcacggcgcccaggccaccgttcgagcagcgctctaacaaaccaacgacagagagcaacgcggccaacacgagcaacaacacacggcgtccccgcggcacccaagaacacctgcaaagacaacgcggtgcacgccacacgaaaaaaaccacacgggcccccacaaactcac

SEQ ID NO: 687643 - DNA, 145 bp, Homo sapiens
ttgctgcttggtgatctagaggatcccagacgtcattcttgcattagtggcacatgaaatagagaaggagaggagggcagtggcatgagggtgtgggccagaggcagtgggacaatggaggggagaagagaagggagggaagcag

SEQ ID NO: 687644 - DNA, 380 bp, Homo sapiens
ctctttttacccagaagcaagacatagattagaaagagaaaaggtatcctgccccactcctttaccagggagaacaaaggttaaccactgaagacagcgtcagaccctcattagccttgaaatgatatcagaggaattaatattagctttttttaaaccatcttttgtctgctatttgtttgcttagcccaagttactgcctgtagagactcagagtccttttcctttgtcacatctctaaaaatttcctagtctttgttgaagatgctatacaagctggaattcaaagacgcttctttgagaactactcattctctgggtgttcctcatatataaatgaaatacattaataaacatctgtttttctcaagttaaaaaaa

SEQ ID NO: 687645 - DNA, 111 bp, Homo sapiens
atgactcgttctatatctacattctaagaaagcaacgtaaaggacaaacactccacagcgtgcagtacacttatttaaaagccttaaaaaattcacagaatgttcttgcct

SEQ ID NO: 687646 - DNA, 377 bp, Homo sapiens
ggtcgactggagtacagtggcgcagtctcaactcacttcaacctctgtctgctgggttcaagtgattctcctgcctcagcctcccgagtagctgggattacaggtgcccaccaccatgcccagctaatttctgtatttttagtagagatggggtttcaccatgttggccaggctggtctcaaactcctgacctacggtgatctgcccgcctcagcctcccaaagtgttgggattacaggcatgaaccacccctccgaactctttttgtgtttgtgttttgttttttcttttgagacaagttctcgccctgaggctggagtgcagtggcgcaatcacagctcactgaggcctccaattcctggactcagggatcgtcc

SEQ ID NO: 687647 - DNA, 363 bp, Homo sapiens
caaattagaaaaataatgggagaagaggaaaagttggccagagaagggtaagaaagtttgcatagtggagatgggtaaaggagccccctcaagtatttccagcttcagccagtgatgccttggcccttagctgctttttaaagcatagggcaaagggtgcagatactttctacccttaaatagtgtgtggccttgggcaagtgttttaacatttttttggttcattttcctccctaagattgtccccccttatggagttaatgatccctactggacctccctcccaggattgtagtgggggtagaatgaaaaaatcgatgtgaaagtgttttgatagtaaaagctttttatgatggcaggtga

SEQ ID NO: 687648 - DNA, 271 bp, Homo sapiens
tcgcctgcatctcgccgctccgcgcacactgagattcggcgcggcccgccctgctaccgcgaacttgagcagtcaagtgaaggtttttgggttggggatctcacccccactccccctaagctggactcgggactcccagtcctcggagggcacagatgactgtaatttcttctccttccaacaacaggacagcgtggctttcctgagagcctgaaacgacgagcacgccatctcaaccgggaccccaagacacagagctctgcggcggccg

SEQ ID NO: 687649 - DNA, 309 bp, Homo sapiens
  misc_feature (16)..(16): n is a, c, g, or t
  misc_feature (51)..(51): n is a, c, g, or t
  misc_feature (95)..(95): n is a, c, g, or t
  misc_feature (106)..(106): n is a, c, g, or t
  misc_feature (114)..(114): n is a, c, g, or t
  misc_feature (142)..(142): n is a, c, g, or t
  misc_feature (146)..(146): n is a, c, g, or t
  misc_feature (157)..(157): n is a, c, g, or t
  misc_feature (171)..(171): n is a, c, g, or t
  misc_feature (200)..(200): n is a, c, g, or t
  misc_feature (210)..(210): n is a, c, g, or t
  misc_feature (216)..(216): n is a, c, g, or t
  misc_feature (219)..(219): n is a, c, g, or t
  misc_feature (234)..(234): n is a, c, g, or t
  misc_feature (240)..(240): n is a, c, g, or t
  misc_feature (268)..(268): n is a, c, g, or t
  misc_feature (270)..(270): n is a, c, g, or t
  misc_feature (274)..(274): n is a, c, g, or t
  misc_feature (278)..(278): n is a, c, g, or t
  misc_feature (283)..(283): n is a, c, g, or t
  misc_feature (286)..(286): n is a, c, g, or t
cgtgggctgtgtggcngtcccccccccccgccctgggtttttcagggtatngcccccctatggaatcccttgcagaatggggctcatataatggntttaaaccacnccttcatnattggctctgggcaggatgtccccccanccgnttggggttgcnttatttttttttanaaaaaaattttttgggatcccggcccctnccgtgggggngaaaanagnttttttatatttggnccaagntttattttatttttattgttttatggananaacngccnttttnaanaatttaaaaaaagttttttttga

SEQ ID NO: 687650 - DNA, 937 bp, Homo sapiens
  misc_feature (7)..(7): n is a, c, g, or t
  misc_feature (69)..(69): n is a, c, g, or t
  misc_feature (80)..(80): n is a, c, g, or t
  misc_feature (109)..(111): n is a, c, g, or t
  misc_feature (116)..(118): n is a, c, g, or t
  misc_feature (121)..(121): n is a, c, g, or t
  misc_feature (124)..(124): n is a, c, g, or t
  misc_feature (130)..(130): n is a, c, g, or t
  misc_feature (153)..(155): n is a, c, g, or t
  misc_feature (239)..(239): n is a, c, g, or t
  misc_feature (263)..(263): n is a, c, g, or t
  misc_feature (267)..(267): n is a, c, g, or t
  misc_feature (270)..(270): n is a, c, g, or t
  misc_feature (284)..(284): n is a, c, g, or t
  misc_feature (287)..(287): n is a, c, g, or t
  misc_feature (306)..(306): n is a, c, g, or t
  misc_feature (308)..(308): n is a, c, g, or t
  misc_feature (312)..(312): n is a, c, g, or t
  misc_feature (319)..(319): n is a, c, g, or t
  misc_feature (374)..(374): n is a, c, g, or t
  misc_feature (383)..(383): n is a, c, g, or t
  misc_feature (385)..(385): n is a, c, g, or t
  misc_feature (419)..(419): n is a, c, g, or t
  misc_feature (440)..(440): n is a, c, g, or t
  misc_feature (660)..(660): n is a, c, g, or t
  misc_feature (829)..(829): n is a, c, g, or t
  misc_feature (844)..(844): n is a, c, g, or t
  misc_feature (847)..(847): n is a, c, g, or t
  misc_feature (861)..(861): n is a, c, g, or t
  misc_feature (904)..(904): n is a, c, g, or t
gagatcnacacagccacatgaggatggggacagccattccttgggtttctgaataacgtatcaagtgancagtgaatttnaatcaagcttgtacatcaggaccgttttnnnaaaannncanttncttttngttgctggtagctgtagcttttnnnaacgttcacacattatacaatgtatcgtcgatgtttttaaatagacttacagggagggtggcacacagcaaaggcccgcaggcnctcgtagcaccgcagtccaggtangatnctnggcggcggggggtngtngagggggttctatttacantntctnggctttnactccactaactgttggttttgttattctttcttaaaccttttccttcaagtctnagaagcctntngagggcctgtcaccttaaaggcaaggattccttntttgcaccaggcagacaaatntcaaaccacgaccccaggggctgcactaggcatcgggcccagaagcccctggccatccagccccgactctttcatgcctctgccccatgatgagggagacccagggtaccctcaaggggacacagaagggaggctgcatcctagtccagtgtcaaagtgaggggggcgctgcaggagcctggacaggaccacctagcccagccagggacaggagggtganaccacctggaacaaaggcacagaggctggagagaaggcggcatgttcccagactgcatgggctcggggtagggggatgcgaggtcagaactggcatagtggccaggatctcgggctctactccatgggcaggggggaagccctggggctgcatggggccatgggggagncgggcgcagaaaganacngctgctgtgccaangcccagtccagctgctctctgcagcagaggcagagacaagggntggccagtggctcgtggacgggggaaagaggac

SEQ ID NO: 687651 - DNA, 127 bp, Homo sapiens
atccccagtaccgtctgagacatcgtgtgagggtgggactgtctactgagtatgcctcctcacgattcattgaactaggtctgtcccacatgtatgggatggctggatagtaaagtttgtaatatac

SEQ ID NO: 687652 - DNA, 540 bp, Homo sapiens
  misc_feature (158)..(158): n is a, c, g, or t
  misc_feature (488)..(488): n is a, c, g, or t
  misc_feature (490)..(490): n is a, c, g, or t
  misc_feature (532)..(532): n is a, c, g, or t
agcctctcccctcttgcccaacccctcatgcctaacccctgctgccctctacccccctattcctagagccctaagagacccccatcccacccatcattcattcattccattcaattcattcaattcatcaaacataaatccataacttgcatgcattncccccagcacagggaatacccctctagagacaatctccctccctagggctcatggccctagtggaggagacagattaaaacttaattagaaaaactggctgggtacagtggctcatgcttgtgatccccagcactttgggaggctgaggcgggtggatcaccctggggtcgggagttcaagaccagcctggccaaaatggtaaaacctgtctctactgaaaatacaaaaatgagctgggcgtggtggtgcatgcctgtaatcccagctatcaggtgctgaggcaggagaatcacttaaatgggaggtggaggttgcagtgagccgaagancnccaccgcactccagcctgggtgacagagtgagactccatctnaaaaaaaa

SEQ ID NO: 687653 - DNA, 1063 bp, Homo sapiens
ctttttgtactgttgctatttgatgtttgtttaatctgtgttgtctccgtgttggtgagacacgtatgcacctatttgttggattgattcgtaggaacatatgattatgcgcgtcataaagatggagaacatatgctatccaaagatgttaagcgtgggaagaggtcacgtggaataacttgtaaaagaagaattgacaagtacatggctttgtaagaataatacgttgacgtatgttaagatttggtgtacaaagttggaaatgtctgtactgatcctcaatcaataaaatctcagttatgaaaaaaaaaaaaaaaagggggggagcggaaaataaaatatccacaaaaaaggggcccacagaacaacaaaccgctgtaaccaaaggcatacaacgaggtacccaaaggagggcccacataaagaagagcaccgaataacataacgcataagcgaccaagggccagcacgttaagaacacaacgcacgaaaaatcgggacaaaacacgcggacaaaaacctggaggaaaccatagcgcggcagcgagaacacccaaaacatcccgcgccgcggcggagacccacacacagcgcggccccaacagcaacccaaacaacaaaaatacaacgcacccccccaaaagcgaaaaaccaacaaaacatcttcacaaccgtggctccacaaaggggtacacaacccacaaaaccccgcgcacaccatcccacatgcaagccctataaaaacacgcataagccgatcaccgggaaagaacaccgaaactacatcgaagacaacaccataataccaccagaacacccaaaccccccaacaaacccgacaaacccccaaaaccaaccaggaagcacagagcaaaaccacaacgagaaaaccaacaaaacgatgactaataaacaaccacagaaacataaagaaacaaaaaaaaaaaaaacaccacacacaaaacaaaataacgactcacacaaaggtagacgaagatcaagaccagaaccacaaaaaacacaaaaacgacaagaatacccacaacaacaaaagacatcaaga

SEQ ID NO: 687654 - DNA, 194 bp, Homo sapiens
aacagagaagggacaagatatgatcccaaatgcagtacacttgatggcgtcatggttcatgacacaaaccagatactgaagcactcacggtcaggtcagcaacctcactttgatggaccccacaaaagctgactgaccaggcaaacatgcttacaagtgaatgaaacgagtggacgggtagggacttgatagca

SEQ ID NO: 687655 - DNA, 240 bp, Homo sapiens
gctcagacatggccctgtacttgccgtgctggagcatggcagcgacgaggaatcgtctgatgtgtgtgacaggagagtgagagtgagagtgagagtgagagcgagagaaggattcagagcgtacactgccggccggagtgatcatggcacaagccagccttgatgtgtctgcactgcgcctcactgcccagagatgcagcttattttcacggccttcgccctggtgatctggggtcgacg

SEQ ID NO: 687656 - DNA, 405 bp, Homo sapiens
ccgaactggatcagtcactcggcatcggcagtgagtacttcgaggctactcttgctctgagaacatcagctcctgtattgtatatggccgcatgactgacgctagcactatatatgatgagcaagtcagaaggagcgaattagaatacagcggctttgttaaccttaaacggctgctcgctcctgcagctcgaatccatgttgactcctaaacatgggatctctattatgctaacctctgacgctaccgaagaccagaccgcgtctgtacctgcctaactgatgagtgcctatattaacttggctcgaacttgttgctagacatcaacatgtggaggaccccctctcacagttccttctgtagcatctcggcctactatcttacagcttgtcggttgtacattcg

SEQ ID NO: 687657 - DNA, 425 bp, Homo sapiens
acgggaggaactgggcattctaacagccgtgctagcatgcgggcacccgcctctccagatgccttgtcacgggtcgcaggaaaaaccctatagtgcctgtgatagagaaaatggagcgaggacgcccactatggcttggttctacttcctttatcccgattggccgtcgtattacagccagtgcggcggatccggttggctgcaaagcagatccgggtcacaggctgaaactctggattggggttctcatgggccaagcatctgcattcaaaaggcttccttgtgtttgctggctgcttgatgaaggacaaaggccatgatggggtcaaggagctggacagcctaaacagtgaccgattgagaaccgtccagctcaatgtctgcagcagcgaagaggtggagaaagtggtgggtcagaacataag

SEQ ID NO: 687658 - DNA, 400 bp, Homo sapiens
ggattagcagctactctgactactcaagacaaactggaaacctggatattagtgtaagagtttcagatctttataattccatgtgagtgagacaatagtcctcttgccaggatggggcaggtaagtatctatctagaatgtgctgggggtgctagtctcaatacttccatgagtaaaacctaaaataacagagtgaagaacaggaacaacaacaacaagctgtttcagctactctccctccctcaccatactggtgaattactgtagcgattctgtaagagcggaaaaagtgggatgtaacatgacaccatcttctacgtgtatcattatcgctgtgtggaaattgagatacgtgtatagtcccaacctattcagatggggggtatccaaaagagaaagg

SEQ ID NO: 687659 - DNA, 242 bp, Homo sapiens
actaatataagatacctgcgtgagcgtctgcggattccgcttccagcatcagccgatgataatctcaagacaccttccgagcgtcagctcactccccttcacaccgctcagctccaccctcgtgcagatgataatatcaagacacctgccgagtgtctgtgggagctgattccaagcctcagcggatgataatctcaagacagcttccgagcgtcagctcactccccttacaccctgagatc

SEQ ID NO: 687660 - DNA, 124 bp, Homo sapiens
tcccccgcaatcgggtaagccgggcgcgtggcgcgtgctgtagtcccagctactcgggaggctgaggctggaggatcgcttgagtccaggagttctgggctgtagtgcgttacgccgatgcggg

SEQ ID NO: 687661 - DNA, 467 bp, Homo sapiens
cagtgagccgagatcatgccactgcacttcagcctggacaacacagcaagactccgtctcaaaaaaaaaaaaggatttctcctatgaaagcccagcttattaaatttggcccatctttctggtatatgtaggtcattttggatacatattctatccctcttaggttacagccatcagcaactattactggtgtgcttgctatgtcctcatctgcaaatagaaaagactttttattagacaggatggataacagagcctgcacctcccccaagatctcctgccccatagccagcctctctgggatgtagttgtgtccatttaaaagcaaagtgttggtgttttcccattatgtccctttagagagtaattgtatctctaaagacatgaaggcaacgtgtgtctgatggtggcatttcaactttatggcacaaggatggaggtgaaatacaggacattcagtgccttaa

SEQ ID NO: 687662 - DNA, 638 bp, Homo sapiens
atcgcacaagtgaaagatgtgtacgtggtgacagatcagattcctgtgtctgtgactatgttccagaagaaggatcgaaattcatccgacgaagaccttccgtcaaagagtctcgcccagttatgtttgatgtcctgattgcatgatcctagctcactgcctcaattattctaccagtgtaagctacaagtggagcttcggggataatactggcctgttggtttgcagcaatcatactgtgaatcagaggtatggtgcctcaaatggaaccattcagccgttagacctcaacgtgtgagaagcatgcatgcacgcgatggaccgtgtggtccgactaccggccagcacgcaccgcgagagctttcataaaccctaggccgcgttcatttaggcaactagtcgtaaaatcttatgggttcaatagcaggcccaaggacctgctggtgataacccccgtggagctgagtaggattcctggatgaagagactgcctggcattcaacagatatggccactttcgagccatcatcaacaatttgtagcagggaatcttagcaggttaacatcatccagatgacagaggtccgtgatgccggtgccatggctgaaagctcctaatagacttggtcgtgactgca

SEQ ID NO: 687663 - DNA, 393 bp, Homo sapiens
  misc_feature (29)..(29): n is a, c, g, or t
  misc_feature (45)..(45): n is a, c, g, or t
aactataaactcccctgtgcttgtattgnaagctatggccgtganaatgtacagtgtgtaagtctatttcattgcccattcccatcagataccagttgacttcatctcccacgtgattgctttctatgaattcctcatcatctttgttacttttctcggggtgatcagagtatgttttgatgttgtcatctaagtaccaagattcattctcatcaacaactagaacaagaagggcaaattccagttttctttgtgggattgaaactttccaagtaggtttttcgacaaacaatcaggggcccaattaatcccctgagagggcctttactttgacccccagttgaataataggcccatgaaatacaaccagaatccttggttccggctggtgcg

SEQ ID NO: 687664 - DNA, 185 bp, Homo sapiens
  misc_feature (89)..(89): n is a, c, g, or t
tgggtcgttcttcggtgggtcgttcttcggtcggtcgttcttcggtcggtcgttcttcggtgggtcgttcttcggtgggtcgttcttcngtgggtcgttcttgggtgggtgtgggtataatactaattgagatgatatcatttaccggggaaggcgctttgtgaagtaagccttatttctcttgt

SEQ ID NO: 687665 - DNA, 104 bp, Homo sapiens
tctaacactctaggggcaccacagcctaattattagcatcatccctctactactttttaaccaaatcaacaacaacctatttagctgttccccccattaaaaat

SEQ ID NO: 687666 - DNA, 173 bp, Homo sapiens
actgaaatctaccttgaagagtctcctgatcctggtggtaataagaaccatacaatacaacatgacaaggacacgagacatgtaccctcacacaaattgtttggcagcttaagcaaatatagtcggcacagatatacgaacacaccatcagatatgctgcccagaggatcatc

SEQ ID NO: 687667 - DNA, 474 bp, Homo sapiens
ttccgcacagcctgtaactactgcaaactcttcccgtgaaccctatctcttaccgtggtagtgtcctattttaggtaggtctctgcaaacttaatagcatcaaactgggccatcttctcacacagtttcacttcgcccaagacagcccggaactggggctggttaatgcaggtgaggaaccagcggttggtattgggaaaggcctggcggaaagaaggctctagaacctgcttatagagccacaacagggtgcatgatgcccaatgtggggaacacccaggtactggctaggggcactatatcggaatcagcaaagctcacccactgcaccacctgggctgctgcctctggagtacttccccgcagctcctcattgctcacatagtaggcaatggcgttgctctcaaacacacagaatccatcatcaccctcaaatgctgggaccttgccggcaaggagaacgcgtacaaatcg

SEQ ID NO: 687668 - DNA, 758 bp, Homo sapiens
cggtaacgcgcgcgggcaggtgtcgaccatgagcgtcgggtcgcacgggtagcgtgggtcaggtgcttgggcgccagctaccgccgcggcgcctcgagcttcccggtgcctccgccgggcgcccaggtgtagcggagctgctgcgagatgcgaccggggcggaggaggaggcgccctgtgtgcggcgactggagctggctgaatgcctggtgccaggtgctccagtgctgctcttccctggtgccagtggcagccacggtggtggtgcatgggtccgctgtgtctgcttcaactacccggcgcgtccgcagaactctacgccgccgcctgccgcgtgctgtgggctacggacctggcttggaacttgagccttgcacggggccgcaggagaccctggacctgcaccgttgcacattgtcatgcccggctgatcttcggttggcatctgctggccggcttgttcgaggaaagctactatcacgctgcagcccatcggtgattgaggacactgtgttgctgctgctggattcagtgtgggagagtttgcagccctagtgtttgccggagccatggaaatttgctgaaggttagtatgcagtgaaaatccgagctgaggccatgcaggaagcttcagaagctgtccccagttgggatgctgtcttgtcctcggccaggctcagtccaagttcaacttcgcctgtttggaagcccgggaacactgcaaggatcgtttaggcatagagaacgccgtatgttag

SEQ ID NO: 687669 - DNA, 325 bp, Homo sapiens
atgcttatagttgaacagcccaagctatatgttatggcttatttgtgttgaagagtcactaagaagtggtgtgccattgatcttcagagtacatccatgcggagtccatctatgtgagtttgacatttaataactttgctggaaaatctgtaaaaaagaaaaacaagtttgctagtgactaagccccgcctatgtgagtgaaagtacttcaggcacgctgcctcctggtaacagctatgcagggagggaggacccacactgctacacttctgatcccctttggttttactacccaaatctaaatagatacttttgataatagata

SEQ ID NO: 687670 - DNA, 112 bp, Homo sapiens
ttcatgagagcagtggaattgtaggcagggaatacgtgatctcgatgtgagtgaagaagtagagcaagaggagaaatgggaaggtgcgtacctacggaatcaccacagtacg

SEQ ID NO: 687671 - DNA, 742 bp, Homo sapiens
  misc_feature (390)..(390): n is a, c, g, or t
  misc_feature (742)..(742): n is a, c, g, or t
cagatttttctcatcaaaaatgtattccagaggcaatcaggtggattacagtttcttgctgcattgaaaatgcacttataaagaaataacatgtagagctccagactgttgtaaaatatacagagggagcaggggaaagttaagcatgtgctagtgtctgaacccggtttcagttgtatctccagtttgaaagtgatatacactatagttatgtagtaacactgtagtacagcagcttcctatatgtagtccacatatatatagtgtatatattataacatgtatacggtcgttgtatatgtagcatatagtagcacatcagtgcagcattaagcaagaagtcaagagtgcgtcacttacataatcctacgatgctcatatacaaaaccnagatgctaaaacaaacagcagcggaggaaacaaggttggacgtctctgcaacgtgatcagaaggagtaaaaacgggctacttgcagtcgactattgggtcattatctgtaatgttcgatagtcgcaattgggatgggtccacacggtgacaaacaagggaagcaggtgttaagtggaaaataggaaaaaatggcgcgaagaccatctttgatccgaatgccgaattgccagctagtgttctatagtaccatctcgagttcaggtcatccctccaagcccactgttgactcgcactccccgtctccggcttatggcacgactttcttaactcgaccgcccacaaaacatgagn

SEQ ID NO: 687672 - DNA, 215 bp, Homo sapiens
gaagtaacaatcgtctttaaaccctgcgtggcaatccctgacgcaccgccgtgatgccagggaagacaggcgactggagtccactacttcttaagatcatccactattgatgattatcgaatgttcattgtggagcagacatgtggctcagcagatgcagcagatcgcatgtccttcgcggaagctgtgtctgatggcagacacatgatgcgcag

SEQ ID NO: 687673 - DNA, 541 bp, Homo sapiens
atggtatacaacgaggaccagatcaacagaggcatactctaccctcaccgtaccccatcgatacacagcatcgtcgccaacagagacgacatggataaaatctggcaccacacctaactacaatgagctgcgtgtggctcccgacgagcaccccgtgcggcagaccgaggcccccctgaaccccaaggccggccgagagaagatgacccagatcatgttagagaccttcaacaccccaaacatgtacagtagccataccaggctgtgctatccctgtacgcctctagccgtaccactggacatcgtgatggactccggtgacggggtcacccaacactgtgacccatctacgaggggtatgccctcccccatgccatcctgcgtactggacctggctggccgggcacctgactgactacctcatgaagatcctcaccgagcgcggatacagctacaccagcaaggaacgagcgggacatcgtgcgtgacattaaggagaagctgtgctacgtcgccctggacttcgagcaagagattccac

SEQ ID NO: 687674 - DNA, 113 bp, Homo sapiens
tccaagaccctagccacccgcagcagattgcactccttgaccagacataaacattggcagagtctgcctgcagttgctatacactgccatgaggctggtggtaacccaaagca

SEQ ID NO: 687675 - DNA, 463 bp, Homo sapiens
agtatgaggctaggataccgggctcgatctcagtagtcagtctgatagctagtcagagaggggtctggagaacatcataagcacgtagttgggagtctccaattacggcatatggggaagaggtttgggaaagaagaactgtgggtaaggggtctctatgagactagacagaaaaaaattctcttaaatgactggagcatgactttaaagctgatactaaataatttatttcggcctaacctttcataagacttttaaaactatatgaggaatacccattggtaagagatgattggcccttcctaagggatatcataagtacaaaattataacccttagaatagcaagccagagaggtacagggatctcggtccgtgcgaccctttaaaactagccccggccaggggtgggggcacagggccggtggtctcagctactggagaggctgaggcaagaggatcac

SEQ ID NO: 687676 - DNA, 214 bp, Homo sapiens
cggggttctcagtcagcctaaagcccgtgacagcaaatctgatagacgtcagaggccagctccctcaaggcactgatggcgactgtgccagagagggtggctggcttccccaagatcacacagcaggcgctgggcccttggcagagtcggaagcagctcctcccattgcccctgccaaagcagtcactgcgcattcaagtctgggatctgagcc

SEQ ID NO: 687677 - DNA, 382 bp, Homo sapiens
  misc_feature (19)..(19): n is a, c, g, or t
  misc_feature (60)..(60): n is a, c, g, or t
  misc_feature (76)..(76): n is a, c, g, or t
taaaagaacccgtaagggnaagaaaccctatgttggagcaggtaggaaacagcatccccnggacgccccggattcngcaacaagcagttaaaagtatagagcctgcccaggtcaggggatggttactttgtgtaaactttgtagaacatttacaacattcttagaagtggtgaactgatgccacctgaagagtctatactgaagcctatgaccttccctgttcccccaactgaggactcttctccttttaatcaaagcagtcaatttaattacatctacattgagaaagtatcactagatatcttttgctatcttgtttcctaggaggaaaatagatcataaagaaatgtgtcatataatccctgctgtcaaaacaaaataa

SEQ ID NO: 687678 - DNA, 993 bp, Homo sapiens
ggtgggatctcaaaagcttgccctgagaagcatttcgctttaaaatggcaagtggagcagccaacgtggtgggacgcaaaatctgccgtggcaagcataatgttttaatgcagtggtgttcaagcaatcaatgttggcaagcagggcatcgaatgttagcacttggacaacatgggtaaaaatatggagcaagatattcagacacttaacatatatattgacaattgtggagtgcacgcagcatcgtgtgcgaccgatgttcatatgcagattatcttgaaagcgccatattacgaaggcatgtgaaactaaatagatatttcaagtgggcaacaattaccgaatgcattggcaaacatagccgaagacattcaattgactgaaggacatcggctggaactcagttgactggatatgtgtcgggaagacaacaatcataatgtactaagtgcttgagatatttaagacgaacaaacatggaggtcattcttgtgcgtggagacagggccattacagacaaaagaagaccctatttgacacagatacgataaatgaacaagtacaggagtacaaatcaaagtattgacaggatgtgcctgaacgttgtacgacatgggacaaggcattgctattacaccgcaagacagccaaggacataactgggacacctgttgtgcacgcagcacttctgacagcacaacggcgcgacctttatccacctcctttcaatggcgaagaagcacgaactaccacattgcggccagcacggccaacttggctggcttaaacacttacgttccttcacaccgacacggccacttgtccagttcgccaaccaccaatatgcgcgttgctgtcttgtccagatgtgaacggattacatttggcatcacttcgatagcgactgggacgctaaggtcaacagaggcacataccacattacgaacttatcatggacattaccaacgagattacgacatgtcaggcacagta

SEQ ID NO: 687679 - DNA, 400 bp, Homo sapiens
ctcgtcctaaaaaaaaagacaagaaaagaaatataagtgaaatcctacctttatttaaaaaaaaaaagggggccgggtacaggggctcacgcctggtaatcctaacactcggggaggctgaggggggcagatcacttgagattagaagtgggagaccagccgggccaaggtgacaaattcacttccatctgtactagaaatacataaattacgccaggtgtggtggcgggggcctgtaatcccagttactcaggaggctcaggcaggagaatcgcttgaacccggggaggcagacacggcaatgagctgagatagtgctacggcactccagctggggcgacagagttgagactccatctcaaaaacaaaccttaacatttttggtggcgggtggttccat

SEQ ID NO: 687680 - DNA, 219 bp, Homo sapiens
aatagcaggtgtgacgtggacaaaattcctgggttactaggtgtcttgcagaagctgatggcatccaaagcaaatgaccaccaacggttatgtatcttctacaactgtataatacgagcacatgcctccgtgaatcagttgaccaataataggaaacaaatcttcattctgctcatccagagcactcagaataccaaaacaaccaagtgtatcaagagt

SEQ ID NO: 687681 - DNA, 821 bp, Homo sapiens
  misc_feature (52)..(52): n is a, c, g, or t
  misc_feature (494)..(494): n is a, c, g, or t
ggagagttctggtgttcctcatcttcgacagcatttggtgtgttcaccgttntgtgttttagccattctgataggtttacagtgatatctcgttttaatgtgcaattccctcacaacaaatgattttgagcatctttctcatatgcttatttgccatctttatatcttattaatgaggtgttcagatctttcaccttttttttttttttgggctgtggggtggttaagtcctcagaaattctccattttttggggccgagcggtttttcccatcgagaattttgtgggaaatttttttcccccgagttgtgggggatgggcttttccacatttctctggaaccaggtggtcttccaccacacaaccaggaggtttcacaatcttaaagggagggctacaattaaaatattttttcacataagcgaaggagaggtcgcttgggcgttgggtcatctaaagaaggccttcttggacccagggatccctaagaattntctcatatagaactctctaagggactcctaatgggttgggccccttaatttacagtgtggaaaagattccattttaactagagggttataatacactggctttccgcgggagtcgactcaattgcggcagtgtgggttgccacgttgttcattacaccaattttttggggcaggggactatcgtggggggttaaagttggctttaaccctccgtggaggaccccgggctgtattttcgcctgtttgtggcccggatctcaaggctcaagtggtggggttccttttccccaaattccacattggggtccgacatagtacctgaatggg

SEQ ID NO: 687682 - DNA, 221 bp, Homo sapiens
  misc_feature (126)..(126): n is a, c, g, or t
caattttataaccttatgaaatagctttcactttataagggaagataatatataccatctcagaagcagcaagtatatctattcaacagatacttgttgaatacggtgagagcttgacaaacgtcnaggagctaagaaacataaaacgatgacaacaaagaaaagagagagtttagagagttgcttttagagagtgtgaaagcttgttgaggaatcagagt

SEQ ID NO: 687683 - DNA, 878 bp, Homo sapiens
tttcttgtgttttgtgttttctctcttaggggtccttctgttcgggtccaggttcctggctcctgttggtggttgaggcctgtctgcattcgttggtattcgttttattgttgtcccccgtgtcttctttcgtgtagttgtccctcttttccgtattttctgtgcccctttctctagttcagtttgtgatcgccaggcgtctctcccacatggtccccatatactccctgaagagaccgaatcagcgctcatccagtgcgccagaaagatatagacacagagtggggtacacttcagaaggacagcacatatggcggcgtgaagattctgcgggacacacgagaatcgagctgaggatgggatggacagagcacaaggaagcacagagaatgtccccctgctcgcaggaggagaaatggggaagaccacgtatgcacggctcctacagggatgagaacacaggcgagcacgagaggagacacccaggagcacatcttgatctgctctatgtccactgagcctcaccaaagatttattccatgggcaagcaacttcatattctttacaggggagatcatctggggacagagcggcgggaaacatcatcactcgatactgtcacacgcacgcttctaatggggggctcgaggactatatgagtgaccgggttcagtgtgtgagcacagcacaggaatgggatcccagctttgaggaggcccttgatggactaacccctctctggcattcgttcgtccccgatggatatacacttgcgagtgagagacaagaagttacttcactcaccaagctctataggggtgtgccgccaggcatgaagtatgtgctatacacacacatacacacagacacaatcaaat

SEQ ID NO: 687684 - DNA, 434 bp, Homo sapiens
actgggatcctcgcaataaccgaccagtgcaggaacatatgagtagacagtcttgcactctacagacggttctaagagggggctgtgttgctccgtgcagagaggctggaactgagtgcagcaaggcacgagtgccctcagggtccctgggcaagactgagtgtcaccgtaaggaacagaggtcttagctgcgggtctaggctcgtgatcctacatcttctagtctaggatgagatctgagtttctagggagtggtcagcacgtacatgcaccatagcagtgctgcagtgagcagagaggacagtacggacggggatgagccatcagtgtgaatgatcacagcagcctgacataggacaatggaaagacagagactagaaatttaagactgtttccatggctgaactgcgagaaataagtgattgattcacaaa

SEQ ID NO: 687685 - DNA, 350 bp, Homo sapiens
  misc_feature (334)..(334): n is a, c, g, or t
gggggtttcaccatgttggccaggttcgtcccaaactcctgacctcaagttatccacccgcctcagcctcccaaagtgctgggattacaggtgtgagccactgtgcctggcccctcgcaccattcctaatccctggtgaaccctaatctgttttccatctatagttttgtcatttcaagactgctatataaggctgagaacggtggtttattcctgtaatcccagcactttggctgggcaggaggattgcttgagaccagggagtttggggaccagcctggggcaatatgggtgagaccttgttcactacaaaaattaaaaataaatattaggntggggcattggtggta

SEQ ID NO: 687686 - DNA, 252 bp, Homo sapiens
gcacccttctggaggtaggcgagttttgtgagcagaactgcgcgtacaacagagggggtctcgatgattgacctcacctcccaggaatccccgtagccccttctcctagagcgagtgagtctctcagaggactaggaagactcttgggtgcccacactcagacgaagttctgggcccaggattctgaagccattctcaccgctgtcaacagctcaaggagaactcacggatgcttcttgacgggtacccgag

SEQ ID NO: 687687 - DNA, 608 bp, Homo sapiens
gggaatggctgtgaaaatgctttgaaaatataaaaccaggccagtcaatatggctcacgcctgtaatcccagcagtttgggaggctgaggcgggaggatcgcctgaggtcaggagttcgggaacgggcctgggccaacaatgggcggaaaaccccattcgatccctaaaaatacaaaaacttagcttggacatggtggctgtgggcctggtagtccacacctacccatggaggctgtaggcaaggagaaatcggctgggaccccgttgagggcatgagggctggtaagttgaggccggaggatttggtggcccaactggcgaacttcacaggccctggaagttgaacggaagcaaagaacttccatcctcaagaaaaaaacaaaaagaagggagcaagggcagaatttttttaacagcgcaaggcacaagaggggccaatatagggagaactcaagggctcagtgtgggtcacagacagcacatcaggggaactagaagctcaggttcctgggagcactggtgttgggtattaagggccttgtccacctggggaagaggtggacagggggtgcattttcccctggggcctactagtcccttgagaata

SEQ ID NO: 687688 - DNA, 888 bp, Homo sapiens
ggccgcttccggcacaaaccaacctgcgtctcacagcaagattcacaagcgatccgaggggtcggccaggccgcccccggcccggggagcccccagctgccagccggccccaggagtccgcggcgagcccaccccggggtacctctgaaaccggcccaggagccgcgccaggggccccgccagagcacccgcaggacccgatcgaagcccccccctccctctacagctgcgacgactgcggcaggagcttccggctggagcgcttcctgcgggcccaccagcggcagcacaccggggagcggccttcacctgcgccgagtgcgggaagaacttcggcaagaagacgcacctggtggcgcactcgcgcgtgcactccggcgagcggccttcgcctgcgaggagtgcgggcgcgcttctcccaggcagccatctggcggcgcatcggcgcgaccacgcccccgatcggccttcgtgtgtcccgactgggcaaggccttccgcacaaacctactggcgggcacgggcatccacacgggagaagcctacgtctgcccgatgggaaagcttcagcagaagtcaactggtgtcgcacggcgcattccacacgggcgagcggcctacgcctgtccgactgggacgagttccgccagaagtccaactcatcaccaccgaagagcaatcgggagggcttctggtgtgccactgtggcagacttcgacgacgaggagagattctggccaccgaagagctcgagttggacggggggcggttgggaagagggggggcctcgggggaggcaggcggggcgcgagcaatgggtggggggaccaggggcgaccggggggcccacaacagccaggtgctctacacgggggcgtcctccggccga

SEQ ID NO: 687689 - DNA, 270 bp, Homo sapiens
  misc_feature (33)..(33): n is a, c, g, or t
  misc_feature (36)..(36): n is a, c, g, or t
  misc_feature (117)..(117): n is a, c, g, or t
  misc_feature (179)..(179): n is a, c, g, or t
  misc_feature (209)..(209): n is a, c, g, or t
accgcagagaatttcggggtctacccagacagnagntcaccccatggagactttctactaggggacttgaaagaggactgaggggcccaaaaataaacttcaccttccattaagtgntcaagcatgtctgcaaattaggggggagtttgaaaaagtctttttcatcctttgtggtgaancctgaaattgtgccgtgttgccttatatgnatatgcagtatggggctttggaataatgattcataataaaatactaaacgtgtgtcttcaa

SEQ ID NO: 687690 - DNA, 534 bp, Homo sapiens
cggaccttataagcagacagaaggggagacgacaagaattggaagacaatgttgaagatgaagcccacagtgggcagaccatctgcatcaatttttaaggaaaaaattaatcttgttcatgccttaattgaagagggccaatgattaaccgaaaaaataacagccaacaccacagacatctcaattggttcagcttacacaattctgactgaaaaattaaagttgagcaaattttccacttggtaggtgccaaaaccattgcacttcgtatcagctgcagacaaaagcagagcattcaatggatgttgcaaacaagtgggatcaagatcccaaagcatttcttcaaagaattgtaaagagatgaaacatggctttaccagtatgatcatgaagacaaagcacaatcaaagcaatggctaccaagatgtagaggtggcccatcaaagcaaaagtggattagtgatgagcaaaggtcatggcaacagtttttgagaatgctcaaagcattttgcttgttgactttctggagagcca

SEQ ID NO: 687691 - DNA, 100 bp, Homo sapiens
gtcacaccgaaccagaaattcacagctcatactgttctcacctggtatacttgagaaaacggctacatgatgagcgggaacggtaggcagaaaggtaaag

SEQ ID NO: 687692 - DNA, 332 bp, Homo sapiens
ccggggttttttttttccgggggggaaaattccccaaaatgggttttaaaaatttgttttttttttaaaaaaggttttatttttccccctttcaccttcccaaaagattttaagggggggggccaaaattttttgggttttttttccccaaggttaaaatttttgggggattattttttcctttttcccccctttcccccggttttttaaaaagaaaaaaaaaaagggggcttaaaacaaattttttttttttattttttttggggggggaacccaaggccttttttttttttaaaaatgggttttttttaaaaaaaagggattccctttta

SEQ ID NO: 687693 - DNA, 323 bp, Homo sapiens
tgtgagccactgcacccagctctatggctatcatcagtatctgcacgagaggggacctatctatggaggccagtctgcagtgcaatgtgatgatcgtcgactcactgcaacactccaccttccagggtcaagcgaatcttccgacccagcctccccagtagctgggatcataggcacccgccatcatgccccgctaatttttgcattttttgtagagacagggtatcaccatgttggccaggctggtcttgaactccttcctgacctcaggttatccgcccacctcggcctcccaaaattctgggattacaggcgtgagccac

SEQ ID NO: 687694 - DNA, 818 bp, Homo sapiens
  misc_feature (504)..(504): n is a, c, g, or t
agcggttgcagtgagccgagacctcaccactgcactccagcctgggcaataagagtgagactctggctcaaaaaaaaaaaaaaaaagatgataatgaaattagccacagaatagcacagatgaagtgactttgctcaagaatcaaccagccagttaagttcatagaaacggggattgtgaaccccttagtgtggttcttacccagaaaatgtgtgctaatctttataaggaaggttgacgaatggggttttagaaaaattcgtgcagaaaactctcaaccatcccaaattgtggtggaaaatacttttatacacgtgaattataagtttctatcacgagaacttgtgtgttctatactctccaaatgaacaaaggcttctcccttttttattctccgaagaaccgagggttcctaggctcttgtttctcccaaggcctggaaggctccaagtgtggctctccaaggcgggctcagccttgcagggtcttcaaaccttcccaagngctttaaagccgggctcctatacccaccttcagaaccttcctgtgaagtgtagctgtgaagaactgtgccgagaaattgccgtttggccaaccaagtgcctgtggggctataaaaatatttgttatgtcacacctatctgtgggggtggaaagaaaccgagagtgtctctctcacacctaagtggtttggggcccagaggccgtggggctctcctcaaagagtctccggtggaacccctcaaaaactgtgacactcatatccggtgaccccctcggaggcctttccccgagaaagcccacggtggggaaattca

SEQ ID NO: 687695 - DNA, 859 bp, Homo sapiens
ggacgcgtgggtccacgccgtatcctgttgtgcgaacagcggttggaaggatctgggtgtgttggtatcctttattcacagggaggagtacagcttatatctcattccattcgatggggatctcttatccatggaatcagagggtgcattcaaagagtgctacctggagggtgaccagacgagcctgtaccactgcagccaaggaggcttgatgaccctgcaagctctgtatggaacgatcccccagagtctttgcggcaacagcgagaatgcgctcgggacagtggccaatatgcatgatcgaggatgacgagagagtttacatggaagccagaattcaatatctcctgttttggataatctcttgttgcttgatcggaatgtggattttattacacgacctcgtgtgccagctcaggctgacatatggaatggactcattgatgacaatttctggcatccagaacagtctatggtgaacattacctccagcagaaatttgcacctataggaaaccagggcgatggtggtcaaggacctccccgacggaagcaacacgaagctgcagctgaattcgtgcagaggagctctatgctgaggatcccgatgatgatgaaccttcaagccgcagttgggcgtcttggtgctcaggcacagaagcgcaacagatcaattctctggtcagcattcgacggaaagggaggcacaatggcgtaagaccgtgggcgggacgaatcaaggcagtcttggtttgccctgttggcccacaatgtctgggcagacaatggggggctcgtcttgcaaagtcattatcttcaattgccgaaattgaaccccagggtggtggactaaacttctt

SEQ ID NO: 687696 - DNA, 1016 bp, Homo sapiens
tttctgaggttggtccgagacctcagtgctcaccctcttcgtgtgaccaggaaacataaccctagctgtaagcgagtgacatgggtatttacccttcctcatcatgatcttctgccctcgttccttctgtttcttgtggtgcgtttcaagatacactcaacacgacagttctcgacaaaattaatgatatgaaccttaagcgtgtagattcgtaacactgaaacgttcccctcagttactaactgtctatggttatctccctgatcgtgtcatttgttatctcgtagaggcagttccatagcgtattaaaagaccattgtgagacatgcaatcggtgtatttgggaacgtgttagaaatgactctgaaattccgacgcctgttttcatcacggaacatcgcccacatagcagatatactgtctggtaagcttaacaatacatcgtaacccctgctcgtcctttgttgtaattagtttatttctgagtgtacatcaatttttttgtctctattaaccttcgaatagcagagagagtaaactcatataggagtttagtgacaaatcgttagccgatgaacaatattttatggccccccctcgagggatagttgccctgctagatgcctagacaagttcatctctaccaggaaagtaactcggaaaacctctagagggggaatgttgctcctttgctgccaatgggacttgttcattcaagcataggagtattgaccaatttcatcgaagcgagtagagctagattagagagtttcccttgtaacgttatctagttcagtgctcggctcctttggttcccatgtcgtttaattgaatggaacttgccgaaaggaacctctcctagtaggtggaaaattcctaaagcaccatatcgctccaaggagggcaaaatctcggttttccccacctaaaccgttaaaccctggaaatagcaagggattcacccaacccaaatgggatttccccttctccttaccccctctacttccccacgcgcg

SEQ ID NO: 687697 - DNA, 502 bp, Homo sapiens
  misc_feature (428)..(428): n is a, c, g, or t
  misc_feature (441)..(441): n is a, c, g, or t
  misc_feature (463)..(463): n is a, c, g, or t
cctgtgagtagttcctccctgctcacaactcagggagcttttggcagggtaggaaggcccgggaagtgaatggtgtttggaggcactgtcttcaaaaacgtcccaggtccatagagaaggcttgatggtcatagtcgcacacccatctgtatcattcctaggattcttcaacggcttgcagtgctctctcctgctggtgtcagcacagccctgtagtgtggcctggcatctgtccttcccctctggatggttgatgggaacctttattgtcccttccccacttatccagtttttagtccaggtctagtacatgcatagaggcttcacttgccatctacctgaattctaacagtagcagccattcattttttccaggggcttactgtaggccagggaaatatggttaagcaccaagtgttgtggccctnttcatttaaggcntcacaacacacctgtgtgggtnacatcttattcatcatccccatttttacatttggggatg

SEQ ID NO: 687698 - DNA, 1097 bp, Homo sapiens
  misc_feature (626)..(626): n is a, c, g, or t
gatcacttgaacctgggaggcagaggttacagtgagccgagatcgcatcactgcactccagcctgggtaacagagcaagactctgtctcaaaaaaaaaaaaaaaaaaaaaaaaaaaaaagggaaagccaaaaaattttttttaagggccataaccccaaaacttacaaaaattggctttgaaaatttttaaaaaaataaatttcggggggaaataaaccgtgtgcgggggctcaaaacgagttggttaagtgttaaaagacgaagatccagttctttcacgtaaatgtggatcctcccgagatcccaaggcatttgctgattaaacaatatccccaggtgggctgttggggtcagaattttccaaggcctggattcctacccatttgtattgggtgactggtccatggattcagcacaatgattaactatcgccattttttcgacaccaattaggggggaatgcatttccacaaccatatttcccagaaatttcctcaagggcctatgaaaactctcaccggattctgtggcggctgcggtgtggaaccaccacaaacctttagaataaatattcttctccgggcgtcaggaagaagaggacagtctcccgaaaattacaattgcntccccctggtttgtgcctcataaaggggaagtctgtgagggcagcttttattttttgtgtgttttatactgccccccaagaaacatcgcagccccaatcccgtctgtgtcgttccgtggggcgcgcgggggctactacctcataattaatatatgtactacggccggattcagaacacatcatttccaaccgctgcaaatgcccagcaatgtacagtccatgtactgatacccacgcccgccacgtatatatataagtgacgcctggcataaacaggaaccaacacggataatgctattctattgcccagaacaatatgcgatcaatagtaacggaacactccttgacacatctacacacagacacacgcaccactagaaatcatgagcggcgagacccgcacaccttaacgttcagcgcagtacactcaaaaacgatacgtagcattaatgactcgcgtcactagtcaac

SEQ ID NO: 687699 - DNA, 614 bp, Homo sapiens
gttcttcagtgtgtgaaaaatactgaggatgcatcttgcacatttgcgatctgagccattcgttgtggttgttttagcttcttgagctcttgtggattatgtcatcatacatgactcagcatacctgctggtgcacagattaagattttgcaaggtccttcacaatcaggtctatgccaaagacggaagcctttttcctctaagtcttaaaataacttatatcatcaacatacctctattgtgatctatcaatagtaaagaaaaattattgtatatgaatagaatgaaaaatgtactggaaggtactatactgtaatcctcatatgatccttttatgttatgcatgtattggtaacatatctttgtattgaaaaatgatcagaccatagctatcttattacaacatgcaactgacaaaacgtgaatgctcaagacatttacagagcggttcattctcaaatgagatgcatgaggcacagagaagggaagtatgctcagagattacctcttgcaaaattcgccacgaaagttgaggtcaccgccggctaagcctggatgacagcttctcctcattgtgtcaggcatatgccttgccaaggtgccagggattcctg

SEQ ID NO: 687700 - DNA, 720 bp, Homo sapiens
gaacatagacataatcgccgtcataatgtccgcaggccgttgacttgattgtcattgaacattgatgatcataggatatctatatgtatgactctgcgaggtgactgtatttccatggtcagctataagttgtgcctaatatccgcataccagtaatagaggtccaagactagaggtccagaccttgtcgtagagttagtccgtacctataatttactgacgcgttatactgtaacgataccaaatgtcgatactttccgttcagcataagcttctagtgacgtacgtggccactttcgaatattcgagaaggtcgttccgagaaaaacaggacataatggcctctctataagaatacctaggtatgtatcctggtgagtaatggattcctttgcacggtctgtgccttccgtgagtaccttcgtggaacttcttctcgtgtcctcttctatctaattcctgaaacgctgtagtgatatcatgctggcagagttgcagtcgaggagctcggtacactatgctttaccgttcccttagggcgtgctttgcggtacctccgtggattgcttggtgtatcctgaagcaagttttgattaaagctaggagagtatacgctcatttgacgggccatactgtgggcccaagagtaaaattgagagataaggcctcctgggtgactctgtaacaaaaggcccgggtctcgatgcaacgagtttatcc

SEQ ID NO: 687701 - DNA, 113 bp, Homo sapiens
  misc_feature (5)..(5): n is a, c, g, or t
  misc_feature (82)..(82): n is a, c, g, or t
  misc_feature (90)..(90): n is a, c, g, or t
ccaantctacaagaatgtgtacacagagatctaggagcaagaacaaagaagatgaaaggacgcaaggtgaagaaaagtctcngagttgcncacagtgtgggagaacattacca

SEQ ID NO: 687702 - DNA, 141 bp, Homo sapiens
ctagagctacttgtgagtgaatcattggcttctagaaatcagatgcccagatgatccaaggactagtttgtgtatctcatcttggaccctacaccaagagatgcagtcagcgatcttagaggtaaaatggtcatgggggct

SEQ ID NO: 687703 - DNA, 559 bp, Homo sapiens
  misc_feature (27)..(27): n is a, c, g, or t
  misc_feature (51)..(51): n is a, c, g, or t
tcaaagcacccccacatttccttaggntaaagcttatccagagcaaggccntcgtttcaattctgtgaagcctaagagaggtgatgaagctgcagaagaaaaattggaagctagcagaggttggttcctgtggtttagggaaagaagccatctccatgagtgcagaatgaagcagcaagtgctgatgtagaagctgctgcaagttacccagaagatctagctaagatcattgatgcagatgactaaacagattgtcagtgtagaggaaacagccttccattggaagaaggtgccgtctaggactttcataactagagagaagacaacatctgctttgaaaggacatgctaactctcattagtggataatgcagctggtcacttttaagtggaagctagtgctcatttatcattctgataatcctaggacccttagaatttgctgaatctactctgcctgtgctttataaatggaacaacaaagcctggatgacagcatgtctgtttacatcatagtgtactgagtattttaagcccactgttgggaccgactgctcagg

SEQ ID NO: 687704 - DNA, 273 bp, Homo sapiens
tgaacattctgtccgaattgatccaagtacttgaacaacggagcaagttaccctagggataccagcgctatcctattctagagtccatatctaacaatacggtgtacgacctcgatgttggtatcacggacatcccgagtggtgcagccgctattgaagtgttcgttagttcaacgagttaagagtcctacgtgatctgagttcagaccggactaatccaggtcggtcgctatctacttcacattcctccctgtactataggacacgaagtgt

SEQ ID NO: 687705 - DNA, 891 bp, Homo sapiens
  misc_feature (584)..(584): n is a, c, g, or t
  misc_feature (641)..(641): n is a, c, g, or t
  misc_feature (706)..(706): n is a, c, g, or t
  misc_feature (710)..(711): n is a, c, g, or t
  misc_feature (722)..(722): n is a, c, g, or t
  misc_feature (731)..(731): n is a, c, g, or t
gaggattatggagtttctgagcgagaagtttgccctcaagagccctccgagtaaaaacagtgacttttacatgggcgcaggaggtcctctggagcacgttatggagacgctggacaatgagtccttttacagcaaagcgtctgcaggcaaatgcgtgcaggccttcggacccctgccccgcgccgagcatcacgtgcgcttggagaggacctcgccctgtcaggacagcagcgtgaactatgggatcactaaagtagaaggacagccccttcacaccgaactgaatagagctatggacaactgtaacagtctccgaatgtctcccgtgaaagggatgcaagagaagggagagctggatgaacttggggataaatgtgatagcaatgtatccagcagtaagaaacggaggcaccgaaccaccttcaccagtttgcagctagaggagctggagaaagtctttcagaaaactcattacccggatgtgtatgtcagagaacagcttgctctgaggacagagctcactgaggccagggtccaggtttggtttcaaaatcgaagggccaaatggagaaaaagggaacgtnatggccaaatacaacaagcgaaaagccatttgctgccacctatgatatatcagtttngccaaggactgacagcttaccacagattccgaaccattgtgggcggaatgcagggggtctgggtnctcnntgctgttccantgaacttcntcgttgaactttttatgctcgagatccgttacgggtgtacccccaacatatccgcccaaattttggcttctctgggccgcacgctgaaaccagttaggggctcctcgaaagacccatggggacactttgaatatccagtggggctaagcaccaccctaac

SEQ ID NO: 687706 - DNA, 134 bp, Homo sapiens
gatcagcctcaggatgaaaataccggaaaaagtaactacaagtcaaggaggagcatatcaagaataaaacgaaagtcagccgggcatggatggctcacacctgtaatctcagcacttcgggagcccaaggtggg

SEQ ID NO: 687707 - DNA, 101 bp, Homo sapiens
agaaaacaacaaaccaacaaaagactacaggaagcagacagtatgcctatgtcgccgtggctcagcgaagacgagcgcaggagctaggagcgaggaagcgg

SEQ ID NO: 687708 - DNA, 210 bp, Homo sapiens
tatcaggaacgtgttgagcggtggtgtttgaacatggtggcagcagtgggccctgtgctgaggatgggcacatcttggtcacaggtcgcatgaggttcctgctgcgaagggctaggggatgatcatccatctacatgggtgtgttccggttgaggaaactcagtcccagcaagtgagcttgagaaagggctggctcagccccaatgctct

SEQ ID NO: 687709 - DNA, 800 bp, Homo sapiens
tcatcttgggttcttttttcccaaaaggatcagaatatatggctttagcccctaaataaaaccctcagccctggtttctgttcaaaggacaagcggcaaaggacaccgagtgccctcgatgggcccctcgaggccgaaatcagcaccatacacgggcaaagcgacgacagggcagcaagaacggcggcgtcaacaaagccgggcacaggtgcacaaatacgtgacagaggggagaaacgaaccgcgtgtcacaagaggaagacgcagtcagggggcagagatccccgggcctcgggacagaggccagtatgcgacgcggcacggccacccagcacaatgtagccagcacgagggagggacaccaaatgacgaacaaccgggcacccgctgtgacaaccggtgggaccacgtcgagacagactggcagggccaacaacaagcgctggcaacacagagggtgtaatatgtgggagcccagacgttgcacccactaagcggtcgagaagacgtccgcacgacaggaggatgtcggacaacgagtgcaggcgagcggccacatatggaccgagatggccagcgtggcacgaggagcaatgagacaagcggagacgggcaaacgatcacgctgatgttgcacctggaacggcggcacaagatgtgggccacgagacacgtgctacctgcggcaccgaacgcggcccgcgtggtgcgaagaggatgagatagcatcactgggccgaacgcatgctaacacacgtggtggcacaccatctcaaagaaatcacggagagcacggagac

SEQ ID NO: 687710 - DNA, 672 bp, Homo sapiens
gtgtcactctatctcccagactggggtgcagtggcacagtctcatctgactggaacctacggctttcaggtttaagcaattctagggccttagcctcccaagtagatggtactataggtaagcgtcacgcacccaggtaattcatatatttttattagacacagagtttcaccttgttggccaggctggcctcaaactcctgacctcatgagatctgcctgcctcagcctctgaaagtgctgggattacaggcatgagccactgccacgagccgttgctcccatattgataacgcatgtcaagacaagataatgtctaggtggggccgtataaaccatgatgtggccccctagcgggcagcactgtagctcaaaacatcatatttttgggttacgcaagccccgtgttgcttttgcataccaagatggtgagagggttctggcccacggcttgcaggccaaaaaccctttcactaaccataaaagatgttaaaaagagtttttagggctagctggggacactttgacctctggcaaccccctcttgggttgacggtaaaaatagccccagaggcaagccggcaaggggctttttggccctattctgcggatggtgggctgaggataaacacccgtagggaacccgcttgcacctgacaacaggagggagggg

SEQ ID NO: 687711 - DNA, 1326 bp, Homo sapiens
cgtattttcccggggtatttcgtcttagctccaccgcgctccctcgtttgggttgtgggaccaccccgtgggccagctgggtccccgcgtttcggtatgatttctggggttgctcccctgcacctgggggcacccctgtagtttgggtgcccggggccgaatcttttctgtagatgggggggcttgtctcttctcgcctcctgcagcctttcgtgctgagcctttgtgttttgctgggatgcctgggtggccccccggagatggcttccgttttccgcttattatgggccctttcttcgcgctgtcttgtgtatggctcccaatatgtcctcccggggggtgaattccaaacaggtgttttgtttttatatggggtcgttaaaagggtcactggtgttttcgcggtgtgtagatctccccgcgtgcaatgcttgtaaatggcgccttattgtggcgctcccacaactgtgggcccctcgtggaaaatgttcgctcccacacacaggatccgggtattttgtttatgtcgaccggtggggcgcacaacatttggttcgcccccctggggagacgctttgtgtctttggtcagatcccccactttctttctgatagaagccgcgtccctctggggtctcacaaagggccttcaccaacaaccccctcgtttggttggtaaaactttgtgtgaactaggggagtgctcacacagagcctgtttagatgaggggcttgggaaacacacgccgactttctttgggggcacacagaggatctgggatatctttacacaacaggggtctttcgcttttctctgcggctctttgggaacaccctgtaggtaacccctcctttcctgtcctccatctctcccacaataacacacggggttttttgacaccaggaagtgttaacctctcttgtcgttatagttctcctctcttgtgtgggggcctgacacatttgtcgcgtgtcctttgcgccctctcccacacatgttggaagtgtagagggggcacacaagggagttctctcttcacaatctcttgttgtctcccacacgggcgtctctgtttctcctcccttcttttccttggcgcgtcttgtctcctttgtctgaacttccttgttccttaacccacgcagaacctcacaccctggggtcggggcacatggggaaggggcctaatccacactgcttttcctatgtccttggcaagctggcctaaggtgggcagagcatatataggagggactggttaggagatttgcattgctttgacttcccttttccttggttaataaaccccaaaggcttgtttttcca

SEQ ID NO: 687712 - DNA, 345 bp, Homo sapiens
  misc_feature (180)..(180): n is a, c, g, or t
gagaggttcgtagtgtgctcttcaggtcagggaaactgcttctgccttttcagcccagggtcactgcatcattggccggactcttcccccaacccaaagcagcagcacacatctctctgaccttcatccgttgtccctctcccccagccccatgggacaagggtctccaactcctgaganccatgggattagactaggcctacctggatgatctgggatcctctcccatgtccaggtctctatccctaaacacatcagcaaagtcacttttgccatggaaggtatttgcaggctctgactttgtgtgtattagggcaggacatctttggcggggcagtggtgggg

SEQ ID NO: 687713 - DNA, 422 bp, Homo sapiens
  misc_feature (100)..(100): n is a, c, g, or t
  misc_feature (198)..(198): n is a, c, g, or t
  misc_feature (390)..(390): n is a, c, g, or t
agaatggaaggcagcacatgtttgttgacttcttgctcaatatcgggcactgtgctagataccatacacgccatcaacatttaggacagtatgacaaagnagaatgaaagctgtctcttgtagataggatattttcagccgtcatcaccatggactctttgaaatgtactacttcagaaaagccacagtgactccctntgggcctcacccacctgagatgacatcacgacgcaaatctaggacttacgctcttcatacggatggaatggttggttcacttggctttcagagtgcagacaagccattcagtggagggcatgcctcagcctgcactcttctgactcatgacatgacttctccatggagagccaggatttttctcaagtgtancaatattaattatcaagtcactttaaaacaaa

SEQ ID NO: 687714 - DNA, 209 bp, Homo sapiens
agatttgctaactcagtgtgctaaggccgagaagtggcacttgttttcgcattctgtccatgcgaacttagcctcatggccatacacagccacaaaggagcctgcaagttataacctagttgggccggcgagtgctgggctaccattactatggaagatggcgactgcagacactgccacaactagcatatatgaagctatctcttagt

SEQ ID NO: 687715 - DNA, 231 bp, Homo sapiens
  misc_feature (218)..(218): n is a, c, g, or t
  misc_feature (227)..(227): n is a, c, g, or t
ggccacagactgaaggctgcactgaccattttcctacttttgaggttttgggacttggactgagccgctactggcttccttgctcttcaacttgcagacagcctgtagtgggacttcaccttgtgatcatgctgctgactaacttaatgaactgaacggattaaaatggtgcaaagagaaaaagggcattttttacaccaaaaggaagcattttctgntgttcccgnttaa

SEQ ID NO: 687716 - DNA, 1417 bp, Homo sapiens
  misc_feature (1)..(1): n is a, c, g, or t
nggtgaccaccgtctctgtgtttgtgtctcgcgtggttccctgtgaggaacagcgctctgccttggtggtgggggtgtgtggtgcctcagccgttctggcgcgtctggcggcggtgggggagacccccgcgtggtgctgtctcccttgagaggtatggggtgtgtcaaaggaccgtttagagaccgtctcgttgttcgtgtggggtcgcctcggtgagagggtcttgactctctttttcgttgcgccccctcggtggttgtataggttcttcgccccggggccacaccagggggggcttgtgcgcccgccctcggaggatgcgctgctcgtgttgatggcgaacaacccccgtgtgtggtgtgtaagttgttgccgcccccagtgtgggcgcccccccggttgggttgggttgtgtgccccccggttgtgcccgggtgccgcccccccccgatatgcgggggcgcacaccttccctcagagccgtggtgggacccaggggaagcctttttgtgacagtgcgtgtttgcgccggatatgtgcacagaggggtttgaccacccgggggggtggcctttcggggtctctgtgttggggaccggtgttgtacagcgcccccagtttgctctcagagggacacccagttctcgcggtagggaccggctgtgtttagagggtgtctcccccctgggtccccagaatgacatcccagggtgtacccccgcccactctgggggtctcccccagcgtgtgttgttgtgtgtcccccccacgaaaaagcgggagatgtgttatatatatatctcctctgggggcgcgctcccccacgggcgcacacagggtgttataagcgcgccctgagaatctctatgagagcccctgcgctggagaagcgccccggccccgcttatactctctccctggtgaaaccccctcgggggcccctcgagaactgggctcacgagaactctgtctcgcctgttcttctgtttgctcgcgagatggaatgtgagaaggttcgtgaatgtgaatgtggtgtgagatggcccgcgtgtgaatgtgccccgtggagatggcgccacgctgccctcgtgcacatataccccaacccacgcgtgggaggccctctttgtttgaggccactgaccacgccccgccacgccacggaaataataatggtggtgcctatatttttgtgtggacccacaaaaatttacacctctaagggtttggaagcttatttccaagaaggaaatagttcaccacgagaacaccgcttaacccacaggagctgagcacaccctctcttggagtttcttgaattctcacaagattgggggcacagggctctgtgcttgaaggcccttctgagtcatttgtttagggccttggttccaataaagccctgccccaattgta

SEQ ID NO: 687717 - DNA, 160 bp, Homo sapiens
cccggcagcctgtcaggggatctatggagccgcattcaaaagaatggttactcatccagggaatcacaggtgaaacttggggagaatgcacgtgggagacagctccccagcatattctctttccaacctggaagaacttgctactggtgcaggcatacct

SEQ ID NO: 687718 - DNA, 369 bp, Homo sapiens
ttctgttctccagcccgggattctggcgcggcaaaaaaatgtattcgccggacagcgaagcgtatctgaagaacccggcgttctgggtaaagatgaataacggctgggacgattacagtatcccgaaagaggtcgcccgggcggtcattgccatgcatgtgaagcgcggcgacagcatttacttcgtcaccggtcgtagtcagaccaaaacagaaaccgtctccagaaccctgcaggatgatttccagatcccggctgccaacatgaacccggtcatttttgcgggtgacaaagaagggcaaaacaccaaaacccagtggctggagaagaaaaacatcaaagtggtctatggtgattcggataacgact

SEQ ID NO: 687719 - DNA, 346 bp, Homo sapiens
ttccaccaagcctaatcgccacacaccaccaaagtcaggctatgctatagtacaagccactagcccgcctatcagaacctatgatttcctttccatcctggaaatctatcctgaaggaaataacttctcagtgttccatctgctattctactactcctcagggattattgaggccctctcccttacctacacatcaagctcgaggatttgcccccacccaggactggcaaattagctttactcaacatgcccgagtcaggaaactaaattacctattactgtaaatagacactttcaactgaataaatcaagacctttcctacggggtctgagaaggccaccgaac

SEQ ID NO: 687720 - DNA, 228 bp, Homo sapiens
agtcaggtgggcggatcatgaggtcaggagatcaataccatcctggctaaccatagtgaaaccccgtctcaatctaaaaatacaaaaaattaggtgtgcacctgtactcccagctacttagccttgccatatgcaattgcatatggctaggccaaggagttgtgttaggcagcggacatcgtgccgaaatagaataagtgcccctacgcttggccttgccatatgcaa

SEQ ID NO: 687721 - DNA, 211 bp, Homo sapiens
acggaggtgcagctggacagcacagaggctgtacagcactgaagaggtggacagcacaaagatggatgagggtccccgcatgcttggtccccttttctccgtcctggtcctgtgaagagaactgtactgacgtgcacggggaaccgtgcggaactagatcatggtggagcgcactgatttcgaggctttgtgttcatttcggccctaggcc

SEQ ID NO: 687722 - DNA, 506 bp, Homo sapiens
actagaggacttagtattgagtggcatgtgacatggaggttgcagtgagccgagatcgcacacctgcactccagcgcgggctacagagtgagactctgtctcaaaaaaaaaaaaatggcaaaataaaaacattttaaaaacttttgggctgggcagggtggctcacgcttgtaatcccagcacttggggaggccgaggcgggcggatcaccaggtcaggagatcgagaccatccgggttaacagggtgaaacccggtctctactaaaaacacaaaaattagctgggcgtggtggcaagcgcctataatcccagctactggggaggttgaggcaggagaatggcttgaacctgggaggtggaggttgcagtgagccgagatcgcacacctgcactccagcgcgggctacagagtgagactctgtctcaaacaaaaccaatcggcacatacaacttccaagaaccttcgggcctgggcagggggcccaggctggaatcccagcacttg

SEQ ID NO: 687723 - DNA, 191 bp, Homo sapiens
actttccaggggtagggcagtgtcaggcagagcatttcagcagggtctactttatgtagaagtctctcttgagatgtctttttttgggggggtggggggaaaggaggatgaattttactatttaaaaatttgaaaaactaacatagtccaaaatgcccgctttgtagattagaacactaagatctacaaag

SEQ ID NO: 687724 - DNA, 283 bp, Homo sapiens
gttacatcagccagcgacgagcagggttacctggcgattggtgatccccgcagagtgggtaacgggctgaatgagtcatgaggtcgagggaatggggtgtggaggggatacccctcctcccacagttttgaggcgtcaggctgctgaaaatgattgtcttttctgtttgggaggtaatgtacctgagctaggtagttccaaagctgcactcctggagcttttgccctcacagctggcgtggctttttggttaatactgtagcatgatctttggtagcctgcag

SEQ ID NO: 687725 - DNA, 387 bp, Homo sapiens
  misc_feature (207)..(207): n is a, c, g, or t
  misc_feature (250)..(250): n is a, c, g, or t
  misc_feature (298)..(298): n is a, c, g, or t
  misc_feature (320)..(320): n is a, c, g, or t
  misc_feature (325)..(325): n is a, c, g, or t
  misc_feature (354)..(354): n is a, c, g, or t
  misc_feature (370)..(370): n is a, c, g, or t
  misc_feature (381)..(381): n is a, c, g, or t
ctctttctaatgtgtagggcaaacgccaaaagattcacattttattcagattcaagtgagggatctttatctgtgcttagaagctgtttaaaatgatatcttatgttttgcaacacttgtccgattctacctttccaaaaacacttgaaatctattcttggccaccaccagcccagatctagggtaactccaaagaggaaactgggnccatcagcgtgagtgggcagtcagagttcattaaaacttgaangatatggcatttcaacggaatataggtctaggcatttaatcctgtgtngggactcctgttacaggatgcnggggnttccaggctcctggaaaccggagtcactntctttggggggttttnccgggggttgnaggggg
